United States Patent 7,534,875 (COMPOSITIONS FOR GLIOMA CLASSIFICATION) - sequence listing, part 2

SEQ ID NO: 38 - DNA, 181279 bp, Homo sapiens
gcttcgaaaacaacgcgctccatgtcccttagcccttagtcttctgcctcaagtgagcctcagctggaccaggtgcactgttccccagcacccatgccctacaagtcctggtgccacacccattacctgggacctaaggttgtgagggagatagccagcaaaacgctcaccctgggtggagggcccccatccatttccatctcatctttgtatttgtttgcactttaattctctatttttaatacactattttagaagttttgtatttgcagaaaattgagacgatagtaccgagagctctcacacgcccacaccaatgtcctcccagcatgaataccttcctctccttggcgcccttgtgacggatcaggaaccggcactgacccgttaccgggagcgtggcccacacttcattcactgccccagtgctccgcagctcatcctgcccagggatcccgtcgagggtcccactggccgtttcgtcctgtcgcctcctcaggttcctctgggccctgagcttctccgactctccttgtctctgaggaccatgatagctgtgtggatggctcaggagttttatagagtgcccctctactgggactgtctgctgtctttctcattagactggggttatgaatcattaggacgatccccggggtgaagtgcccatctcatcacatcccatcaagggtccacaccatcaacaggactcatcacagtggatgctgacatcgaccgcctggctgaggtcgtgtctgacagtttctcttcagctctatgttctcacagatattgacacagacttcggccacgctactgtggtcgcaggggtagtgacacagacttcaggcatgctctgtgcctcatggatactgacacagacttcaggcacgctcagtgcctcgtggatattgacacaggctttgggcacgctctgtgtctcatggatattgacagactttgggcacattctaaggtcttgtggatatttatgcagactttgggtaggctctatgtctcgtagatattgacacagacttcaggtacgctctatgtctcgtggatactgacgtagactttgggtacacactatggtcttgtggatatttatgtagactttgggtacgcgctatgtctcgtggatattgacgtagactttgggtacacgctatggtcttgtggatattgacgtagactttgggtacgcgctatgtctcgtggatactgacatagactttgggtacacgctatggtcttgtagatattgacgtagactttgggtacacgctatggtcttgtggatattgacgtagactctgggtacgcgctatgtctcgtggatactgacgcagagttcggctatgctctatcactacccatctttgttgctcgggttgttcaacgacacacagctgccactaggagcctttacagctactcttgggtccctgtgacttgcaccatctttgtgggttcctttgagcacctccttaggctctggcaccacaagatgctcaattcctcctatatactccctgctcggccctacgattcgccatttctcaagggagccctggttccctttgttggagaatagtgttagaaaccaagaaaccaggggccgggcacggtggcttacacctgtaatcccagcacttcaggaggccgaggggggtagaccatgaggtcaggagatcaagactaatcctggctaacacgatgaaaccccatctctacgaaaaatacaaaaaaattagccaggcacagtggcaggcgcctgtagtcccagctactggggaggctgaggcaggagaatggcatgaacccaggaggcggagcttgcagtgagccgagatctcgccactgcactccagcctgggcgacagagcgagactccgtctcaaaaaaaagaaaagaaaagaaactaagataccaagatttgctgtaatcccagcactttgagagtccaaggtgggcagactgcttgagttcaggagttcaagaccagcctgggcaatggcaaaaacccatctctcccaaaaaatatgaaaatcagccaggcatggtggcatgcatctgtagtctcagctactcccaacgctgaggtgggaggactacttgagcctgaaaggcagaggctgcagtgagccaagatcatgccactgcactccagcctggacgacagagtgagacttctcaaaaattaaaaaaattaaagagaccaagatttgggcaatggatgtgtaaactgctaccgggtagtattgtttctaggccgtcccatctggtagagcaaggaaatatttgtttatggttatttttcttatagctaacatgtactgtatttactataatggaaaaaaaacattttccttttgaaacatgcaaatgatccactgtccacagagacttcatatttccacctgggcctgagtgtcctaaaactaagagggctccacattggccatatggagagtgacctgaatctcaggaagtgaaaactgagtctgggtctcttttgttctccttctggaaacatctgtgcaattccagtgatgcagtttctgcacattacagacagtgattgagactagtctctttttgtaacaggttgatagaaaatggctgtcatttccatgcctgcttttccaaacctaagggcctagcattattgtgaactgaattgacacccagagacttcatctgctggggggacaaggaaggaattcagtgacgtctctatttgtcatcagaaactcaaatcgctgcttagcttcggcaggtctctgtctccttgtagtaccctgcacctgtctatatgaaccgtcttgttttgctgacagcaacattgtcttcttagaattaacagcctatgggggaatgttttatgctacaatatttaagtacttcccctccagaccatgcaagccagagaggtggagcacttcacaaggcctgatctgctcacacgggtccacaggttccttccggcacacagctggctggccacaccctctaacagggcccatggttcgacctccccaacagcttctaactcctccttctacagcagtttcttttcttgaagtgttgtgacttttcccaaaatccaacctgtctgtcttcaaagaaagtaacagacaacggccttgttgccctctgtttttctggatcacctgtgctcaagctctattagcatacaccaaaccagctttacattcacgcagtctttccacaaaaaccgattcgctctcgctctccctctccctctccctccccctctccctccccctccctctccctccccctctcctccccctccccctccctctccctccacagtctccctctccctctccctctctctccacggtctccctctgatgccgagcggaggctggactgtactgccgccatctcggctcactgcaacctccctgcctgattctcctgcctcagcctgctgagtgcctgggattgcaggcacgcgccgccacgcctgactggtttttgctggagtgcagtggcgtgatctcggctcgctacaacccccacctcccagccacctgccttggcctcccaaagtgctgagattgcagcctctgcccggccgccacctcgtctgggaagtgaggagcgtctctgcctggccgcccatcgtctgggatgtgaggagcccctctgcccggctgcccagcctgggaagtgaggagcgcctcttcccggccgccatcctgtctgggaagtgacgagcgtctctgaccggccgcccatcgtctgagatgtggggagtgcctctgccccgccgccccgtctgggatgtgaggagtgcctctgtccggccgcgaccccgtctgggaactgaggagtgtctctgcccagccgccaccctgtctgggaggtgaggagcgtctctgcccggccgcccggtctgagaagtgaggagcccctccgcccggcagccgccccctccgggaagtgaggagcgtctccgcccagcagccaccccatccgggaggtggggggcagcccccgcccggccagccgccccgtctgggagggaggtggtggatgcctctgcccggctgccccgtctgggaagtgaggatcttcccggccgccaccccgtctgggaggagtacccaacagctcattgagaatgggccatgatgatgatggtggttttgtcaaatagaaaagggggaaatgtggggaaaagaaagagagatcagattgttactgtgtctgtgtgcaaagaggtagacatgggagactccattttgttctgtactaagaaaaattcttctgccttgggatgctgttaatctataaccttacccccaaccctgtgctctctgaaacatgtgctgtgtccactcagggttaaatggattaagggcggtgcaagatgtactttgttaaacagatgcttgaaggcagcatactcgttaagagtcatcaccactccctaatctcaactacccagggacacaaacacacggaaggccgcagggtcctctgcctaggaaaaccagagacctttgttcacatgtttatctgctgaccttccctccactgttgtcctatgacccagccaaatccccctctccgagaaacacccaagaatgatcaataaatactaaaaaaaaaaaacaaaaaactgattcggctacggtaaagtagtaaacagaatctgcatgaatttttggagaagttagacttcattctaatacattattgctggaatgcaaagacatctgagagagagatcaagtgtcaacatggagggtgagcgcaacagggctggctctggaattacttagcatccggctgagaccccagagcccagcagagctgtgcctgaacgtttggaggcgcatcggccgcacacgccaagtcccaacgggcccccacctcccgcacaatgtagtacaggccacctagcttagcctgcagccacatcccctgatgagaccccacctcccgcagaagtacaggccacttagcttagcctgcagtgagtcctcaatgcagctgctttggctcacccggctgtcggctcagacgccgacccatttcaatcatcaggagaggagaagacacacagggccgccccaaggaccccgtcaccagctcaggccaggtcacagaatgggccggcggtgcagtggtaggtagataaaggccggggagcgtttgtgggagaagacggccagacgactggtcctgggagaagacagtgctaacggcagcactgatgttcaccgaaatcacaatcaggcagggatagggtgtcggttccaagcggacgtgtgtgaacacagaaaccatgggggccgctccttcccacaccactgagactgtccatccaggcgcccgaagacgactcctaaaccacctttgccagacgcaggtccagcaacccatcaagagcacagctcgggcaagcagcgaccgcacgcaccgtgccctcctcaccacacaaccacaggtgatgagcccctgcggagacgccgcgcccctggggagacgccgcaccacatcagtgcacaggaggcatctcacgttttgcggggcttgggagagagggacccatgacgagaggacccccgcccaaccacgtgtcgcgagagcagcatgaagccgcgcgccccctccaggcagagctgctgctaaaatgacaccctgtcggttacggttagcatcacttccatcagcaccacttctagtcagcttccttttgaaaactgcttcagggaagctgctccagaagcccatgcatgtgccctgccacagccgcagcctctttggggacactgctgtcgcgatggtttctgcagagccagcccggggtccccaccgtgcctgcctctccagtcactcagtcctttctcctggaaccgggtcaagtccctctgcgtgtctgaaccgggacaaggccctgcctgcttccatacctgaagctgggccccagggcaccttcccatccacatccgagaccaccttcttaacggccaacggccactcaaccccccacagccaagacttctacctgtcgctttccaagactgaacattttcagcttcgccattaaaaaatacacccagaaggccgggcatagtggctcatgcctgtaatcccagcactttgggaggccgagacgggcggatcacaaggtcaggagatcgagaccatcctggctaacgcagtaaaaccccgtctctactaaaaatataaaaaattagccgggtgtggtggcaggcgcctgtagtcccacctactccggaggcaggagaatggcgtgaacccggtgggtggagcttgcagtgcgccgagattgccccactgcactccagcctgggggatagagcgagactctgtctctaaaaaaaaaaaaaaaaaaaaaaaaatacacccagaaacaggtgtggccacaggtctgcgtgtgctggaacatgagtagaagccactgtcgcgcccaattccccagcacgagacaagctgagacaacctgcagccggtgacctgggagagctgggcacggacctcaggggccaggtgagcacggagctctggctccgaggtcagccgggatctcccaagtcacacagtccacactcgcaacaactctgtctgcttctggtattccaggagctcagctcccaagtggcaaatgaaaggacgctctggcctctgccagcatgctccacggcctcgcggtaacagtggggcgtgcagagaacagccctctcctggttatgcatggacgttatctcctgacctccaggcgcacaatgacaactgaggtcaaaacgcaggcaggaaggagggccccgtcctcagcaggactccgcccctcgctgcccatgtgtccatggaaacagaccactaggtgataaaccttccaccgtcgcgcccccaccctccccatccaaacaccatttccaaagagctgtgctggttccctgactctctaaaggaacgagaactccccctctccagaagctcccacgacaccggaagcacatactaaggactgagtctttgacacgtgaatgttgctgggtctaaggactgagtctttgacacgtgaatgctgctgggtctgctgtcccacacgctgcatctctttcgttaggatacaagtcatcatagtcaaagcactagctggacccagactgactcggaatttataaaacgtggttacgatactgaccaaagctgccggttcttcgtggcagcgcagagcctggagggtgtttaaagtcctcccaaggctactcagatgcatctcctgagggagcctgggacgggatctggttacaggaggaggaaggagggcaggtgtctgtgagttcctcttaatctacaggcaggtccagccccaaggtcaaggctctgagcactactgtccacttcatgaacccgagctcttcacatgtcaaactctggagccttgccatgcagaaccacggtcagaatgccttcatctgatcaaacactgtcaagcacgccactgtccaggcaccaggcacgcaagtggacagaagactggccctgtgagactctcttctccgggctgagagacaatggccaagtctgtaaccagcagggaggatggtgagcagaaggacaaggacacgcagggggatggaaactggggccgccctgctgagacgaggaccatgggggttctgcatagaggagacctggcctggcttgcatctctgcaggtcactccagctgctgcactgtggtgtgatcctgagggccccggggaggcgccaggtctggcaggagagtgcagtgcatggcagtgggcaggggtcaggcactctccaagccacctctacttgctcagtgaaatgtgaggtgagggtgggtggcgggtggcaggacctcctgggagcatggacggggcctgcgtgggagagaggcgtgtgcccacagtgtgtggggtcttctctggcctgggccgcgcagcagcacagcacagctgggtcatgccaagaggacagagcatggcgggtgagggtgtaatggcgccagagcaaggacgagcttcccccagccccaagctcaggtacgggccatgtaccaaagtttctatcagttcgtgcacactgccgcttcagccatggcgcagctgaccacctgcttaggctactgacttttttttacactccaaaccattcacaactcaaatctctcgctaattctgataaatctctcatgaatccaaacagacaagcttttcactgcaattccaaatgccacaggctcagagccaagagctactgaactaagtggattgagatcacccaccgtcagactgagggcgggtgcacgtggctgcagacagcagctgctgagaatgacacgcgactctgatgaaagcgatacagcttagccggtctggctgttcaccgtcctgctgcactctacgacacatctgctgggagaaagcactagaccggggcatcctgcctggctttcagccaagtcagcctgttctcagtgccctcccacatgccagaatatctagacaagcctgaccgatgccagccactactccagaaaatagggtgattttctctgtgcagaacaaaagatgaccaagaaaaaaatcgggtcattccgatcaactcggtacaatctctgaccaactgccattaaaaggctgaaatcctttattgccaaggcagcagaatgaacgtggatcagaatggagaaacagacctatgttcctgcaggcatgtgattttcaacaaaggttcctaaggtattcaatggagaataaaaagccttttcttttttcttttttttgagatgagtcttgctctattgcccaggctggaatgtagcagcacaatcttggctcactgcaacctccgcctcccgggttcaagtgattctcctatctcagcctcccgagtagctgggattacaggcacgccccaccacgcctggctaatttttgtatttttcagtagacatggggtttcaccatgttggccaggctgatctcgaactcctgacctcgagtgatccgcccgactcagcctcccaaagtgctgggattacaggcgtgagccactgtgctcggcctaaaaagcctttccaacagatgctgctgagacaagtgagtatctacatgggggaaacagcctcaacactcacctaatgctgctcttgagaattagtcccgggcagatcacagggctaactgtgaaaccatatcatttttagagaaaaataaaagaaaatctttgttactgaagctaaacaaggtcttcctgtatcacagaccgcaataatcacaaaagaaaaacgtaataaattagattttatcaaaaactcaaagcttctcatcaacaaacacttcggaaggtgaccagccaagccactactgggagggtatttgtaatccacacacctgaaaagaactggtgtccagaatgtcaccttctgcaactcactaacaaaaactacagcccattaaaaatagcagaagacatgaacacacacttcaggaaagacaagctcatgaaaagcactcaacaccagcagtcatgagagaaatgagaattaaaaccacgaggtaccacacatccaccagagcagctaaaaacagaaagactgacgccattggggctggtatgaacagggggcaactggaactccccaacatttccagcacaagtggaaccggccactgcttcgggaagagagctgaccattccttattaaataacacccacacccacacccaccccagggcccagcagctccactccagatatctatttacccaagagaaaccaacacacgcagccactcaaaagattattatggacgtgctcatagcagcttcagtcacagctgcttccaaaggctgtgtcttctgaagaacggaaacagcccaggtgtccaacgaaaaacagaaccacaaactgtgggacagtcatataatggaacacttcagcacgaagcagcaatgaacagaaacatgcaacacgtgggtctgaaaagctgagggaaagaagactggccccacacatctgggtgacttgtttagcagaagctccaggacaggcagatctattacggtgggaaaatcagagcagcgtcacctctgggcggaggggagggtgggcagcggggccgagtgggaagggcacggcaggatcagggtgtgagtcacacggtgcccgcacttgtaaaaatgtgtcccctcactgtgggtcaatgacgcataggaaattaccaccgactacaggcgcccgccaccacgcccggctaattttttgtatttttagtagagacggggtttcacagtgttagccaggatggtctcgatctcttgacctcgtgagccgcccgcctcggcctcccaaagtgctgggattacaggcgtgagccaccgcgcccagcctaagcatagcaaaatcttaatagcaggatctaggaggagtatacaggtgttccccgtaaaattctttcaaaagttagctgtggttgaaaattttcaaaatacaaaggattttttaaacccctacagtgagatactacttcatacctctcagattcacagaaatgtaaaggttggcagagtgtgaaatgggagtgaagcaacaggaacacttgagttccgaggacagagcctgtgccagccgcctctgtgaagcacacgccccacgagcagcaggcacatgtgaggagcacacactccacgagcagatgccagtacacgtgcagagcacacgccccaagagcaggaggctccggggtgggcgcgagaacattcctgtcagcactgttctcaggttaccaaagaaacaagcccgttaacaggagcgaggagaatttcattccacagagactactacacagtagtgagcgtccatggtgcaggaaggagaccctcagaacacagaatcgctcacactgcactgctgacaggggtgtggagaacagaacagggccctaacacggcaccaagttcacagaggagccgattaacactatctctatttctaattctatacaaagaactgtttatattcaaccaatgagtaatcccatgtgaaagcttcaatgttcatgaaactgaagagaccacagacagcagcgcctattttcccacgccgcaactcacccgtctccccaccccgcgcctcgcccgtctccccacgccgcgcctcgcccgtctccccacgccgcgcctcggcccgtctccccacgccgcgcctcgcccgtctccccacgccgcgcctcgcccgtctccccacgccgcgcctcgcccgtctccccacgccgcgcctcgcccgtctccccacgccgcgcctcgcccgtctccccacgccgcgcctcgcccgtctccccacgccgcgcctcgcccgtctccccacgccgcgcctcgcccgtctccccacgccgcgcctcgcccgtctccccaccccgcgcctcgcccgtctccccacgccgcgcctcgcccgtctccccacgccgcgcctcgcccgtctccccacgccgcgcctcgcccgtctccccacgccgcgcctcgcccgtctccccacgccgcgcctcgcccgtctccccacgccgcgcctcgcccgtctccccacgccgcgcctcgcccgtctccccaccccgcgcctcgcccgtctccccaccccgcgcctcgcctgtttcccggtccaacgccttgcctgtttccccaccccccgccttacctgtttcgagtagcccccatagacgacgatgccgccctggggagtgacggacatctggcagcctgatctgggtgtgggccccgtccctgacggggacagcttgctccatgtgaaggtgtccagattaaaggcatacacgtcgttgtagtagatgtaatccctggttagaagaacagcagctgtcagggtccgtaacattgggaaaagccctgacattaaaaactgaactgatttaaattaaaggtaaatttcctactgtttggggaaaaactcaaaccatttttctcctctgctcttacaccaacacaacaatcaacacagaaacgtggccgctttccctgcaacgagccagagacgccagtcaggtctcctcaaactcaatcttgacgcaatctacctggagacagggcaacattttcacctgtttaattcaagtttgaattgatatgaaaggaccacaagcacgtatgagtttgcatttgaaaaccggaaataatgctggcccacagaggcagaggaatttaatctgaaagccatactgcgttttcttacacagttaacacaatcagagacaattccattaggttattaggtgtgcaaccgtaagggcagcagtgaatggcgcctccaaagggatgatcagaacggaggtgtgagcagcctggcagcaagggtggtaaggccccacagtggactggaggggtgagcgaggggactgggcgctccagggaaactgaagaccacagaagccgaccctctgtgcccgaaatcacagcgcggcaaggaggccccgcagccttgccctgctcagtgcctgccggacccagcacgcagactgggctgaacagggaagtggcagctttgctggaggcatggggagactcggaggcgcacccagaaagtcctgtcctaatgtggaactttgacacaattatcgtgaaagcgtaaggggctgctctccagctactcaaaaaggagagccaaactcattttttaaggaaagcatggaagagcaagcagctctagcccaagtctcaagtgcccggttttctcctgtttgttcctgttttgtgtgaagcaggaaaagtcacagggcgtttacccagcaccagctgccacatctggtcttaagataaacagcctgggcacagtggctcacacctgcaatcccagcactttgggagtctcaggcaggtagatcacttgaggcgaggagttcaaaaacagcctggacaatatggtgaaaccttgtctctactaaaaacacaaaaaattagccaagcatgggggcgggtgcctataatcccagctactcaggaggctgaggcacgagaatagtttgaacctacgaggtggaggctacagtgagctgatcacgccactgcactccagcctgggcgatcgagtgagaatctgtctcaaaaaaagaagaaagaaaagataacctgaccttgctgactgcaactcagactgaccacatccttcgcaggacgatggctcttaatatagatagaatctgaggaatgtggaaatgtggaagcgtgtaatctttaaaagactgctacagaccactgtttttttcagatttcacgtcgcagatttttagtacaaagattctactttgcacgtaagataaatacagaatattttctctataaatgcagaatagagtttaaggaaaactcccaagttggtatttgaataattttaaacaagataacaacagctttgaaaaaagttctgattttaaaatggttgcaagttaaaacaaacatgaagcatgatttgatttataacctgtaagttcaaaggaggaaggggctgtacaatctcactgtcctacacatagtaggtaatgaattaatgctctgacaaacttatgtgtgcattctgacaattatttgttttaaaataaattttaagaatgaacataaggctaggcgcgggggctcaagcctataatcacagcactttgggaggccgaggcatgtggatcatgaggtcaggagttcgagaccagcctggcgaacatagtgaaaccccgtctctactaaaaatacaaaaattagctgggcatgcggctcacttcaacatccgcctccccagttcaagcgattctcttgtatcagcctcccgagtgcctgggattaaaggtgtgcaccaccacacctggctaattttttgtattttttagtagagatgagtttttgccatgttggccaggctggtctcaaacttctggcctcaagtgatccacccacctcagcctcccaaagtgctgagattacacatgtgagccactgtacccagccttaaatactttttagtttgaattacatttttaaatctttcccccttgaaaagtatttaagaatttggatcccttttccccccgaattcacaaaattaatgagactatatcagtgaagaaaatctgaaacccggctgggcgcggtggcttacgcctgtaatcccagcactctgggaggctgtacagacttatcacgatggatcaagaatcacgagagggtgcgactggactcaccatgtgacaaaggtgtgagtggcaccttcacatcaatcaattgccatgctggttcctgagggaccagtagagaaagagggcttcaaatgaggccccggagatacagacagccactgtctctgacaccacgatgccagcagagagccttcaaagatgaccttcaccagggttgcagagtctgcgacacttcactcagaacacaactgcacttatgacagaaacagggataaccagctcccctgtgtcttgcttttctggactgaactaagtaagctcaagaagataacgtgagcagataacaggcctaaaacaatgagagagcccgcagctcaccctgggcagccatgccagctgcacgaacacccacgtgacatcaaaagagaaccgcaggcctcttccggcatcgctgtggagagtgtgctatcactgctctcccggacaggagtgttttgaagtgattacagacccgtggctctcaaagtgaagtcccctggccagcaacgtcaacatcacctgggagcttgttaaaatgcagattcctgggcctcactccaggcctctgactcagagctgcgatcagcactctaaccagccctctagggtattctgaaccaggctaaggtttgagaatcccattttatttttttatttatttattttttcaaacgaagtctcgctttgtcacccaggctggagttcagtggcatgatctcaactcactgcaacctccatctcctgggttcaagcgattctcctgcctcagcctcctgagtagctgagattacaggcacctgccaccacgcctggccaatttttgtatttttagtagagacagcgtttcactatgttggccacgctggtttcgaactcttgagctcaagtgatccacccgcctcagcctcccaaagtgctgggattataggcgtgaggcaccatgcccagccaaaaccccattttagatagaactagccacatcatttgcaggacctggtgtaaaattaaaatgtggggtcccttgttcaacaatggttaagaatttcaataggaatacagcatgaagccagtgtgaggcccggtgtgaggccctttggagggcaaggccctgtgtggctgcccaaagctcatgaagctggatttgggaggatgggtgcgtctttcttgtgtattcagaatgctctttctataaaaagcccactccttaatgcttcaggagagaaagatttttccgttcttggtaccaaccgtgtactttcatggaagccaccaaacaggatcaattgtctcttccaggccaccatccgatgtccactccgacccgaaggaccgcctgttgatctaaaatgaaataaacaaaaagacactatcaacctgcttaatttctggttgttctaaagacgacaacaacaaacaaaatccaatttttacactgatttctgttttgtgagcacttactgctcacaaattaaataccatttaatctgatctatcaactaccaaaaccatcctgctaagagcccagctagctaagctcaaacctcaagaataaaacaggagaacatctccaagaccttggactgcataaagatttcctaggtagaacattataaactggactccgccaacataaaaaacttcaaaaatacaccattagaaaataaaaagacaagcaacagacagagaaatatcttgaaacacatgactgacaaatgacttgtatccagaatacatacagaattctttttttttttttttttttttttttttttttttttgagatggactctccctctgtctcccatgctggagttcagtggccagatctcggctcactgcaaccttcgcctccaaagttcaagcggttctcctgcctcagcctcctgagtagctggaattacaagcgtgcaccaccacacctggctgattttttgtatttctagtacagatggggtttcaccatgttggccaggctggtctcgaactcctgacctcaaacctcaagtgatctgcctgactcagactcccaaagtgctgagattacaggcatgagccactgtgcccggcccagaattctatcttaatagtaagataaatgacccaataaaaatataggcaaaagatttgatcagaaagttcgtaagatagaaaaatggggggaaaaaagatggaaaaaggccaatgaaaaaaggaaagatgcccaacatcacgagcggtcagggaaacatatgccaagtccacagtgacttcctaccacacatggctgggcacccgagatcaagacaacatcaagtgctggcgaggacatggggctgctggagccatggcaccggtgaaaacgtaacacagtgaaacaacggtgaaacataaacttagcgcacagcttagcaatctgacataagacatggactcaagagaaaggaaaacaccagtccacacagacggacatgcacaagtttatacacgctcttgtgtcaccaccagcagccgagctgtccctcagtgggtgaatgaacagcatgtggtgctccccacatgggggaggacttctcagaaacaaaaaggaattgtttactgatgcacacagcaatgtgaatgaatcttaaaaacatctcgctgaaggaaggcaggttctgctggactccatgcacacgagcgtcttaaaggtgagatccgtcttcggcccaggatagctgctcggggcaggagctgggaggggaccaactacagctctctggggtgacaagggcctacatcttgtctgtggtgctaattacataagtgtgcatatttcttttttttttttttttttgagacagcgtttcattcttgcccaggccggagtgcagtggtgcaatctcggctccctgcaacctccgcctccagggttcaagtgaatctcctgtctcagcctcccaagtacctgggattacaggtgcctgccaccacgaccagctaatttttgtatttttagtagagatggggtttcatcatattggtcaggctggtctcgaactcctgacctcaggtgatttgcctgcctcggcctcccaaagtgctgggattacaggcatgagccaccgcctctggtcaggtgtgtatatttcttaacactcatctaagtgtacatctaaaaggcatgcattttattgaattttattgtaattatgtctcaataaaactgatataaaaatacatggcaataaaaaaatacaaaaagcaaatttaaaaccttaaaaatacacacaaataatacaatcacacacaaataacacataaataactacaatcaacctccctagtaatcaaagaatttcaaataaagcagagataccattttattctatcaacttgacaaagatgtttaagaattagattctttaaaatactgcatgtcacgggacaatgctcgaaaaacagcacgtgaaaaggcaggtccaaagcaaatcctatcccagcttctacaggtaaaaaggcaggtgcaaagcaaatcctatcccagcttctacaggtgaaaaggcaggtgcaaagcaaatcctatcccagcttctacaggtgaaaaggcaggtgcaaagcaaatcctatcccagcttctataggtgaaaaggcaggtgcaaagcaaatcctatcccagcttctataggtgaaaaggcaggtgcaaagcaaatcctatcccagcttctataggtgaaaaggcaggtgcaaagcaaatcctatcccagcttctatcggtgaaaaggcaggtgcaaagcaaatcctatcccagcttttatcggtgaaaaggcaggtgcaaagcaaatcctatcccagcttctatcggtgaaaaggcaggtgcaaagcaaatcctatcccagcttctacaggtgaaaaggcaggtgcaaagcaaatcctaacccagcttctacatgggtggttctcagtggttttcttgtcttaatcgtttcctgcatctcccagcagtcctccagtgagcaggcgtgactttcacaaccagagagaggagcaacaaaacagacaggggtggtgaggaggcgctcgggcagcaggtgctcagaaagctcgcagaggtgcttacgccggccacagatgtgcagggcgcccaggcacagaggaggcggggcacacaggaatggctttgggctgcaacatcaggctgaacagggtgcgtgtgctgggactacccagggaatctcctagagccgcaggcaccagggcagggccttaaggagggttgctgggcacagtcactgcagccactccctgggatcctcactgatgacctgcctcgcctcctacttaggaatccactccctgggatcctcactgatgacctgcctcgcctcctacttaggaatccactccctgggatcctcactgatgacctgcctcgcctcctacttaggaatccactccctgggatcctcactgatgacctgcctctcctcctacttaggaatccactccctgggatcctcactgatgacctgcctcgcctcctacttaggaatccactccctgggatcctccgtggctttcacacccactctctgcctggccctcccacctctccacacaggtcacagcaactctgggctgcaaaggatggttacagcttcaatcacgcaagtcagtgcctatttagataatgcattcttcctccatttattttttgtgcatgttacacagctgtccccaaaacccacttacagggttttatgtaaaagcccagaaatgggcaggtaccctaaaaaacacaagagggccgggcgcggtggctcacgcctgtcatccccagcactttgagaggccaaggtgggcggatcacgaggtcaggagctcaagaccagcctcaccaacatggtgaaaccctgtctatactaaaaatacagtaattagcttggcgtcgtggaggcacctgtaatgccagctactcaggaggctgaggcaggagaattgcttgaacccaggaggtgggagctgcagtgagccgacactgcgccactgcactccagtctgggcgatagagcaagactccgtctcaagaaaaaaaaaacacaagacatcaagacatggaatctcaaacgtaaaaggaagcttgagtgatctaatccaagtttactgaagttcagagataattcaccacatcatcagggtgactgccaggagtcttcgcttgctccaagctggagcgaattcggttctcactgctcaaacgcgggatcccaccagcttctctcctctagcaccctccatcatatcagcacccctttcaatgtatcactgaaaatgacaaccacacccctccatggaatgtcaaccagaagcaatcagttcctttttctagacaccaattctattaatccaacccggagttggcatgagcctttggggtggcctcttcacatagggatacccagcaggatctcagctcactaagtttctttggagtcctgcaagctggcctcacttcacagttccacagactccacagcagctccatcccctccgggcttggcaccgcaggggacagcaccatccagcggacacactacacatgagagtcaattgagaagaaaaccccacacatgcggagcaagaaaagaacgcccctccccctcctggcaaatttcccgatgccccctcccactcctgacgaattgcctgacgcccctccccctcctgacgaattgcctgacgcccctccccctcctgacgaattgcccgacgccccctcccccccagacgaatttcctgatggattactttataagaacaatctgaggatcagaccttcattcaaaactaaaccagtgctgaaaccccgtctctactaaaaatacaaaaaaattagccaggcatggtggcgggcgcctgtagtcccagctactcaggaggctgaggcaggagaatggcgtgaacccgggaggcggagcttgcagtgagcagagatcgcaccactgcactccagcctgggcaacacagcgagactccgtctcaaaaaaaaaaaaaagaaaaaaaaaaaactaaaccagtgtgtctgcatccaagtccgcttcaaaaaatgacagaggagaaccgagcgctgccactgccgtccccaaccagcgagggaacacaggcctggggcctgctgcagccccatagatggggcgccccccgctgccctaactgcgctggggcggggcctcctttcactgcctgcatgggaaccccaccagagtctcatcctctggctgacacaacggactcaattaactttttgtggcagtagccaaatatcaccgttttctacctaaaaggggaaaattttctataaaaagattccacgtccctctttagaaaaataaagctactttaaaaagcccatttatatttgaaaccccaacaggcttctcaaaactgctgtcattcctaaatacgaagtcttaaaaaatccacatgtcctcctcagccagaggcctatggacagcacaaaatacaggggaatgtcgtggtggcggctgcctcgaggctcagcagctgcgtgcaggatggagctccaagcagggcaagctgccaggcagtgtcaccaccaggcccctcgactgggccgctgtggtgacatttacagaaaactctacatgcttagggtacagtcagaattaaacactctgcatgcaaacgcttctctgagttaagcactctgcatgcaaacgcttctctgagtgactttacagtctacaccttacaaaattatacaacatacagtcacgcactgcttaatgacagagacgggttctgggaaacaacacatcattaggcgaccttgtcattgtgctgtccgagtgcacgcacacacttctggaaggcacagcctgccacacgcctgcactgacgggagagcccaatgcttataggctacaaacctggacagcacagtactgtcccagacactctaagccactgtaacacaatggcaagtagatgtctcaacacacagaagggaagtaaaaacacagtctgatcatcttagcggaccaccagtatgtatggtccgtcgtgaacagaaacatcgtgaggcagcccgacagcaggaccactgctgcaccggcggcctagagacatctgctgagcaaaggagcaattcctgccggatccctgagagtctagtggctcatcctcagactagagagcccctgtctttcaaaagcagttacagcacagccagggagagccgtgtgcatgcacctcccctaccatttcaaacacatgccttggaaacttcgccctgcttttccgagtatcaagtccatcaaataacaaatgatagtgtaaagacagggcacttaatcacgttatgtggcatgattagtagccgtctccagaattcaggcaacttataaaccacacccttgtctcatcttaatgattactactcagagaaaaaccaccatttgtgtttattctatgccaggcacagtccttttatgtgcatttatcctcacagcaaactcgtggtgcagatattacctttattctcattttacagacaaggaaatcggccgggcgcggtggctcacgcctgtaatcccagtactttgggaggccgaggtgggtggatcacctgaggtcaggagttcgagaccagcctggccaacatggtaaaaccctgcctcttattaaaaatataacattagccaggcatggtggtaggcacctgtaatcccagctacttgggaggctgaggcaggagaattgcttgaactcaggaggcagaggctgcagtgacccgagatggcgcctttgtactccagcctgggcgacaaaaaaaaaaaaaaaaaaaaaaagataagaaaaccaagactaacaagtcaggatacccaggaaagcagtcagtggcacagccagaatttgaaccaaggtgttctggctgtcaacactgattaagacactaaatgacatcacatgaagttagaggcctcagcactgaaataaacctatggctcaaaaaccacttaccctaggccaggggcggtggctcacgcctgtaatcccagcactttgggaggccaaagcagccagatcacttgaagtcaggagttcaagaccagcctggccaacatggtgaaaccccgactctcctaaaaatacaaaaattagccgagcgtggtggtgcgcacctgtaatcccagctacttggaaagctgaggcaagagaatcacttgaactcaggaggcggaggttgccgtgagccgagatcacaccaccgcactccagctcaccttcccggtttctctacaaatcagtctttttttttttttttttgagacagtctcgctctgtcacccaggctggagcacaatggcacgatctcagctcactgctacctccacctcccgggttcaagcaattattccacctaagactcccgagtagctgcaattacaggtgcccaccatcatgcctggctaatatttttctgtatttctgtagagatggcgtttcaccatgttggtcaagatggtcttgaactcctgacctcaggtgatccgcctgcctcggcctcccaaagtgctgggattacaggtgtgaaccactgcgcccagcccagtctctctaagtacatgtgggtcccacctccgtcctatcagagatagaaactatcatccgtcagcaaacagcacaacggggaatccatacacaccccggccttccagcagggcaggttctgccttcatgagctactgctgtttgctgtcgatagaccccaggttactgtggagtcagagagcttcagaccatgcaacccaacccaccacccagagggcagagcagggtgtgtccattcctatggtgacctgtacttcacacctgagactctcagaggccagtcactgttagctaactcgttgcggtccttcactacagaatcgtaaagtaacggaatcatcctgccgaggagccttctccaggaaactgactttcactcagatgcagctttagctgaggaccaaatgaggacccttcctcacatcaggagaaaacagtgcgtatgcctgcgcacacacggacgtgcacacacacacacacacacacatctatatcttcatccaaccaaacagtaccgatcatctcccaagtgctccggtgcatacaaagatgtatgcactgtccgtgaactttcacagcaacactgcaagagcagaaaagtggaaacaacccaagtgcccaacagaaaaccaaaacgtggtccatccacacaccagcacctcatccacacaccagcacctcatccatccacacaccagcacctcatccatccacacagcacctcatccatccacacaccagcatctcatccatccacacaccagcatctcatccatccacacaccagcacctcatccatccacacaccagcacctcatccacccacacaccagcacctcatccatccacacaccagcacctcatccacacaccagcacctcatccatccacacaccagcacctcatccatccacacaccagcacctcatccacccacacaccagcacctcatccatccacacaccagcacctcatccacacaccagcacctcatccatccacacaccagcacctcatccacccacacaccagcacctcatccacccacacaccagcacctcatccatccacacaccagcacctcatccatccacacaccagcacctcatccatccacacaccagcacctcatccatccacacaccagcatctcatccatccacacaccagcacctcatccatccacacaccagcacctcatccatccacacaccagcacctcatccatccacacaccagcacctcatccatccacacaccagcacctcatccatccacacaccagcatctcatccacacaccagcacctcatccatccacacaccagcatctcatccacacaccagcacctcatccatccacacaccagcatctcatccatccacacaccagcacctcatccatccacacaccagcacctcatccatccacacaacagcatctcatccatccacacaccagcatctcatccatccacacaccagcacgtcatccatccacacaccagcacctcatccacacaccagcatctcatccatccacacaccagcacctcatccacacaacagcatctcatccatccacacaccagcacgtcatccatccacacaccagcacctcatccacacaccagcatctcatccatccacacaccagcacctcatccatccacacaccagcacgtcatccatccacacaccagcacgtcatccatccacacaccagcacgtcatccatccacacaccagcacgtcatacatccacacaccagcacctcatctggccacgggagtgaagtgctgatactcgcaacagcaggacacgtcctgacagcaccacgcggaaagaagagcccgtcacagaggccacgtgttttgattccgcttttatgaaatacccagaagaggcagatccacagacacagacagcagggaccggggacggtggggtgtctgctaaaaagacggtttttctttctgggggatgaaaatgcaccaactttagatcatggtgttggctgcgcaattctgtgaacatgctaaagaccaatgaatgacacattttaaagggtgatttgagggtatatgaatcacatctcagagaaagctgttatgaaacacctatcgggcggggtcctaaagtggagtcacagatcatccctcagagggcactggcccagaaaccaatggagggagacgaatctcccccaaccccctgcaccttctccaggggacaggaagagaaggtggcaagtgcctggagaaacgctggctgtgatgtgtggcaggcagacctaaccaaactctgaatcttcaaagccagcaagctcagccggcagggcaggcccaccgtgactgaggagggaaatgagagagctccagtgatcccacccgacatgtgtgcatcccgaggggaccaccggctccgctctgctccctatcccagaggcccagggctgagcagcacaacgggagattgacaagttgtgggggtggggagaggggaaaccctactttgggggttcccaggagcagccgcctcccctcctgctccagagcctaatgctgggaggatccaggccggactgggcaacagggcctctctcccgcccagcccagcggagggtggctcccaccttcctgggagctgcctgcacccccagctgtgacccatctccaccaggacacaccttcgtcaaaggaaaatgctctgcaaacaccagatgctggtgtttttagtgtttcacagtttccagtcactcttgccaataaccgcagacagactttcagtcaccagcatctgtttacatgcgagggaaaaggggagtcttacaaccccctcctcttcccagcccttcccacgccctccataattaacaccactgccctgagcacagctcctgctgttgcatctaactcccttcaaactcacatgagcgcacacacatttaaaacaaacacacagaaacaaaaataagaaacagtacggagatctatgctgcaaagtcgcaatggggcagctttgcaggcaactcccactcaagcaagagactgaagagatctcaaaatagctgctagcgctggccacacgcagccctccaacgaggcacggatgctcccgcacgtgagttttggtcttgaggtcagcattgccattacccccctcatttccaaaccattatgacgtcaagtatatgtgtctgttgctagaatggagaagatgagggactgttacaaagtatccacatgatgtcctgtctgttgctagaatggagaagacaatgagagactgttaaaaagtatccactagtcatccaatgtgctacaaaaacacccgccagccaaccaaccaacacatagcagaaggcagccagccagcgctggcctggacagaggcccaggcgccctgctgcctgccagttggaggtccatggcctgttaggaatcaggtcgcacagcaggaggtgagggggccagcaggcatcaaaggctgagccccacctcctgtcaaagcagcagcagcattagactctcacaggagtgagaaccctgttgtgggctgcacacaccatagatccaggttgcggaatctaggttgtgagctccttaggacaatctaatgcctgatgatctgaggtgcaacagtttcatcctgaaaccgtcatccctccccaccagcggtggaaaaactgtcttccgtgaaaccagtccctggtgccgaaaagggtggggaccattgctatacattaacacaactcaaatcagattatcagcatcccaaaatatgcatcgctgttaaaaatgaccagataacaggagggactctattctgccttcctacaagaaaacccttaaaagccaaggaagagactgactactccagatactgaatccagactccctgcgcctctaccaatatttaattcccgccaacttcacatcctcggctgaaaaaccaactcccccacagaagtaaaaaatattcactaaaaaatgaatgcgcagtgcagggctgcgtcatggtagcaacgcctattccgtttcctgatgagctcttcctggacttctcaaaagacataagcccaccccacagggattcccacgtgctctgcacgaggcctgacacagcaatcttccccagaaagggcaaaaaccgtctttgttgtggctgaatctcctgacctttccttttagatcaatttaaaaaaaaaaatgacagaggaaaaacagccagagtagtcctctctcagcagcggccacatagtgtgtgaacccccaagcccaattacaggcagcagcagcactgcaccaggatgccacacaccgcagcccagcccatgaaatcaacaggccgcctgcacccttcagtcccctgtaccatccccagctacactagcccctgacgatccggccacatagcactcagagcctgacctgccaaaccaccgttaagagaatgctttcattctgcaatcattagtaacttacaaaagcaaaacctacactactttcattattaaggatctaagaggtattttacatgaatattcttacttcttttaagcagcaactaaaaaacttcacatcagttgaacaatattcaaaataagcatgccttccaccagtcacagaggctgatggatcagatcacaactggaccccgtctatggtccacagctgtcaggatagggatcgtggagagggtacaaggagaggttagggtaaaacacagattcctcaaccacacatcaacctgctctgaatgggactgatgtccggagtgggagggcaggaaggagcagtctcctgggctccctagggtctacgtggagtacgaagacttgagaaccactactcaagatcctcttctctgccagcagacagctctgctggccactgtgccaggaaaaccccccactgttctctaagttcagaatcaaaacacggcccctccagacgagttgccctaacgccttcctatcagggaagggaagactcattctgcaaggcgccgcagctgtagtccagtgtctgccacaggtatgaagtgacgacgagcacggagaacacttgaggaaaactgtgaaacaggagcacctgcacaggcatcacgccaagagtcagccctccacacgccagcaccggcaccaactggaggcttttgggagaaccatcagacatgaggtcaaagactttataaatgtgtatgccttgcattctgatgtttcgttaagtcacagggcctcacttgtggcccaggttgcagtacagtgatgcaatcacagctcactgccaccttgaactcctgagctcaagtgatcctcccaccccagcctcccaagtagctgggattacacacacaccagcacacctagctaacttctttagagatggggtcttactatgttgtcccggctggtctcaaactcctgggctcaagtgatgctcccacctccgtttcctaaagtgctgggattacaggcatgagccactgcacccggcctggactctacaattctacttcaggccattttaaacttgactgaatattaaaaaaaataaacctggccaggcgccgtggctcatgcctgtaatctcagcactttgggaggccgaggtgggtggatcatgagggtcaggagatcgagaccatcctggctaacacagtgaaaccccgtctctacttaaaatacaaaatattagccaggcgtggtggcgggcgcctgtagtcccagctactcgggaggctgaggcaagataatggcgtgaacccaggaggcggagcttgcagtgagccgagatcaaaccactgcactccagcctgggagacagagcgcgacaccgcctcaaaaaaaataaaaataaaagtaaataaataaataaataaacctaacttcccagggtgtttagaggtcaggatttgacactcttaccaccatagcccaggtttaaattcttaaataaataaaaaaaccaaatggagacatacacaatgctcccgatggggaggaatgaggggtatgatgctgtcactgcctaaatgcgatttatcagcaaacgcaatccagtcaaaatccttctggacttttaacattagaatttgagggccaggcgtggtggctcatgcctgtaatcccagcaatttgggaggccgaggggggcagatcacttgaggtcaggagttcaagaccagcctggccaacacggtgaaaccctgtctctactaaaaatacaaaaattaaggctgggtacagtggctcatgcctgtaatcccagcactttgtgagaccgaggtggggggatcacctgaggtcaggagttcaagaccagcctgaccaacgtgaagaaaccccatctctactaaaagtacaaaattagccgggcatggtggcgggcatctgtaatccctgctactcaggaagctgaggcaggagaattgcttgaacctctgaggtggaggtggcagtgagccgagatcccgccactgcactccagcctgggcgacgagaatgagactccgtctccaaaaaaaaaaaaaaaaattagccaggcatgatggcagacacctgtaatcccagctactcgggacactgaggcacaagaatggcttgaaccagcgaggtggaggttgtagtgaaccaagattgtgctactgcactccagcctgggcaacagagctagactgtctcagaaaaaaaaaaaaaatagaatttgaaaaactgatggtaaagctcataaaaacaaaatacatgaaaaaagcaaagactttaagtaaatgagaaaaatcctccaacctatcaaaatataccataaagctacagtaattaaaatagcataaaaaatgataccaagaaaagatcaatgaatcagaaaaaacctcagaaacaatacagaccttctcccttctcctgtgcacgtacagtgtgcacgcaccaggttctccagatcactgcgtcagcacacacttgcaagtgcacacacacgagcacacacacgctcacacgcatgcagtcacacacatgcatacacaggcatagacaggcacatgcactcacatatgctcacacgtgcacacatgcaatcatctgcacacacgcggtgcacacacgtgtacacatgcaggcttttttccaagcatatgttgttctgcatcctgttttttgtatatatttttgtacgaaataagaggaagcatttctttagggtataatccttaaacttgggggtcaggggacacgcacatttaaaattccaatgagcaggtgccacccactgagcggtgggggcatgttctctccaccctcaccctacacccatattgcccagcactgctctcacaacacccgccctggggccggccatagggtgccctctgctccgccttctgctcttgcagcacccgccccggggccacctcttggtgcctctgcccagcccatactacccagcactgctctcgcagcacccgccccagggcccgccctgtggtgcctctgccccgccttctgctctgctgcagagggcaccacctcccggaacgtgagctccgcctgatgctgcaggtaccttctccccaccagtcaccatttttaactttccctgtggcatcatcttccacacaaagaccttcctgtttcatatgggcaaatccatccacctcttctggcttctgctgaatgtcttgctcagaaaaccttagctaagatgcgcttggagctggtacacaacagactgcagtcaactgtcaccgcaagagaagcgttcactcgcactgaaggtcttcaagacgacattggggcagggtgggagagggcaggctgaggccatggggacagtcaaggcgcctggtgtttatgagggcaagggctcagcaccccgagctgactacagggtgggagagaatgcggaaagggacacggacatcagctgtcaaagaacatctcctgcagaccatttgtcaccgctgtgcgtctcgtcagggtcttaacaactgaataaggctcaacattaggcatctcccaatcacaaatacattaagcagcagtaaccgaatcctgctgagcagtagaaatacagaaattaagcagctcagcctggcacagtggctcacacctataatcccagctactcaggaagctgaagtgggagaatctcttgaggccaagagttcaagaccaacctgggcaacatgacaagaccccatctctaaaaaaagaaaaaaaaatttaattagcccggcacggtggtgcacgcctgtaatcctggctactaggggggctgaggcaggaagaccacttgagcccaggagtttgaggctgcaataaggtgtgatcacaccactgtattccagcctgggcaacagagtaagactttgtctcttgaagaaggaagaaagaaagaaaggaaggagaaagagagagagagaaaagagacagagaggagaaaaagacaagaccacaaagagagaaagagagagagagcgagaaagagagaaagagacagagagagaaagagagtgagagaaagattaagcgcacaccctccattccctgacctccaaatccgtactcacaacaggctgtgtctccttatcagacgcacactccacacgaccttccaggaccaagggtgacctgcggaaccacaccctggctgccaaggcaaacgtctcaaagcaatgctccgcgaggtatctctgttcatcccccacacaggtctcccttgctaatggttacttaggccaaggagaaccagaaatcaccaccagagacagatgcctccacaaagggtgattctggcaaaaagaagagagtgaagcacataatgaccctgttcctgccccaccactccctctagagactggaactgggggccaagaatcgcaactacattgtatgtttgcaggatcactattaaaaaaagtctaatagcttctacaatatacctttaaaacaggtctcctgttttaattaccattagcaagcattcgaggaatgaggtgtctgtttatcagacaatccagacccagggcagctgccacggatgtcccgcgtacgaccgagcctgcagtgtgggatgcagctggagctgcacacgaggtaggggctgccatccgcagctgccggcccaagagaggggccagggccactcccaaagtgaccaggtacccacagtgcatccctattcccttggaacagatacccacgatccgagtgacagaaccagcaaagcctgaaggcacgagagagccctcatgtcacagacagctcagagtcaccacagagtcaccacagaggcaccggagccaacaccagcctggcgggacttgctgggttgggtgctgggttagccgcattctatcacagagacttcactctcctcacctgtcaattgtgaacaagagataccaaagctgacaaaatgctattaaaaaatcaatcgatttgccaaagataaacaagcaaatcagtaacaagcgggctccaaaaggaataaagcaaaaggacaactgtgtgctgagtggaaatacgtgagcttcaagatatacacaaagaaatccatttttagcatgaaagtaatttcccaattgctgcgcctactaaaattacgaacctttctcaaagcaagcatgagaaaagggacggaaaagcctgggaacacagtaacccaccccacaccacagcaccttccgggtcccactgtaaggctatggtcatgtcctcctccagcaggtgggcccagggcagggaatctgtctgcaccctccccacccacagcagactcttcatttgactggttaacattcccggcctagagccaggcagagcagtgcagccagcgaacaggactcaacaccctgacaaggctcactgcaatacagctggggaccaaactccagaaaacacccggaactggctcattgtgacataaccaagcccgggctccagggagcgccgctgccctccggctgaagccccaggatgtggagaaggcctgtgtgcggcggcctctatcccagaagcaagggcacttccgctctgctgctttaatggcagagagatggtgtgcgtaatggtgggtcatggccgcagcaatcgagccaggccacacatagaaggacactaacaactctacttcagtctgtcattcgactagacttcttctcttaaataatttatatgcaaacatgccatctggctctctacacggagagacaaacatgtagctcttgactaatgggagacacccgtgcgtggtaaacatgcatcagaaaccccatcagcaacattcccgacagaggtggaaatcaagaggctgagcagggttcactgaagagaaatgtcaacatccttcctgtctcataccagctccacggtttctacaccaactcgacacagaaagaacgtgccttttagtcaatgacacatcgctatggggccccccttccaacaagctgggcacccagagctgcctccaatgatgtaaacagaagaccacaggagaagagctgcaacacaggcagcgagaggctggtggccaacaacaagaggaacctggagaacaacaccaggcagctggcaccccccacacccggcccaggcttctgtatgaagggtccagagaaaatgtggtctcccaggacccagcgaggctgggctccaggactgtgacccaagttcctctgaaccctggtattctgaggtctgctccgagcactcgggctcagcacacaagcacagaagagccatgcccggagctcagcttctcatctggcttcttacttgacttgttcccaggtcttggtggccaaatgcaggacccagagatccttgtagtggtagaactgctctccgttgggagaggcaaactcccctccaaagacccacagctgtccgccaccttgaggcactaccaccgcctgtgaaaagaaaggtgacaggtcagggcacagccacacagcagaagggccagtgtcatgggtgaccggtagtggtgagcgcttcagtactatctcggatgccctgcaacatgaccagccccacactcagccactttcctctcctgcctctaaggggaggattccagacaaacaccctcgtaggaaagcacgtcctcagtcaagggtctaataaaccttcatgtatccctaggttgcaagataaacatccatttacatgtagacaatgccatatcccattaaagtggacacagctagttacttcaaacattaacaacggtgtggtgcaacctagcagtgttttccttttattaatatccacaataaagctgtctgcctgctctcgttaatccctctccttgctatcatgtgccaactaaattagcctcagaagtacaatgtgcacgtaaaagaaagtgtttatgtgccaggcgcggtggctcacacctgtaatcccagcacttcgggaggctgaggtggacagatcacgagatcaagaaatagagaccatcctggccaacatggtgaaaccccatctctactaaaaatacaaacattagccgggcatggtggcatgcacctgtagtcccagctgcttgggaggctaaggcagaagaatcgcttgaacctgggaggtggagggtgcagtgagccaagactgtgccattgcactccagcctggacgacagagcgagactccatgtcaaaaaaaaaaaaaaaaaagaaagaaagtgtttatgttttttccttttagagaccacgtcttgctctattgcccagactggagtgcggtggcgccatcatcactcactgcagcctcgacctcatggtttcaagtgaccctcccacttcagcctcctgagtagcttggacgacaggcatgtgacatcatgcccagctgtttaattttttgcagcaatggcgtctacgctgtccaggctggtctcaaactcctggctttagtcaattctcccgcctcggcctcccaaagcacactgggattacacacacgaaccaccacacccagccttacgtgacattatgaatgattaataaagactcagcaccacagtaaaggtgaaggagcgcagcgggagtgatgccctctgggccacacacggcaaagcactccggcagcaggggatgctgaggagagagcagaccaccaatcaaaaacaacggcatccctgacgggtcatcagacaccaccggctactccacatgaggccctccgtggcccactccctctcagggcccccaagaactgcgggaggcagagtctttaggggacggcacacatccatctgtggaaagagctgcttggacagactgctgggctacaagcaatggcagagaccaccaagctccacggggtctttcctccaaacctgcaaattaagcagtagctggggtccaggatgagaaaagcacgctcctaggcagtctgtgttagcaaccacgctggaggggcccctcagtgctgcatctccacaggtgagagccgcccaccctgcccagggtcacgcagcccagcttcgcctgactgtaacgcacctagtggcataattaagagagaaaaagcgacctgagcaacctggcagcaggtgaagccccatttcccagctcagccgtggtcattgcagagttggttctttcataaaagcctcttgttttatttcctctcgtttcaaggtaagagtgaggatctagcaggacgaagaatggttccacacagggcgcagagagggctggtaaatgagagtgccaacccgtctaaggtcaagtgcgcctcgggtggggcagacagtggtcctcagcaggctccctcccggcacctctgagtcggtgttccgcccgcccgcacatagaaacggccacagtgccgcccctctgcaccgatgcggttccttcctgggccagacagcgggcgcaggtggtagcagcacacagggggtggcgtgtccctctccaccccacccacttccagttgttctttgcatctgtcatctcagcacagaggacttacctgtaaagggacaggccaggtttcctatcattctaaaagcccagtagttccatagggagaaactgaccaatttacacctttacagcagacatgatgactggctcaaggccgaaacctaacaaatgttttgagtctagaggaagttaggtggcacaaccatgccacacagtaaatagagttttaaactatcatctcgggaagactattcaatgccacagaataatcctacaataatacatcaacggtaaaaaacactatagaaagaacacatacatgcacgctccagttagcgtgaaatagatgcatagaaatatgaactggctgggcgtggtggctcacgcctctaattccagtgctttgggaggccgagggaggtagatcatgaggtcaggagtttgagaccagcctgaccaacatggtgaaaccctgtctgtactaaaaatataaaaattagccagacgtggtggcatgcgcctgtaaacccagctacttgggaggctgaggcaggagaatcgcttgagcctgggaggcagaagttgcagtgagctgaggtcgcaccactgcactccagcccgggcaacagagcaagacttcatctcaaaaaaaaaagaaaaaaaaaatgaactttatgtgcagagaaaacatgcagaaaatacaaattcagtttagggagaatagacaatggacttgccttttaattcttttcatttttttcagaatgaatatttacaccttacataatcagtccctaaagccattcctggccaggtgcagtggctcatgcctgtaaccccaacactgtgggaggctcatgtgggaggattgcttgagcccagtactttgacaccagccttcacaacaagcaagaccctatttctaaaatataaaaaataaagccattcttaaaaaatgaagtcggccgggcacggtggctcacgcctgtaatcccagcactttgggaggccgaggcgggcggatcacgaggccaggagattaagaccatcctggctaacatggtgaaaccctatttctactaaaaatactaaaaaaattagccaggcacggtggcaggtgcctgtagtcccagctactcaggaagctgaggcaggagaatggcatgaacccgggaggcatgaacccgggaggcggaggttgcagtgagccgagatcgcgccactgcactccagcctgggcaacagagtgagactttgtctcaaaaaaaaaaaaaaaaaaaaaaaaagaagccaaatggccaggcacagtggctcacgcctgtaatcccagctctcagggaagcagaggcaggaggatcgtttgagcccaggagttcaacacttgcctgggcaatatagcgagacccgttctccacaaaaaagaaaaaaaaaaaagaccaaaaagaaaaaaatgaagtcaaactccaggcaagagtgtaatccacaatccgatccacagcactgttttttctttttttttttttttggagacagagtctcgctctgtcaccaggctggagtgcagtggcgtgatcttggctcactgcaacctccaacgcccctggttcaagcgattctcctgcctcagcctcctgagtagctgggattacaggcacgcgccacgacgcccaggtaatttttgtagttttagtagagacggggtttcaccatgttggccaggatggtctcgatctcctgaccttgtgattcgcccatcccggcctcccaaagtgctgggattacaggcatgagccaccatgcccagcccacagcactgtttcaacatcctttcctccatcttagttacaatcccaggcttgacccagtccgacccagaggaccacccaaaggcaggctgatcagcagtctaagagcttcgtatagcctacgccccaaagataatgaacaccagggaaaaaaataaatatgactcaagggaagattaaaactacggagacccacagataaaacttctactcctgcccacgatggagcaacctgtaccacgttagctccgcaccatcaacaaggaaaaaaccagacgaaatctaggaagcaacaacctccagacaacaggaagcgggaagtgcaggactgtgaacctgagagccaggaaacacgccacgcagccctgacccatgactccagcccctgcaggcagctccttccctggagcagggacaaggggcacaggcagggcaggtggtcttgcatagctgaggagacaaggactggagttcagggacgcagaggcagctaaaagtggcagggcagagcactggagagaggaagctatgggagaaaaagccctggaaatctgcacgggggcgtcccctggagtctctgtacactaaactgcaccctgggagggtgagaccaaggaaccaccactgtgaagacaaaagcatcttctgatgctgagaactatcagagcttacacagggcttggaaacaggcaagttccaaccagacgaggtgaaaagatgtcactgaccacacaggtcattcactagagactgcagaaaggccaccactgagggctaagccagccctagagagagcgtcaaagatcaagatgatctgcaaggaactgaatcacctcaggacaaaatgcaacactgtttgataggtgaaaaaatccagacactcaggctgggagcagtggctcacgcctgtaatctcagcactttgggaggccgaggtgggtggatcacttgaggtcaggagttcgaaaccagcctggccaacatggtgaaaccccgtctctactgaaaatacaaaaaattacctaggcgtggtggcacacgcctataatcccagctacttgggaggctaaggcaggagaatctcttgaactcaggaagcggaggttgcagtgagccaagatcgcgccactgcactccagcctgggcaacaagagagagactccatctcaaggagaaaaaaaaaaaaaaaattagccaagcgtggtggcgggtacctgtaatcccagctactcagcgggctgaagcaggagaatcgcttgaacccggcaggcggaggttgtagtgagatgagatcacaccattgtactcttacctgggtgacagcaagacaccatctcaaaaaaaaaaaaaaaaaaaagtagccggacgtggtggcatgtgcctgtaatcccagctactggggaggctgaggcaggagaatcccttgaacccaggaggcggaaattgcagtgagctgatataatgccactgcactccaggctgggagacagagcaagactccctctcaaaaaaaataaaataaagattcaaatgtagaaggcaccttagccacctaatacaatcccagtcaggtgtggtgaggggtgcctgtaatcccagttactcaggaggctggggcaggagaatcacttcaacctggggggcagaggttgcaatgagccgaaatcaggccattgcactccagcctgggtgacagagcaagactccatctcaacaacaacaacaacaaatacaagcgtatacaaatctgatttttaaaccagcccaaatgcctgcaagcctgcatctgcacgggatgttcacacagctcaggcaggcaggtcctcctcaccaaaccaacttcattagcaggtgagttctaagcacacaatcagcaaagggggaaggaaatattgcacaggaatgcatgtatcatgctgtggtcacctgatgcgttgatctttctctgcactggagaggcaggcactcattcaaattttctgtgcgagtctaactgtcacagagttgaacaatggacaaggacagagttcccatcctcacagagcttacagaacgtctaactccggaagccccttccctgacaggagagcgacagctgacactgctctcctgggtaggaaaccagctaaccacgtgctaagtcagtgccacttctctgtgatccggttaccactcgtttccgctaatacaattgttttccttccaccatgcacacctttcctgaacatccagttctcctgtcttcaccatctagtccagaccgtgggcctagggggagtgagcattctgccagtggctgcgacacaccaggaacgacacgagctattttacatggaatatttcatgtgatcctcatgccacctggggagcaggtgttctcctccccgtctcacagtgaagaagctgagtaaggaatccaagtgagcaaacagcagaaccaggcgatctacagggcccagcccctccgcaccagctgcctgtcacctatcaactctccgtgtgtctaccagactcccacgtgggaagagggagggtggctgagagtcagtgctgacattacctggtgagcacagcgcctcggaggtggactggggatgtcaactttggtccaggtgtcctttctggtattgtagacatagagctcgttatacaaaaaagtctacaggaaggaagaagaatgtcagtgtcacaaatgatacgcttccaaggaagtggtgagaacaatcttaatcatgacaattccctgggaaactgacatgctaaaggaatgtaaaccataccagcacagggaggccatgggctgggtccccggggccattggggatgacgacacaatgaaaacgaccgaacgcccaccaggcccatcaatctggaaggtactgaaagccctcgttgttattaggactggtcattctcctaattccagcctagtttttttgtttttgttttgtttgagatgaagtctcgctgttgcccacaatggagtgcaatggcgcaatctttgctcactgcaacctccgcctcccaggtgcaagtgattctctgcctcagcctccaagtagctaggactacaggcgcccgccaccacaccccgctaatttttgtatcgttagcagagactgggtttcaccacattggccagactgctctcaaactcctgacctcaggtgatctgcccacctcggcctcccaaagtgctgggattacaggcatgagccactgtacccagtcaagcctagtttctaaatgcacgaaaactgagagacgaagatggacaaatgcagtcaaacccccaaggcccatcccgggctgcagggaaggtgagctcctgcttttgtgtgtcacacacaattgtgaaacacaggtcttactggcctgctcaaaaataaaaattagccctaaaatttatcagcactttccgtgtttaagacaacctgaaagctgagtgtgaaacctggaaacccgctgggaggaagaacagcacagacaaccacaaagaggggtgcgcccgccaagagtgatgacggcagagctgggcctcagcctaagtcccaggaatagagaccccaggaccactgaagtcatcaacagtcatgccagggcctggagcatcctggcgacgtctcacatcaggcctgacggctcaagcgcgtgatacaaggggtgaaggggctaacgcatatttgatgtcactgccttaagttaactttctgtcaaatgatactcacgcaacatgggaagaaaagaaaaaaatatatactttactttttggccgttgaaatattcacctccaaaaaggattaactcatctttctcaggatgaaccgagagggaggcatttaacctacaagacacacaagcggcaggtcagcaagatcacccccgatacccacctgagcgctgtccccttcctcacagaatcctctgtcaccacaaactggctgcctctacacttcctgaaaggagagcctggcatcgagaaaggaagcaaaggtgccacttgaacaccaacccctctaccagtgcccagggccacactccaaggacaaccatggagctggactgacacagtgtctggttgtattaacaaaaaaaaaaaaaaaaaaaaaattccccaggcaggaataagtccagatgcccctactgatgtatcaaatgttccagaactgtttttttgatttgttttttttcatttttgagatggagtttccctcttgtcacccaggctggagtgcaatggcacaatctcagctcaccacaacctccaactcctgggttcaagcaattctcctgcctcagccctccgagtggctgggattgcaggtgcccaccaccacacccagctagtttttgtattttttagtagagatggggtttcactgcattggccaggctggtctcaaactccggacctcaagtgatctgcccacctcggcctcccacagtgctgggattacaggtgtgagccaccgtgcctggacctcagaactgtcctcttttaagagcctatcctgtcaaatcacctcaaaaccattctaaaaagtccagtaactaggccaggagcagtggctcctgcctgtaatcccagcactttgggaggccgaggcaggcagatcacgaggtgaagagatcgagaccatcctagccaacatggcgaaaccccgtctcaactaaaaatagaaaaattagctgggcatggtggtgcgtgcctatggtcccagctactcgggaggctgaggcaggagaaccacttgaacctgggagttgggggttgcagtgagctgagatcatgccattgcactccagcctggcgacagagcaagattccatctgaaaaaaaaaaaaaaaagtccatatgtaagtacttcaatatacatgccagatatcttccatctagaaaatacaaacaactttctatttatttcacatgagaacaaaagaagagctacaaggaaattacataataatattatgggccaggcccggtggctcacacttgtaatcccagcactttgggaggctgaggcgggcagatcacctgaggtgaggagttcaagaccagcctggcaaacacggtgaaaccccccgtctctactaaaaatacaaaaagtagccaggcatggtggtgggcacctgtaatcccagctactcaggaggctgaggcaggaggatcacttgaacccgggaggcagaggctgcagtgagccaggattgcatcattgcactccatcctgggagacagagcaagactgtcttaaaaaaacaaaaaataaataaataaatacatagggccacttcagttgaaagtaatgaaagacacagtgactatctggcgaatcactgggaaagatcctcccttcagagtcctctaagacggcgttccccaaggcgtgctccataatgccaactccaaaagatgtttctcaaaggaaaaacaggtttcaaggtcaagtgagtttgggaaatctgagaactctattttctattggggatttatttgcatagaaacatgtcataggctgggaatttctgcaggaaagaaaccagtattaaaagctaaacacagaatcaccacataatccagcagttcgttcccaggcattagctcaaacagatacctgtatgcaatgctcgttacggcctcacaaaagccaaacagtagaaataacctaagtgttggtctgcagatgagtggacaaacacaatgtggcatacccacagacggaacaggatttagccataagaagaaataaagttctcacacatgccacagaactgatgaacttggacataccaggtgaaggaagtcagtcacaaaaagacacttctatgactccacttacgcaaaatacctagaataggccaattcacagtgacagaaagttgaccagaagtcaccagggggctgggggaggggaaacagggagcaaccattgaagggtctagacacttctcccatcttttggcttccctgggctacaatggaagaagaattgtctcgggccacgcataaaatacactaacactaacaatagctgatgagctttaaaaaaaaatctcatcatgttttaagaaagtttacaaatacgtgtcacgctgcattcgaagctgtcctgggccaccagttagacaaggttggtctagagtttctatttggggtgataaaacaatgttgcaactggttagtgctaatggttgcacagcgacatgaagtaattccactgaactgcacagttttaatgattaaaatggcaaattttggccaggcgcattggctcatgcctgtaatcccagcactttcggaggccgaggcgggcggatcacctgaggtggggagttcgagaccagtctggccagcatgaggaaaccccatctctactaaaaatacaaaattagccaggcatggtggcgcatgcctgtaatcccagctacttgggaggctgaggaagaattgcttgaacctgggaggtggaggttgcggtgagccgatatcataccattgcactccagcctgggcaacaagagcaaaactctgtctcaaaaaaaccaaaaccaaacaaaaataaaataaaatggcaaattttgttaaacattttaccacaataaaaaaaactttttaggtcgggtgcagtggctcacacctgtaatcacagcattttgggaggccaaggcagttggatcatctgaggtcaggaatttgaggccagcctgactccagaggttgcagtgagctgagatcgcgccatagcactccagcctgggcaacaaaagcaaaactccgtctcagaaaagaaaaaaagaaaaaaaaaaactttttaaaaataataaataggccgggtacagtggctcacgcctgtaatcccagcactttgggaggccgaggtgggtggatcacctaaggtcgggagttcaagaccagcctgaccaacacggagaaactccgtctctactaaaaatacaaaattagccgggcgtggtggtgcatgcctattgtcccagctactccggaggctgaggcaggagaatcacttgaacctaggaggctacagtgagccgagatcgtgccattgcactccagcctgggcaacaagagctacactccgtctcagaaaaaaaaataaagagtgtttcccaaattcctctgaccctgaatcttttctcactgaatacctattgattttctgcagaaaagcaccaaacacaacttcagaaacgatctacacggggcccaaactgaggtccccacccagccaccagcggcaccagcccaggtgttgccgccgcacaggcaggtgaggtactgaggcagctggtgtcatgcccccattttccaggtaggtcacatcagagccaatcctgacgatatgctcatttagaaactggtcattctcacaaggttttaaagtaatatgattaagaaataggaagttggaagatattaaggttaccaagcaaaagatcttaatctcaggataactgctccctcctattaggaagcatttccagctgacccagggaactgccaacaccttaaattatatcctgacatgaaatctgactttcaggcaacattacttatggaaaaattctaaaatatcattaaaaaaaaaaaaaaagaaaaaggccaggtacggtgacttgagcccaggaactcgagaccagcctggacaacataaaaaaaagtctctacagggccgggcacggtggctcacgcctgtaatcctagcactctgggaggctgaggcgggcggatcacgaggtcagaagatcaagaccatcctggccaacatggtgaaaccccgtctctactaaaaacacaaaaaattagccaggcttggtggcgggtgcctgtagtcccagctacttggcaggctgaggcaggagaatggcgtgaacccgggaggcagagcttgcagtgaaccaagatggcgccactgtactccagcctgggtgacagagtgagactccgtcccaaaaaaaaaaaaaaaaaaaagtctctacaaaaaaaataaaactaatccccattcaaagtggctttcctcaggagtgctatatatcagaagcctaagatcaaggatttatttgctccaataactcaaatgaaaatgtacatttacagccaggcacagcgactcacgcctgtaatcccagcactttgggaggccaaggcaggtggattacctaaggtcaggagttcacgaccagccaggccaacatggcaaaaccccatctctactaaaaatacaaaaattagctgggtatggtggctggcgcctgtaatcccagctacttggaaggctgaggcaggagaatcacttgaacctgggaggcagaggttgtagtgagccaagatcatgccactgtactccagcctggatgacagagtgagactccatctcaaaaagaaaaaaaaaagtacatttaccacatgtaacttacatttggccctgagggcaacatgcaaactaaagggaaaaagaaaactaaaatcctaatggacatgaagtgaaaaccaggaaggacactggcctttgggagtggctccaacaccactcactctgctcaggggctgatcaccgtgctcctcccacctctgggcaggtgatgataaccctgcctctgaggccggtgggtgggactcgggcaccagagccatcacatgcgcctcattaatgcaaacgcagcacaatcgtgaccctccactcccgatgggctgaaccccggcttccactagggcctgcagcagctttattaaaagggtaaatcctgcaaggttaatctcctactgagggaaataaaccatttctcattccagctcatcccacacgtgtatgaaatcctacagactcggaacgtttttacgtaattttcaaatccatttaaaatggcttatactcaatttatgtttaacaaacttttcacatgagaatttgaaagcattacaaacacatcaaaaggccacagtgattttcagctttctgcctacagtacgcacttttaaaataccttaagaaccaaagaaaagctcactggggcaaaactttcatccccacgtcacgaccagtggaggagctttcaaagttggcaccggagcccagaggcagcagctgtgctgtaggccctgctcccaggttccatgacagtaaagcttacagcctcattccagttcttcagcagaaagtgaccaagaacaggttttaataatgaaaatgtcccaagtgcctggtcatttacgaaacctggtgctatttaaagcagtttttcaatgtatagaagaaaaggaaacatacaatatgaaaaatgctacttgctcaccttggtgagggtggggggcacggaagttccacagtctgagtcctcttggcatcgagtgtctggaaatgggctatgagcgcttccaggtcttcctagggcaagcaagcaggcacacgtgagacttattcccaggacccgccgcggagccacagcccgctcagctttcctccaatcagtgtgattcgactgggctcagtcacatctgtgaattgcaacatactgtgcctgtttgaaatgcagagtttgacacattcgaaagtaaccagagcttgacctcaaaggcagtctgcttaaagggtagatgtgtgcaccaagtattatctccacacccttaacgctccctctgcaagaccttccacttagacaagcccgttgtgacttcactgcagacactctcagcacctctcataacccagactcgagccgtcgcacctgccagccttcctgtctgcagagcagtgtctgacaagaacttccacttagacaagcccatcgtgacttcactgcagacaccctcagcacctctcagagcccaggcctgggccgtcacgcctgcctgccttcctgtctgctgagcagtgtctgatatatttctcttgcttatttgtttcctccaccccaacaaaataataaaatatgagctccaccagagcaagacttgtgtctagttaaaacactgcctgcacagcaagagctcagcaaataccagctgcagtctatccaagtaagaaggtctcaacttttactaccatcgagagtgactcaaggtactgatgtgccagcacagagggcagcactggaacccagtgttcccgcctcagtcccagtgcccatttcccaacatttacgagacactcccatgcacacccgagcctggcatttcaagttccttctagccttcagtgtcctgcttgcaactacacacacctgcagaccatcttccctcccccacacccacctctccaacctcacctcccacctggcctcactctccaagatacaccagcgtcctctccgttccttcaatgaaaacgccaggttccctcagcctgccacgccccacctcgtgcttccttcagtctacctctcatctcagggtgaatgtcagcagggtacactgcttagtattctaaacgatgcaatatttaaaacacacaagttaacagaactttatccaagacattcctgtatacggttcccagggtaaggaataaagtgtcacccacatgtacccacccacacattccctcaagtaaccactatctggaactcgatgcttattagtctcacgcttttcttcaatcttttattacacatgtgtatccctaagcaacatatagtattgttttacatttttaaatgtcattaaatggactgggcacagtggctcacgcctgtaatccccgaactttgggaggccgaggcaggtggataatttgaggtcaggagttcgagaccagcctgaccaacacggtgaaaccccgtctctactaaaaaatacaaaaattagccggccacagtggcgcacacctgtagtcccaaactactcgggaggctgaggcaggagaattgcttgagcctgggaggcagaggttgcaatgagctgagatcatgccactgcgacacttgctctgggtgacagagcaggactccatctcaaaaaaaataaaaaataaaatgtcattaaatggtatcatactgtatattctttcaacttgctttttttgctcaacgaggttaaacaaacagttcaaatactaacgtctatgtaccgcgaaagctttgctgctgctacttagagcggtctttgaccttggctgaacctcatcatcattgggtgactgaaggagagcaaggtggtagggtctgggtgacgccagtggcctagccagtgacagcctctccaaagtgacaataagctgaatgctgaaaagacgactcagacggagtatggttggggtataggtaagaccacagacacaacttgccatgtttgagacactaaaagacactgtggctggagtgagcccagggagacagctggaaagacaggcagaggccaggactaagtgaaggtgcgaaccaggtgacctgatacatgagttctgtgggagcagaattccaaactgtccccaatccttcccccaataattgccaggactgtgaaagaatgggataccactcttgtgattaggttgtattacagacacagctgaatttaagaaagagatgatcctctgtgggtctagcctaatcagacgcccacttattttaaaagtttgttttgagggttcattcagataacatacaaaccccaggcctgacaggctctctctcttaagggaagctactgttacaatcaccttagtattgggtactggagggagacatggagatgagtaaaaatgacaggtaactggcggggcaaggtggcttacggcttgtaatcccagcactttgggaggccgaggcgagcgcatcacctgaggtcaggagtcccagaccagcctgaccaaaacggtgaaacccggtctctattaaaaatacaaaattagctgggtgtggtggtgcatgcctgtaatctcagctacttgggaggctgaggcaggagaaccacttgaacctgggaggcggaggtgcagtgagctgagatcgcaccattgcactccaccctgggcaacaagagtgaaactccttcaaaaaaaaaaaaaaaaaaaaaaaaaaaaagcagaaagcagctaacagctggttactgagtgcttactttctgccaagcaccattctgaagataccacacagatgaactgacttcctgtgccacaaccctagccagcaggtcatgccactgcagcccagcctaggtgacagagcaagactctgtcaaaaaaaaaaaaaaaaaaaagaaagagcctaagaggagtgtgagggaaaagtccaactccattatttaagagatgaggacatggagagatcaatgacttaggaagaaaagggacaaaggactgtggtcaagagctcctgattcaggacatctggtcacatcccagttccataccacttcatggttcacctgttggtcttcctgtcaaatgggaataccagtgctacggaactgacctgctcgtgaggagtaaagcccagggagctgtgcctggcgcacggcaggccataaaactggccccggttagggaatccatgagcagcagccgcagaacactcaaccccaaggtcaggacggatcctcctgcagaccccgggctgaggaccagagggaaggagacaaccgtgatggccgccatcagctgctacgggataccccgtggctccagtgccttcttcacttaaccatctgctgctcactgctcagggctgctgtgatgattatttgccctcttttgaaagaaaagtaaggttcagaaaagttaagagtcttactcccagaccacacatcatgcagaggcagcccccggctcaacctcaggtcttcctgtgccaaacccctccctcttctcaccacccagcctcccttcagagggagggtggagggagaagggaggagggggaggaaacgcagaaaaacgcccgtgacaccacactaagaaaagcaagcacgttaaagggggcagctccgagaagcggacagacacacgtggagactcaggagggggcgggccccgtctgggctgcccggacgcggcgccggggcagttcctacggcctccagctctcccgcagggccggcgcggctcccacggccgacccgtaaccccggggggcgcagggagtcggccgaggctgcacggccgcgacgtcgggccgctaagcccggtctgacccgctcacctcctccttccgcgagcgcttagacaccttcttctccatcttggcggccgtcttctccgcgccgcggcccttcttctccttcttgcccttcttgcccatcttgccgggtcccaagccgcgacgggacaccaggaaagaaaacggcccgcgctctccgctcggaaacaggtgctcgtggggcggagctcggcgcacagaaatggagtcacttccggccccgagttcgagccgcttccgggtagaggtgcggctgggccctttacgaggttcggtcttggagctccgtcttcggcagcgggctcgggggcctcggactctgcataaggccccggaaaagatgaccggccccgggctgggcgcggtggctcatgcctgtaaccctggagctttgggaggccttggcgggcggatcgcttgagtccaggagttcgagatcagcctgggcaacaaagcgagacaccaccccccacccccagtcgctacagaagaaaaaaaaaaaaattaaccgggcgtggtgtctcgcgcccagtggtcctagctcctcgggaaggtgaggcgggaagatcgcttgagtcaaggagttccaggcagcaatgcgcccctgcaccccaacctgggcgacagagcgagatcctgtttcaaaaaacaaaaaagatggcagccccggcctgacataccccggccatgctcgccaattctcacgccctgtgcccccacctagcctgtccccgtgtcctaggagacgtgccctctgagttttattttttatttctatttttttgaggcagggtcttgctctgtcgcccaggctggagtgcggtagcgcgatctcggctcgctgtaacctccgcctctggagtagctgggaccacaggagcccaccacgcccggctcattttctcttgagttttccggggtgcacgtgccccccgttaaggcacattgcttcgccctgggtagaactaagtgggcgactcttgggctagccccattttttcccctcagaccaaacaaatgagtgcttttttcccagaaaaaaaatttcacacagttataagattttgcagatcctgagtaagacagtccctgccgggcgcggtggctcacgcctgtaatcccagcactttgggaggccgaggtgagtggatcacgaggtcaggagttcgagaccagcctagccaacatggtgaaacccccgtctctactaaaactacaaaaattagccaggcgtggtggtgggcacctgtaatcccagctacttgggaggctgaggcaggagaattgcttgaacccagggggcagaggttgcaatgagctgagatcaagccacttcactccagcttgggcaaaagagcaaaattccatcttaaaaaaaaaaaaaaatgggggggcccttccaccttcccatttaaaatgtgccagacactgttaggtactaagggcatgtcctcaaatgtcctaacatggaggacttttgtttcttcataggtaggctagagctaatgatagcaccctgaaagggtactcaatttgtggagcctgagaaataaagataggtaatatccaaatgcctgctaggaaattgtactctaggatttgcctcaaattacgtaagaaatggcaaaatcatctgcagtgcatggaatgttatgatttgaaagagcagagtaaaaatgcttatcactacttagaagatgtcatctttggatgggtaatcaaggaataaggcaaattaaggacaaggacaagccaaaatttggcaaagggaaagcataaatcaggaaataatctagtttattactttgtgtgtgagtcagcctttaaaagttctcttaggccaggcgtggtggttcattcctgtaatcccagcactttgggaggctgaagcgggctgatcacgaggtcaggagttcaagaccagcctggccaatatggtgaaaccctgtctccactaaaaatacaaaaaaaaaaaaaaaaattagccaggtgtggtggcacccacctgtagtcccaactattcaggaggctgaggcaaaagaatcatttgaacctaggcggcagaggttgcagtgagcggagattgcaccactgcactccagcctgggcgacaaagcaagactccatctcaaaaaaaaaaaaaaaaaaagatgttatcttagatccagccaggtgtgatggctcacgcctgtaatcctagcactttgagaggcagaggcaggcagatcacctgaggtcaggagtttgagaccagcctgatcaacatggtgaaaccccatctccactaaaaatacaaaattagacaggcatggtggtgcgcacctgtaatcccagctactcgggaggctgagtcaggagaatggcttgagcctgggagacagaggttgcagtgagccgagactgaaccactgcactccagcctgggcaacagagctagactccgtctcaaaaaaaaaaaaaaaaagaagaagttaactcggccaggcgtagtggctcacatctgtaatcccagcactttgggaggccaaggtgggcagatcacgaggtcaggagttcaaaaccagcctggccaacatggtgaaaccccgtctctacaaaaatacaaaaaaattagccaggtgtggtggtgtgcacctttaatcccagctactcaggaggctgaggtaggagaattgcttgaaccgggaggaaaggttgcggtgagcccagatcacgccattgcactccagcctgggcagcaaaagcgaaactctgtctcaaaaacaaaaaaagttaccttagatccaatcaatgactagtcactgagcagctgaggaggaatgattttccaacccactccaagccttatccataaacctagctctttaagaagaaaaatgaaatttggggaaataatgagaagaaaagatagcactggttgaagaccaccatggtctccagcactgcttgtaggaaacctatgtggtggtagaaaaaaaaaaccggttaggagctgagcagaaaggagctggagaatttcacagaaacccagcctgggcatccaggcatgtttatcttccatgacgaactacaaaaggctaaatcctcactattgccctcgggaaatagttctgtcccctctagtgtactatgactttaagaacatacgtaatcctttaatatttttctaaaaatcctgggtaaacctgaggcaatgcacttgaagccaaaaggctcttcattcacagcacatctggctgcagtacattacagtggtgcccacttcaggccggagacagggagagcgtatgacctattgaagatttaggaggatctggtggatgcggggtttaatacttttattatctgaaagaagcttgaagctaaattagaaggctcttggattataggtgtcatggtgatttacgtgagactgaaattctcatactgagaaagacggaatagaacatctaaaatgagatcagatcctaaaatagtcaaaagattaagtacaaggctctattttagtaaaattcacattgttgaaactttcatggattatctttaatctgtcgctgacttttagagtgtatcttttgtgtgatcaggcgccctctgctgccttcaagttgaagtgcagaagagaaaaaaaatctattaataatagattaaattttaggaaaatatgctaacttctaattatcctcaccacaagtaatcaatgtgattggaaggttctgccaagtgtggtatggattacgtggctctttgcacgtttcccagcaggaaagtgggaataatgaactagttcacctattacacaggattcttgggaaaatcaagtgaaacaataataaagcttaggaaagaggccaggcgcggtggctcacgcctgtaatcccagcactttgggaggctgaggcgggtggatcacgaggtcaggagatcaagaccatcctggctaacacggtgaaaccccgtctctactaaaaatacaaaaaattagccgggcgcggtggcgggcgcctgtagtcccagtactcgggaagctgaggcaggagaatggcgtgaacacgggaggcggagcttgcagtgagccaagatcgcaccattgcactccagcctgggcgacagagtgagactccgtctcaaaaaataaaaattaaaaataaataaaataaagcttagggaagtaaaaaagcaaaacacaaaggctttttttttttttttttgagacagagtctcactctgtcacccaggctggagtgcagtggcactatctcagctcactgcaacctccggctcccaagttcttacctcagcctcccaggtagctgggattacaggcatctgccaccacacccagctaatttttgtatgttttatagagacaaggtttcaccatgtaggccaagctggtctcaaactcctgacctcacgtgatccacccgactgggcatcttaaagtgctgggattacaggcgtgagccaccatgctggccttactgaatttttcccacttctttgaatccattccagagagaggaataataagatttccaactataatcagggatttatctatgtgttgcttatatacaataaactgtatatatttcaagtgtgcacaggtggctggggtgaggcaggtggctgctgaggagcaagagggatctacagttgtcccctgccctatgagaagggccacccactcaggaggggcctcaagggatgatgagaaatgagtatggaatttgtcagccttgaagttccaaattggaaacctggaaacatgtgtcccgtcttcttcatcaagattgtccaattttttttctttttttttttttttttttttgagacggagtctcactctgtctcccaggctggagggcagtggcgctatctcggctcactgcaagctccgccttccgggttcacgccattctcctgcctcagccttccaagtagttgggaaaacaggcgcccgccaccatgcccggctaatttttttttgtatttttagtagagacggggtttcaccatgttagccaggatggtctcgatctcctgacctcgtgatccgcccgcctcagcctcccaaagtgctgggattacagatatgagccaccgcgcccggccgattttccagtgtcatagcataaagcaataagtgatgttcttctaattaaaacaataaattaaagtgtagaatttaatatgtattaatactatcaaggtctggccaggcacagtggctcacgcctgtaatctcagcactttgggaggccgaggcaggcagatcacaagatcgggagatcgagaccatcctcgctaacacagtgaaaccccgtctctactaaaaatagaaaaattagccaggcgtggcggcatgtgcctgtagtcccagctgctggagaggctgaggcaggagaatggcgtgaacccgggaggcagagcttgcagtgagctgagatcgcgccactgcaccccagcctgggcgacagagtgagattccatctcaaaaaaaaaaaaatactatcaaggtcaaataaaaatatagagatggatctctaaacaaaacaccttgtatgggaatcatagaattatattttgaggcatatccacaggctggggtgaacttcaatatgtccaaagaacaaagagaaggttgggggttttattaaaaagagaaatgtggccaggcgcggtggctcatgcctgtaattccagcactttgggaggtcaaggtgggtggatcatttgagatcaggagttcaagaccagcctggccaacatggtgaaaccccatctctactaaaaatacaaaagttagctggacgtggtgacatatgcctgtaatcccagctactcgggaggctgaggcaggagaactgcttgaacctgggaggcagaggttgtagtgagccaagactgtgccactgcactccaacctgggcaacagagtgagactccgtctcaaaaaaaaaaaaaaaaaaaaaaaaagaaatgtggctgggcatgatggctcacacctgtaatcctagcaccttgggaggccaaggtgggcagatcatttgaggtcaggagttcaagacaagccttgccaatatggtgaaacccgtctctactacaaacacaaaaattagctgggcgtggtggcacacacctgtaatcccagctactcgggaggctgaggcaggagaatcacttgaacccgcgagatggaagttgcagtgagctgagatcgcaccgagatcacctgggtgacagagcgagactcaggctcaaataaataaataaataaataaataaataaataaaataaaaagaaactcttgattagtttccatttttctagggttttacaaaatggaatcctacagccagggacagtggctcccacctgtaatcccagcactttggaagtctgaagtgagtagatcacctgaggtcaggagttcaagaccagcctggccaacatggcaaaaccccatcactactaaaaatataaaaattggccaggctgtgagatcgtctcccatagcattgagctgatttctgtggttccttaggtcatgggggtagggtgaggcctgcttcaatcttacccttttggggcagaactcttgaaatcttggcttaatctggggagttctctcttagatcccaccttggacacccttggatttgattatgtttttcttgcccttggaggctgtcaaaaccaaaggtaagtatggcaagatcggctcatgcgtgaaactaaaagctgtctcagagcccagtggcctgtttttgttgctactttccattaaggtctgacttggtaattccttattagctttcggatgcctttctgatgttatttgtgtctaccatattccttaaaaggcagcattgcttcgtttttaaatggtgggtttttgggaggtttttctgagacggagtcttgctctgtagccccggctggagtgccagcagcatgatcttggctcactgcaacctctgcctcctgggttcaagcaatcctcctgcctcagccttccaagtagctgggattacagatctgcaccaccacgctcaactaatttttgtttttttagtagagacagggtttcaccatgttggccagactggtcttgaattcctgacctcaagtgatctgtctgcctcggcctcccaaagcactgggattacaggcgtgaagcatcacacccaggtaaatgaagtctgttattgttgttgttattgttgttttgagatgaagtctcaccctatcaccaggctggagtgcagtggtgtgatctcggctcactgcaacctccacctccctggttcaagcaattctcatgcctcagcctcctgagtagctgggactacaggcgcccaccaccacgcctggctatttttttgtattttcagtaaagacaaggttttaccatgttggccaggctggtctcgaactcctgacctcaagtgatccgcccgcccaccttggcctcccaaagtgctgggattacagatgtaaatgatgttttttagtgtgtaattaatatatactcattttcaaaatttggaaaatgcagatgagtataatgaaggaaacctcacagtcacttacagccttctctgctgcatgccagcactctcggcacttggggggtatttcctgctgacggatcttgagcaaaggtccgtgctgtggcgtcactcatcttagtgtcgtgcacagggcctccttccttcttgctgtatccgtgtcttctttatcactgatctcagaagaagcacgtgaagattaagaacattctgtaagatacctgatgcaaagatagggaagaagaaactaccaaaacttagaaaatagcacagaaaatggaacagaagatagaagctatgctggaaatgctaactgcaaactagaaaacagcattatttatttatttttttttatttatttatttttgagacggagtctcgcactgtcgcccaggctggagtgcagtggcacagtctcggctcactgcaacttccatctcccaggttcaggcaattctcccacctcagcctcccgagtagctgggattacaggcgcacaccaccacacccggctaatttttttgtattttttgtagagacggggtttcactatgttggccagactggtctcgaactcccgacctcataatccacccgcctcggcctcccgaagtgctgggattacaggtgtgagccaccgcgcccggctagaaacagcttttcacatcatgtcaacaactgcgagccagggattggctctgaggaagccatggaccttgtgtgctccccatgtgagactgcaggtttgcgtctgtctcccagtgggcgtgttccccgaccctacccagacataaccaaaaccttgctttcctgcatgcagtcatcagagatgccagaccagaggaaatacagcaatcaaagcaggcaaacctgttgctaaatgtgtttttgagagtaaaactccttggccaaatacttcaagacgctgatgattctcaaagtaagtagatttttaaaatcctatactgtcaatgttttgagcatctggcttcttaacccaggaacgagctgttttccagcctgataatcccatagtcaacagtgtatgcttagccaggccggtggctcacgcctgtaatctcagcactttgggaggctgaggcgggcggatcacgaggtcaggagttcgagaccagtctggctaacatagtgaaaccccctctctgctaaaaatacacaaaaaattagccgggcgtggtggtgtgcgcctgtaatcccagctactcgggaggctgaggcaggagaatcgcatgaacccaggaggcagagcttgcagtgagccgagatcacgccactgcactccagcctgggcgacagaacgagactccgtctcaaaaaaaaaagaagaaaaaaaatgtatgcttagggttcacagtggtaacccctgaaattctggctgtctagccatggaactagttcgcactgaaaccccctaattctaaaaaaggtcttttttttctcattgttcctacacagactgtcatcatgaaccatctggagaaggccagatgtttacatttcacggaaatgtggtcctgaaaccttcattctgagcgcagagctaaccacctcctcctattcttggcaacactagtaaatgatacattaccacagagcaggtgaaatgcagcagagacatctacgctagaacctgagggttgctatgttgtaagaagcatgcccaggtttatactaggacgctcggctggagcattggttcaccgctgtccactattttaaagacatgccagaaataacaatcctattatctgatttccaagtaagtcaggatgttcctactaacagcccttccttttatggtagtgagaatagtctagaaacttagtgttttatgataattcatgtgccgtggctctcttccaggagattttaatctccctctggccttgtcttattcacctttatgtcccaggacaaaaatgttggactgtttgttatatgttaataagtgggctgggcgcggtggctcacgcctgtaatcccagcactttgggaggccgaggtgggcagatcacaaggtcaggagttcaagaccagcctgcccaatatggtgaaaccccatctgtactaaaaatacaaaaacattagccaggtgtagtggcacatgcctgtaatcccagctactcgggaggttgaggcaggagaattgcttgaatccgggagatggaggttacagtgagccaagattgcgacactgcactccagcctgggcaacagagcaagacttcgtcttaaaaaataaaataaaataaaataaatgattgataaacagtgaatgaaggctgggcgcagtggctcacacctggaatcccaacactttgggaagccaaggcaggcagatcacctgaagtcaggagttcaaatccagcctggccaacatggcgaaaccccgtctttactaaaaaatactaacaattaggctgggcacggtggctcacgcctgtaatcctagcactttaggaggccaaggtgggcggattgcctgagctcaggcgttcaagaccagcctgggcaacacagtgaaaccccgtctctactaaaatacaaaaaattaaccaggcatggcggtgtgtgcctgtaatcccagctactcaggaggctgagacaggataattgcttgaacgtgggaggcggaggttgcagtgagccaagatcacaccactgtgtcacaaacgtccgtgtgaagagagtccaccaaacaggctttgtgtgagcaacaaggctgttgatttcacctgggtgcaggcgggctgagtccaaaaaaggagtcagcaaagggtggtgggattatcattaattcttacccttttgggataggcgtacaaagtacattctcaagggctcggagaatattacaaagtacattcacaaggttagggggagaatattacaaagtaccttcttaagcggggggagaggccgggcacggtggcacacgcctgtaatcccagcactttgggaggccgaggtgggtggatcacaaggtcaggagatcgagaccatcctggctaagacggtgaaaccccatctctaccaaaagtacaaaaaattagccgggcgtggtggcgggcgcctgtagtcccagctacttgggaggctgaggcaggagaatggcgtgaacccaggaggcggaggttgcagtgagccaagattgcgccactgcactctagcctgggtgacagagccagactccgtctcaaaaaaaaaagaatttgctgtcagagcgagtcacaatggctcacacctgtaatctcagcactttgggaggccaaggtgggcggatcaccagaggtcaggagttcgagatcagcctggtcaacatggtgaaaccccgtctctactaaaaatacaaaacttagccgggcatggtggcaggtgcctgtaatcctagctacttgggaggctgaggcaggagaattgtttaaacccgggaggcagaggttgcagtgagccaagatcacttcattgcagtctagcctgggcaacaagagcaaaaccctgtctcaaaaaaaaaaaaaaaaaaaaaaaagaatttgctgttggctctcactctgattcatatctcatatctgcctatgtttctttctttttctttttttgctgtagcctggggtggagcagaggggactgctgtagctggggacctggaaacatggtcaacactgaaagtaaaaacacaaacttggtttttccagggagctgctggaaactgacccaaggcaaaagcaaggtgcaggtggaattactgagaggttgtggaggcctcctgctcccctctctgctgccagacactctgtgtggggccccccaaaacgtgcctggcaccccagtccctcaagtgttccctggatatggggaaattgttgactaacgactttataagtcatggacatttcttggctgggtgcagtggctcatgcctgtaatcccagcactttgggaggcggaggcgggcggatcacgaggtcaggagctcgagaccatcctggctaacacggtgaaaccacgtctctaccacaaaatacaaaaacattagctgggcgtggtggcaggcgcctgtagtcccagctactccggaggctgaggcaggagaatggcgtgaacctgggaggcggagcttgcagtgagccgagatcgcgccactgcactccagcctgggcgacagagcggactccgtctcaaaaaaaaaaaaaaaaaaaaagtcatggacatttatccgcaaacgtctgctatcagggatatgtaaactctaacagccatgagaagccattggacgggtgttgctgtggccaaaatccagagcatggacagcaccacacgccggccaggaggtggcgcatcttttcatgtcagtcatgatttatccaaaaacagcacctcccgtgatgccagtgctgcgcagaggttgggatacagcgggtgggtgcctagaagccaactcccgccttccaggaagtatggttaggggacatactcacccggacaccgacgtgaacctgcagcctcccccggggagcacgcatgggtcccagttgccttacagtctgatcacggatgctgttgcctaggcaacgtgagggtggccctggctccttgatcttcctggtggctctgggggaccatgacggagatgcggataattcaggtcagggcagcagccggccggcagggggcgacaagcacactgctcatgaacggttggctctgcccacgtgcacacggcgtttccacattaacattcatttaataataataaaagaataagcaacgagagagaaagccagagatctacatgactagacttgctgcatttctaaattaccaggtacgacgtgagccgagcatctgcccccttgccctgaccaggtccccatttctgactctccactcccagccctggacaggaggagtcaagggtcagaaatggtccgggtctgccaatacattccttggtaatagtatgttaaaagtagcaagtggcaatctgttctctctctttctttctttctctttctttctttctttctttctttctttctctttctttctttctttctttctttctttctttctttctttctttctttctttctctctctctctctctctctttctttctttcttcttcctctgtctctctctttctctctccctctcgctctccctctcgctctctctctctttcggaacagggtctcgctctgtctccccggctggagtgctgtggtgccatctcggctcagtgcagcctctgtctcctgggctcaagcaatcctcccgcctcagcgtcccaagtacctgggaccacaggcgtgtaccactacgcccggctaattttgtaatattttgtacagagatggggtctcattatgctgctcaggctggtgacaaactcctgggctcaagcgacccacccacctcggccccccaaagtggtgggatcacagacgtgagccagcgctccctgtcagcgtttcattccctcttcatatcacatcacttgggtctgtggtccaggtgcgctgggggcagcgcaggccgggttcaggagagctcggctcagcagcagccgatggagctttcctgggggctcctacctggccgccagctccagaagccaagccaggggctcttcgagacatggtcccaccagaggagagaccgagcctcggagaaatgaacgtcctaggccatgggactcggacccctcaccccacccgccacacctgccaacttcccggcctgcagggtggcaggaagcctgaggcattattcagcttccttagggcccgttggctgatgcaacacagctcagaagttgagtccaagcaccaagcccgcaatgtctgcgtcggccgccaggggtcactcctcccgcgcagaaggcggccttggagcctcgcaaccgcagtatgcgaaggttgcatcaccctcgcggggtctaagaggaaggatggggaccagcccgcaggcgggcctgagcctcctggcaaagccctttgtcaacgtcaacagaagcatctggcgtcctttctggtcgcggacgtcagagctggctgctccggcactcagccgggtggttggtccccaggcagccgctggggccctgccaccaggtctcacctggccgagagggagtcaggatgccctctgaagcaatgtcccgaaatcccaaattcacccctacccccaggtcaataatgtacaagaagctacattcctttttttttttttttttttgagagggagtctcactcttgttgcccaggctggaatgcaatgccacgacctcggctcaccgcaacctctgcttcccaagttcaagcaattctcctgcctcagcctcccaagtagctgggattacaggcatgcgccaccacaccctgctaattttgtatttttagtacagacagggtttcttttttctttttttttttttttttggagacgcagtttcactcttgttgcccaggctggagtgcaatggcatgatcttggctcaccacaacctctgcctcctgggttcgagtgattctcctgcctcagcctcccgagtagctgggactacaggcatgcaccaccatatctggctgatttttttgtatttttagtagagatggggtttctccacgttggtcaggctagcctcaaactcccgacctcaggtgatccacccgcctcggcctcccaaagtgttgggattacaggcgtgagccaccgtgcccggcctgagacagggtttctccatgttggccaggctggtctcaaactccagacctcaggtgatccgcctgccttggcctcccaaagcattgggattacaggcatgaaccaccacgcctggccgttgaagctacattcttgttccaaagttttaagcagggactttggtgcagacatagcaatcttttgggaggattaatggagggaagaaatagtacctggtattcccactgctctcacccacagccccgggatccacctcctctttaccgcccgggccacagagagcacacgtgggctcctttccatttgctggtccgacccagcagtggtcaccgctggagccctgagaccccaccaaggtgttctgcccagctctcctcatccacagaggacagagggggtcaggggaaataatatgaatctgacgctggggacatttgcaacccgcagagtcaccgccacctggtgtctcttcagtgtctatggagaccagtaaatgactgtttgctccactgttctgaaaacaaatgagtgcagaaacaatcttcttttgcttcctgcctggtgagagacatgattgccaagagctcaggccaggagccgagggtttgcttttcatcctaatcttcaaggtggtcatcttcaaaggatgtgagagggcaagagctgagctctgcttcctgcaaagagaaccacacatgtccctcagtggagcacccagtctagctttcctgtgtctgccttcctccctccacccacgccttcctccctctgcccacaagtccttcaccctctccccacaggctcagccttcgggagctatttcctgtggctttttattcacttcctttttttttttttttttttttgagatggagtctcactctgtcgcccaggctggagtgcagtggcacgatcttggctcactgcaacttctgtctctcagattcaagcgattctcctgcctcatcctcctgagtagctgggattacaggcctgaactaccatgcctggctaatttttatatttttagtagagacggggtttcaccatgttggtcaggctagtcttgaactcctgacctcaagtgatccacccgcctcagccccccaaactgctgagattacaggtgtgagccaccgcgcccagcctcatttacttgttttgataatttttttcttttgggataatcgtagctttgcaggacagctaagatagttcctgaagttctccagtgatcatcttccatacaatggtacattggtcaaaactaagcaaccaacattggtatattgccattaactaaaccccagacttgctttggatttccctgggtcttttcctacttacatccttttcctgttcccatccaggatcctacgcaggagacaacattgcatttagatgtggttcactcttcaatgcagagattttagaccctaacccatctcaccctgtgtagctccaggtgtgtggcctcctgctgctgggaggaaacgcaccgagtcgtggtgctcagtggcaccctaaatgccctgggagcctgtgaaccccaaaaatctgagacaggtctcaatcaatgaagaaagcttattttgccaggtcaaagacaggcactgtgacacagctgagtcaggagaatagatcctggaagaagggaaccgagagactgcctaggactaaatcaaatgtaagggcttggtacagtggctcacgcctgtaatcccagaactctgggaggccaggcgggcagatcacctgaggtcaggagttcaagaccagcctggacaacatggtgaaaccccgtcactactaaaaatacaaaaattagctgggtgtagtggtgggtgcctgtaatgccagcaactcaggaggctgaggcaggagaatcacttgaacctgggaggcggaggttgcagtgagctgagaacgtgccactgcacaccagcctggatgacagggagagactccatctcaaaaataaataaataaataaaatagaaacacttcagctatgacaggaaatatcctctttacttacatagggcatctgtgtaaatgaagcgtaaatgatttcattgacaaatgagtaagtgactttgtaactttacttcatcctcttcatttacacagggcgtacaccaagtaaatgactttgtaacttcactttagcctcttcattcacaaagggcatacaccaagcaaccaatggaaacctctagagggtatttaaatcccagaaaattctgtaaccagtttcttgagcccctatgctggggcccactcctaccttgtggaatgtactttctcgttttcttttttttttttttttttgaggtggagtctcgctctgtcgcccaggctggagtgcaatggcgtgatctcagctcactgcaagctccgcctcccaggttcacgccattctcctgcctcagcctcccgagtagctgggactataggtgcccgccacaacgcctggctaattttttgtattttttagtagagacgaggttttaccgtgttggccaggatggtcttgatctcctgaccttgtgatccgcccacctcggcctcccaaaatcctgggatcacaggtgtgagccaccgcgcccggccttgtactttcgttttcaataactctctgcttttgctgcctcactctttttgctttgtttgtgcattttgtgcaattatttgttggacaacaccaagatgccaagaacctggacaccgtccaccggtaacacagcctcagggggtcctgaggacatgtacccaaggtggctggggcacggtttggttttacacgttttagggagacatggagacatcaatcaatatatgtaagatgtacattggttccgtacaaagaggcaggacaactcaagcagggaggggggcttccaggtggcaggtcggggagagacaaaccgttgcattcttttgaaatttctgattagcctttccaaaggacgccatcagatatgtatgtatctcagtgagcagaggtgtgactgaatagaatgggaggcagttttgccttaagcagctcccagattgacttttccctttagcttagtgatttgagggccacaagatttccaagatttattttcctttcacaagctgaagaagtgggagctgcctttggtgctctccccatggacctgactctggccttcccctccctttacccccatgggtcccttgtctctgcagttgatttgctcacgagattctaaatatcagccgtttactacttaggataaaccgcaggtcttgctgcagtatcgcccgttgctgatatgtgcagatgccaagttctctggatgggaaccatctagagccttggtagtcaaaggccgggcgcagtggctcacccctgtaatcccagcactttgggaagtcaaggcaggcggattacttgaggtcaggagtttgagaccagcctggacaacatggtgaaaccctgtctctcccagaaatacaaaaatttgctgggcatggtggtgcgtgcctgtaatcccagctactcgggaggctgaggccggagaatcacttgaacccaggaagggaggttgcagtgagccgagattacgctactgcactccagcctgggcaacagagcgagactccgtcacagaaaaaaaaagagtcttggtagtcatggggattgaagcctctttgggagtcccatcccttcgctccttctgtgcctgtgacccctcactgtgaagtgcacactcccagagtgcccaggccaggctggttcagtgccacccaccctccagcctctcccaaccccccacagccaaagcaccggcacagaggtcacaggagactcaggccacgtggcatccagatgccgacaaagtgagttctttacccagaaaatgaaagggagaccttcccgaggcgcttgcccatccaactgtgcaaggatgacggggttccactcaagccaaccgaaaacatccacagataagaatacacaaaataaagccaacccacaacaaactcccaggactcagaatccaacacgcctcccatcgtcgtgttgtgaccaagcgagttacagagaaacgccacactttgagacaaattaaagagtcttttattagccagcgaccaagaggcagctaatgctcaaaattctctcagccctgaggaagggactagttttgtttttataccgtggtctaaacagcggaggcaggattttagctgaagcaatttttacagaagcagaactggcaaaaagttaaaaatttaattggttacatggccgggcgcggtggcttaagcctgtaatcccagcactttgggaggccgaggcgggtggatcatgaggtcaggagattgagaccatcctggctaacgtgatgaaaccccgtctctactaaaaatacaaaaaattagccgggcgtggtggcgggcgcctgtagtcccagctactcgggaggctgaggcaggagaatggcttgaacccgggaggcagagcttgcagtgagccaagatcgcgccactgcactccagcctgggcgacagagcgagactccatctcaaaaaaaaaaaattaattggttacaaaaaataaacagttccaggtgcaggggcttaaactatcacaaagagataaatgcaggggcttcgggtgccatccaccgagcgcgtcccgaggagctgctggtgcagcttgcctctgtatcttatcagtaggtgcatttctggacgtgctttgagtcagtttacactagttatgccttaagggagggagatgaaaggggactgcaggtgaagaaactaaaatggagtctgtccggctctctctctgctaggagagagtaggctatcaccgctgagccacaggggacggcaagttgtccatttttcctgctcaggggccgctgacctcacagcagccggaatgtgggtggtggcattccaagggcaatccacatttcaccgtgattagaaaacgaggccaacacggctcaggctctgagcatggcttctctgcactggtgactgcaagaatatccctcatgcctttgaagggccatggagaagttggcatagctctcctggagttcccgaatctctcgcccaaagtaacttggcccttcgaggcagaattggagaaacagaacatcctcacacccaagtcccattttctctgtggtgacctgcaaaccacactgcaccttctggctgcgacaccctcagatttcaggccagaaccttggaagaagtagggccactccctggtttctgatggggccagagtgctgggttggggacgttgcctccagagctgtctctgggggccctgacgctgccgtgtgctgggagtgaaggagctcctacctcacgggccaaacccactcccgctctctcccaggctccagggataaaactggagaccactatgtcttgctttccgtgttctttctccctgccatggctgggtgcagaagctgaagccgcctttgcaaaattatgactgcagcagtgaaagagatctaatgtaaccgacatcatcttacttctttttggtgggtggggggggatggagtttcactcttgttgcccaggcaggagtacaatggcacaatctcggctcactacaacctccacctcccagattcaagcgattctcctgcctcagcctcccgagtagctggaattacaggcatgtgccaccacgcctggctaattttgtatttttagtggagatggggtttctccatgttggtcaggctggtcttgaactcccaaccttaggtgatctgcctgcctcggcctcccaaagtgctgggattacaggcatgagccagtgcgcccggccttaacccctattttaaatgtgcataatttctacattgtcaaatcacagagtcattgcatatgatcacatctctcattttgtcctagtccttcaaacagctatgcacgtgtatctcccactcccagcagtccttctcttgatatcttgtcactttggttgtctgaaacccagcctctaggaggttccttaaaaggcatatagggaccaggtacagtggctcatgcctgtaatcccagcactttgagaggccaaggtgggtgggtcacctgaggtcaggagttcaaaaccagcctggccaacatggcaaaaaccccgtctctactaaaaataaaaaagttagccgggcgcggtggcaggcatctgtaatcccaggtactctaaggctgaggcatgagaattccttgagtccgggagacagaggttgcagtgagccgagatcatgccattgcactccagcctgggggagacaaagtagaactctgtctcaaaaaaaaaaaaaaaaaaaggaggctggatactgtggctcacacctgtaattgcagcactttgggaggccaaggcgggcaaatcacctgaagtcagaagttcaaaaccagcctggccagcacagtgaaactttgtctctagtaaaaatacaaaaattagctaggtgtggtggcgcacacccctagtcccaactactcaggaggctgaggcaggagaatcaattgaacccaggaggccgaggttgcagtgagccgacattgagccactgtattccagcctgggcgacacagtgtgactccatctcaaaaaaaaaaaaaaaaaaatacaaaggcttatgggaataatgagttcttgcacgtcgatgttttgtctatgccctttgtacttgaagatcggttttgcttggtgcgtcttgaaaggaggccctgagcagtgatttctgagagttcacagaggatgtagaccccagcctctttaaacataaccagagtccccttgcactcacccactaatgcagagaaaaccactctgtcagtgataatcctattacatgtgaatgtaaataaattatttttttaatgaaaagcaactatgtttctaaaaccacaacatatttagtaagaaggatggcttgttttatgtttttgcaaatagaagacaattggatttttattttatgtatgtatttatttatttagagacagggtctcactctgtcacccaggctgcagtgcagtggcgtgatcatggctcaccacagccttaacttgcctggctcaggtaattctcccacctcagcctcccaagtggctgggactataggtgtgcaccaccacacctggctaatttttgtattttttttgtagagatggagtttcaccgtgttgcccaagctggtctcaaactcctgggctcaataaatctgccttcctcggcctccagaagatctgggattataagcatgagccactgagcctggcccagattttgttttctgttttgggatagagtcttattctgtcacccaggctgcagtgcagtggcacaatctcagctcactgcaaccttcacctcctgggttcatgcaattctcctgcctcagcctctggagtagcagggattacaggcatgtgccaccatgcccagctaatttttgcatttttagtagagacagggtttcaccatgttggccaggctggtcttgaactcctgacctgaagtgatccactcgccttggcctctcaaagtgctgggatgacaggtgtgagcaatcacgcctggcctgtattttcagtagagacaggttttcaccatgttggccaggctggtctcaaactcctgacttcaggtgacccacctgccttggcatcccaaagtgctgggatgacaggtgtgagccaccatgccaggccagtggcccagagtttatatctggttctgcattctatctcctggctgcatcatgtcatatggcctctggaaaacttcactgaacactcatgaaagaatccctggactttttgttttgctatgttgtcatgctctctgcttttttgtggggatttggaatgttcaaaaactatgctgccactgccatcttcccagatcttcataagattgctgataagggaaaggggtaagaaatagaaggtaggccatgtgtggtggctcacacctgtaatcccaacacttcgggaggccgaggcaggtggatcagttgagcacaggagtttcagaccagcctggacaacatggtgaaaccctgtctcttcaaaaaatccaaaaattagctgggcatgctagcacacacctgtagccccagctactctgaaggctgacataggaggatctcttgagccagggagatcaaggctgcagtgagtggtaaccactccagcctgggtgacagagtgagatcctgtctcaaaaaaaaaattaaaaagaaagaaatagaaggtgaagctgcaatgttctctctcagcatgtctatttaacattgtaccagaaggcttagcacaaaaggcaggaaaaagaaataaaaggtttaaggtttagaaaatgtagaaaatttaaagaatgtacggataatctattagaatccataagtaaatttatctaggttgctggatacaagatcaacatacaaaaactagttgtttttctatatatcagcagcaaacaaaacaaagctaaaatcttaaaagttaccatttataaagtcaccatttataaaaaacatcagatacttaagaataaatcaaacaggccaggtgcagtggctcacacctgcaatcccagcactttgggaagccaaggcaggtggatcacttgaggttaggagtttgagaccagcctgcccaacatggtgaatccctgtcttgactaaaaatacaaaaattagccgggcatgttagcatgcacctgtaatcccagatactcgggaggctgaggcaccagaatcgctagagcctgggaggtggaggtgtcagtgagccaagatcacgccactgcactccagcatgggtgacagaatgagacttcaattcaaacaaaaccaaaaccaaaacaaacaaacgaagaataaatcaaacaaagaatttgcaagacctctacactgaaaactacaaaatattgttgagagaaatgtaaggagaccaaaaaataatggcagggctcttttagtaactgagacaagactaaatattagaaagatgtcagttctcctcaaactgacctacagattcaacaccaatttttttttcttttccttttttttttttttttttttttttttgagacagggtctcactctgttgcccaggctggagtccagtggcttgatctcacctcactgcaacctccgcctctcgggttcaagcgattctcctgcctcagcttcctgagtagctgggattacaggcgtgagccaccacacctggctaattttgtatttttagtagagacagggtttcgccatgttggtcaggctggtcttgaattcctgacctcaggtaatccacctgccttggcctcccaaagcactgggattacagaaatgagccctggagcctggctgctttgggtgttctcgagactctacactctcctcccgtacaccacagcaaacagctcggaccccctgacagctcctggccttccccagctgagtggaaggcttctccagggcttacttcagttcttcgtggattttgcccagtcgcccggaggctgcagttccaccaggcaaagccaaacatgcttgtttgttctattaagaaatggctggttaatctttggacctaagtgcaatgttggacgtggctgacgttcattgcttgaggaggtatgtgttattgaaatgacccagaaggctgcatttggcagtttcccttacttctgacccaagcctcatgcagggctgtgtgggtgctgcctgcagccttttgcaaaagatggaaaaatggcaggaggcacgaaagaccaccaggaaagccgagcgagctcctcaggcttgttccatcaggtctgggaagtcagtaagccatgggaatgagatcccagcaattcttgggtccttccagctgtttcattccttgggaattaacacataggaccctgagggttctaacgcacaagggcagggaagggggccaggccatgcccgcgagcttgccaggtcattgtcctgggtcacggggtggaggaacctgctctgtgcacgcaaggcacgagctgacttgcagggccgctgagtcacgggagagtcaggagtcagtccagtgtagactgcgtgctagagtggtttaacaaggatgccaagtgcattgttcaaaacatggctcccctgtctgccgtgagtcgtcttgaggcggggctcctgtaataaccttcccccaaggcctctcctctgcagcaccccgctggacacctgaggtcctctccctgtacaaagaaaacccaaacccactgcttctctttggccattagcttttggcctcttcaagctgctctttggggtcttcacggtctctggtgggattctctctgcgaattaggtttgcattaagttttctatctttattacgcagagaagactggcttcacgggctttccccctacttggctagcagacacatcttttcagccctaggcaaaagaatcccgtgctcgaattatccagagataatgtacgtttgctgtaattaacaacccaccagagccctggggcgctccctacagacatgggtctggtgtggcaaatgtgcaagggaactggctctgcccggccctcccaggcagctctcccatttgtctcagtatcatcgccttcccagctccctggggctccccctcccagagaggagcagcccaggcctgactgccaagacacagggcatcatttacccactatggttagaaagcttgcccaagcaatggcaccaagccaataaatattattctctgctatcaacagccaaggccacactctgatttgttagtggtgggttaaataaacaagacttctggctgggcgcggtggctcatgcctgtgatcccagcactttgggagtggatcacaaggccaggagatcgagaccatcctggctaacacagtgaaaccccatctctactaaaaaaaaatacaaaaaattagccgctcgtggtggcatgccactctgtagacccagctactcgggaggctgaagcaggagaatagtttgaacccaagaggcggaggctacggtgagccaagatcgccccactgcactccagcctcggcgacagagtgagacaccaactcaataaataaaaaataaaataaacaagacttccagaccacgggtggagaagatccagccagggagctgggcacaactccccgtttcactgtgcggtttcatttcagttggaaagaacttcatctgttgaagtgcacagacagcattcagaggctagagacgccggcatcggcacagcacacagtgccctctgttcccctggcccaggccaagagctctttgtgtgtctgagtgactggtcagcactgggcaacaaacccacgccgggagacggacagcgagccgcctcaacccaccagcctctggggagcctctcatctcgcaagcacctgcggaggcccgcccggcgccagaccagtccaggcacccagaggcctctgctctcctggagctcatgacaagtaaacaaatacacaagatggtttgggatcccgatgaataagttaagcagggcaacccaacagggaggacagggctcccgcatgtgacggacccaggagggagcgaccccccgtgttgacatggggggaaaggcgggaagtcagagaggccgggaggtcagagaggccaggaggtcagagaggccaggccccttcacacggggtgggcgggggggggggggatttgctccctctggaggccaaagaggagggtcctttccacctcttccagcttctgggggcggctggcttcctgggcttgtggcgtgtctgtcactccagtctctgcctctgccttcacgtggcctcagtgcatgtcctcacatggccttcttataaagatacctgtcatcgcatttaggacccaccctaatccagcacgacctcatcttaactaatggcacatgcaaagaccctgattccaaatccggttatgttctggggatccggtgaacacaaatttcggtgctttgctcagtttctatggagtcttgtgtataggaagggacaggagaagaaccaaattctcatctgaggcagatttttattcctcattgcaaaatttaaacatgaaaccaattaaaacctttttggggaggcctctgctcaatcagtcaaccaaggactatttaccaagcagctggtcttgggctcagctctgcagtcagcactgtggtacctgacacggattggcagcttgctctcagaacatttccaggctaaccaagaggacgagcacaacgagctatttttcaaggaatagatcagttaagatataacccacctaccgtacgatttgcccatttagagtgcgcaattcagtggccgttagtacaatgacagagttatgcagctattaccccaatcaatattaaaacattctcttttctttttttttttttttcagatggagtctcactctgtcgcccaggctggagtacagtgacacgatctcagctcactgcaacctctgcctcctgggttcaagtgattctcctgcctcagcctcctgagtagctgggattacaggtgcgtgccatcacgcccggctaatttttgtatttttagtagagacagggtttcaccatgttgggcaggctggtctcaaactccagacttcgggtgatccgcctgcctaggcctcccaatgctgggattacgggcgtgagccaccacgcccggccaaacgttttctttttacttttttttttttttttttttaggacagggtctggctttttttttttgagatgcagccacaaggccaggctggagtgcagcggtgcaatcttggctcactgaaacctctgcctcccgggctcaggtgatcctcccacctcagcctcctgagtagctcaggccacagacacatgccaccgtgcacagctgattttattattatttatgtatttatttatttaattgagatgggggtcttgctatgttgcccaggctggtcttgaactcctgagctcaagcaatccacccgcctcagcctcccaaagtgctgggatgacaggcgtgagccatgtcacctgccccagttaacttttgtgtatatttggtagagatgaggttttaccatggtgcctacactggtcttgggctgagctcaagcaatccacccacctcggcttcccaaagtacagaggtgaggcaccatgcccagcataacttttccttttttaatttattgaaaatacataggactgtataaagccaaaattaccacatcaccctggggtttgtaatgtatgtaggtgcaatatgcaagacaacagcagcatgaagcatggggggttgggtaaatatggtcacaaggcttctatgttttatgtgacgtttatatttctaatactaactctgggctgggcgcggtggctcacgcctgtaatcccagcactttgggaggtggatcacctggggtcgagagttcgagaccaacctgaccaacatggagaaaccccgtctctactaaaaatacaaaattagccaggtacggtggtagatgcctgtaatcccagctatttgggaagctgaggcaggaggatcgcttgaacccaggaggtggagattgtgatgagccgagatcgcgccactgcactccagcctgggcaacaagagcgagactccatctcaaacaaacaaaaaacaaaacaaaacaaaacaaaacactctgagtagactgtgaaaaactaagggtagatgttgcaatccctagagcaaggagaaggaatagctaaaaagccatagttcttgcttcataatgctaatacttggggtgggcatggtgactcatgcctgtaatcccggcattttgagaggccgaggcaggtggatgacttgagttcaggaatttgagaccagccgggcatggtggcgcatgcttgtaatcccagctactcaggaggctgagacagaagaatcgtttgaacctgggaggcggaggttgccgtgagctgagattgtgaattgcactccagcctgggcaacagagcaagactccgtctcaaaaaaaaaaaaaagctaatactcagaatagaaattccaacttgaccacttagtggtgtgatcagaggcgggtctctcagcctctctgaacttcatctgtcctgggaattgaacaatctaagctgtttatcccccagggtgtcccagaggatgaaatgaggcaatatcaactgtgcactgtgttttgtaacctgagaagcattgttagcctgcaaagggtcccttccatttgacaggattctcctgtaccagagatgatggtttcctccctatcccccaagaaaacagagactatctctgatttcagcaaacagctgtgtcaaggcctcacatccttggcatgcaggcatgtctcagtcattggtgaggacctctgatcccaccttcaggttcacgatcaaagggactgttcccatttccttgggcaagaaaccagaggcccgggactttgtacaatttccgaagcaaatgttatgcacacatacgccttccccagcccacaggagatacgcatttccggaagcttttggtgatcgtgatcacacgtaggcagtttccaaagcgtgaggggacctggtggtgcaggtgaggtggcccgtcccaggtcctacaaggtcctctggcacagctgggatccctgctaactcggcggaagggctctctgctcaccctgccacctcggtgccctgtggaccctgatcagcggtctgaagccaactgccctggcatgacctccctgtggggttcccttcccagcctgaaccctttggggttccactgctcaccaggggtgatgcttcagaaatcatactaaacagcacctgcttcagaggtctaacctacccctggcccagcccaggtaggagttccccagtcttcatgagcttgggaggggtggtcagacaccaggagactgttgccattccctgcagtgacactccagaaaccaggcagccgacggtcccagaggggcgagtctaaagggaggcactgccaggtggggtatcccaggctgcaggacacccacggagaggctgagggttccggccagagaaaggaatagagcagagccctctgattgctccttcctacaaagtctaggtggacgtcctcaacagcaggtcgctttgctgaggggactgtcttcaaggggaagcagccagagaaatctaccacgacctaaaccagccctcacacttagtcttcggcacatgccaaaggtgttccctgcgttagtctccactgctgccgcgcttccctcccagcaagctcaagaaaagcctggccctgtgtgtatcaaccgcatggtccccctttgatctctctggcccagctgccgggccctggctcgccactggggaggccctcagtcctctcgcattgatccttccagtgaggccacgggaaagcctttggcactgggtgctgtagggcacatgagctggggtcagagccttggaccaccaactgcaaggggtgctgtggagggctctctggagacccccacagcactgaggctctcgtcccccgaccaggagtttctccacaaattgttctccaggaactgcccttggctaaagcaatgtcacgtcccaggccatggtccctccctggtggcccatgtggaatcactcgtcagtgtcatatgagaagaattgtatgctcagaccctgtaacccaaggcagctgcctgcttgccagtgttgtctcagagcctgtttgttgcagcaacaaaaagcacaggcatctcgggggcttgaaaactcaggcttctttctcgtgtacatcaagtccgctgggggtccaggaggttccccagggtagctgctgccaggggagggcccacacatgacccacgccaacccctgcttgcccagccatcatgcagaggacagaggaaggcgaaccccagcaaataagggcttccaccaagaagcgacacccattgcctccactctgagcccactggccttcccgaagtctaagactagaattcctgcctgtgcataaagaactggggattggtgaaccgccatcagatctgccagatgtttcaggaaagtgaacatttgtttacatctgtgtggattgggctacctccttctagacagagcccggtcccctcagcctcactgccctctttttattttattttatttttttgagacggagtttcactctttttttttttttttttttttttgagacggagtctcgctctatcacccaggctggagtacagtagcacgatcttcgctcactgcaagctccgcctcccgggttcacaccgttctcctgcctcagcctcccgagtagctgtgactacaggtgcccgccaccctgcctggctaatttttcgtatttttagtacagacggggtatcatcgtgttagccaggatggtcccgatctcctgacctcgtgatccacctgcctcagcctcccaaagtgctgggattacaggtgtgagccaccgcgcccggctgagatggagtttcactcttctcacccaggctggagtgcaatggcacaatctctgctcactgcaacctccacctcgcaggttcaagcgattctcctgcctcagcctcctaagtagctgggtttgcaggcacccgccacccacgccaggctaatttttgtatttttagtagacatggggtttcaccatattattgctctttttataacagatattttgaatgcctcctttctaccctgaaatgaaatccacagaaactataacttgccaatacacggaatttaaaaaaatctacacgatacatattggatcatacaagcatgagagataaactgaagcagaaaggaagtatgaaaataaaaacaattggcaataaagcaatatgaatttcaagatgtaaattctcaggcaccgctatgctagaagacataaaacacgaatgctgtactcacatgtaaatttgctgtcaacgcagcagggacaaatgtcagcagcatcaggagcactgtggctcaaatgccaggaggggatttactaaaattgtgagcctctcctggttccagttagaacccagcaccttcatctgcatggtagtttcatctctacagatttcagaacttatcaaaactggccaaagtggctgagcgtggtggctcatgcctgtaatcccagcactttgggaggccaagacgggtggatcacttgaggtcaggagttcaagaccagtctggccaacgtggtgaaaccccgtctttactaaaaatacaaaaattagctgggcgtggtggcaggtgcctggaatcccagtgactcaggaggctgaggcaggagaatcacttgaaccagggaggcggaggttgcagtgagccaagatcatgccactgcactccagcctgggcgacacagggagactctgcctcaaaaaaaaaaaacaaaaaaaaaaaactggacagacccactttgtgttgattggcaaaaaataataacaatgttaggttttaggatcagatagttataaataggtttttcacctttgaaaactcatacaggacaatccttcattgtttaggaccttttttcacatcacagaacatttagcctcctttctcttactccacatcctaagaaggctgcaaacacctcccacaaacttccaaaatgcctcctagggagggtaccacatccaataagaaaacctctataggctgggtgcactggctcatgcctgtaatcccagcactttgggaggccgaggtgggtagatcgttcgagcccaggagtttgagaccagcctgagcaacatggtgaaacctcatctctacaaaaaaaaatacaaaacttagccgggtgtgttggtgcacacttgtgatcccaactacttgagaggctgaggtgggaggatcacctgagccggggagttcaagcctgaagtgagccatgatcacaccactgcactccagcctggatgacaaagcaagaccctgcctcaatcaatcaatcaatcaatcaatcaatactttttaaaaaagaaagaaaacctccatccaagatggtattagctgtagtgttttctaggccaccaaagaagtggaaaacatagaaggacttgaggagtagcgttagtgacacatttcagtgctagagattctatacaataaagataagtgaaaggctgggcacggtggctcacgcctgtaatcccagcactccaggaggccgggcatggtggctcacgcctgtaatcccagcactttgagaggccaagggggggcggatcacttgaggtcaggattacgagaccagcctgtccaacatggtgaaaccccatctctactaaaaaaaatatatatatatataaaatatatatataaaatatatataaatatatataatatataaatatatataaaatatataaatatatataatatatatataaatatatatatttatatattatatataaatatatataatatataaaaatatatataatatataaatatacataatatataaatatatataatatataaatatacataatatataaatatatatattatatataaatatatataatatataaatatatataatatatataatatataaaatatatataaatatatataaaatatatatatgtatatatatatatatatatatatatatatatatatatatatagccaggcgtggtggtatgcacctgtaatcccaactactggggaggctgaggcaggagaatcacttgaccctgggaggtggaggttgcagtgagccgcgattgcaccactgcactccagcctgggcaacagagcaagactccatctcaaaaaaaaagataaatgagataaaattgtattgatggaggagcaagacttgggaatgagaccccagagggcatagaaaagcctatttgggaattagaaatagaggaatcccaaggacatattgtttgcttctctgtagtggttgaatagtgacaccctcccccaccaacgagtatgttcaagtcctaatccctggcacctgtggatgtgaacttatttggaaatatcttctttgcagatgcaattaaggatctcaggatgagatcattcttgattgaaggtagaggctaaatccaatgggtggtatccttataaaataaaagagaggggggtttgaaacacagagagacagagaagaagaccatgagaagatgaggcagagattgcagtgacagagcttcaagtcaaggaatgcctggagccaccaggagctagaaggggcaaggagggtgtgatggttggttttatgtatcagattggctgggttgtgggtactgagatatttggtcaaacattattccaggtgtgcctatgaagatgtttctggataagactaacatgtgagtttgtacacttagaagagcagattgtcctctccaatgtgggtgggtctcatccaataagttaaaaacctgaatagaacaaaaaggctgttcctctcctgagaaagagagaattcttcatacctgatggcctttgaactgggacatgggtctgttcttgccttcagaccagaactgacacatggggtcttcctgggtctcaagcctgtgggccttcagactagaactacactaccagctctcctgggtctcaggccttcagactcagactggagcattcaccatcagctgtcctgggtctcaagcctgtgggccttcagactagaactacaccactagctctcctgggtctcaggccttcagactcagactggagcatgcaccattggctctcctgggtctcctgcttgccgtctcaccctgcagatcttgagacttgccagccactgtaattgtgtggccaagtccttaaggcacacctctttctacatataaatgtacatccttttggctctgtctgtttggagaatcctactaatacagaagtgtctgagttcattttgtgttgccatagcagaacactgggggctgggtgatttttttttttttttttttttgagacgaagtctcgctctatcgccgaggctggagtgcagtggcgcgatctcggctcactgcaagctccacctcctgggttcacgccattctcctgcctcagcctcccaagtagctgggactgcaggtgcctgccaccacgcccggctaatttttttgtattttttgcagagacagggtttccccatgttagccaggatggtctcgatctcctgacctcgtgattcggaggctgggtgatttataaagaacagaggtttatttggccataactctggtggccagaagtccaagattgggcagcccatctatgagggtcttgtgctgcttcaagtcctggcagaaggcagaaggagagcgagggggtgcagagaccaaaagtgcgaaaaaaaaccacctggtcttgcagtaacccagccccatgacagcaagaactcactttcccgacacagcatttgtcgattcaggaaggatctgccccatgacccaaacacctgccactaggccccacctccaacactggcaaactgggactcaaatttcaacatgacttttggcaggaacaaagcacatccaaaccatagcagaaaggatggtccccaagagccctaggagggaacgtggccctactggtaccttgatttcagagttctgcttccagaacggtgagagaatcaattcctactgttttcagcccccagtgtgtgggactgttccagcaggccccagaacactctcacaaaacaaaatcaaacaggctaggtgcagtggcttacggctgtaatcccaccactttgggaggccaaggcaggcagatcacgaggtcaggagtttgagaccagcctggccaacatggtgaaacccccatctctactaaaaatacaaaaattagctgggcatggtggcaggcgcctgtagtctcagctacttgggaggctgaggcaggagaattgcttgaacctgggaggcagaagttgcagcaagccggggctgcaccattgcactccagccttggtgacagagcgagactccatctcaaaaagaaaagaaaagaaaagaaaagagaaaagaaaattatccctgtgcactataaatttgagaatggaggggtctctaatttcacagcatccctggtggagaacccgacttcccatctcctccctggtcttccgaggagtaagagggaggagttgatttgctccctgaggagcagaactggaagaggaggggagagaagctggtcacagttggtctaatacattttgtgtttataacaggcctgcagtgaagacaagaagagccttggctagagttcccaccacggctttaactggatggacgtctgggaacacacatctcccttccctgggcttccatctcttcacgtctcagtgaggatgttgactaagcagatctcctgggccccttttccagctcaaacccgtgggttctctgaccactggagtcagagcacaggcctctgatggagatacgatgtcacagagaggtgtctggcccagaagaccccagcgtcaagctccaagcttctgctccaagtcagcctggaacagaatcctggagagggcgggtggaccttcaaggaggaggcagctcccgtcactgggctgatgcgcctgcccagaggcctccacaggaggagcctgcagggtgcgggccacccccaggctgaactgctctctcacacggtctgaactggaaagggcctgagaccttcagcggacgagagccacccctcaccagggagccagttcctccacccccacctgggtgccctgcaggtccctcagagaccaatgaccacctaagaggctgtggctacagctgtttcctggctgtttcctctcaacttgagaaagtcccatgaaacagagcagacctggcgctgtttagggggcggccgccagttacagcgcagttcctctcccgggctccaggacctttccaggagcttccaccccggttccgctgcttcctgcctcacacaatgacctggtcccctccatccatctgccatctgcacacactgaaatccatgggtccccaagctcctgccacggcacttctgccatgaggcctcccaggatgaccccttaactccatctttccaggaagacacctgcttagtcaattccacagcacctggacagacacacgctccgtcagtcacagagagcagcccttgctgtgcaggcacagtggctcatgcctgtaatcccagcattttgggaggccgaggcgggcagatcacttgagtgaggtcaggagtttgagaacagcctggccaacatggtgaaaccccgtctccactaaaaatacaaaattagctgggtgtggtggtgcttgcctataatctcaactacttgggaggctgaggcaggagaatcgcttcaacccaggaggtagaggttgcagtgagccgagatcgtgccattgcactcccgcctggcaacaacagcaaaactccatctcaaaaaaaaaaaaaaaaaatagaaaagaaagaaagcagctctcgctgccagctggtcacagacactgggtgctgagatggaccaagtcccactgcactccagcctgggtgacagagcgagactgtctcaaaacacacacacacacacacacacaaacacctgtttctctgtgggcatctgctgcctcttgcagcctgaccgttatgcactatgatacccgcagaggctgtttcctttttcttctttcaaaatgtgtctcctcatagcccatgcagcaccaggagcgagggagagaaggaagaaagtggccgaggggcaccgaccccatccctccacagcacacccttcacagtggtctgtgctgtcactctctgggtgttcgtctgcctgatgaggctggcagctcccagaacgcactggtgggggttcattcattctgggaccctccagttcctggtacagggccctgcatcagatcacaccacccagtccacatagcacgggatggggcagagatgaccacacacttcattcaccctccttgtgtcatacgattctggaagagtagaatccagtggcagtgacactgtgccaattccaggccaggccccaggaggctggcagctcctacatcccttcttcccttctctcagaacagtcactctggagcaaggagcttccacgtgagaaaccccactaccctcagactgccaggtgatggggagctccaggcaagccccatggagcccgcgtagagagacagttgcctaactagccccaggggttccagccctcccagtgaggggccagacacgtggacaaagaagccttgagaggactctagactcagccaccacctgactgcaagtgcatgggagaccctgcacaagaaccacctggctgagcccagcctgtcccagactcatgagctgctacactattgtcctaagccattacgtgttgagctgatttgttctgcagcaatagatagcccaagaagtggcttggtgaggaccaaaacaggctcccactctaggggggacgcattgttaaacagcactccctctgggctgacacagtccacaggaggctagtggacaccacctctgtgcagggaagcagaggccccatctttgagctggaggaggcccagccagaatgcacagggtgcccatgagtcgcaggctggcgccaggtgcttttgtacagtgaacaaactgtgcaactgtatgtggtggcccttcctagagctctcattgcagacaggaggcaggaagagtctgatgagagctccatcaccgtccttcacagtatccttactgactttcatccgcccagtccacagaggggccccttgctcatgctggggaactcagtgcagcagggacctggcagaatgctcaggcgaagggaggtggggtgccaggagaccatggagaagggcgctggctgggcttggcaacacacgggtcaggacctgactctacttcccgggcacagggctgcagtcactgcttgtcccagccttgttcgcccgaccaagctcttttgaagttcaatgccaggaacattaacaagtgtgctgatctggaactgagtgctgcctgacccccatctttggctcttctgccccggatgcacctaccccactccctggtatccctgcctgtccagaactgcctggtgtcattatccagccctgccccgcccaacctgaagggatttgcctcccagcctccagattctctctctgctgtgtccaccctgttctgggcccgggggcctctcttgccttcaggggcctctcttgcccacgggggcctctcttgcccactgtggcttccaactgggtttgtggctggattttcttccccagctccccactggagctctgctgtggggcatgcttctccaggaaggccagcagcccctccctgttgcagggatctcgggaccttctgggccctccctgtcctccctgagctcggggtccctggtcctgctctctcgaagcctcggtttcctaggcccttcccacactggcgaatactctctgtatcccaccctcctccccaccacgttcccaccacgaccctgcctgaggagggtcgaaaagaaaacaacatggctttgactgctgtcctgaggcttcccgggatgacccctcgactccacctttccaggaaggcacctgcttagtcaaacacatagcacctggacagacactttatcccatatcttggggtctgatgggcaggggcagcatgtggagagagagggcggatgggccgtcatccttccttccccagaggctgacctttctcgctggtctctggggcctcgtggccatggggcctccaacgccgcccagccatgttgctgagggcgaggcaccaggcctctctgtggcccgcttcctcccatgtcatagtggtcatcatagccctgccacctgcccatctgcctgtggctcacccagctgggaaggaactgagagttgtgagatccacacacactccccaggcaggggctctccccgccctgaccttggtgcatggacccctggcctttttttttttttttttttttgagatagagtcttgctctgtcacccaggctggagtacagtggcgcgaccttggctcgctacaacatccgcctctcgggttcaagcgattctcctacctcagcctcccaagtagctaggattacaggcatgcaccaccataccgggctaatttttttttttttttttttttgagacagagtttcactcttgttgccaaggctggagtgaagtggcacgatctcagctcaccacaacctccacctcccaggttcaagcaattctcctgcctcagcctcccgagtagctgggacaacaggcatgcaccaccaggcctggctaattttgtatttttagtagagacaggatttctccatgttgaggctggtctcgaactcctgacctcaggtgatccgcccgcctcggcctcccaaagtgctgggattacaggcatgagccaccatgccaggccaattttttgtatttttaatagagaagcggtttcaccatgttggccaggctggtctcgaactcctgacctcaggtgatccacctgcctcggcctcccaaacttacgggattacaggtgtgagccaccgtgcctggcgggccctgtgttttgatacctgagaaggtgcagctcacctggttctggagtttaattggaccctgagttctcccagtggaagtctgagaaggccaagctgagctcgatggctgtcagaatcctcatttacattggatgaacagggcgcagtttcccctgctccggaggatggtggggtgaggtgggagcccagcctgggggagtgggggcaatagaagctgtgggagcagcagccccccaggggccaggaccacgaagcctccagggacgagcaaggaggccgcagagggccaggcatcagagtggagagcagacgcacaggacacccagagaggcccctgcccctacctcgccccctccaagaacatgctcttccagtgaagtcactgcagccccactccctccccacacggaggaggaggcagctttagggtacctaggacacgaaggtgaccaagacacaccactgtggtcaaggggcgtgtggctgaggacgacatctgtcaacctcccttaccatgactcacgttcagaaatccacagacatacgcatacatgtgtcggaaacaaaagtggcaccgacagttctctcaaaggagccgtgttctgcgcagacacccgcagcccctgtccaacatacagccaggtaaagctgcagccgggcctcccggcaccccaggcccctccctttgcagccggggcacggcccacagctctttaaaaagcccactgccttacatccccacgctgtcctgcagaagactgcagtcaggtcttctgcctcccagaatcatttccccagcagcccggcggcgcccacccagccccaacggggcctgtcctgggaggtgcctgcagggcggctcttgttttctttcccacttctgtgcccacgtgcatttgtaagggctccgggaggagggggcttcccttttctgtgggtctctttcaggtcctccttccacagagctacacaaggccccactaattgctctaattgccttgccgccacctggtgcagatgcagccgcctttccaaacggagctgccgggcagggctgtaactcatacttcctgcttgaatcatgtctgcctcttacatcagccaccagcctctttttcatccagcatgggagggtgcagctggggcagagctgccgttgatgtaaagtcactaagccctgggggctgggttcatgagtgggatgggaatggaggtgccccgggggctcctctttctctccagaacatgctgcaccctttgtgggcaggttggcacctgtacaattggagataatgggtgtcatacggtccagttgctcctctgagctgctctgacacgcacctgccctcacctgggacacggcaggctcccctgtgagccacccctggaggcgcggttcctggaagcagggagggaggagggcagggaggttggggtggggccctttaaggagtcagccctgccctttaatcctcacagggacgatgggagccaggatggctgccagcgtttcgagataacgccagccatgcagggcctggaagggggagcatcacccaggcacctcacagagcacacatatgcaaagccacacggtccacaccccagcagacacgggagagaggcttcgcaccaccagctcccagtgatgatgctgcctgcctgcagcctggtgtttgcagctggacttagttcttaaccaggggatacagcaatgtttagaacaggggtgtccaatcttttggctttcctgggccaccctggaagaagaattgtcttgggccacacatcaaatgcactaacaatagctgatgagctaagagaaaatcacaaaaaaaatctcataatgttttaagcaagtttacgaatttgggctggatgcagtggctcatgcctatgatctcagcactttgggaagctgaggtgggtggatcactgaggtcaggagttcgagaccagcctggccaacatggtgaaaccccgtctctactaaaaatacaaaaattagccaggcgtggtggtgcctgcctgtagtcccagatacttgggaggctgaggcaggataatttcttgaacccaggaggcagaggttccagtgagctgagattacgccactgcactcctgcctgagcaacagagcaagactccatctcaaaaaaaaaaaaaaagtttataaatttgtgttgggcctcattcaaagctgcactgggccacaggtcggacaaacttggcgtaaaatatttttgggttgtcacaattaactaacggggaggttgctgctggcctccagtcggtggaggccaaggatgctgctaagcatcctgcaatgcacaggaaacaaccaattaaccccacagtgaagaattatccagcccccaatcccagtgaccaagactgaaaaacccgggctgggagagacagtgctgccatcgattgcttatgtctgccactggtgcagacagggtggtggtgatgcctgcaatcctaatcccacccggcagactgtcctgaatgtataacccatctcacctcccactgttctctctgggaccttcacacctatagtctcctttgctctgtgagctccaggttgaggagaggtgcttggacctgggccaccatgttgcacaactgcgtaggttctgcaacatgttggcctcctttggattgttgttgtcttgaggatggtttttatacaggccgggagttgaaatctcaaagagctacagggcccagacccaggaaagagatgagtgaagtgggcaggtgggaatgatggttaaatgcagaggcgtgccacaaccaaggggcaacagccttcagcccccgccacttccaggctctgaggatggtgagccccagattactaaatctttcatttttttaaaaggaagtaaaaaatgtgtttttcttttttaaatgtgaaattggccgggtgcaccttgacctccaaaactgctgggattacaggcatgagccatcacacctggtcaggaatctgttttttaaaagattttaaacaatgttctttatcttgatagggattcgggttaacaagtgtatgtgtctggcaaaactcatgaagtggtgcctcgtaggtagtttgcttcagtgtatgtgactgtacacaaagaagaaagaaggaaggggtggaaggaaaggagaaagggaaagagaggaccataaaccaatgctgaacactagttgaagcccaagtccagtatgatttccagaggtttccctaacacccgctatcccataactcaaccattttaccatgtcctgtgccactggtattcttttttttttgagacagaatctcgctctgtcacccaggctggggtgcagtggcatgattttggatcaacgttgtcagcggggtccccgcaggagatctgagcacaagttccttctgggagcagggaggtgcataggcacctggatcatcatttccgcttctggggtggcaattctcctagaacctgttcacagctgtggcattcgtgtcctggaactgctatcattagcttccacaaaacaggtggctctaacaacagaaactgagggtcctgcaatcctggagaactaaagtccaaaatcaagttgtcagcagggcctgctccctccagaggctctagaggaggctccttccttcctcttccggctcctggtggcccccagagtcccttggtgcctggctgcatcgctccaatccctgccttccccctcacacagtctctcctctgtgtctgtgtccaaatttcccccttcttataaggacacctggcattgggttcagggacggcccctcggtaagtatgactcatcttagataatcacatccgcaaagaccctgtttccaaacagagtcacattcacagataccggggttaggactcgagcatattgtaggctgcaactcacccacacagctgtagagaagcacagccactcccaaaccatgggcaggggcagcagcgtgcacactgagcactctttcgtttttttttttcttttgagacagtcttgctctattgcccaggttggagtgcagtggcatgatctcagctcaccacaacctccgcctcctgggttcaagtgattctcctgcctcagcttcccaagtaactgggactgcaggcacgcaccactacacccagctaatttttgtatttttagtagagacggggtttcactatgttggccaggctgatcgcgaactcctgacctcacgatccacctgccttggcctcccagtgtgctgggattacaggcgtgagccactgcgcccggccagcgctctgttctttctccaatggccccactgcaattccctggacaagagagcccctgaagcaggctgtagggctcaggccgcggcacagagatgggcagagggagcccaacagctgtgagtgggagggggcagctctgccccacacacccctccctcagaagagccagaagagagaaaatggtctcctcccacgtggggtctttgaagcagcccacaggtgctggtgactctggccgcagcgtggttgcctgcaggactgtccccaggccctggagacccaccttctcctctcagccagcaccctcggctttgcccaaccacagtaaagctccaaattccccaattctctgagtactttgatgcaaaactgccaaatggggaagtgattctgctgaggtaatgagcacctggggctgggacggagcagcatagagggatgggtgtgatcgggggggcccctgcaccccactgcagccccaggtggaccttgggtggcagcagagcctcttctgctgcaggaagaagtcaggtcctttcacctaaaacctgtcatgagctcgggcggctccagtgctgggcgccgattagaaaacaagccagggaaggccaggtgcagtggctcacgcttgtaatcccaacgctttgggaggccgaggtgggcagatcacctgaagtcaggagttcgagaccagcctggccaacatggtgaagcccccatctctactaaaaatgcaaaaattagccaggcatggtagcacacgcctgtagtctcagctactcagaagactgaggcaggagaattgcttaagcccgagaggcggaggttgcagtgagcagagatcacaccatgcactccagcctgggcaacagagtgagactccaactcaaaaaaaaaaaaaaaaaaaaaagagggattgagaccctaacgtaaaacccaaaactatcaaaaccctggaagacaacctaggcaataccatcctggacccaggaacgggcagagatttcatgaagacgacgccaaaagcaattgcaacaaagcaaaaattgacaagtgggatctaattaaacttagatcctgctgcaagtacttcctcccgggcccatctattcattttccccatgttttcccaactcactcatcacctggtctctgctgcctcttgcttcgaaggctccaatcacacagcggcagcttgtcaatccgactcttaccctatggattctcagcccggagcggagcagcccaggcgggcatgtgtgcaggactcagagaagagctctgtaggagggttttgcacagcaaaagaaactatcaacagagtaaacacacaacctacagaataggagaaaatatgtgcaaattatgcatctgacaaaggtctaaaatgcagcatctataaggaacttaaacaaatatagaagaagaaaacaaccccatttaaaagtggggaaagtacatgaacagacactttcccaaagaagacatacatgcagccaacaaacataagaaaaaaaactcaatatcactgttagagaaatgcaaatcaaaaccacaatgagataccatctcacaccagtcagaatggctattattgttattttttttgagactgagtcttgctctgttgccaggctggagtgcagtggtgcagtcttggctcactgcaacctctgcctcctaggttcaaacgattctgctgcctcagcctcccaagtagctgggactacaggcacctgccaccacacccggctaattttttgtgtttttagtagagacggggtttcaccgtgttagccaggatggtctcgatctcctgacctcatgatctgcccgcctcagcctcctaaagtgctgggattacaggtgtgagccaccgcacccggccctagagagttatttataagtgcacagtgataatgaatgttcagtcacatcaaacgttacattgtctttacatcttctcatagggaacgttgaaacattttgcgatagcttgaattcaaaccatcgcactcacagcaccgctacatgtctccagcctcacctggggagtgagcaaatgccagacaccctcctacggagctattctctgaaccctccacacaggcccggctgggctgctccgctccgggccgagagagtgattgataagctgccgctgtgtgattgcagcctttgaagcaagaggcagcagagaccaggtgatgagtgagttgggaaaacatggggaaaatgaacggatgggcccgggaggaagcacttgccgcaggaagccacccccagcccaggctgctggggcctgagacactgaacagagctgctgtttgccaagcattctggttacacttttgttgtgggatctgttacctgggggcggttgcctggctactgccaagacaggaacatgtgtcccttgtgacatctggacctgagccatctcagtgtggaagtcatggccagagaggtttctggaacctgagaccttgactattaccctaccctatctctctttctcctggcgacctggaatcccaggttgcaaagggtcttacaggtgtctaacccaaacccatggcctctactaaactttgactctgctctgtggcccccagcggcggccccaaggtctccttccatcctcacccatccttggttggtgaacacgaaccctctcatagacccacagggaaagccttgtaggtcctgcagcggctgctcccaagacagtctttgggttttcttgacactgttttcttctcctccaaagagattcccccttagaccgggcatggtggctcacacctgtaatcccagcactttgggaggccgaggcggtggatcacttaaggtcagcagtttgagaccagcctggccaacatgatgaaaaccctgtctctactaaaaatacagtaattagctaggcgtggtgatgtacgcctgtagtcccagctacttgggaggttgaagcaggagaattgtttgaacctgggaggtggaggttgcagtgagccaagatcatgccattgcactccagcctgggtgacagagcaagactctaaaaataaaaaatttaaaaaacccaaagatgttgccctttgttgggacctcctcaaagtgtgtgcctgggatatgaagataaaaataagacccagagacttggggtgaagaaccagaacccggccacacgtccattccctccttgcgtcagggagggagaagagctggccacgcttggagttcccaagagttcttcaggtgcctttcccaccctcccaccttgatatctttcctcctgggcttgcccttggcccctgaaattctatcatcaaagctttattgcaggccaggcgcggtggctcacgcctgtagtctcaggactttgggagaccaaggtgggtggatcacctgaggtcaggagttcgagaccagcctggccaacatggtgaaaccccatctctactaaaaatacaaaaattagctgggcatggtggcacacgcctgtaatcccagctacttgggagactgaggcaggagaatcgtttgaacccgggaggtggaggctgcagtgagcggagatcactccactacactccagcctaggcaacaaagcgagactccgtctcaaagaaaaaaaaaacctttattgctttcggtcaaaagacccaaaacaggccagctgaggtggctcacgcctgtaatccctgtgctttgggaggctaaggtgggaggaccacttgagcccaggagttcaaagcctgtaatcccagcactttgggaggccgaggcgggcggatcacgaggtcaggagatcgagaccagcctggccaacatggctaaaccccgtttctactaaaaatacaaaaattagccaggcatggtggtgggcgcctgtaatcccagctaccctggaggctgaggcaggagaatggtgtgaacccgggaggcggagcttgcagtgagccgagattgcgccactgcactccagcctgggagacagcaagactctgtctcacaaaaaaaaaaaaaaaaaaaaaaagaacagaaaagactacatgcctgtggacatctcactgcctgtccccccgcccttttttttgagatggagtttctctcttattgcccaggttggagtgtagtggcaccatctcggctcactgcaagctccgcctcccaggttcacaccattctcctgcctcagcctccagggtagctgggattacaggcgcccaccaccatgcctggctaatttttgtatttttagtagaaacggggtttagccatgttggccaggctggtctcgaactcctgacctcaggtgatccacctgcttcagcctcccaaagtgttaagattacaggtgtgagccattgtgcctggcttgtctcttctttaggtttggttttctgtgacccctatttttttttttttttgagacggagtttccctcttgttgcccaggatggaatgcaatggcgcgatcttggctcaccacaacctctgcctcccgggttcaagcaattatcctgcctcagcctccctagtagctgggattacaggcatgtgccaccatgcctggctagttttgtatttttagtagttttgtatttagtagttttgtatttttgtattttagtagagggtttctccgtgttggtcaggctggtcttgaactcccgacctcaggtgatccgcccgcctcagtctcccaaagtgctgggattaaggcatgagccaccgcgcccggtctttttttttttttttttttttttttttcagacagagtctcgctcttgtcgcccaggctggagtgcaatggtgcgatctccgctcactgcaacatctgcctcctgagttcaagcaattctcctgcctcagtctcctgagtaactgggattacaggcatgtgccactgcgcctggctaatttttttattttcagtagagacagggttttgccacattagccaggctggtcttgaactcctgacctcaggtgatccacccgcctcagcctcccaaagtgctgggattacaggcgtgagccaccacgcccagcctgaccctctattttaatgcagactttttaagtgtgatgtacatgccctaagtgtccaccgtttgatgaatttcacaaaggggctattgccgtgtacccagcactaaggatgagaatcagagtgaggccccacacagaagtccctcggttagaacccttttccgtcatgtgccacgcagaagaggccatcccccaaaatgcacacccacctggaactccagaatgtggccgtgtttggaagcagggtctttgcagatggaatgagctaggatgaggtcatgctcatcttagtgtggtaggtgggccctaaattctacgactaggcccttttaaggggagggagagggagatacacacatgcaggggagaggttgtgtgaaggccaaggctgagaccagaatggtgcagccacccaccaggggagtgcaaggaccctccccaagagccctcagagggagcacagccttgctgtcaccttgaccccagacatctgcctccagaactgggacagtgcattcctgttctctcagccaccccgtttgtccatttgtggtggatgtaactgcagccagagggcactcacactgccccatggccacatagctgctggccaacagaagggaggaacagctgtgggctccctctgaccaaaggcaagctgtgggctcagcagacagccgccggcagccagctgaggacagcaaggctcagggttcgcaccatctgggccacacccctcaacgtccactccagacctggaccaagccaggcagccagcaactcccaccctgagcagctcctggaagggacgggagctgtgacagccacaataataacattcatcggctgggtgtagtggctcatgactgtaatcccagcactttgggaggccgaggcgggcagatcacctgaggtcaggagttcgagatcagccttgccaacatggtgaaaccccatctctaccaaaaatataacaattagtagggcatggtggcatgcgactgtaatcccagctaatagggaggctgagggacaagaatcgctggaacccaggagtcaagggctgcagtgagctgaaattgcaccactgcactccatccttggcgacagcaagactctgtctcaagtaaataaataaataaatacaacattcttcgcagcccaccattgttggaggtgtcctaggtacccggcttcctgctcaaagctgcaggcaaagtgttggggtcatacaggacttgcccgagaacaggaaacccaagtcaaactgtggaagctgtgaggacatctgttggtttctgcaactggacgtctggagggagtgtgaacttccggtggcatctgcttctcccttccactcctggggctccagcatggtgggcctctctcaggatgggctggagcaccggcagcttcaggcctcaggggccttcggcaacgtccagaggaaggaaactgcctctttcaggagcctgtggcactaagaggaagccttctgcagatgcagccagcaggcttccccacggaccccagaggcacagctgctcctgccgggaaggggtgtaagttcaaccacggagcagccacagccctgcagcagctgtgggcttgagctccccagaagcgcctgggatcaggaaggtgcggtggctcctggagtgctgatgggtgtgtcacaggcatgtgaaccagagcaactccatcttgaatagaggctgtaaaatgaggctgagacctgctgggctgcatctccaggtgattaagacattctaagtcataggatgagatagaaggtcggcacaagacacaggtcataaagaccttgcagataagacaggttgcaataaagaaaccagccaaaacccaccaaaaccaagatggtgatgagagtgacctctggtcatcctcactggtacactcccaccagctccatgacagtttaccaatgccctggcaatgcaggaagttaccctgtatggtctaaaaaggggaggcatgaataatccaccccttgtttagcatatcatcaagaaataaccataaaaatgggcaaccagcagcccttggggctgctctgtctatggagtagccattctttattcctttcctttccttttttttttcaagacagagtttcgcttatgttgcccaggctggagtgcaatggcgtcatctaggctcgcggcaacctctgcctcctgggttgggtatcagtttagactgtgaagtctggctgaagccaacggatgcaggacacaacagtaaggatgagccaaaagtgtaaggaataaatatgtctgcgtttcctttgttcactgtcctcttggggcaagactgctggcgagtgtaccctttctgcagaaagtaaaaattgccttgctgagagaattaaatatatgttcaagtgctatttctttatggcaccagggaacaagcatttagcatttctaacacgggttcaagtgattctcctacctcagcctccccagtagctgggactataggcacctgccaccatacctggctaatttttgtatttttagtggagatggggtttcaccatgctggccagactggtctcgaactcctgacctcaggtaatccacccgcctgggcttcccaaagtgctgggatgacaggcgtgagcccctgtgcctggcccgatttattcctttactttcctaacaaatttgctctcactttgcagacttggcctgaattatttcttgcgtgagattcaaggactcttattggggtctggatcaggaaccctttctggtaacagatgtgcctgggggagaaggggccaggaggaaggtgatgcagaggccacctccactaaccctcaacagcgtacaccacctctgccactcccacttcacaggcgagaaaaccaaggcttagtgcggtggggccaagtgctcagcggacacagctggagagcggcgggccaggattccgcataaaaaaagcagccctctcagatcctgggaggacaaacaggagagctcattccctattctccagcttccatctcaaagtctccaggaacccccagcaaccaaaatattcttgtaagtgaataaggaaaagcaaagccaacaggtgattctcgatgctcccgtaggccccagggagtggagaagcaccacgctccaagtgcctggacagagagggatctgccaacgggagctcggtcagaaagaggaggagggggagccagggcagggggcaaagaaagagagttcagtgagggggcagcacgtgccaaggccccaaggagtgtcccgggcatggaatgttccggcaaccaagagaaggccgtgtgggtttgagtgcagacaaggggaaagcggctcagcacagccagggaaagccagccagagtgagggacaacggcccaggaatggctggggagctgcggctctgtctggaaagcagtgggtgggcgtcactggcacctgctgccatctatggattcacccaagccaaggatgaagatggggaaccagcaggctcaggacacaacatgggcccatccctcgttgactcccattagcagacagcgacccgtgcatgagctgctctgggggacggcagcttctggctcaggggccagcctgcgtgtctctgccatggcgggtcataacctcatcagcctccttcctgaaacccgaatgccacacgcctgctgagtttctcaggatctcacaaatcctaccccagtccccaacatcctggccagcctgacagttacttcctggagcatcttccagagttccgtcgggtttgctgaccctggttgagtgatggcattttctagctctttctgtctgtaccccagaatgtagcttgtctaagcccagtgacttaagcccaatctattcatttcaccactgtcccctggcaggaggaattcctctgaaaagaccccaggagcctggcgaggggtacgctggggaggcagctggtgacaaggcctgggcagaaagcctgcttttcactaagaattctttgaacattttgaattttgtactatttgcagatactgcctattcaaaaataagtaattaattgaaacaatgagatcattctctttgatacaaaaaggcaaaaccctaaccggagtcctgtcgttctgctgttatctcatcccgggctggaatctggtcaccccaaactccccacgccccagcctcagcgtctccatctgtaaaccaaggcccaggccctcggaccttggtgggggggctccactttgtgagtctgacttgtcatagcctgaagctgtggcctgggcccctgtctccgtcccactcgcaggctggttaaatcccgggagtcaaaacctccaggagcaggttccgtggtctgagagtccaggacagcttgtcactcagcaagacagcctggcggcggtggggggggggggggcgccaaccagggcgaccgaggacaccaaggtggggcctgtgggtgaggtgcccccaggagtctcagtggaagctccaggaaggtcacaagagatccctcctcccaggtggcccctaaagaggccagcacacagtccatggaggaagaggcacagaatcaatgaatctggctttcaaggagcgaataaacttaggcttgttggtgtctcaaaggcatctggtacctgaattgttcttggggttcctactggaggcgccagcccttagagactgagcagccagggacaacactcccgggcggctggcagtgccacccgtttcctgccaacccaggacccgtggagaccaggatcagcctctagcatccctggggcagcaggagagacccttgtccctcctccacccacacactggggatccccatgcctccctcatagcttgtgaggagccaggggtccggggtcaaagtcagatgccacgagctggagaggaagcgtcggcagacgtcccctgggtggggtcctggggtctgcaggtcacgtggagaaggcacagcaagaacaagacctaggccagacggcagcgtcagcgcacgctccacagcgggcttcccgcagctctgcacagcacggcgaatttccacctaagtgtgtccacggagcctccaccagatcaaagctggagacagccccagcttcccagacagcctgacgaccctcaaaactgcatttaaaaaccactgtttcggtgagtgggtgaatcattcacatggttcaaaattcaaaaggaacagaatgatgtcgcctggaaatgcgtgtcctgccccatcccagggactcagggtcctgcacctgaaacggcctttgcagaagtcctgtcagtgagacaattagaacaccaacctaagctaacccagcccccatcctgcccttcccttaattattcctgggctattgggccaagctaactttggaagacatttaggctacagtttaaatgattgataataggccttgccccaaacctgcttttgtaaagctaatgggaggcccccaggcttccaggaggagggaaccagagaccttataaggcgcagacacaaaggatggtcggccattatcccggaggttacaaatatgcaacttcccccattactcctgcaagtaacaccaccgctgtagatggaagtatcttctgagagatctttccaggttttttgcatgtctgacgcccacagctccactcagaccccatggctccacctggacctacagccccgctcctgtggccccaccagaagcaattcggctgcaggaggaaggcttccacccctgtgatttcatctccaccccaaccaatcagcagcaaacatctgttacctggccacccctacctaaacccctaatctaatccggttgcggtgactcacgcctgtaatctcagcactttgggaggccgaggcgggcggatcacaaggtcaagagatcaagactatcctggtcaacaaggtgaaaccccatctctactaaaaatacaaaaattagccaggcgtggtggcgggtgcctgtagtctcagtaactcgggaggctgaggcaggagaatcgcttgaacctgggaggtggaggttgaggtgagccgagatcgcgccaccgcactccagcctgggtgacacagtgagatccgtctcaaaaaaaataaagaaataaataataaaaaattgtcacaaggctggccatgccacaagggagatggaattattactcaaatcaacctccctgaaggcatggaggttaggggattttcaaaaactaaatttctcccaaagctagcttggcgcacgcccaggaatgaaggaagccagccagcctgcctgtgaggtgaggagcaagatggaggcagccatgtcagatttctcttcctgtcataattttgcaaaggcggtttcaggacagggcaggaagttgtctgtaaccagcaggtgctcgacaatgaaaaaaggagagtaaggccacgcacagcatctccacatctaaagtcccgaggaggggtgtcctgcagcgggggcagagggagagaccaccaggggccctagaaggggcagtgcctcgtgcagctcagcaaggaatccatcttcatctccacagcgtggaactcagccagtcccggaaagccctcccgtgtgttctggaaacagctcactgcaaacagcccccttcgcacaggactgagatgagactcgcggctgccgggtccgcctaggagaaggccagatcacggcctcatcagcgattccctgagctgttttgttcccacagaagcagcagaacaaaatgcttgtttaaaaaaacaacaaaaaaagcttgttcagcttctctgcctcccccaaaccctgaactgggagaccccccccagcctagttccccctgggtcagcctgtaaccccaccttagcccctgagactgggctggccagggggaacctgctgtatctgctgcccctcaggccccctcacgccactcccccaccgattctttccagccctgctccctctctccgtcaaagaaaacccctttccctggctctggaggccttgtaggccttgtaagttggagtggtacgtacccctactgtgaggcgctcccccaagccctgcaataatccttttggaataaagttccccttactaaatccggatttgttttttatttgacaatttcttctctgtggaattctcggctcaactcaagggacggagccgagcttagaaataaaacaggagcagcgtcaacagaagatgtcaggagtgggggcctcgtttctgcgtggtgaattctgagaccagagcacaccgtcccaagagggcagtggacgctggggaaagtgtcacggccgctgaaggagagggagggggccagtggaggatccaggctccttctggcccctggctgcctaaagatgaagcgtcgccctggcagcgtttgaaacacggtcattaaggagtgaaatcggcgcggtgagttgtgcaggagaacgtggcgaaacctccctggagacgaagagccccagagcgtgcaacctctccgggggagtctgggtccaagcccaccgtgtcctcacccagacctgcccacgcctctctcccagctgtcaggagttgtcaaggggattaagcggattctctttgccgttcatgggaacggcagcgggattagctggggcctcctaccgaggagggggtgggctcgggttagcacagacgacactcagagagcttggaggggcggtgaccaaagaggtaggtcacagccagataccaaggccttgactttggggtctcattttacgggtaagaaccctcccttggctgggggtgaggctagggccacacacccattccccagccagcctttgcagaggtcaatgagaaagaggcaaattctggaacctttcctcaccctctttgacccagagaggatttaatctggaatgaagctggttgagactagttttgtgagcgatctgtccacctggggtgccggtgtgttttacaaggctggctttcatggcgcagttgagttcccacttgcagaacatactcaccctgtggctataaggcaaagcgctggggcttgtaggcactggaccccaagcagtgaacaggtcagtgcagggcctgtttggtgtggctgcacaagcgcgagaaacaggaatgcaggcgtttctggctggagggagaaggttggatgagtgtaacagcaccttcggggtgagggtttgcatttccgctggagacgaggccaggtgtcttgcactcaggttaggctgtgaggaattgaggccaggcccagaaggagggtgggatggaagggaggggccgtcatgtggatggtgggccaggtgtccaggcccgccaggtgcccaggttggagaacccggattctccatgtgtgcgggtcctccaggtgcccacgtcctccaggtgcccgggccgtccgggtgcacaggtttgtgagatgctcccactgtgtgcttcctaccgttttgcatccaatgcacatggatgcactcccacctctcggctcccctggatcaccccaggcaggtgaaggaatgttttggagccctgttttctcctccctgagacagggtggcacccggcctcctcctctggctgctgcaggctcagttcactttcccacgctggaccccttcaggccaagcctcggggagcacagaaccatgggacagcggggatccaggacccccagaaatccggctggaggagcttcagggtgacccctcctcccctgtccctcagagcagatgctcctagaatgctccttcttagagcaagtgaattagcattcccaccaaggctgcccagaatggggtaggggcagggtgtgtggggaccagcatgggcaccgagccttcgtcatctgtggtctcagtggcaggcgggcagtgccagaagccccatctccatccactgtctcccctctgtgctctcccaaggcgtggcccctccccccaccatctcaccatctctgcagggtttctgctgaagaccaaggacttacaggctctttagaggccagagaggcaacctgtgtttgggacagttggcggggacccagcccaggtggggagtgaccagaggacacccaggcagagccactgctcccttggggactcctgggccccctgctcttcccaggtggggagtgaacagaggattcccaggcagagccactgttgcctctggggctcctgcacccctgctctgtccagatgttggcttcccaccctgcccgggctgggacccctgttcacctccctccgctattcctgcagcctgtgaagcccatgccccgcggtggttttggctgactccagggcagggttgcctcctcctgtcccaggtgtgcagctcgcacgcacacagccggcaaacacagcgtggtgagctcaggaggattgtctaggatgcaggagtcacaggaaggggtcccagcctgcagcccaccctcttctgcatccccctcttcccaccaccgccttctcctccctctgctttcctctgtcctccatcctcctctgcacaggaagcctctccaggcccgaaggcagagttgctggagctgttgcttgattagggccatggcccccatcccctggccaggggaattctctctcctctccccgtttttcctccacacttccctcttccctccctgttctctccctctgagctgggttaggctgatgggctccgagcacagaggcagaagcatattcatttcggtcctctcaggggccaagacccttttacatcggagctggagaacgcagccacccgtgggctagaggaggggccggggcgccccagaactgaggcccccgctttccaggccaatgccctccttccttctgtttcccaccctttcccaccccgggggtttaatgtgcgtctccatgcactactatcggcagttcccagcaggtcataagagctgccccggagttctgtccagtgggacctcacggggagacggggttccagcaaggagctctgaaggagggcgaggtagcaggagagggcgggccatggggagacccgggctttctgcaatgagggggcggtgagaggattggtcactggttcctttaggaagccctgctttcttggggagggcgcacctgacaggtggcttcattcgaatgtgtttggggctcccgccccaacaaacgcacccccctcatcctctctctgggggagagggagctgccacacaccattcgtttatgcccgccatctcccacggtgctcaaggcatcgaagcgccagttggagggagggcagagcttgctgggtccacccgggatgaggccgggacatacacagcccctttcttggcctcatcaatgattctctgagctgtttttatccccacagatccatcagaacaaaatacctgttgactagacttgagttcagctcctctccttcccgcaggcccttaacctggaccccctcagcctgggccagcccgtgactccccaccccctgagacagtgctggccaggggaagctgatttgttgtccctgaggccacccaccccacccccgacacaagaacaaagaacaaggttgaattctttccagccttgttcacatcccccataaaagaaaacctttggccaggcaccgtggctcatggctggaatcccagcacttggggaggctgaggccggcaggtcacttggggccaggagttcaagaccagcctggccaacatagtgaaaccccatctctactaaaaataaaaattaaaaaaagtagccaggcatagtggtaagtgcccgtaatcccagctactctggaggctgaggcaggagaatcactggagcccgggtggcggaggttgcagtgagctgagatcacaccattgcactccagcttgggtgacagagtgagactccatctcaattaaaaaaaaaaaaaaaaaaaaaaggccgggcgcggtggctcacgcctgtaatcccagcactttgggaggcctaggcgggtggatcacgaggtcaatagatcgagaccaccctggctaacacggtgaaaccccatctctactgaaaatacaaaaacaaaattagcctggcgtggtggcaggcacctgtagtcccagctactcgggaggctgaggcaggagaatggcgtgaaccctggaggcggagcttgcagtgagccaagattgcgccactgcactccagcctgggtggcaaagcaagactccatctcaaaaaaaaaaaaaaagtctggattggccaggtgctatggctcacacctgtagtcccagcactttgggaaccccccaggcaggcagatcacttaagcccgggagtttgagaccagcctgcctgggcaacatagcaagaccccatctctacaaaaagttaaaaaaaaattagccaggtgtggcggtgcacacctgtagtctcagctactcaggaggctgaggcaggaggatcacttgaccctgggaggtcgaggctgcagtgagctgagattgcaccactgcactccagcctgggtgacagagtgagaccctgtctcaaagaaaaacaaaaagtctgggtcgggctttgattttgacattcccctacctgtgtccacctccgtcgacagggctggacgttggtccctgcagtggcctggccggtctctgggcacccgtaactgctgcagcccagaagggagcccctcccaccttcccgcagacctgcgccccacccaaggggcccggccgccgctcactcggggcccccgagctgagatggggtgctggcttcattttttttcacctcttccacaaatactgaccaaggcttttgttcaaccagaccctggaactgggggacccagtgggggacagggcagatgacctgtcttcaggaaccttcccggggtgggggtgcacccatgggtgactgcaagaacgctaacaccagcactgcgggtgcagaccgtgctctggggggggacaggggctgggtcagggcaggcgtctgaccatgaagggtggcctggagggagagtgatccaggctaagtggaaggcagtggaaagccccgggacgggggcggatgggggtgcggggcagagcttcggggactccaggggcccagcctgactggaaaagggagattgggcagggccagggctggtggggctgcagctctgtggggcgtctgcatttctcttcaagggcaggaggagcttttctgactggtgttcggcaggggactgagggatgaagaacaaatcagggtttttaaaggagttgacttgaaaaggttgcaggccgagcgcggtggctcacgcttgtcatcctagcagtttgggaggcctgtaatcccagctactcaggaggctgaggcaggagaattgcttgaacctgggaggcaaaggttgcagtgagctgagatcataccactgcactccagcctgggtgagagtgagacttcgtctcaaaaaaaaaaaaaaaggttattgcagcaccgaggactatcgcaatgggggatctctgctcccaccacagggtctacaaggagctccagggttaggcaaaggctttttgttttttttgagacggagtttcgctcttgttgcccaggctggagtgcaatggtgcgatctctgctaactgcaacctccacctcctgggttcaagcgattctcctgccccagtctcccaagtagctgggattacagatgccccccaccatgcctggctaatttttgtatttttagttgagaaggggtttcaccatgttggtcaggctggtctggaactcctgaccttaggtgatctgcctgccttggcctcccaaagtgctgggattacaggtgtgagccactgcacccagcctgggttttttattttatgggggtgtgaacaaggctagaatctgtgtggggagttgggcgcggggcctgaggggcagtagatagaggggttccccgggccagcctggtctcagggagtgggaagtcacaggctggcccaggctgagggggtccaggtcctgggcctaggggagggagagcagccgagctgggtttggtcagcaagcattttgttctgatggatccctgccggtcatcggcgaggtcaaggggactcagggcctgggctgggccttgccctaggtagacccggggtgggggcatctctgagtctccctcaagtcacatgggaagaggtttctctgcacaagcagaacacaggggtcaggggtttcttaaccttcactgtttccaggagcccaaggctctttgagctccatgttggcaccaagcatctcgaaggagccagctgggctgggggccaggcgggctggcagtcactgaaatgccacctgggagggccgccgaggctgaggctgctcaccatgctggtagcagcacctgcagggctggctcacctgtggctcccagccccaccctcggatatcactcagcaggcccccagggagtccccagatgctggtgcaggtgtgttggggcctgtctcaccggtgacctcacatggccagtgtcgggggtggggcagcctgtgagttctctccttcctgtccctcgacaagcccaccctaacggtcaagtccgcaaaggggtacgcacctgccgcagggccatccaaggtccccagctccaaaaattgctttccaaattccagctcccttagagggcagccagttctcaattgtgagggggtgagctattggattaatttgcctttgaacagcactgagaggcctgggcctcaacttcccagtagtgaagacattactacaatgcgcccgaatccttccagaacccatgggaggtgggtgggcccttcctgcctgggtggtcagagtggggggctcacacagatcctgagccagggctctaggtgaccctggttgctgcaaaggttcccagctgcaccccagaatgccctggtccatcactgggcaaggtctccctaaagaaagggctgcggggaggggggtgcccagcctactagggaaaagccgcccaacccccagtcccaggagacctgcagccaggaggcctctttgctaataccctgtggagctgactgctcactccagtgactttgtatttctggagccctcccagctcctcgcgggactcggtggctccaggataagactcagactatggggcccactcagggcctgtcccccacctcccgttcagctgggactgcgtgagtcctgcagataggagcagccttcactggatccaggacggagccctatggttgccttcccaccccgtgctgggaggtggatgaggggctcatgctctgagccccggactcgcccccttaactgagaggctcgggagtgtcctgggaacacagaatcggtgccgcttcctctcctgctctgatcccaggctggagaaaggcttccttcctgacctcccaggagctggagccccgcatcctctcagcgggtgacccccaaacccctcccaacttcacccctgcagctccctgggactggaaccttccccctcctccccggtggtctccacctgaacatccctgcgcaggctgcctgccccccactcccgaggcagatccgatatcttggctcggcacccccaccctcgaggggtgcgtgctcacatgtgtgcaacccgcccatggctcacccccacccagcggcctaagtgggctgtcggtgaatgaatgaatgaatgtgtgaaggtgggaaggaatgaggtggccaagagggggccaggaacgttcctatacacagaacctggcgcagaagaaaagaacacagaacatcagcggtaggatgattgagtgtttctttaaaaataaaaaccccacaaaaaagccagaacaccctacccaacccagcccagtgtaacaggttagccattaacacagaataaagaaggtcccagccacacacgtcattactcggcagagggtgtccagcctggtcggccgacgtcacagtggatggccctgcgtggctgggacacagacagggagcaggcatggcacctgcgccacgcagagcagcaaggctgagcatgaccactggaaataaataaacatggtgccgacagcatctttaaattagtaagacgttagcacaaaacaaaaaagcacaacgactgaaaatgcacttgcttgttgtggtgggttgtgcttgaaaacacctgaagcccacaagtggaaaccgctggggacgtttgtcagtggagtgtggagaaaaagggacggaaaaatcaagtcttctgagacagtcccctgcggtggccctggtccctgtggaattccagcacagcaggagggggagggggaagcaggcctcagtcagcaccgcgggacacggcccctaccttctgaagtggggtccccaggctggagtggggcacacagcaccaaggatcacagactggaccccccaccaaccttctgcggaggagctcccaccccagctcagacgcccagaagagacctgcgcagtgtgaagacggaccccagcggccccagccatttcactagcagctactttccacaacagacgctggcagcccccatgctcgcccacagccgcagcagccaacaggcaagtgcgtgccgtcgagaggccgccggctccctgtatccttgaggcatgtccacgtcccagagcaggaggttggaacagaacggcatcccgaggacccctagccgaggcgggaaggtaagaggctgacgtcgtgcgtgggccccgccggccccagtgggaagcagtggtgcgtgcctccagggagcacttctcctggacccggggccgtggctgcctacgatgtccactgcctcctggattcacacagcaatgcaccaggcaggtggggcaccagctgctgtccttatttgcagccaagagaacaggcccagagggaagaggtcttgcccaacacagtcagtccacctgcctgctggtggtcctcggcctccagaccgtgggctgtcccttggacgagtggaattcgtccccaggaaggatgcaggtcctatgagcagacgctgtgaagtctgtccatgtgcagcgggaagcaacggggcaggggtgaataaaggtcttcattcctcaagcaagagagacggacatctggtcctgagtccccaaactgttcatcaggtttctccgggcccactggatggtgagggggtcccggtgcccaggcgggggcggcaggctccactgggcacttgctgagagcttgcggcttgagcagccgctggtcagtgaagccgtgtccggcttcgttggctcccggcttgggacactcagggctgtgccacaggccagctcctccagccacagctgagcactggagtgacgctggaccacttggctccacctctggctggggagaagggaagcccggggcctgagaaggcagagccccccgagctcaggagggatcctgcggggtcttcttgttctgggggtccctggctgctgccatggaggcagcgacagctcaggaaagtgggccgcattggccaggcctcggctgcctcccatagcgaaaaaaattcacgggaacaacagaaacaaggggtgccctagttccctctctgcaggcgggtggggactgggtgagagcccaggggcctccaaacgcaggcggcagagacgtgagcagtgcttggctctgtctcctagacaacgggcatcaggaccaggacaggacatgagcgtgacagggagagcggggaggtgcctaggccgggagtgggaacccagcaccggccagaaggggctgccgggcggtacagaggccaatgcattggaggctgagggtagctgcgacctctggggcaggggacactgctgtgtggagcccagggtgggcgcccacatgggtgcctggccgcggtgtgtctgcctttcttgtctctgtttctagaagactgaaggacagggctttgtctgcatgaaccagaactcagcctccaaaactggacacagaaatagccaagaggccacactgcccagaggccaggcctggtgagctaggggagatgccggcaccccccaaccctggggctgttccctggctcaggatggtgtctcggggctaggattatggtcaggagtccatcggggcctcaagcacctcctgggaggaatcacccaccttgcccagatcccccaccccctcccagtgccaccctacggctgagtttccactctgcaaaccctaaggcagagacataagcccacagggttggttttcacgaatgtcacaagcccatgtgtctgggcagctgtccggcttcagtgcaagtctgtggtagcaatgaggttccaagtctcagtagctctgtttgcccagggtctgggcccttggggcaggagaaaggaaggctcctgccttcccccagctccttaaaaaatcatcttagtggtgtcaagttgacccaaaatttaagtttaaaaaaaatatatatataagtaaacaaaggagggaagggaaaaagggcccaaggagaccaaaagctgctcctgggcaggagcacaggcacacctgggtccctggccctcagttgagggatgagattcgtaccagagttttcacagcagcctccactgcccgacctgggagggacggcgagggactgggatgggcagctgagctgtgggttgcggggaaccggagtgggttcgaggaggtgatctactttaactggcctctgcgcatgctcctccggcagccactcggcctcctggctatgtctcctgggggaccacctgcatgagcttctgacacaggacggtcgtggagactgtcaggagagaagacagctgtgttagcctgggggctgggtaggcacccgtgggacacgggggcgtgagctggggctcccccagccctgctgtcaccaaacccagcgccgctgcccagcgctgggattttaaggaaccttcccttgtgtacttgcgcatgtgggtgccgggtgcccgaggcgctgtcttcaactgaaatgcggaagtgccacatcccactcggcccacccctcgcctgcttcagaaccctggggaggcagagtgcggcccctggggcacacgaaccaggccctggtgtctcagcaaagtgcaacggggggatgacaggccttcctgcaggtccacacccgggccaccacctggacacatgcctggactgttcacagcaggcagggccggaggggccaatctgctaacgggtcctcggaagacctgtcgcgcctgggactgtctacagagacatcactctgtggagggggactgctttcaggatagagacgggggtttgctttaagctcttggtgtcctgaatgacagttaatgcagatcccactgcaaagcttgaggcaaatgttctaccatgaccctggcggtgatcagagtgtggggtaggggtggggggtctccctgcctgtgttgctgccatcccgggaattctccaagccacccagtgacatggggatcagcatgtaggcccgcaagcaccccggcctttttctacgagcctggccacatttgcaggcgctgaggacggggtcctgagcttggtgacaaagcacccctggggctgccgctgcacacagggccggggggcgggtttctccttctgcctttttttttttttttgagaagagtctcgctctgtcgcccaggctggagtgcaatggtgcgatctcggctcactgcaacctccgtctcccgggttcaagtgattctcctgcctcagcctcctgagtagctgggattacaggtgtgtgccactacacccagctgatctgtgtatttttagtagagacagagtttcaccatgttggccaggctggtcttgaactcctgacctcaagtgatccgcctgcctctgcctctttctgcctttctgggtaagtctgctgtgtccgctggtggcagccagcaggattttgttacttggcagcagtagcctggttttccggaatccctcgtcctgagagattagctggtgctgcgctgtgtgtcttatccctgaaccatgtgggctgcgtgtcactggcggacactgcagtgacctgaaccctcctgccacccaacacgcttcgccccatgtgggtggagacggccgacgcctctcaactcccttcgctgcccagggcagagggtaccacgggctgtgggccagcgagatactcacagatgccctggaggagccacttgggcttgtttttccaccagaccccgaagaagtagacgggcagcccgctgaggatgatggtgaagccgatgccacactccacgggtgtcttccagaaggagacggcgatcaggaagaggcaggccaggatgaagaacacaggcagggccaggttcacctggggcagaggacagggcctgggtgagccctctcctgtccagcctccctcccccatgccccgaggttcctcagccctcctgggccctccacacccacggctgctgacttccaggtcaccaagatgcgatctgcactccatctgcctcacacaccgggctgtcccgccctcgactctgcatacagtgctgggcatgttgccaggggctcaggcggcttatgatgagggatggaaggagacagcttcgtctcccgaggcctcccacgggcagggaaggtcacggctccattcccacatcacaggcctggaaaccctgagccgccaggacgcacaggggcctgatgcttccaggagacagtggccacccactaataagccaggagaccaccctcttggagacgccgctgtggacagcgctgagcaaaagcccatccctgaagctgcagcctaaactgtcaccttcagcagatgagctccacccggcacagaagccaggcagggctgcaaggagcctgcaggccgcaacctgcggctcggcatggctgggggattgactcagctgtcctgaatccatacttggacagggcaccctgggagatgcagggctgaccacaggtcccagcccatcagtgtgggctgcatgactgccctgtccccagggaacagacgccaacccgtgcccaggctcacaacagtgggtagagcctaccccatgcccaggtccccatgggggctgagcccccgctgtgcgcagtgactgccctgtgccctaggcactgccccaggctggcacagcaggcacaagctggtgcccatgtagggcggctcctccctgccctctgcagccttctcttggggcagcatctgggttcttgtgctgactgtattttaaagcccctgttttttttgtttgtttgagacggagtctcactctgtcgtccaggctggagtacagtggcgcgacctcggcctcccaggttcatgccattctcctgcctccacctcccgagtagctgcaactataggcgcccgccaccacgcccagctaatttttttgtatttttagtagagacggggtttcaccgtgttagccaggatggtctctatctcctgactttgtgatctgcccgcctcggcctcccaaagtgctgggattacaggcgtgagccaccgcgcccagcctaaagcccgttcaacagcattcacaggcacccccggggcccccaggcttcgggaacacagagggagagatggtccgggcagggaagcaggggctactgtgacagccataggccagctgagtgacaaaagctgctggctagcagccaccaggggctctggcctcttgttctgtgtcagggccagggcggcgggacttgctgggccccaggcaagagcatggcctctgctggacggccccgtttttggagaaggcagcccacggataacagctacccctctgaatgagccgctggggacggggagagtccaggagagtccagctgggcccaggcgctcctcgggccgggttccctgcattcctcctgccagcacagccccgacggccctttgaatgctgcgccaggcccggctctgccccgcccctgccggggctcaccaccgcccacctatgactgcagtgtccttatctgcttccctccacccaacggagcacaagctctgtgccatctgctgtcctttgaggaaccccggctcctgcagtcacacttggcaccctcgtagctggtggtcaagtcatcaccggaattagtcgacccaggtgcatgcaggcaggggcaggtccagaggctgagctgggatgctggctcccaactcagggtccttaggacccacggaccctgcctctgtgaagggtgcctgggtgagcgggaggccccgggctcaccttgatgggccgctcaagctcaggctttctgtggcgcagccagatcatgccgatgatggccagggccacgcagagccagttgaagaagctgaagaagttgatgacggagaagatgtccttggagaaggcgtagagcagcgtcatcacacactggaagagagaggcggctggctgagccctggggcccacgagcagggctgtggacggccgtggtggccaccggggactgtccagcctggctgggcccagctgagcaccagggaattttgttttaaaggagaaacctcatctgagcaacatgcaaggtcttgaaggaggaaaggagggaaggagggaggagaggaggagggaagaggcggggaggagggaaggagggaggagaggagggaaggagggaggagaggaggaaatggagaccacatttgggttaaggacaggtgaagaacacagtgtacatacacagctgggctctgctggactgtggctctgtgtgcgagggccacaacctgacctaacccagtggtcaccaagaaaacagtttctgtaacccccggcacagccgtgctcccgaggaccgtgcagctgccaaagagtccaggacttgctgcccttcctgactggcttctaactcagggaaggagtagtaagcaagggccaggacctctgaggccagcccacagctgccagaccccagcttcctctgctgtatctcactggctttgggggaagcagcctgttgggggagcccagtgtgctcaggggtggggcctgcagcccacagccctggaggaagccactgtggagtggcctctccagccctggtcacaccctacgatgagaacacagcttcaggcaccagctccctgaattcctgacttacggaaactgtgagataataagtgcttttccttttagaacactacattttggagtgatgtgtgacacagccagagggaacaaaggcagtcacgcgggctggcacggaaagatgcaggagaagcggaaggaaactgtgtgtgatgcaccccgctgagaaacgaacagagtgggcgcccacggaggtgcagtgagccaggcggctggcagagcagcaccccgggtcagcttctgcctcccgcatttccgatggtctgaatcgtttgtggcagccaccatatattatttttggaataaaatctaaagcccctccagcgctctctggcattcagcggagctcggcaggaggccacatttgagctgtcacccagtccacaccccagacagagctgcaagctgtggcagcctccctctgggagcccccggacaacccccagggatgtagggcacagggccgtgcagcaggcttaccgtgaacacgagggacggcacgggggtgaggagctgtgggtggatcatggagaggatggagggcaggtggccttcccgggaccccacgaagaagagcctgtggacagacaagagtggcagagtcagccaccgccccacaactcagcacgtggacaggggacacgcaggctggggagtggcagggcctgtgcctggcttgtctgggcctctctggccacagtgggaaccaggcccctccagccgctggctgtgggcctctcagttcccccaaccaactcggcaaggacagcaacttgggagccactgctcactccagcccggggggtcaagcggcggccacagggcatctaggacaccacagctgtgtcacctccaggcaggagtggggaggcgagggccaaagttcatgcttcctttatttctgtattatttgggcttgctgctgccttttttttttttttttttttgagatggtctcactttgtcacccaggctggagtgcagtggcaccatctcggctcactgcagtctcaatcttctggtctcaagcaatccttcgacctcagccccccaagtagctgggactacgggcacgtgccaccacgcctggctaatttttgtatatttttgtagaaacggggttttgccatattgctcaggctggtctcgaactcctgagctcaagcgatctgctcacctcggcctcctaaagtgctgggattacaggtatgagccaccatgcctggcctatttgagcaattatgcatccccagtatcacagagacaaaccttttacagacatggaacatgttgaacctggccatgaggcctgggcctccctcacctgtggtgggtcgggctgtgctcacctggaggatgtgaacagggacccattgacggagccgaagcaggacaggcccacgaagacggggatgatccaggacatgacgcccaggtgatagttcccgaagtcctaggcaggcacaaccagtgagctgggccccaccgggccggccctcgccctccctgtgctcactgggagccctctgcaccgggccagccctcgccctctgtgctcacaagagccctctgcagaggacctctcaggctggattctggcctctggggggacttcccaggacagggctttccagtgacccctgcccagcctgcttgttggggagcccttgctggtcctgatttgccccctcctctgggactccctggagcaagctacggcctgcaggtggggatcttgccttcccccgtggggtcctccacaggctcagcacggtgccctgccggcagcgggctgggagtcagagcttgttcagtaggaagctggccagagcacccactccctgttcccccagccctgggagggcagtgggagaagcctcgggaactgcgaggccagcctggctgagctgcccggtgacaccgcccgggcctggcctcccgcctgccaagccagcagcagccgtgccttctaacgaaccccactctgtggcagactccaatctttctgtactcagatttaaaatgacctctgccctggactccccaggcattctggcttatagctggttctgggtgtggcttggtatcagattttaaacccttctcccctttgactcccccagcagctgagcttgaggatgatccccagacacttcctctgcggtcgctgtgaggggagaccaccactccacccctccgggtaggggaggcttagagacgcggggccccctctgcgtaggggaggcttagagatgtggggcaccactccggtctggaagggacgggctggccacagcctctcaggcccctggtggaagctggcgggtagcggctcaccacggccacggcctcggacgacagcatctgctcggtggacagggtggtgaagtaggccaggttggtcagcacgtacaccagcgtcacgatgggcagggagatgatgatggccaggggcaggtttctggaaagaacagggacgacatgtcacccaacgcagcccgggctgaaggccaaaccctgtgcccaggagccaggtgggctcctcgcaagcagtagctccagcctctgtgctgggcttctcggggaaggtgggaagcagcaagagaacacaggctggcggcaggaggctgtgcctggagcgggacactgcacagccctggctggtgccttggccgcggcctcagcttccccacctgagaaatggggattcttcggggtgacctcaagggctcaggagagttaagtcaggccacctggtctgaattctaaggctctgcccacgagctgcacagccggggaccagagccgagagcccaggcagctcctctgtaccgtcccgccctgagtggggccctcacttgccacccgttctctggagaaaccgtgctcaaggacacacggccagaagccacccgccccacatcctgctggccccagaggccccaatcacggcccgactgtgaactggcctgagccgaccaacaggcttcgagtggaatgtggctgcttcctgcctcacattaaaataatgaaaaaagacggctccatccattcttgcacgtacctgtaggggttgatcatttcctctgtgacgaaattcaagtaattcctaaaatttagagaacagcgttcaaattatatgatcctcatcagggaaaataaatcaccggggagagagcatcccagggcagctggtgagcctgccccccggtggtctgctcgctgggctggaaagcggacctggagtgggagggagctcagcctcctgcgtgttccggggggtccctgctaccccttccaggccctcccgcacattccctgcctgttcgccctactggggtgattctcaggtccctgtgaggcccgcctgagcgcaggagtcaggctggggacctggaggaaaggggccgcagggctcagccgcctccacctgccaccttcgccaagactgcgacgtggagctagagccagagtagggctgcagcgggcggcctccccacgcttcgtcgggatgtgggtgactctggagggtcacctgccactctttaactgccaaggggcagttaaagggaggggcagtccactccctttaactgccccttgatggctgggagatttgggattcctggacacgtcagggactgtatgtccccagaccaagggacccagacattccagaacctaccatcctccataggcaaagaggccgctgtataatgccagcacaatgttccccacatccagtttggtgccttcaaatgagaagttgggatctagattggacacatcacctggcagggccaaagaaaggaatgctgggttagagagcgctgaacagaggtcatgctaccagttctagaatgttcctggagcaaaatacatagcaaacaaaaatgctggagtgaaggcttttcactgtgacaaatggtatgtacctgctgagccacatggagggtgcagggttccaaccacaaccagggggatgtggccctgccagaggccctgtgcccacctgagagggcacaggcagttctgaccactgcccaggagggctcctcagacgcttgtctacaggaggtcaggatggaggggtcaaccagccccagttgccttcaagaaggttccctgagacctcacgacatgagtgtcaaggcagtataaagccaggagacctcggtttgcatcctggctacggcaacaaggaaggcccagagccactagggccctgcttcttggggtgcgaggagctcggaacagactgccctccctccagggctggcaggacaggcctgggcaagaacataggtttgtcctggaccgtgctgagtgtgtggccagctgcagccggggcaggggcaggagcagggctgccagggccgagaacgatccccgtgctgtgtgcagagctctctcctttgccctctgaggacacgcgtcactggacttcgtgactgctccaccctattccagaaggacctcatttcaaaacttgaacttcagtcacatctgcgaagaccctttttccaaataaggccaccagcattcacaggttccccaggaggacatgtcttttgggggaaggggtgtctccggaaggtcacgtggctgctgggacagcactggccctttctgtggctgttgcctcctctgtgaaatgggcctggtgtgttcgagcccggaatatattgcccagacatcagtctcacagaccactgcgcttcaggaaggagaacttggaaagaagaccaaagacaccaccggaacaaaggagccgggtcccctcctgcctacctgccaggtgcatatacagctggaggcacaagtggaaatcttggtcaggctgtggactgttagttcattagagaaccgtgtgtgacagtatccttcctgctggaaagtcaccagcccgtctcacagggccaggcagggacgggccctggggctgctgtgtcccaacatgtggccttggaccacaggtcaccatgggggcccaagaaggggaaccaccttggtggtccagggaacaccgcagagtgacgaggtgagcaaatttcaaaggggacccgtgaagggaggttcccataagaccttggcaattaccccaaacaaagtgcgcacttcaaaggtggcaccagatttcctacggcagagcccacggtggggtcccttcctgatgggtggacccagttcctgttttgcacctgcttccccgtggcgtgctggatgcctgcggctctgcctccagctctgtctgtcccagatgccaggtgtgctggggcctttgatcttcagcctacactgggggtgctggtgggttccctgagggctgcccgccaccctgccctgctgaggccttgatctcctgagaaggagctccagggcccactgcctgcgtgtgatgtattctggtcaccaggtggtcagcaggcggagcttgactctgcaggcctggagcgggggcagctcagagcagctcaggacagggcactttgcacagcacctcggcacagcccctctggcctctctcccatctgctctctgatggaatgttctggaatgtgcagacccttcacatctgcatagccctactgtgtctcgcccacttacttctgctggggggagcatctgtcctacaagtgggggaatgcagacctgccaggctgcttgagaatcaaggtcctgcctcccccatctggcactcatggtgggagggggtgaaggtgagccctggaggccagaaacacgtgccccattcactgtgaccacccccggactcagcctgagctgatggacaggaggcctcagtccaaggtccccgccagacacatcaatcctcatagctgacctccagcctcatgacagaaaggcggctgatcctacacagagggtggctgcttttgctaaggacaatataccgaggcttgacatggtatgaggtcttcagtcaggagccagatattggcagccctaaggcctgagtaactttttttttttttttttttttttttttttttttttttttgagacagagttccaccacgcttggctaatttttgtatttttagtagagatggggtttcaccatgttggccaggctggtccagctctgcttaagggtggcctggagggctgcaggagggacctgcttgcagcccagggcagctggacacagggaggtcaccacactcatccagtgactccacgctacacacaggggagagacacaccagaggtgggagttagacagcgttcaaaccctgggggcagcacccctgtacctctcagcatgaccagcgggcattctgcacaccgggagacctgggctgtcacgacggcggggtgcggcgctactggcacggagcaggaggccggggatgctgctggatgtcctgcaatgcacgggacacccccacacaacagagagcccacggtggcagaggtgccaggctgaggccctgtgcaagaagaccatgacaaggcatcagccacgagcctctacccctgccgggaggacaggaccagctcctctcagctttctctcccatggaccctagactcgggcgtggtcctggcttcgacatgaagccccaggcactgggcaggactggaaggaatggctgagcggcccactcatccagcagccacccagcctccacacctgacagtctgctatccagtcagcctccacccacaaggaggggacagcgtgacagggaagtgaggaagagaatcaccgtggacagacggtgacatctgccagagcccacagagacgcgagaacagactcagcgcagagcctgagtggggccctccagccccttccttgtccctaagaggcatcttcctcaggggctggtggagctgccatgaaagcaaacgcacagccaaaccccgggtggggggaaggcaaactgcaaacgccgcggcgaccccggcacagcagccctgtcagcaggattcccccgagagcggggtaattgcggtgggaacgagcgctccaaaggccctggggagatgatttcagggaaaagtggccttgatccctgagtcaggcagatgcggccatgggaaccatccaccccgaggctggaggggagactccgccggtggctaaagccatcctgctgacggggcccagggacgcccccagtggccaaacgcacgtgggaacgggatcttccccctcctctgtgatgcggccaaccctccaagcctctggctcctgactcagaggacgatgtctccccatgaacgcagtgtccctggagagaagagcctgcccagcgtggggaacatgggaatgtggagatggagggcatcccggaacctcagggctgacgggcccctgccccagccctggaaacacctcagggacaagagagtcactcctcaagcgcggactttccactgtgctggggccttccgccttccaaccactctggccccttggggctctaggtggagtgtgctgaacagtgtccccaaaattcacgtccagtggagctgcgggatgtgtcctagctgcaaatgcggtctccgcaggtgcaattagcgaaggaccttgagatgagatcatcccggattagagtaggcactaaggccgacgacaagtgtcctcagcgacacagagacagatccaggggagacagagccagagccagcccaggatgcctggagccacgggcagctggaaggggaaggtggcaccttgggtctggacctctggctgccaggaccaggaccgtctgcatgtctgttgctaaagccagtctgtaggcatctgtcaccacacatgaggggccaaccgtgccacccaggggagacctcccggcttctcagtgcatcaggcatggtcaggggcaggacagctgcagctcacaccccacttctcagtcaccagccgagtgcacagccaatggcacctcatctaagagggggctgtgagtcccatgtggtcagcaccctggagctagctgccctgtgggctcagggaagtcgtgcagtgaccgccacatgggttcagtccagagcccaggccagagtccatgcccaccccacagagtccacgcccaccccagagtccatgcccactccaggcagagtccacgcccaccccacagagtccacgcccaccccagagtccatgcccactccaggcagagtccacgcccaccccacggagtccacgcccaccctaggccacggcgccgcttttcagatgcctgtttcgctctggccatctaatgcctgggaaccgtgatggggcaggaatttgggtttgggggttctggcggcaaccagatggcacttttggaccaccagcagtgtctgtcggtcttggaaactcatgaaggagtgggccctttgcttagagctgccaacctcacaccagaagtaaaagctttttccaactccacaggcggggaaagaccctgagaactgtccccagcacagggctgtggctgccctggcctctgtccatgcgtctgacgaagggcaccgggaggtgaaggccgcgggaaaacaagccccgctcccgtcctttgattctgtcccagcacacggcaccggcagagccccagcttccccagcctgtcatcctcccgaggccgacggcacagaagaatggcaggcccaggacacactgagctcccagagcaagcggcgggtcaagcatcctttatcaactgcgaggtcttcgaggcccaaaagaggtgccctgagtcgcgaagtacccacccttggggcagccaacgccgcagccctggctccaggcccaggttgtccggagtggagccacactcgagcctggcaccaatctgggagctcctgagcgcaatgtcctgtctgtccctgcatgaccctgagactgtctgagatgcctcacagagagatgccctggagtcccccacaggcaggccagcctggaagcttctctggaaagtgagctttggcagctcgaggccgagctgtggccgactcctcccttggttaacacagcctgtacccagctgggattcactttgaggccctggggcttgccctatttcctgccaggagagcggggcccgaagctccatcctgtcccccaaaactcagacgtggaagccctaaccccggtgtggctgtacgtggacatggggcctctacagattaagggtaagtggggtcctcagggtggggcctgatctgacaggatccttgtccacacaagaggaggccccagacagctcactctcccacaaggaaacacagcgagggggtgtctaggagccaggaggccgagcaccccgcccagggcatcagggtccctggcctggcggggcctctcaccgactctcccgccggcatccaggtagcagggccctggcaccagaccctctgaagctgagacccacccacccaggcctgctccgctcttgctgtcacccccggagaaagcggcagtcagggcgtgaggtgaggaaaaggggctgttggaccctgcatggcagtggctcccgtgccggggacgcggtgagcctggcctcctccctgcaagggaggacagcccatttcccaggggaagacaccgaggctcagacaccctggccggggggcggcaaaactagaatcccaaggcagctgcacatctagcacctgcccttgccctctctccgggagggcaccctagaagcccacagtcctgatctggggttcggagagcaggctgggctgagctctgctgggagcgcctagaagcccagctatgggtccacgcacacactcaggtgaagccaggcccagaagaaggaacagctctaagccacagcccaggggggcttctcagtccacgaggcgacccctccacaccccagagccacagacagccaaggtgtgggtgaaacgtttttctcaccagaacagcccagcagctgggcatgtgctgtgaccactgagggggcctttgtcagaaacatcgtctgggggctggacgcccccacccacaggaagaggagaccaagacagggccgcacacccccagccagatgagggccagatgagggaggcggcacctcttcctccaggaagctcctcaggagggacatcgggaggggctcagggggctgccttcaaggaagctcagtgaagctcagagaccagtctgaaaaggaatgtcctccagacctccaccctctcaggatggacgtgttactcaggaactgtcccgtcagcttttcccgtaacacatgacaccccacgtgaacctcccaagagcagatgggcccagtgctgtccacccgaacgcaccttgggaacagaggtgtgggcctccccccagcagcgcatgaccctgcacactgcacccagggtcacagtgggggtggggagggacctgcccactgctcacggctgtgggacctggggcagggcaccccacttctctgagtctaaggggccctactagctgaagaaccaaaggaaaaccatcatttcaaaactgtcacgtgacacacaaatgcaggcccctgccccacagcccagtggcacacacgtatttaccgcctgggacacgggaccgtccagaagtgccctactcataggtgtaggtcacatccaggggtctcggccaccgggacccagggcccagcagctcagcaaagccattcagccggggtctgagccctgcccaggggaagcattttcccctcctggggtgaaggacagcaagaggcacgccgccctggcaggctgcggctttctttcctttttgtggacagagtgaaagggcaaatttgctccaggggaatactgacctccaacagtacaatgtgggaggagaaggaaaagaaagtttttatgcaaccttttttttaaatctgcccaactatccaatctgtaactgttcaaggagagattagtttgttctgccgctgacggctgcagcccaagcaaagcacaaagcgccccattgtgtcctccaggagggacgtgctgctgctgctgggctgggacggcagagcctgtgccctcgctcccaccctccgccctgcaggcgaaggcccagccaccctctccttaggcaacagcctgcgagtggactcatgggacggtgggtcagatctgaaccctcatgagtactgtctccctttcgaaaaggctgggactaactgtagaacctcatgtgacacctaagcctgcgtgtccccatgccccagcctaggggcagccatgactcccccaagacgcggaggaggcaagggctcccgaccactcaggcccctgcagagtcgcccctgtcactcagccagctgcccctcccagcccgcatctcaggaaaggcccaacccctcagaagggcttttctggtctgcaccagggccccgcttattccccactgcgactctcccattcacgtgcctatggctctcaggtccccccatgagctctggatgcggggccatgttctcattgggacccggcatagatgcggcacacgggacagaagatggttctgcggatggccaactgggaaggggtgattacaaacttccctgacgaggaggaaacaggtcagccaaggcctacaggaccctagggccagtgcctttccatagcacagggcccacctgggggccaagggcagcaaggaggagccttttcagccccaatggagcagggcacccagggtgcgggacaggcaggaacaggtgcgtgggccaggcctgctctgccagattttcgctgcattctccagacccggaaagggccacttgccagtcgttgcaaaattgaggccggagtctctgccttgaagtatctgggggcgctgctgccaggtgccagcgaggggagggggcagctgcccaagggctttgcgtccactggggggtataaagttggacaactgctttgggagaaaggggtcaacacaatgtatcttctaaaagcaaggcattcatctggtaacaaaataaatctgttgaagccaaacaggagacaggaattctgcagacactgcactgtatcccaaagctcagaagggaattgctggggggagcacggtgggaggacgctttcaacagctaacggaattataaacctattatgtattcaagtcgaacaaaagctctttgctctccctaccgaaatttgtttttacaaaaatcacgttcccctcctaaatctttcctggctatctgatgagcgcagccaagcaaaggccttcacgagcaaagcaccccttccgtgcccacttctgggaggcacaggatggatttgtctcctgcccgtaaaatgtcactcaggcccaaccacctccctgggcaacttctgagtgcccgggagccatggaatgagctcgtcttgccttgagtaaggtgccggaacctgaggtcccaggaaggttcagaattgggacttcctgccagccctgtcctgccagctcttgggtggctctggtaccccgggcgactctgagaatccctggtcagacacatgcatgggggatgggctcgagctcctgaaggattgacctgggcaaccttccagagccacctgggaatcaagtgggacttcccctcgacgatgaggcaggtaactaacacctgctgcagactttgtacagattgatacatttgataaagacagtctggccccagcccctggagctcgcctcgctgtggtgaggtcagtatagcccggcactgcatccccctgcaggcccaggttacctgcttggtgtggagacccctccccagctgcagccagactttgtcctaaggcgaagtgccacgtacagccagcagggggcgccaggagcaaggcggaggctcagctaaagctgcgtgctgggtgctgggtgctgcggggcactgttcagttcacagcccaccagtggcacggtgcacacaggagagcctcccagccctgaggcagggccccacacaggaggaggcagcgtccttgtgtctgcatgttttggcctggccgtgcatgggggcggggcagctcacagcttgctgggtgaggaccttcctgcctctaggagcaaggtccttgccctgtcctctgcagccctggggtcctacctgcctcccctacagccatgtgggaccaggcagcctctctgcagccatcggtgactgcgagtcaccagagcgtgcatccgccgggtgcctgcactcagcgaaagctccacagctccaggactgggatcatctctacctgaggctctgggagagaagagaaggaggccagctcctaactgctctgctcctaggctggctccaacatggatggagacaaactcagaaggaactgcagacagaggcatccctgctggactcaagcaacagggccccccacttcaactgtacccaaccacgggtgggatccagtgccaaggacagtgtgtcccagggtctgtgaccacacaaatgggaactgcttatgaaaccccagcccgacctcaccgcggaatggcagtgtggaaagggtggaggctctgcaggcagacacagaacacagatctatggagtgtgtgttaaagggtccagagacacccagcaaaataccaactgtgtcagtccacgtcaacagagaacacaggtgcaaaggggcgggggctgtttcacactcactctctttattccttctaccagccccaagagaaaaagcagctgggaaaaaggctcagaatcagtgatttccccaagatcacacagcacaagaccaaagtctgggccagccagccttaaaacctgtgcgccagactgctctcacctgttcccgaatgctaacagtggacacgtctgagtgatggggttaccacgtttgttttgttttccatgcttacctcatcttctttaaaaagcagacagaaacacagagacaatcccacacctgcccatggaatgatgaatgaatcacagcatgaccaggagcatggccccgtcgggggtgggtgaggggcgacagcacgtgggactctgacagacccagggtgagatggctcgggtgaggtctgcatggcaggcatagcccctgccaggcctggaatgttccacatcgcccccaggtgaggttacaacgcatcagctgggctctcaagattcacagacatcgcagcgtaaaaaacaagaaaaactgccagagcccctcccagtggtggccacgctgtcccacgggagcactcctgtgtccccctctgggtcggatttcacttgctgggtgattttcccagagggaaatctccacgttgtacagcactgcagagctgcggactgggaggcacccggggacgggacctcatgccctgtgaaggacacacaggcaaagcctcgaggggccgccggtggggcctgggggacgtactcacccttcccgatctggacgaagcccagcaggatgatcagggccagggccaggagcttggcggcggcaaaggcatcctggacccgggtggcggccttcacgctgtagcagttcacggccgtgagcagcactgtggagacagagggcagcggtgagttccacgggcagacagacgccagctcaggggtaggctgggaggtgacgaccccacccccaccccagggccaggtccaccagaaaaacaagctccttaaacagctccagtcccctgccagcccttagggcacgttctgactttctgagacctgttttgataaacttcgcagtcctttcaggtctaagggctggatcccaggtgccccttaagatctgcaagggacctttcctcaccccccaccacaccaggccatggagtcccacctgtagtcaggacttcaagtggggtcactgcctccagagacccaggtgagcaaggtgaccctgccacttggaaggcgcccattacacctttttgtacctactcagcaccctgacctgactgtgagacccacgcacagcccgactgccggactccatgagggcggggccctttcctcaaagaggatcttctgtggattccaacagaagtggggtgtcccgctttcccggaactacctggccagtcacctggggacggcagcctgggaggggccacaggggcctgtggtgagcagagcagaccctgctgccctgctgctttgggggcatacgatgaaacccaaaatagcaccgtgtgcttcagaagcctgagtgaccccacacagatggccagaacgcctgccccaggaggcgctgagatgtggggtcaggcacgctcagacaggtctccagacaccagcacgtcctcctgggccctgtaaggcacccagctctgagcctctgtgtgtgtgtgtgtgtgtgtgtgtgtgtgtgtgtgtgtgtgtgtgtgttgggggttctgttgcaatatataggcacgctgagccactgtgtgtgtgtgcgtgtgtgtgtgtgttttggggggttctgttgcaatatgtgcgcacgctgagccactattcagggatctgtgagctggtggggaaacagccacccccacaacttaaaatgaagtaaaatcatattaatcccgaggcactgactccacgacacccctcactgcctgctgcactacccttcactcctctgctcacgaggttatctgtcgctgtcagcagcttgaaatctgccagtgggaacgtctacaccccagaagtgggcaaaggcccagcacgggccacccacacagctcagatctcacagccctcccggcaccgcaccactaagactgcaggaaggtgagagcatcagaaaggccgtgggctcctcttctctctttccccttgggagtaacgctcagaaaggtctggccagccaaggccttgaggactccagtggcttttccccagctgaacaaatcctgtggaatcttacaatgtaagcaacagaccccgaggaaagacatccatgctaattaactaatgacaccggaaacgtcctgaggtgcgggacgggctgccgcctgcctatctctcagaaattaaccaccccgctacaattctgtggatgccagagcggagacggctactacacaccaggaaagtctggttgaaaaatgtctgaaagtcagtgttttcgctgctattcctaaaataaaatacttgaaattccggaacttccactcctcacccaaactgaagaggtgattcttcacctcttcccagggctcccagggacatggagatgttaccagtccagagctctccagtccaaccctcagggctcagcagggtcaggtcagtgggtctaggcagctccttgtccgctgcacagggcaaggggcaggtcctggcttgccagtcccatttccttatggttggggggagcacgaccataaaagaaactgagcctcggggacctagccggcttctggagagctttctggattcgcaagaggccggctgattgcatcactcgctcattcatgcccggagggaggcggggagtgggtgtggccaagccgcactcgaggctgcctctccccaaaagggagagaggcacgctgccaccactgaactccagacaccagacaggcgctgcggagacactgagcactgccctcgcggctgtcacgtctgcggctgtcacgtctgctagggggttggggggtccaggaagggcagcgagttgcccagaattgcccaaccacgggctgtcctgccacactgacgtggtgctgggtaatgacgccatcagggctgtcactgtgggtgggacagaggccaggacccccccgcccccccccccaccgccagcctgaccctgcctgcccagttccaacccagccgctccccaaccaaaaacagtctggaggggctgacgggtgccaccgggagggttcaccagatcatctcctgacgttggaaataaccacaggacagacaggcgggggccgggtcttgaagtcaggtggggagcaaaatggccatagaacaaaggggaccttatatttattccttttataacaagaacataaattttcatgttcactgactttgggtgatgagtaaacaaaggtttcattattctccacagtgtccttttttttacgttttaagatgagataaaatcttaaacaaatacatgaattcatctgggttcagtacctttcgaccttaaggaggcgaggcagtcacaggataagtctggggtttgaacctcagtccctgctggcacttgccctctcccaagcctcagtgtccacaccatggaggggctgctggctgcccccacagcagggagatcgacagggctgtgccctgagtcagagtgagggggctgagcacacagggccagccacccccagataagtgtggccgcgccagcctgcggggacagctgggccaggagataaaacccgtccggggataccccgtggcgtggcttggcttgattggcagatagccgggcaggctgagctgggggcccctcccagtctggggtgctgtcttccccgtcctcacctggctgcctcccacctggctggctggcaggggctccagaggagctggggtgccttgggggcagtgcattggaggaacccctgccctcctcctcccttcacctgtgtctccaccacccttcagggccatcagccacagaaacatcctcatcttcgggtgggcattgacagcaaggcccacagcccggtgaaggaaggacagccctggccatacccagagccagcgccagggccttggccaggacacctgtcacagtgaggcccaagctgtggtcctggtcctgactcaaaagccacttcagataccctgaggctcacgcaggagggattggggacgcggccagcccatttctcctcaggaccctggggtgggcaccaaggcctcccactgctctcgccacgtgccctgctgctcagagctggggcgtcccggggaggttgccaccacccagcatgaggtgggggacacccccacccccttgtgcctccccatctctggggtggggccggcagtgatactgacctcagagaccatgcaagaaggcacctgaacagggagggcccacagacgggacaggtgcatactgctggctgggcccacagacgggacaggtgcataccgctggctgaccccccaactctgctcaatcacacacgtgcacacacacgcacagcacccccacaacttgtaaaccaggaggctgccttctcctggcccctggccttacccctctcccctcggggggatgactctctgaggtgcctccctgcctgatgcccgtgaacgctcacctctgcggcagccggctctgctcacctcccctgatgctggcatcttggtctcctggccccaactctgtccagctcctgataaaatcccgctacaagcaaagggatgatcccccagggtccagtgttggaggagaggggtgggggaagggccagtaacaggtgtgttcaatatggagagcaggtgggacctgtgggccccggctgggtggggaccccgcaggccccatgaacccaccccacacggactaatgcctgattctttcaggtaataaacatgtaccaggtacaggagcatccgtggatagggttcagggtcagccacaatgaaaatcctctctgttggccacagaggctgctccctgggccgccggtcctcacctgcccccgagccaggcacagcagtgagtcctgcagggctcagcaccttggcctgtctgtaagtgggagtacccagtgaacatgatcctcccgggccccttcgagcccaaacacagccactgtgagtgccccaggcaggcgtccagcccaggcaggcatcctgcagtcccttctgtcattttcagacccaacagaaacagaagtgctcctgccaggcccccgaggactgcctccaggagtcatctgtaatgacaggctgtgttccgcgcacggtttcagagtctgtccagagggccaatgctggggctggggcagagatggtccaaggcctgtgagctgtgcagctttataggcaaatgacgattgtttacccagaactgcctgctggagacagcacagaggaagtggccggcagcttcatcagttccaggaagcccaggcagcctggtcccccagggtgcaccgggcacagcagttcgcacggggccggagagcggcagctgaccacagcaactacagctggcccgacaccgggcacaggtaccagcccagcccagtcccgcccagtgcagcctgtggcccctagcggagccagcacctggcaaacctgacacccagccttggagcttgggcccccctctgcagctggctggggctcctgagacagcttctttgtcggaatccactcggtacgcacagggccccgaacttggtggctgcccagtgcacatggggctttagtagaaccagtaccttcctccctggccccttcaagtctaaatatcccctgctctgagtacaagcctccaccttctccaccgacagacagcccccaccatctcccgtgtcatcccccgggggaacttataaaagcagtggtgggggaggcggatggaaacccagagcttctgatcaggcaggtccgggagatggagacaacacatctgcacagaacaaggtcccagggaggctggtgctgccggcctggggagcgcccccagcacaggcgcgtgcttccctgatggacacgtcaccgccccgggctccagaaaatgaatgtgtctgacccagtgacccctgtcctcacccaaggccaacctcaccccagaatgggctggaatgccaagcctgcccatgccggctccagatccacctgcctccctgccactgctggccagagagagaggtcaaagtggtccggaaaccccaaggaaaatgaagcagttccggggcagggaagcaaaggcagcgttcacattttttttttttttgagacgaagtctcgctcttgtcgcccaggctggagtgcagtggtacgatcttggctcactgcaacctccgcctcctgagttcaagccattctctcacatctacctcccgagtagctgcagcctccgcctctggggatcaagtgattctcctgcctcagcctcctgcctcagtagctgggattactgacacctgccaccacaccggcctaatttttgtatttttagtagagacaagcgttcaccatgttggccgggctggtctcgaactcctgacctcaggcgatccgcccaccttggcctcccaaagtgttgggattacaggcgtgagccaccgcgcctggccgggatggtctgcttataatggctcaattttgatgcccagtctctgcagagcacaaggccccacctttgggccggacatacagatgtccctgggcaaacagagagatgatcccaaggccctggccccacctgtctgctcagtgttgaaacagatttctgtgaaaacaaattactaacaggctggtgtcacattttcaaattctgtcaccagcccttgaacacatgtctttgtacttttttccatttttaaccggggctgagttacgcccaaccacactgtcctggctggcacgggggaggaggtgtcagctgctgtccagaatggggctgacacattcattttaaacaggccaggaagatgcagatttggcaagctctgaaatttgccaacatcccaagtccagggtaagcaggagaactggaaaagggcagcttctcatgtggtcaggttctcctgacacaagcgtcctggtggatttgggtttcccaagggtcctgactccaggagacccccagggctgacaggaagggccaccgctccctctgaaactctgaaaccaggccacccggtgctgaaatgctgtgtgaactccggcaagttcctttgcagggactgagcctccctttcctgtttccaacagactggaacaactgcctcctgctgcatgggcgaaatacctcgcggacgtgtcttacggcgccccatgaaagcatcaccattaatctgaccagtcaccgcagcatgagtatcttcagggcacagatgaagccgtgggcaccagtgataaggagttgccactgctggctaagtgcggagcctcacacatctgtggtccggaaacccacgccccactccaaaccctctacagctccaacagttatgctaacaagaaaaaggagtgaaaacccgctccagtcacggtattgtggaggtggaaggacacttgtggcagccaatccaacacctccattttatagccggggtaaacgtagttcagagaggttgtcccacttggtgaaagtcacacagcagttcctgggcggcaaagtgaggacatccaggtctcctaaatctcaccctcgtgctctggccacttgactgggattttcaatcccggctgtcaaagagaagcaccaagtccacttgggctcctggccagcgtccaagccagtccaactcaacagcaagcggaagcaaataccacacaatgaactcgttgaacagactctgcgctcaggcttaaccagtgcacagcctgtacacccgacaggaggatgcagctgttccaagctaaggccagggcctctccccaatcccgatgggctctgcagatgcagtgatggaagaatccctggtgacggggagcccttagctctgagcaggacctgaagccatctcagggcttgcaccggcccagatgctgctgcacaagtgctccaggggctcctgccctgccctcctcacctgccccctcacctgtcagggatgtttgattcctggctggcccctcccctacctgacccctgccaaagacccacgtcaccccaggcttccagctctgaagcaaacgaccagagaagtcaagcgcctggctccgggccacacagcttgagggactcagagctccagggacagtgcccgggccctgctcaggccttctgcagaggccctgggctcttccagttgactcagctcacaaggcccctacacggtagcaggtgaagacagggccccaagaaccctcaggctctgaagccacacatgagagccgtggacagaatcctgcattggcctccagcagctcgagagcacagggacaaagctggactggccccggggtcaccatggccttggttttgtagcagctgcagtttgagcacgtacaccaaaaataaaattctaagccccgtaactgactaaagggacccctcctattgccaaagggatattccaaagttaacctgaaaaacgagctcaggtcacgatgggaagagggggtcacacaggccttgttataccccctccctctggaattcaggtacagcggaccagcactaacactcaaacacagatcttggcctggctcagtggctcatgcctgtaatcccagcactttgggaggctgaggtgggcagatcacgaggtcaggagttcgagaccagcccgaccaacatggagaaaccccatctctactaaaaatacaaaattagccaggcatggtggcggcaggcacctgcaatcccagctacttgcgaggctgaggcaggagaatcgcttgaaccgggttgcagtgagctgagatcatgccactgcactccagcctgggtgacaaaaacaaaacaaaacaaaacaaaacaaaacacaatattcgtctccacaacctcctgtcttacccagatactcctttctattgataccaggtctttagctaataactctttcaaccaattgtgaatcagaaaatcttttgccaggcacggtggctcacacctgtaatcccagcactttgggaagccaaggtgggcggatcacctgagatcaagagttcgaaaccagcctgaccaacatggtgaaacccccgtctctactaaaaacacaaaattagctgggcatggtggtgcatgcctgtagtcccagctactcgggaagctaaggcaggagaatcacttgaacccaggaggcggaggttgcagtgaactgagatcataccactgcactccagcccgagtaacaaaagcatctcaaaaaaaaaaaaaaatacacacacacacacacacacacacacacacacacacacacacacacacacacacacacatatatatataaagaaaaaggaaatcttcgaacccacctgtgaccaggaagcccatccccgccttggagttgtcccgcctttctcggcagaaccaacaaatacctttcatgtactgactgatgtctgcctgtaacttctgtccttgtaggaggtatgaactccagctgtggcccaccccctggggcacatgtcctcagggcctccaggccttggtcctcacatttgactccggataaatctcttcaaacattttacagagtctggctttctcgttaacaagcagctcacacatacagtgtctcagtagtgacagatgctggcccaccccgaggtcaggatgactcagcagggatcgagtttgcgggcgtcacgctccaaggcccagaataggaggtcggtgctcattcctcacgtagtgggcaaatcctagggcaggggaggggcgggcaatgccagagaacggtccccacctggggtggtctgacggccagggatgcagggagagacgcctcccacactcccggaggcacgcacgtgctgtggccaccccggagggtccgccttccagagggagaattcaggattcggccagtatcagggaaggagacgctgtggggggccctcctgttggaaaagggcagcagcgggaagagggtgctgccacagggcctctggggagcgtgcgggcacacagtaccaatctgcatgcatacacgtgtcctgtccctgcagacgggccaggcaaggcctgcccatggccagctatccaggtgatgctccagggagggccaggcctactggggggcagaaccctgtggctgtccagggtacctggatgtgagtctgggaaggatggagaagggtggaggagcgcaaagggcccctaggggatgctggggaacacagatgagcctctgacccacctgtgtccttacctgggccgactgggccacccagtcttgctgactgacacctccccagacccctggcacccaccagactccccaggcgtggctttgtgctcccctatgcctgatgacaaatggtggcctcagtgtagaggtgggcactgtggcccctggctcctggctcgctcctgcctcagtttccccagctgtaaattggggattatcactggcttcaaaggctggagtgcaaagtggtggccaagaggtggccaagaggtgccaagaggtggtccaagagtgtgccctaccttggacacccctctcctgggggtggctctcaacctggcctgggcccccgggggtctgcgcaacccacccttctgtgtgaaggcggctgatacacatttctgggcaagattctgcacattctgctggattatgaaagaggtctgtgacccaagaaaaaagggtcacaagtgcccgttaggctctcctgtgtggctcaggtcatgtgcttctgtgagctccccctacggccttgccccgaatcccgtgatgcagcgtgacctgcctaggtgccggcggcactttcatgtgcggctgggaaagtcagatttcagcactaatcactggctgccgcctgcaatgagcccacggcttgagctctggggcccacccagctccttaaacacgcagaacctttgccagctgagccaggatcccagctgtggggggttgggggtggaggggtgcagggatcccaaaacccaacccggggccaggttttacacaggcctggactgagaagtggggctacaggctacaggtgcttgataccccaggggggccctggaacaggcctggactgagaagcggggctacaggttacaggtgctggataccccagcggttgggggggtggtgctggacacccagggggcagatagaggcagccaggcagcctgaagaccctggggcaaaacacacacaggccccctctgctctctggtcactgctaactggccaactggcctttgagtccactgaccacagctaagcccacagccatcaaaacccaccccttacacccttcaccctttagggaggggctcagagacagttgtggcgattcctacttccacccatagccccccgaccctgggcctgtgccgagcgtgggtgggtgacatcatctcgcacccagagctccagactaaaggaaaccctggctcctgtctctggctcttccctccctctctttgttcccttgctccttccttcttttgccagaggagaagacagtgaggctgagggctgctccatgtgcacagtgagcaggagatacaggcacgtggagggacggtcacagcccgtgcaactggcaccttcacacgcagaggcctgggattcccagacacctggcgctggggccaatcccattccacagtcagaaacaggctcggcggggccaggtggatttctcaaagccttggttgcttttggcctgatgctagctggacagtgtctcagctcacaggttcctaaacgcatacccgcccacaccaatctgctgaggagtgacagccatggggaggagagccacctcactccagggaccctggcaccgtctcccatgaggccaggtgtcctcagccacccgcagccagagtcccgcgagaccgacggacggcctgcccctgcgtgacggcacgcctgggactgtctcagcagccccccatgcttcacccaactgggacagggaaacaggagggggctacttctgctttcaaggcatggaggagctgtctgcaggccacttcccgaacacctatgcgcttggagaagtgactgagactgagccagggtatcttctccacgatgcagtgagcccatcgggcccttcttctgagagcacctccctggaggtggaagcccctgaggcccacagcatcttctgaacctgtgagttcccacttactgagaactcgcctggatcagtgccgggccacagtggaccgggactttgagtggatgctaccctactcgctatgcagagccagctggggcccagggaggtcagataaactgcccaaaccaaatccaggcccagccagaatctcagctccagcctttgcgccttctgataaaacccagcatcgcttgaatttccagtacacgctgccaagtcttcgttaagcaataaataaccacacaaccctactgtcatgccaagttccatatggccatccagaaagagacacatggagctggttcctctcacctttatgaccagtgaaaagcgcaccaacacgaagacacgcgtgaaaggacctcatctcctacccagactgacaagcaagggatttttttcactcaccgtcagtgggatggttctaagcaccgaggccaacccatttcacacgattatttcacaaaaagaaaccttctgtgggacgtgcctgggcgactgaaaagacagccagcaaaactgagaaccttgttctcaaatctataccctctcccaaggcagcctcagaggcccgagggctgaggatccagacccgaaagccactgtaccttctgtaggatcaggctcaaggaataagggggtaaaaggtgccctttcccttcctaagcagaaaattccagaacccaaccttatgtgtgatcatttaaaaatatatatatatatatatatatcagccgagtaggctgactcacgcctgtaatcccagcactttgggaggccgaggtgggcggatcacctgaggtcaggagttcgagaccagcctggccaacgtggagaaaccctgtctctactaaaaaatacaaaatcagccaggcatggtggtgcatgcctgtaatcccagctactcgggaggctgaggcaggacagtcgcttgaacccaggaggcagaggttgcagtgagccgagatcgtgccattgcactccagcctggacaaaaagagcgaaactccacctcaaaataaataaataaataaataataaataagtaaaataaatcactttctatggcttttcactgctccaggagcaatgtccacagatcaaacgcccggcctctccttcacaccctggagcgcccatcctgcccactggtccgggctccaggctgccccctgcacctgtcagaagcccccctataagggcagggtctcccttcccgggacatccactgcccttctccgagctgaagtcagaatgacctgagaatcagcttggagttctaccagcctcagcaaagcccacctctgcgacagcactccttgcagacccctgacccggtgacagatgaataaagtacagacacacagatattctgctctgccagtccagctgagggtcccagccgcttataggctccctgctgagtcctgtaaacagttgctacttggccctgatcagctagtcagacgtgcatttattcagtatgattaactaacaaaagcttgagtcaacaccattagaatgtaacagacattgtggacttcccaagtaaaaagcacttaaacacccacggtcttaagattatgcgagtaaacaagctagctaggtaaactacgctgcctttcttttatcactatttttatttgtttaattaaaggtaaagggatcaggccgccttcagccagagctaattaccgaagttatgccaacttctcggccttccaagatttgtgtctatttctataactatctctaatatctttcccaccagaatgattgaaccccaacacacctccctctctcagcagggtctgcctgttcagagaacacagcttctctttcttgccttacacacaggggcaagaatagattcactcttgcagagagtacatccctttctgttactgaaaatcactttccaaaaaaaaaagcaacacatacacacatactcaccacacacacaggtgggtcagagaaaaaaaacaagtacaaatggcttagggacatgagaagtgtggccctaactttcgctgaaagggaccctattaacattaaccctcacctctgggtcagagagggttggcactctagggcctgccttgaagctttacctactgggaccaaaaggactgcttggaaagctattttaggccaggtgtggtggctcaagcctgtaatcccagcactttgggaggcagaggcgggtggatcacctgaggtcaggagttcaagacaagcctggccaacatggtgaagccccgtctctgctaaaaatacaaaaaattagctgggcatggtgggcacctgtagtcccagctactcgggaggctgaggcaggagagtcgcttgaacccgggatgcggaggttgtagtgagccaagatcgtgccattgtactccagcctgggtaagagcaaaactccatctcaaagataaaataaaataaaaataaatttaaaaaatactttttaaagccctattaccacaaaataaatccaggaacgcgtgacttggtacagcctctttggaaggcacattagctattacattagaatccacaccccgccgggtgcgatggctcatgcctgtaatcccagcaaattgggaggctgaggcacatgcctgtaatctaagctccggaggttgaggcaggagaatcgtttaaacccaggaagcagaggttgcagtgagcaacgagcctgggcaacagacacagactctgtctcaaaacaaaatcaaaaacaaaaagcaaaaaaccacatacccttttcccatttgcacaaagctgggaaaccccaaatgccctccacagggttctatgggggggcgggggtgcggtgagcacacttgttcctgccgacacagggaagtcttcttagcagctaaagagggcagcctctgcgtactgcctgggaacatggcaaaaccattttaggctttaaaaaaaaggtggagaacaagttgtacattatgatcttttaaataaataggccagcgatatatttgtaacagaagcagctccggaagcatacactgtcagccgcagaaactctgggggtcgggggtggtaaaggaggagaaatgtgtcacccaggcaggagctcagtggcaccatgcttggttcaagcagttctcctgcctcagcctccgagtagctgggactacaggtgtgcgccatgacgcccagctgatttttgctttttttttgagatggagtttcgccttgttgcccaggctggagtgcagtggtgcgatctcagctcactgcaacctccacctcctgggttctagtgattctcctgcctcagcctcccgagtagctgggattacaggcatctgccaccacacccagctaattttttgtatttttagtagagatggggtttcaccatgttggccaggctggtctcgaactcctgacttcaggtgatccgcctgcctcggcctcccaagtgctgggattacaggtgtgagccacagtgcctggctggtttgaatttttaaatgatgatgaattcatgtatgactgatgtgatttttattagaaagagaaaactaggcagcgccccatcctacgtctccttcctggtggccaatgaagcatttcccacgactcactcctggcaccagcaggaagtcagagactcagcacccaggggctgcttttttttttttgagacaggcttgctctgtcacccagactggagtgcagtggcgggatctcaactcactgcaacctccacatcccggagcatgcctcagactcataagcagctgggattacaggcgtgagccactctgcccggctaatttttgtatttttagtagagatggggtttcaccatgttggtcaggctggtctcgaactcctgacctcggtagatccgcccgtctcggcctcccaaagtgctgggattataggcgtgggccatcacacccagccaaccaggggttcattttttaaagataagagtgcaggctgcgtaagctactatccatgtcgttacataccgggccgacatgtacctaggcgggagggagactgaaccagtgaaattctaatgacaaaaaaagaaatcagagtcatcccctacattcacatctccaacgcccagctggaaggcacaggctctccccactgctgtcctgctacgatttttcccggctttgacctgcatggtggtgcggctgctcgactcagagcctcagagaaaccacacagagccctgctgagtcttgccctcggggcattctcacatttatgaagaaatgcctccccctccccctcccccccaaagtacggtgtggcagaaaacagcgccaacaggtcctgccagtcagaagccactcccctgatttcatggctcaagaccccaactataaattagcccttcccaccttgaatgtgtacacacactattgagatgcaggccgatccatgccatgggatgaatctgagaattgccaagacccaccttcccacgccacccaaccaaatcatgtggcatctgctacaagtgattttccccctgaaatcccacaagaaaactattttgaggccgggcacggtggctcacgcctgtaatcccagcactttgggaggccgaggcgggcggatcacaaggtcaggagatcgagaccatcctggctaacacggtgaaacgccgtctctactaaaaatacaaaaaaaattacccgggcgtagtggcgggcacctgtagtcccagctactcgggaggctgagccaggagaatggcatgaacctgggaggcgggcttgcggtgagccgagatcgtgccactgtactccagcctgggcgactgagcgggactcagtgtcaaaaaaaaaaaaaaaaaagaaagaaaaagaaaaagaaaactattttgaaaagcagttatctctggcctggtgaagaacacaccagcaccatgcccaccaaaacaggagccccatggctgtttcccagagaaacctgggacccgcacgtccattcactgcaacacagactgaatctgcagccaagctccgctctctcactactgggaaccctcaggggggatcccttagcctaaatcagcaccagtcactacccgcacacgatgttattactactgttttcttatgagtcagcccgtgtcactgattcctgacgagctggtgtggagagcagaaatgaatgattttttttttaactgcaatttccttctcaccaaccagtcagcaatcggagctctaacagtaaaccgattgctcagttactccacgtgggtgccacgcaagaggctgggagtattgctcagcggggccaacgggagggtggcacttgcctaaaccgcttaagtgggggaatggaatgcccaccgaagggcagggcagggaccctgctgtcccgtcactgaagatattcccagcctgtggggagaagtgtaaaagaatgaatgaaagaaacgcacgtggtttctgggaccaatgaccttagcctagaactgccgggatggtccaggaacgtaaagatgtagagatgtgggagccaggggcgtagtgatgcaaggatgcagggacccagagactacgacctcccaacccccggcccgcgccccgtactcacgcacgcagaggcaggccacgagcttggctgcctcctcgggcaccgggcaggtggggaagagcggcttgagcaggtaggtggcgaagaccagggccacgatgtactgcgatgaaggccggatgatgagcagctcgatccagagcttgaggaaggcgggcagcgagccgtagacctccagcatgtaggcgtagtcgccgcccgatttggagatggtggtgccgagctccgcgtagcagagcgcgcccacgatggagaagacgccgcacgcggcccacaccaccagcgccagccccggcgagcctgcctccttgagcacgcccgtgggcgtcacgaagatgcccgagccgataatggtccccacgatgatggccacgccgttgagcagcgtgatgttccgctgcagggtcacgccctcgccctcgcctgccggcgccgagccgtccgcgctcttggcggccagcatcttctcccgcgcctcttccttctcctcggccgccggcgccgctagcgcgcgccgcttcgggcccgcacccgccatgctctgcgcaccggccgggcctgggacacccgggagccgcggcccagcgagcagtgtgcgcgccgcccgccgcccgcagctgcgtcaggaaccccgcccgcgccgccttttaggccccggcccgccggccccgcccaccgtccgcggctcctccccgccccgtggcccggccccgtccctcagccccgccccctcggcccagctcggagcacgtgcgtcgtccggcccagcctggcgggctattcccaggcccgcgtggtcctcgaaggccccagtcctcctgcgccatggagaccccggcctcgcgacctcccccctcccggcgcccgcgtcatcccagcccgtcctcccggatgcgcctgggcggggcctggcagtcagggcgcgccccttcacccactggcccgcagcctctcgtcaagcctgggagcgggcagtgcaccagggctggcctgaggccaaggatggagtttggggtaccccccgaagggaacctaggctcctgtcccggatgggccgaggggatggaaccgcccccacaaccagctcctggggcacgggggagggatgagaggatgacctgaggggaagctcctgcagcctccttccagcctgggggctgcatcagtggggctggtgagccgcgaactgggacgagggaagaaccgaaccgaggccacccagtaattcccattgtatcccaaaagaatcttgccaaagacggcgatccggtgcccgtagctttgagaagcagtaataacacaggctttgggaagccagcaatctgcctgagctcaatttaatcaacagaaccgggggttcgctgggagccataagacccccacccccaaatctacctggggaattcaaaggcaggcttcagtgtgaaggggctttaaagcttgttattcctagggaatgcgagaggcatcttagctaaaaagggttgagaggtaatttcagttagaggcgagagcaggatgccaaggctcctaggcctggaaatgggaaggaatataaatactgccccgagattgaccagactggtgagcggccaaagacctgttcaaagggtgtgtgtgggtcagggaggaagctcctcagtatcaccccaccccggggttccttggcgtgtgtgcaaacgagtccttggaagctcacagcaggcatgtggggaggcctttgttctgggtgagcgttcagcctcccagggcaaacacgcaaacaccggttgcagagctgggtgttcacagcaagacagtctgctgggcagatgcctctggaatccacagaattctgaacaatagccgtggtggaggggggtcagaatccctgtcgtgctgggacctctagctgcagccaggaatgtccaggccccaccccagggagggggcggctgaggaatgccagggcttgtcattctggaccttgctcgccccccggtatgtcgggcattcctctgcggtgataaaaccgagcgaaatctcagcagcccaggcagccacaggcgggggagtgcggaggtcacacagatactaacttgtaatctgccgtccacattgctggctgtggaaggtgcagagacccctccatctgccctattcttcccgctgtgcctgcagagggaaggagacagtaccaccatggctgggcaaactcaccgagtgctcactgagtcctcccctagacagcttcttatgcaatagggtaggtgccagttagagccattttgcaaataaggaagctgaggcttggtagggttacctcgcttgtccggccagcaagtagcctgggagctgtccttttgactctgaacttatatggtacttttaatcattccaccattcttctttgagtaacaagaaaggcaaccaacagtcataccccaaagcataaaattacaaccatgataagccaaggacatgacagggtgagccagcgacagcgacagggaccaggcaggtccagatagacttttctgaggtggtacctggagctgagagcccagggtgagtgagaattaataagggaggtgcaggggtccccaccggcacagagggggccctgcacagttggtgcaagtcatggttggtgcccccagagccaggctcctggcaagtgctggagcccttaagcaggaagggtgacaacagccatgagcgtgttcaagtcacacagctattacgccacctctgtcggtttttactgggttttcatatgacaacattctagatttatccagcaaatctactcctctcagacgtccctgatgccggccctgaaacgccttcgcctgaaagctatgactctagaatcttagcaaagagtgccatctgttggaaagattcggcagcgttttgatttttacagaggcaggacaatggtcttttcagctccagtcagtaatttatcacatgttgtgtattttcagaggttaaaaaaaagaaagaaagaaaagaaaaaaaagttgtggcactctcgcttgagctggttgggagaatactttcttttcttttttttttttttgaaacggagtctcactctgtcacccaggctggagtgcagtggcacagtctcaactcactgcaacctccgcctcccgggttcaagcaattctcctgcctcagcctccggagtagctgggattacaggcacccgccaccatgctcggctaattttttattttttgtatttttagtagaattggggttagccaggatggtcccaatctcctgatctcgtgatccgcccgcctcagcctcccaaagtgctgggattacaggcgtgagccaccacgcccagcgccctgcaggtcctttttaaggctgtttgcaacataaatgagacgaggcatcttctgcccccctcagagcgccagcgtggagttgagcaggccaccctctctcacaaggcgaacccgtcattattttgtcatttggagcaactgcaggggagcagcaaggccacagggcgaggggagagaacccggtggataatcctttgttttctaattatgagatgagtctcgcagtgcagggattgtggttttcatctcagcaaaatataggagtgaggtccggagcggatccttgctcttcctttcaactcgttctttttcccaggaaaacgacttacctggtaaaccctgtaaaccaaaaataaaattctaagggccaccccagacatctaaacagacttcctcctcagccagggctcttaacatttaacctgaaagactggtttgggccaggaagagaatcgggggttggacggcctctttagacctctccagcactaacaccaacacatacttgaagtctatcagacttaaagattaacattttacagcctgttctctttgaagcctcctagctaaaagcttcatctgcatgatacagctttcatctccacagcctcaccacaacccaaacattccttccttcctttctttctttctttctttctttctttctttctttctttctttctttctttcttccttccttccttccttccttccttccttccttccttccttccttcctttctttctctctctctctctctctctctctctttctctctttctctctttctttctttcttgtctcacttatcgcccaggctagagtgtggtggcgcgatctcggctcactgcaagctccgcctcctgggttcaagtgattctcctgcctcagcctccagagtagctgggactacaggcgcctgccaccacgcccggctaatttttttgtatttttagtacaaacggggtttcaccgtgttagtcaggatggtctccatctcctgacctcgtgatccgcccgccttggcctcccagagtgctgggattacaggtgtgagccactgtgcccggcctccaaacattgctttctactgatcccaggtcttttgtgtttttctttttttttttgagacagagtctcactgtcgccctggctggagtgcaatggcacgatcttggctcactgcaacctctgcctcccgggatcaagtgattctcctgcctcagcctcccgagtagctgggattacaggcacctgccaccacacctggctaatttttgtatttttagtagaggctgggttccaccaggttgaccacgctggtctcgaactcctggtgatctgcccacctcggcctcccaaagtgctgggattacaggcgtgagccaccatgctcggcaacaatcccaggtctttagacaacaaactcaaacaattgtcaaccagaaaatgtttaaattggttgggcgcggtggctcacacttgtaatcccagcgatttgggaactttgggaggccgaggcggggggatctcgaggtcatgagttaaagaccagcctggccaacatggtgaaaccccatctctactaaaaatataaacattggccgagtgcggtggctcatgcctgtaatcccagcactttgggaggccgaagcaggcagatcacttgaggtcaggagtttaagaccagcctggccaacatggtgaaaccccgtctctaccaaaaatacaaaaaaattagctgggcgtggtggtgggcgcctgtagtcccagctactcgggaggctgaggcaggagaatggcatgaacgtgggaggcggaggttgcagtgacgggagatcgcaccactgcactccagcctgggtgacaaagcgagactccgtctcaaaaaaaaaatatatatatatatatatatatatatacacacatatatatacacacatatatacacatatatacacacatatatatacacatatatacacacatatatatacatatatgtatatacacatatatacatatatacgtatatatacacatatatacacatatatatacacacacacacatatatatacacacacatatatatatataaacatcagctgggcgtgttggtgcaccgcctgtaatgggaggctgaggcaagagaatcgcttgaaaccagaaggcagaggttgcagtgaaccaagattgtgccactgcactccagcctgggtggaagagcgaaactcttgtctcaaaaaaaaaaaaaaagaaaatgtttacatttacctctagcctggaagcccccctcctgctttgagttgtcccgcctttctgaaccaaaccaatgtattttttaaatgtacttgattgatgtctcatgtctccttaaaatgtataagaccaagctgcaccccaaccaccttgggcacatgcggtccggacctcccgaggctgtgtcacgggtgcgccctcaaccttagcaaaatacgctttctaaattaaaggaggcctgtctcagatttgctggcttcacaacccttaattgaagtggggcttcctggggccgcctctctcctgtgagtcccctgccgggctggttctcagtcacaggggagaaatgcctgcatcttttaacatagcaagggtccttgcttcttctggaggttgtttttgaaagccatgcttttattatgctcagaggtgagcttttcctatctgcatgcttgacaaggtggggctgccctgagtacgatcagaaattccgttctgtttccaggcagataggtgtgtagggcagccactcagtcagtgttcggccttaaagactcttgccagtcaaggaagacgaccgaggcaagtctccgtcattttagctttaaatgccaacattagggacgcgcacctgagagactggtctatgcctttctccgaagatgattttgagggcttcaatattgaaagggggaagggcaggatattgggcagtacacaattttcatgtgaagggggtaggggaaaattcaagtttttgtctggtttagtgactctgccgtttcacgtaagataccctagacgatagggcagcggaaacaatgagatatgcatttgcttcaggtgggcggagggatgactcagttctgcccctcgtcccagcacctgtgaagataagctaacggttcacattgccagggtgaactttaacagaagcgcttagggtaaagatcttggagcccacaaggaatttccttatgggcaaaatgtgagggaggtgtgtcgcttttcatctttttttttttttttttttgagacggagtctcactctgtcaccaggctggagtgtagtgggtcgatctcagctcactgcaacctctgcctcccgggttcaactgattcttctgcctcagtctcccaagtagctgggattacaggcgcctgccaccatgcccggctaagttttgcagttttagtagggacggggtttcatcatgttggccaggcgggtctggaattcctaacctcaagtgatccacccgccttggcctcccaaagtgctgggattacaggggtgagccaccaagcccagccaaacttttcatctctgtagctgtttgttaaataattaggagccgaaacaggaggctggttcccatgacacggtcaccagcttcacttttccctttcgttagcaagtgtggggtcccaggatttatgttcctttcacactctctatgccatttaatttttgcagcaactatagttagttgtcatttatggttggagaaaaagggcagttcagtaagtggccaagcccagcttcagacccagggcaggcctttaatcctcgtggcaatgctgactgccacgctgatggcgccacttacataggcagccagattcataagcatgcggattctcccagttaaaagagaattttggccgggggcggtggctcacgcctgtaatcccagcactttgggaggctgaggtgggcagatcacaaggtcaagagttcaagaccagcctggccaacatggtgaaactccgtctctaccaaaaatacaaaaattagcctggcgcagtggcaggcacctgtaatcccagctactcgggaggctgaggcaggagaattgcttgaacccagcaggcagaggttgcagtgagccaagattgtgccactgcactccagcctgggcaacacactgagaatccatctaacaacaaaaaaaagagaacttcatttcagctgcccctggtggcaccttgaaagcctcattgcctcttcactggaaacatccaccattcttgttaaagaaaagacactcatgactttccttcaccgaatccttctagcttctgtttgaacacttgggtagtccccccacccgtttcctgaagttcgtatgggggaacggtaaacagtgtccatgcctgcaagtaaaatccgaagccctgcgattgctcagtaacagctaggagcaaggttagggattgtagggccagattttttgcttaggttcaactaggtaaaataaaaatagactttgcatgcatttcaggcactgggctgatgaccggccaccagggaggctccgccccacttcttaactttggccccaacgttagtcttgttgctgctctcagatgtgctctgcgtgtcaaagatgacttggaggctgggcgctgtggctcatgcctgtaatgccagccctttgggagaccaaggtgggagaatttcttgagcccaggagttcaagaccagcctggacaacatagggagaccccgtctctacaaaaaatacaaaaactagcccagcgtggtggtggtgcacctgtagttccagctgccggggaggctgaggtagaaggatcacctgagatcaggaaggttgaggctgctgtgagctgagatcatgccactgcactccagcctaggcgacagagcgagaccggtctttttttttttttgagacggagtctcgctctgtcacccaggctggagtgcagtggcgcgatctcggctcactgcaaactctgcctcccgggttcacgccattctcctgcttcagcctcctgagtagctgggactacaggtgcccgccaccatgcctggctaattttttgtatttttagtagagacggggtttcaccgtgttagccaggatggtcttgatctcctgacctcgtgatccaccctcctcggcctcccaaagtgctgggattacaggcttgagccaccgcgcctggcgagactggtcttgaaaaaaaaaaaaaaaagatgacatggaagcaacagtaggagccggggtcagagttcaggcccgtccatccgtggatgatggataaacccagtgtagtccgccatcccttggagcgtcattcagccgcacacaggaagacacgctgcaacgtgcaggacccctgaaaacactgggctgcgtgaaagggtcagtgaccacgagttgtatgattccgagtgcacgaatgtccaggacaggcggatccagagagatggacgagattcgtggctgcttagggcggggggaaggggtgatggagagtgagggctgagtggatggggtctctctttggggtgataaaatgtcttggaactagatgatggggatggttgcccaacactgggagtgacttaaacaccacggatttgtacgtgtttaaatgactaacggttaatgtgatgttatgtgtgaactatacatccaaaagataaaagcagttcaggcctggaatcgaacggtcctgggttcacatctcacctctaccacttggtggcaccaggcgagtgactcggctcagctttcgaagtctcagtttcctcttctgtgaagcagggagacacctgtgcctgcctcctggggaccagcaggtagaagaccctgagccgctggcattgccatcactgcagaactgtgctcccaagaccagccagtggaggaccctgaggtactgctgtgtccctgtcactgcagaactgtgctcccagggctggcggatggaggaccctgagccgctggtgtcatcctcactgcagaactgtgctcccggggccagcaggtggaggaccctgagctgctggtgttgccatcactgcagaactgtgctcccagggccggccgaatgcctggcttccaccctcagactttctttccaatgtgggcgaagggaacacggagggacagcggtcgcagcagcccacacttgctgtgtcgggcgtggtctcagtggctggagtgtgaagatggaggcggggatgggagtgggcggccctgagtcaagggacacctgtagcccccagaagctggaagaggcaggaggggtcctggagcctcccgagggagcctggccctgccaccaccttgaagttggcctctggcctccaggactgtgagagaacaaaagggctgttgtcttaagcccctgtttgcggacaaagggaataatctcaacattgaaaaaatatggccttaatctttagtgctgtaggtggcaaacttaccttcaggatggcagagacagatctttttttcctgttgacaggcattctaacatttccagagacacgggagccaggttctcctgctgggcctctgcactatgagccaaacctgcctattgttaagtgattgaatgagttgacgctcaccttgaactttcttccactctgccctggattacaagaagaattcattgctcagcccatgtcccagcatgaggctggaagcagctgtgaattttgtagagcctggagggccctgcactctttgcagctgccagcttcagcgctgctctcttcggccactttgccccgcctctgttttgggcagtggctgcagggcagatgccacccaaccaggtcaaatttccctgtgaggatggaagtttgtaggttataattcagttctccatcttggaaaatatccaggtggatattgtttaccaccaaaacaatgacttctatcgcgtgagcccgaaaaccaggctgatgcgtgctacggcatgcgtgcgtggtgcctgctccatgtgtgaactgtgtctgttccatgtgtgaaccgtgtctgttccatgtgtgaactgtgtctgttccatgtgtgatccatgctgctccatatgtgttccatgctgctccatgtgtgaaccatgtctgttccatgtgtgattcatgctgctccgtgtgtgatccatgctgctccatgtgggaaccatgtctgttccatgtgtgaaccatgtctgttccatgtgtgaaccgtgtctgttccatgtgtgaaccgtgtctgttccatgtgtgattcatgctgctccatgtgtgatccatgctgctccatgtgggaaccatgtctgttccatgtgtgaaccatgtctgttccatgtgtgaaccatgtctgttccatgtgtgaaccgtgtctgttccatgtgtgatccatgctgctccacatgtgaaccatgtcttttccatgtgtgaaccatgtctgctccatgtgtgatccatgctcttccatgtgtgaaccgtgtctattccatgtgagatccatgctgctccatgtgtgaaccgtgtctgttccatgtgtgatctgtgtctgttccatgtatggtccatgctgctccatgtgtgaactgtgtctgttccatgtgtgaactgtgtctgttccatgtgtgagccatgtctgttccatgtgtgatccatgtctgctccatgtctgatcacacctgctccctgtcactcattttgtctagacttctcaatgatgacagcccccagttacccagatttaaggtagtttctaaatatttgtagccagatccatctagtatcctgcaattcattcattgactcagcaaacatttcacgatagctagacatacgcctggctttgtgagaatgtgtgtccgtatgacaccccagcctgcgggtgaccctttcatgtgcacccctgtgataacaggggatgtgcaggagcccaggtgcggggggaggggatgctgctgcctggggctggcactgacgaaggtgtggtggagaggaggggctgcgctgggccttggcagagaggagaaagtgcatctagcagagcagggaggacagcccaggagagggagcagcgcctagaggacctgcggcagcgcacagcagtccccgagcttacaagtgggagcactgcagcccatggcgcccgaccacgtttattgtgtgctgtgggcaagcagaacagttgaggatcccgcccctgggggctcacattccagagggggatgcaagcatcatgcagcaacacgtgcctgatgccaacagctggggaggggacacagggagaccgtggttggggcaggtgtctgagaactggttgaggatggaaaggagtgactgtgaagcagccttggggacagcaaccccagccagaggcccacacacacaaggtgacgtggaagagggccaggctgcgaatcttgctgggagaagctcgtgctcattcccaagcctagtggaaagcctcagttttgaacagggcagcagaatggccaagtgtcggtttctcaaaaaaacccactgttaaaagaaaaatggatttgggggaagaggggaagaggctggaaagaaagtggctaaactggaaggccagcttgtcactcaggctgcagcagaagggacagagaaaagtggacagacttggaataggcggcagtttgagggtcctccagcagagcctgctgctgccctgggtgcaaggagtgaggggagaggaggtcccaagggggctcccgagattgcctgtggcgtcgggtggatggaggaaccatttatcaagacggggttggtgggcacagagttggggacgcagcagtgcacggacagcccacctttcagcaggagggacaagtgtcaaaaaatgacacttactgctccgttaacggagtaatggagcagacactccgttactgctgggcaccgctgtgtgccaggtgccatctgggggctcagctcaggccgaggaaacaggaggagcaggtgttgagcaggtggtatggggcgggcggggaagggtgccctcaggtccatcagaacagccacaagagccctggggtgggagggggccgatattctggtcggcacagagtgggctgccaggagagggcgggggcggaggggcaggaatgtggattctgtcccaagggggcaaggctgaggggatgtagctgggcacatggtctgctctgaattgagcttggttctctagagggtcgatgggaaggacgtgctggggatggggaggaagcggaggaggaggaggcggtggcagctgggaacaggcaatgcttctcacacaggcgtatctttattaaacaagaaaataagataaaagcaaagggaggaagccttgaaccttaaaagctgggccagaaattctacaatacaatcagaagccacaatctggtcacagtgagagcccttcccgcagagccgcagacaccggccgctgcccctggggcgggagggaagcctcctgtttgttttttgtcccgttgctttgagggctggaatcaatgtcttttcctctcggcgtgtttgtggtttcatctcagtgtgtccaggctcggatggcttcccgggagtatctccgtgtctcaggattagcaccagtttttaaaaataactgacaaaggccatttttcaggagacaaagatgttggtgggtgcagagggccccctgtgtgttgatacggaaaatgaaggtcagccactccctgcttctcttggtgtcttgttggacacgatgtcaacatggggccggtagaactggagcccagggcccctctggccgcttgggcctttctctgtccccaagcccacctggaaatgggcagcccatggagaatggctgaatagctgctctctgcccccatcccaagccccaggttcagagaccaccccctccattgactgtgtcaccccttccccagcagaggagcgggctgttctcagagcgctgcaggaagcccagacaagtgccttcctctggctgctgcttccatcagcgtgaactgcccggcattgtaggataagttttctcctgggttttaaggttcaggactttctctctttgctgcgctttttccttgactgattgcacaaatcagagaaggcaagagtgaaatgctgcgtatcccttggcctagcgggtcagcgacaactttcttaacttctcaagtgagcctcagtttccttattaaaaaccagggacgattttgtggaacttgtcgcaactcaatgggagtgccgtggcccttacgcccaacgacaccatcctgtcacttcgggagtttttcctaaaacaccattccccagaccaacggcgctgcgagcttctggggcgtgggctgggcccaacatgtcagtgcgacccacagcggggctggagctgctgaatgtgcacaacacacttcacccgggcctggttcaggagcgggcgaggcagccgtacaccctgtccttcagcagactcctcttgatcgatggaatcgaagtcaggcgcagcagcttagagcagaacagaaacgtgcccatttccccgcttggtgctttcccgcttccacttcgactccttcaacccaatcctctttcacccgcatcgccaccaagtgtgatctcctttaaagagccagacgctttattttgggggggcgtggaggggtggagtctcactctgttgcccaggctagagggcagtggcacaatctcagctcactgcgacctccacctcctgggttcaagcgatttctggctagattttgttttgttttgttttgagacggagtctcgctctgtcgcccaggctggagtgcggtggccaccatctcggctcactgcaagctctgcctcccaggttcaagcaattctcctgcctcagcctccacagtagctgggattataggtgcgtgccaacacgcccggctgatttttctttgtatttttagaagagacagggtttcacaatattgcccaggctcgtctcaaactcctgacctcatgatctgcccacctcagccttccaaagtgctgggattacaggcgtgagccaccgcgcctagccttagtttttttttttttttctttttgagatggagtctcactctgttgcccaggctggagtacagtggcacgatctcggctcactgaaacctccacctcctgggttcaagcaattctccctgcctcagtctcccgagtcgctgggactacaggtacacaccagcacacccggctagttttttgtatttttagtagagacggggtttcaccgtgttagccaggatggtcttgatctcctgacctcatgatctacctgcctcagccttccaaagtgctgggattacaggcgtgagccaccgcacccggcctacttttcgtatttttttttttttggaggcggagtctcgctctgttgcccagactggagtgcagtggcacaatcttggctcattgcaacgtctgcatcctgggttcaagcaattctcctgcctcagcctcccaagtagctgggattacaggtgcctgccaccacgcccagcgaattttttgcatttttttttagtagagacggggcttcaccgttttgcccaggctggtctcgaactcctgacctcaggtgatctgcccacctcagcctcccaaagtgctgggattgcaggcgtgagccaccgcgcctgacctaacctacttattctttatctccccggaatgaaatggcctttatcaccttgggaaacagattagcatctgcttatttttctgtgctcatctgactgtaaggtaatgttggaagataatgtaattaggtttattgtaaaactttctctcttctggcgggaatattttttaatgctatgaaaataaaaatactgggccaggcgcggtggctcatgcctgtaatcccagcactttggggggccaaggtaggcagatcacctgaggtcaggagttcgagaccagcctgaccaacatggtgaaaccgaatctctactaaaaatgcaaaaaaaaaaaaaaaaaaaaaaaagactgggcacagtggctcgcgtctgtaatcccagcactttgggaggctgaggcgggcagatcacctgaggttgagagtttgagaccagcctgaccaacatggagaaaccccgtctctcgtaaaaatacaaaattagccaggcgtggtggcccatgcctgtaatctcagctaattgggaggctgaggcaggagaatcacttgaacctgggaggcagaggttgtggtgaaccaagatcgcatcaatgcactccagcctaggcgacaagagcaaaactctgtctcaaaaaaaaaaaaaaaaattcgctgggcgtggtggcgggcacctgtaatcccagctactccggaggctgaggcaggagaattgtttgaacccgggaggcagaggttgcagtgagctgagatcgtgacattgcactctagcctgggcaacagagctacactccatctaaaaaaaaggaaaagaaaaacactgtactgattttggattttttccaagcaagtaataggtaaaaagaaacccaaactggcttacatgaaagggcacctattggcttgtgtaactgatcaggtgcaaccattgctataagcttgatccagacccgactcagtgactcatgccagtaatctcagcagtttgggaggacgaggcaggcggatcacctgaggtcgggagatcgagaccagcctgaccaacatggagaaaccccgtctctactaaaaatacaaaattagccaggcacggtggtgtatgcctgtaatcccagctacttgtgaggctgaggcaggagaatcacctgaacccgggaggtgaaggttgcagtgagccaagattgcgccactgcactccagcctgggtgacaaagcaagactccatctcaaaaacaaaacaaaacaaaacaaaacaaaacaacaacaacaacaaaaaaaagagggtgaaaggcagccccagagtgggagaagagatttgtaaaatggacaaaggccttataattggaatatataaagaactcctaaaaatcaataagaaaaccacagacagcccaagagaaaaatgggcaaatggctcaagcaggtatctggtgaaagaggatatgcagacggccaatgaatctgcacaaagtgctccacgtcatgaatcattagggaagtgcaaattaaatccacaggagacacctgggcacaccctccagaaagcacacaatgacctgctggcaaggacaggaatgaccactttggaaaactctttggcagcacagccgaactgagcctctccacttgaaaatgccctttgctcagaacccagcagcagctccaaagtctccacccagcctgtggggccccagtacccacccttgcctcccatgcctctctcctcacccctgcacttggctgccctcaccctcgggctgcaccttgaacaccagaagggcgctcctgcctccagcctctgcctggaattctctgcccttgggtagccacgtggttcactcctcctttggtctctgcccaaatggcccctgtagaagagacctccccacccagccatgtcctcttcctgtgacttaccactccagactttctgtgtggatgcatcatggtctacctccttccatcagaatgtgagctccgaggcaaaggctcttcagaccttaaacagtctaggctccgtccccagagtctagaatagagcctgccacgtaattggcactcaataaatgttacatgaattaatggaaaccatcctggcacgagtggtagctctctttcctccaaaagaatgagcttgccgagagagacaacatcatgaaagagagacagaaaagccacactcagacccaacattgagttctggatcaagtttttttttttttttttttttttgagacaaagtttcgctcttgtttcccaggctggaatgcaatggcgcgatctcggctcactacaacctccgcctcacgggttcaagcaattctcctgcctcagcctcccgagtagctgggattacaggcatgcaccaccaagctcggctaattttgtatttttagtagagatggggtttctccatgttggtcaggctagtctggaacttggcctccgaaagtgctgggtttacaggcgtgagccacagcgcccagctcctgttattttttaggagctttattgttttacctttcctgtttagatctataatctgtcaggaattaatttttgtgtgtgctgtgaggtaggggtgtgaggtatggtgagaaaaaagattcatggttccccatttggatatcccgttggctcggtggggtggctaatgcctgtaatcccagcactttgggaggtcaaggcaggagaactattggagcccaggagttcaggaccaacctgggcaacatagtgagaccccatggatcgactgatgaattgatcgatcaatcaatagatagatcaatcaatagatatccaaatgatccaaaactattcacagaagagcccatccattccctacagcatgagtcagggatcacaaatgtgtggaaccttctagacacgctattctttttcattggttgatttgtccttctctgacaggtaccacattatcttaattaatatagctttttatttttatttatttatttattttgagatggagtctcgctctgtcaccctggctggagtgcagtggcatgatctcggctcactgcaagctctgcctcccgggttcaagcgattctcctgcctcagtctcctgagtagctgggattacaggcatgagccaccacacctagctcatttttgtatttttagcagagacggggtttcgccatgttggtcaggctggtgtcgaacttctgacctcaggtggtcttcccgcctcggcctcccaaagtgctgggattacaggcatgagccactgcacctggcctactacagcttttgaagtaggtcttgacatcaaattgtgtatgttttctggttttatcctgccagattatttttggttgtatttttggtagagacggggtttcaccatgttggccaggctggtctcaaactcctgacctcaagtgatctgcctgccttggcctcccaaagtgctgggattacaggcgtgaaccacggtgcctggcctcacaagaattcctttttactttgagacagagttttgctcttgttgcccacgctggagtgcaatagtgtgatcttggctcactgcaacctctgcctcccgggttcaagcaattcttctgcctcagcctcccaagtagctgggattacagacatgcagcaccacacccagctaatttttgtgttttttatagagatggggtttcaccgtgttggccaggatggtctcgatctcctgacctcgtgatccgcccgcctcggcctcccaaagtgctgggattaaaggcatgaggcaatgcaccccgccagttcttacaaggaggaggcagaagctggaaaggcaaggaaaaagatcctgccctagagcctcagaaggaagcagccgtgaggacaccttggtgtcgggcttctggctcactgaaccgtaagagaatcaatctccattgttttaatccaccaagtttgtggtacttcgttacagtgaaactaagcaccctgcacttgcgttgggtgccatggcacacccctccatcccagcgttatgttccccacggtacttacacatctttctttcacttgcagctgaaaagtacttcgactaaaacaataacctcatgctctctttttaatttcagaagtcatgtacaatcacattgtgaaacttgggaaacaacgcttccttccttcaaagtcagttctgctattcatgtggacctaatgtctctaggaccttgtgccctcattagtggcctggaaggacgcccagaccttccggttcatcaagggttgaagtgggcgatagttgttcaccatcatcttctcctcttcaccaagtgcagaaaacaggagagtacgaaatgcagagagctggaatagagggcagccagggtgagcttggtatgagtgcagggtgagccagcctctgggtgtccctcaggccttatgtggtcccctcccatgctgaatcaggatggcccgaaatgatcaataaatatggtggaagtgatggtgtgtgcagggccagattataaaaggcattgccgcttccgccttggtctttaggatcacttgctctggggggaagctggtcgccatattgggagggtactcaagcagccccgaggagaggcccatagggagaggaactgaggctcccagcgaactgccagcaccaacttgctagctactcgagagggccaaccttggaatgaatcctctagccctagttgagctttcagattgctacagtcccagctgacactgggctacaattcatgaaagatggtaagccagagccacccaaattcacaacccaaggaaactatgggagataataaatgattggtttttgttgttgttgtttgagacagtgtttcgctcttgtttcccaggctggagtgtcattggcgagatctcagctcgctgcaacctccgcctcccaggttcaagcgattctcctgcctcggcctcctgagtagttggaattacaggcacaagccaccacgcccggctaatttttttttttttttttgagatggagtttcgctcctgttgcccagactggagtgcaatggtgtgatctttgctcaccgcaacttctgcctcctgggttcaagggattctcctgcctcagcctcctgagtagctgggcttacaggcatgcaccaccatgcccagttaattttgtatttttagtagagatggggtttctccatgttggtcaggctgctctcaaactcctgacctcaggttatccacctgcctcggcctcccaaagtactgggattataggcgtttagccactgtgctaggcctaattttgtatttttagtagagacagggtttcaccatgttggtcaggctggtcttgaactcctgacctcaggtgatcgacttgcctaggcccccaaagtgctgggattacaggcatgagctactgcacccggctcaaatgattgttttctaaagccactatgttttggagctatttgttacacagcaatagataactaacacctataatgtaaatgctaaagtaacatttgaatttacttttcactgaaggaactaaaagactactttttatggctggatgtggtgcctcacgcctgtaatcccagcactttgggaggccgaggtgggtgaatcacctgaggtcaggagtttgagaccagcctggccaacatggagaaaccctgtttctactaaaaatacaaaattagccaggtgtggtggctcatgcttgtaatccagctacttgggagggtgaggcaggagaagctctttaacctgggaggcggagcttgtggtgagcgagatcacgccattgcactccagcccgggcaagaagagggaaactccatctcaaaaaaaaataataaaataaaaaataaaaaaagactttttatgtattatctcacttgttcacagaatatacttatgaaccctgtgaggcaactcacgcatttgattacattcagaagtgagattatgtctacatgctgacagcatactggtccagttagccctgcgtgatgatgcagcgccccctagagttgcgcgcatggtgcacgtggcctcctgggccgtgaccacggtgtgctcatccacatttgtggtctgcacatttgttgactgtgcagcctttctcctcccctggaaaactccccgccttccaggacatgtgcctccctggctcccctgctcaggataaggggctcctgccctgcatttttatatgacaccggccaccctggcttaatactattggcttcgtttctactttcctgccatacagcagtgttctgagacgaatgccctgttcctgtaccgcccctccacacctgcccccctcccaccctctcttggtggcacagacccagaatgggcacttgtcacatatatgcttgttgagtggcataagggccttgctgacaaggggccaccttcaacaaaagccttccccgtttgtatataagggaatattttcacaggcccgggagactgaaagaccctctaagagctcacctggagccctcggaaagagatgagccagagatgctaagtcgcgctgcgactgctgagaaacgtctgccgggcgggggcggggcataggcagcacgtctgtggctctgaactgccttggacagacagaattgctacagattcttaagatttccagaaaaaaatgatagtataacttttatttattttttattttatttttttgaggcagagtgtcactctgtcacccaggttggagtgcagtggtgccatctcagctcactgcaacctccgccttccaggttcaagtgattctcctacctcagcctcccaagtagctgggattacaggcaaacgccaccatgcctggctaatttttgtatttttatttatttatttatttgagatggagttttgctcttgttgtccaggctggagtgcagtggcgtgatctcagctcactgcagcctctgcctcccggcttcaagttattctcttgccccagcctcccaagtagctgatattacaggcatgcaccaccacgcctggctaattttgtagatttagtagagacggggtttcaccatgttggtcaggctggtctcgaactcctggcctcaagtgatctggctgccttggcctctttaagtcctaaaattatgggcatgagccatgacgcccagcccaagagtataactttaaaaagtgtatacaaatattattaattaattttcgaaaaaaaaaaaagcaatgaaactatttagataagaaaaaggaggccgggctcggtggcttatgcctggaatcccagcgctttgggaggccaaggtgggcagatcacctgaggtcaagagttcaagaccagcctggccaacatggtgaaactccgtctctactaaaaatacaaaaattagccaggcgtggtgatgggtgcctgtaatcccagctatttgggaggctgaggcaggagaatcgcttgaacccaggaggtggaggttgtagtgagccgagatcgcaccactgcactccagcctgggcgatagaacgagactctgtctcaaaaaaaaaaaaggaaagaaaagaaaaaggaagaaaacaaaaaccatgcagacccatgaccctgggacaactcccatggatgcctcgtgtgtctgtgtgtgatagattagggcgttgctcaggacatgcttgctgtgatcactggaaccgctgtccaatctcaacaagctcctacttcagttggaattttcttcttgtgtaagaatgccccaaatgcatgaaagaatatatataactccacaacgctctcatgcagcatcttagtgacgctgccaagcaagagggacgccttccatgaagcgccatcgtgccagttacgggcacggctcacctggcttggggccacttcaacgggctccttctggatgatccaggtgaccgactcggtcagcggcggggtggtgagcgagcccgcgtaggtccagtaatcccagcaggtgggcagcagagtggaggggtcgaaggggcgcatggccgcccgcgcgtcctgagagaccgagaagcacaggacgtgtcagtcctcaggggagactaggagcttccatcttgtctcagcacgtgaggccttcatggtgcttggaaggaagtgctttcccccagataaggccatgaggccactgctgtcacacttgcaagcagtgatgagaaaatgtgacccttctatacagagcaaggattcctgccaacttacattggtgggaattacgttacattacaccagcttacgttggtgctcacatttttccttttgaagtcatttcttggggcgcagtagctcacccctgtaatctcagcactttgggaggccgaggcgggtgcatcacttgaggtcaggagttcgagaccagcctggtcaacgtggtgaaaccctgtctctactaaaaatacaaaaattatccagatgtggtggtgggcgcctgtagtcccagctactcaggaggctgaggcaggagaatcgcttgagcccaggaggcagaggttgcagtgagccgagatcatgccactgcactccagcctgggcaacagagtgagactctgtctcaaataataataataataataataataataataataataataataataaattaattaataataaaaataaaaataaagccatttcttttagcataccttggctgcaaaaaatattactttttattgtgataaaatatacataacataaaatttaccatcttaaccttttttttttttttttcgagatggagttttgctcttgttgcccaggctggagtgcaatggtgtgatcttggctcaccgcaacctctgcctcccaggttcaagcgattctcctgcctcagcctccagcgcctgccaccacgcccagctaatttttgtatttttagtagagacagggtctcaccatgttagccaggctggtcttgaactcctgacctcggatgatccacccgccttggcctcccaaagtgctggggtgagccactgtgcccggcctatgggctcctttttaaggagggagtcatggtggccaagaaggatgtccacatgcctaagcacccggagatggcagacaagaatgtgcccaaccttcatgtcacgaaggccatgcagtctctcaagccccgaggctgcctgaaggaacagtttgcctagagacatttctttctttcttcctttctttctttctttctttcttttttttttcagacagagtctccaggctggagtgcagtggtgcgatctcagctcactgcagcctctgcttcctgggttccagcgatcctcctgcctcagcctccctagtagctgggactacatcttcacgccatcgcgaccagctaattttttatatttttagtagagacggggtttcaccatattagtcaggatggtctcgatctcctgacctcgtgatctgcccacctcggcctcccaaagtgttgggattacaggcgtgagccaccacgcccggcttgcctggagacatttctactgctaccttaccaatgagggcatccagtatctccgtgattaccttcatctgtccctggaaactgtgcctgccaccctatgctgcagccgtccagggactggcaggcctcggcctaaaggtctggagggtgggcgacctgcaagactcacaagaggggaagctgacagacatacctacagacggagtgctgtgcccctggtgccgacaagatagccgaggctcgggctgggtcagcaaccgaattccagtttaaaggcagatttggtcgtggacatggccagctacctcagtaaaatcagagaggattattttgcattgaatacactcacagccaaaaaacaaaaagagtcagggtcttactttgtcacccaggcaggagtgcaatgatgccatcatagctcactgcaggctctaattcctgggctcaagcgatccccccgcctcagtttcccaagtagctaggacaccacaccagggtttaaaattaattgtttgtagccagggggtcttgccatcttgcccaagctgttctccaactcctgggctcaagcgatcctcctgccttggcttctcaaaatattgggattacaggcataagccactgtgcccagccagctcttttggatatatacccagaagtgtgtgattgctgaatcatagggtagttctatttataactttttattttttttattttttttgaggcagagtctcactctgtcttccaggctggagtgccgtggcatgatctcagctcacggtggttgggcctggccgcaacacagccctcatcagcgtcccatgccaaccaagcatagctctgcacctgcccctggccagcactgtgggacaagagtccagtccaaagtgacagagtccctgtctgcaaggaagatggcctccctgctcagccacatcacatcaccttgactttgctgggccctggccttccaaggtggaagctggcaacccagatgccttgggcttgtctcctaacatcaagcagtgagggtcagggtcaagagaggtggctgagctaccagaaggaagcccgggagtgtccacactggcagacacatgcatcagttctatgcacgcatgttcacgtttataattatccagttaattaaaaaaaaaaaaacagcattataggctgggcacagtggctcatgcctgtaatcgcagcattttgggaggccaaggcaggcagatcacctgaagtcaggagttcaagaccagcctgaccaacatggcgaaaccccatctctactaaaaatacaaaaattagccaggcatggtggcaggtgcctgtcatcgcagctgctcgggagactgagacacaggaactgctttggcacaggatgcagaggttgcagtgagccgagatggcaccattgcactccagcctgggcaacagagagagagactctgtctcaaacaacagcagcagcagcaaaacccacagcattattgtgatagaattcacataccatgcaactctcccatctaaagtgtacagcctggttgggcgcaatggatcatgtctgtaatcccagcactttgggaggccgatgtgggaggactgcttgaggccaggagtttgagaccagcctaagcaacataacgagaccctgactctacaaaaaatacaaaaactagccaggtgcagtggtgcacgcctgtggtcccaggtagttgggaggctgaggtgggaggatggcttgagccccggaggttgaggctgcagtgagctgtgatcataccactgcactctagcctcggtgacggagtgagatcctttcttaaaataagtaaataggctgggcacggtggctcacgcctgtaatcccagcactttgggaggccgaggcggatggatcacctgaggtcaggagttcgagaccagcctgaccaacatggcgaaaccatgtctctactaaaaatacaaaattagccaggcgtggtggcgcatgcctgtaatcccagctactcgggaggctgaggcaggagaatcacttaaacccgggaggcagaggttgcagtgagctgagctcatgccattgcactccagcctgggcaacaagagtgaaactccatctcaaaaagaaaacaaaaaacaaaaaacaaaaaaagtaaataaaaattgaagggtacagttctatggttttgggtatattcacagttgtgcagccatcccaagtcaattttagaacttccacctcaagggggaagcttggtactttttagctatggtccccacccccgccctgctgcttctgtctctgtgggtttcataggaactgagtcatgtaacatgtggaacatttgtgtcttgtgtctctcactcagcacggcgcttttgaggctcacccacaccgcagcatgagttagagctgtgtcctttctgattgccaagtaatatctcactgcatggtctagctgggttgacatcccattgcacgctctagctgggctgtgaaggagcagactgcttgtgcatgtgggtaacaggcgggtgtgcagtgagacatcagtctggtgcacgtgggtaacaggcgggtgtgcagtgagacgtccgtctcctcctgcctgccacacatccccagggcacagatgtgccagtcactttctgagcaactacttcaaatcttcagaacaaccctttgagaagtatttctagtttactgatgaagatagacagacagatataaaaaacttgcccaaagccacgttgccagtcagggccactgaggcctggcccgttccgaggtgcgggctcttccttccctccccaaggctgcaggaatcagtcaggggagtggcaggctccagccatgccactgcgggtaggtttcttgccaatta

SEQ ID NO: 39 - DNA, 124596 bp, Homo sapiens
gcttgcccaagcaatggcaccaagccaataaatattattctctgctatcaacagccaaggccacactctgatttgttagtggtgggttaaataaacaagacttctggctgggcgcggtggctcatgcctgtgatcccagcactttgggagtggatcacaaggccaggagatcgagaccatcctggctaacacagtgaaaccccatctctactaaaaaaaaatacaaaaaattagccgctcgtggtggcatgccactctgtagacccagctactcgggaggctgaagcaggagaatagtttgaacccaagaggcggaggctacggtgagccaagatcgccccactgcactccagcctcggcgacagagtgagacaccaactcaataaataaaaaataaaataaacaagacttccagaccacgggtggagaagatccagccagggagctgggcacaactccccgtttcactgtgcggtttcatttcagttggaaagaacttcatctgttgaagtgcacagacagcattcagaggctagagacgccggcatcggcacagcacacagtgccctctgttcccctggcccaggccaagagctctttgtgtgtctgagtgactggtcagcactgggcaacaaacccacgccgggagacggacagcgagccgcctcaacccaccagcctctggggagcctctcatctcgcaagcacctgcggaggcccgcccggcgccagaccagtccaggcacccagaggcctctgctctcctggagctcatgacaagtaaacaaatacacaagatggtttgggatcccgatgaataagttaagcagggcaacccaacagggaggacagggctcccgcatgtgacggacccaggagggagcgaccccccgtgttgacatggggggaaaggcgggaagtcagagaggccgggaggtcagagaggccaggaggtcagagaggccaggccccttcacacggggtgggcgggggggggggggatttgctccctctggaggccaaagaggagggtcctttccacctcttccagcttctgggggcggctggcttcctgggcttgtggcgtgtctgtcactccagtctctgcctctgccttcacgtggcctcagtgcatgtcctcacatggccttcttataaagatacctgtcatcgcatttaggacccaccctaatccagcacgacctcatcttaactaatggcacatgcaaagaccctgattccaaatccggttatgttctggggatccggtgaacacaaatttcggtgctttgctcagtttctatggagtcttgtgtataggaagggacaggagaagaaccaaattctcatctgaggcagatttttattcctcattgcaaaatttaaacatgaaaccaattaaaacctttttggggaggcctctgctcaatcagtcaaccaaggactatttaccaagcagctggtcttgggctcagctctgcagtcagcactgtggtacctgacacggattggcagcttgctctcagaacatttccaggctaaccaagaggacgagcacaacgagctatttttcaaggaatagatcagttaagatataacccacctaccgtacgatttgcccatttagagtgcgcaattcagtggccgttagtacaatgacagagttatgcagctattaccccaatcaatattaaaacattctcttttctttttttttttttttcagatggagtctcactctgtcgcccaggctggagtacagtgacacgatctcagctcactgcaacctctgcctcctgggttcaagtgattctcctgcctcagcctcctgagtagctgggattacaggtgcgtgccatcacgcccggctaatttttgtatttttagtagagacagggtttcaccatgttgggcaggctggtctcaaactccagacttcgggtgatccgcctgcctaggcctcccaatgctgggattacgggcgtgagccaccacgcccggccaaacgttttctttttacttttttttttttttttttttaggacagggtctggctttttttttttgagatgcagccacaaggccaggctggagtgcagcggtgcaatcttggctcactgaaacctctgcctcccgggctcaggtgatcctcccacctcagcctcctgagtagctcaggccacagacacatgccaccgtgcacagctgattttattattatttatgtatttatttatttaattgagatgggggtcttgctatgttgcccaggctggtcttgaactcctgagctcaagcaatccacccgcctcagcctcccaaagtgctgggatgacaggcgtgagccatgtcacctgccccagttaacttttgtgtatatttggtagagatgaggttttaccatggtgcctacactggtcttgggctgagctcaagcaatccacccacctcggcttcccaaagtacagaggtgaggcaccatgcccagcataacttttccttttttaatttattgaaaatacataggactgtataaagccaaaattaccacatcaccctggggtttgtaatgtatgtaggtgcaatatgcaagacaacagcagcatgaagcatggggggttgggtaaatatggtcacaaggcttctatgttttatgtgacgtttatatttctaatactaactctgggctgggcgcggtggctcacgcctgtaatcccagcactttgggaggtggatcacctggggtcgagagttcgagaccaacctgaccaacatggagaaaccccgtctctactaaaaatacaaaattagccaggtacggtggtagatgcctgtaatcccagctatttgggaagctgaggcaggaggatcgcttgaacccaggaggtggagattgtgatgagccgagatcgcgccactgcactccagcctgggcaacaagagcgagactccatctcaaacaaacaaaaaacaaaacaaaacaaaacaaaacactctgagtagactgtgaaaaactaagggtagatgttgcaatccctagagcaaggagaaggaatagctaaaaagccatagttcttgcttcataatgctaatacttggggtgggcatggtgactcatgcctgtaatcccggcattttgagaggccgaggcaggtggatgacttgagttcaggaatttgagaccagccgggcatggtggcgcatgcttgtaatcccagctactcaggaggctgagacagaagaatcgtttgaacctgggaggcggaggttgccgtgagctgagattgtgaattgcactccagcctgggcaacagagcaagactccgtctcaaaaaaaaaaaaaagctaatactcagaatagaaattccaacttgaccacttagtggtgtgatcagaggcgggtctctcagcctctctgaacttcatctgtcctgggaattgaacaatctaagctgtttatcccccagggtgtcccagaggatgaaatgaggcaatatcaactgtgcactgtgttttgtaacctgagaagcattgttagcctgcaaagggtcccttccatttgacaggattctcctgtaccagagatgatggtttcctccctatcccccaagaaaacagagactatctctgatttcagcaaacagctgtgtcaaggcctcacatccttggcatgcaggcatgtctcagtcattggtgaggacctctgatcccaccttcaggttcacgatcaaagggactgttcccatttccttgggcaagaaaccagaggcccgggactttgtacaatttccgaagcaaatgttatgcacacatacgccttccccagcccacaggagatacgcatttccggaagcttttggtgatcgtgatcacacgtaggcagtttccaaagcgtgaggggacctggtggtgcaggtgaggtggcccgtcccaggtcctacaaggtcctctggcacagctgggatccctgctaactcggcggaagggctctctgctcaccctgccacctcggtgccctgtggaccctgatcagcggtctgaagccaactgccctggcatgacctccctgtggggttcccttcccagcctgaaccctttggggttccactgctcaccaggggtgatgcttcagaaatcatactaaacagcacctgcttcagaggtctaacctacccctggcccagcccaggtaggagttccccagtcttcatgagcttgggaggggtggtcagacaccaggagactgttgccattccctgcagtgacactccagaaaccaggcagccgacggtcccagaggggcgagtctaaagggaggcactgccaggtggggtatcccaggctgcaggacacccacggagaggctgagggttccggccagagaaaggaatagagcagagccctctgattgctccttcctacaaagtctaggtggacgtcctcaacagcaggtcgctttgctgaggggactgtcttcaaggggaagcagccagagaaatctaccacgacctaaaccagccctcacacttagtcttcggcacatgccaaaggtgttccctgcgttagtctccactgctgccgcgcttccctcccagcaagctcaagaaaagcctggccctgtgtgtatcaaccgcatggtccccctttgatctctctggcccagctgccgggccctggctcgccactggggaggccctcagtcctctcgcattgatccttccagtgaggccacgggaaagcctttggcactgggtgctgtagggcacatgagctggggtcagagccttggaccaccaactgcaaggggtgctgtggagggctctctggagacccccacagcactgaggctctcgtcccccgaccaggagtttctccacaaattgttctccaggaactgcccttggctaaagcaatgtcacgtcccaggccatggtccctccctggtggcccatgtggaatcactcgtcagtgtcatatgagaagaattgtatgctcagaccctgtaacccaaggcagctgcctgcttgccagtgttgtctcagagcctgtttgttgcagcaacaaaaagcacaggcatctcgggggcttgaaaactcaggcttctttctcgtgtacatcaagtccgctgggggtccaggaggttccccagggtagctgctgccaggggagggcccacacatgacccacgccaacccctgcttgcccagccatcatgcagaggacagaggaaggcgaaccccagcaaataagggcttccaccaagaagcgacacccattgcctccactctgagcccactggccttcccgaagtctaagactagaattcctgcctgtgcataaagaactggggattggtgaaccgccatcagatctgccagatgtttcaggaaagtgaacatttgtttacatctgtgtggattgggctacctccttctagacagagcccggtcccctcagcctcactgccctctttttattttattttatttttttgagacggagtttcactctttttttttttttttttttttttgagacggagtctcgctctatcacccaggctggagtacagtagcacgatcttcgctcactgcaagctccgcctcccgggttcacaccgttctcctgcctcagcctcccgagtagctgtgactacaggtgcccgccaccctgcctggctaatttttcgtatttttagtacagacggggtatcatcgtgttagccaggatggtcccgatctcctgacctcgtgatccacctgcctcagcctcccaaagtgctgggattacaggtgtgagccaccgcgcccggctgagatggagtttcactcttctcacccaggctggagtgcaatggcacaatctctgctcactgcaacctccacctcgcaggttcaagcgattctcctgcctcagcctcctaagtagctgggtttgcaggcacccgccacccacgccaggctaatttttgtatttttagtagacatggggtttcaccatattattgctctttttataacagatattttgaatgcctcctttctaccctgaaatgaaatccacagaaactataacttgccaatacacggaatttaaaaaaatctacacgatacatattggatcatacaagcatgagagataaactgaagcagaaaggaagtatgaaaataaaaacaattggcaataaagcaatatgaatttcaagatgtaaattctcaggcaccgctatgctagaagacataaaacacgaatgctgtactcacatgtaaatttgctgtcaacgcagcagggacaaatgtcagcagcatcaggagcactgtggctcaaatgccaggaggggatttactaaaattgtgagcctctcctggttccagttagaacccagcaccttcatctgcatggtagtttcatctctacagatttcagaacttatcaaaactggccaaagtggctgagcgtggtggctcatgcctgtaatcccagcactttgggaggccaagacgggtggatcacttgaggtcaggagttcaagaccagtctggccaacgtggtgaaaccccgtctttactaaaaatacaaaaattagctgggcgtggtggcaggtgcctggaatcccagtgactcaggaggctgaggcaggagaatcacttgaaccagggaggcggaggttgcagtgagccaagatcatgccactgcactccagcctgggcgacacagggagactctgcctcaaaaaaaaaaaacaaaaaaaaaaaactggacagacccactttgtgttgattggcaaaaaataataacaatgttaggttttaggatcagatagttataaataggtttttcacctttgaaaactcatacaggacaatccttcattgtttaggaccttttttcacatcacagaacatttagcctcctttctcttactccacatcctaagaaggctgcaaacacctcccacaaacttccaaaatgcctcctagggagggtaccacatccaataagaaaacctctataggctgggtgcactggctcatgcctgtaatcccagcactttgggaggccgaggtgggtagatcgttcgagcccaggagtttgagaccagcctgagcaacatggtgaaacctcatctctacaaaaaaaaatacaaaacttagccgggtgtgttggtgcacacttgtgatcccaactacttgagaggctgaggtgggaggatcacctgagccggggagttcaagcctgaagtgagccatgatcacaccactgcactccagcctggatgacaaagcaagaccctgcctcaatcaatcaatcaatcaatcaatcaatactttttaaaaaagaaagaaaacctccatccaagatggtattagctgtagtgttttctaggccaccaaagaagtggaaaacatagaaggacttgaggagtagcgttagtgacacatttcagtgctagagattctatacaataaagataagtgaaaggctgggcacggtggctcacgcctgtaatcccagcactccaggaggccgggcatggtggctcacgcctgtaatcccagcactttgagaggccaagggggggcggatcacttgaggtcaggattacgagaccagcctgtccaacatggtgaaaccccatctctactaaaaaaaatatatatatatataaaatatatatataaaatatatataaatatatataatatataaatatatataaaatatataaatatatataatatatatataaatatatatatttatatattatatataaatatatataatatataaaaatatatataatatataaatatacataatatataaatatatataatatataaatatacataatatataaatatatatattatatataaatatatataatatataaatatatataatatatataatatataaaatatatataaatatatataaaatatatatatgtatatatatatatatatatatatatatatatatatatatatagccaggcgtggtggtatgcacctgtaatcccaactactggggaggctgaggcaggagaatcacttgaccctgggaggtggaggttgcagtgagccgcgattgcaccactgcactccagcctgggcaacagagcaagactccatctcaaaaaaaaagataaatgagataaaattgtattgatggaggagcaagacttgggaatgagaccccagagggcatagaaaagcctatttgggaattagaaatagaggaatcccaaggacatattgtttgcttctctgtagtggttgaatagtgacaccctcccccaccaacgagtatgttcaagtcctaatccctggcacctgtggatgtgaacttatttggaaatatcttctttgcagatgcaattaaggatctcaggatgagatcattcttgattgaaggtagaggctaaatccaatgggtggtatccttataaaataaaagagaggggggtttgaaacacagagagacagagaagaagaccatgagaagatgaggcagagattgcagtgacagagcttcaagtcaaggaatgcctggagccaccaggagctagaaggggcaaggagggtgtgatggttggttttatgtatcagattggctgggttgtgggtactgagatatttggtcaaacattattccaggtgtgcctatgaagatgtttctggataagactaacatgtgagtttgtacacttagaagagcagattgtcctctccaatgtgggtgggtctcatccaataagttaaaaacctgaatagaacaaaaaggctgttcctctcctgagaaagagagaattcttcatacctgatggcctttgaactgggacatgggtctgttcttgccttcagaccagaactgacacatggggtcttcctgggtctcaagcctgtgggccttcagactagaactacactaccagctctcctgggtctcaggccttcagactcagactggagcattcaccatcagctgtcctgggtctcaagcctgtgggccttcagactagaactacaccactagctctcctgggtctcaggccttcagactcagactggagcatgcaccattggctctcctgggtctcctgcttgccgtctcaccctgcagatcttgagacttgccagccactgtaattgtgtggccaagtccttaaggcacacctctttctacatataaatgtacatccttttggctctgtctgtttggagaatcctactaatacagaagtgtctgagttcattttgtgttgccatagcagaacactgggggctgggtgatttttttttttttttttttttgagacgaagtctcgctctatcgccgaggctggagtgcagtggcgcgatctcggctcactgcaagctccacctcctgggttcacgccattctcctgcctcagcctcccaagtagctgggactgcaggtgcctgccaccacgcccggctaatttttttgtattttttgcagagacagggtttccccatgttagccaggatggtctcgatctcctgacctcgtgattcggaggctgggtgatttataaagaacagaggtttatttggccataactctggtggccagaagtccaagattgggcagcccatctatgagggtcttgtgctgcttcaagtcctggcagaaggcagaaggagagcgagggggtgcagagaccaaaagtgcgaaaaaaaaccacctggtcttgcagtaacccagccccatgacagcaagaactcactttcccgacacagcatttgtcgattcaggaaggatctgccccatgacccaaacacctgccactaggccccacctccaacactggcaaactgggactcaaatttcaacatgacttttggcaggaacaaagcacatccaaaccatagcagaaaggatggtccccaagagccctaggagggaacgtggccctactggtaccttgatttcagagttctgcttccagaacggtgagagaatcaattcctactgttttcagcccccagtgtgtgggactgttccagcaggccccagaacactctcacaaaacaaaatcaaacaggctaggtgcagtggcttacggctgtaatcccaccactttgggaggccaaggcaggcagatcacgaggtcaggagtttgagaccagcctggccaacatggtgaaacccccatctctactaaaaatacaaaaattagctgggcatggtggcaggcgcctgtagtctcagctacttgggaggctgaggcaggagaattgcttgaacctgggaggcagaagttgcagcaagccggggctgcaccattgcactccagccttggtgacagagcgagactccatctcaaaaagaaaagaaaagaaaagaaaagagaaaagaaaattatccctgtgcactataaatttgagaatggaggggtctctaatttcacagcatccctggtggagaacccgacttcccatctcctccctggtcttccgaggagtaagagggaggagttgatttgctccctgaggagcagaactggaagaggaggggagagaagctggtcacagttggtctaatacattttgtgtttataacaggcctgcagtgaagacaagaagagccttggctagagttcccaccacggctttaactggatggacgtctgggaacacacatctcccttccctgggcttccatctcttcacgtctcagtgaggatgttgactaagcagatctcctgggccccttttccagctcaaacccgtgggttctctgaccactggagtcagagcacaggcctctgatggagatacgatgtcacagagaggtgtctggcccagaagaccccagcgtcaagctccaagcttctgctccaagtcagcctggaacagaatcctggagagggcgggtggaccttcaaggaggaggcagctcccgtcactgggctgatgcgcctgcccagaggcctccacaggaggagcctgcagggtgcgggccacccccaggctgaactgctctctcacacggtctgaactggaaagggcctgagaccttcagcggacgagagccacccctcaccagggagccagttcctccacccccacctgggtgccctgcaggtccctcagagaccaatgaccacctaagaggctgtggctacagctgtttcctggctgtttcctctcaacttgagaaagtcccatgaaacagagcagacctggcgctgtttagggggcggccgccagttacagcgcagttcctctcccgggctccaggacctttccaggagcttccaccccggttccgctgcttcctgcctcacacaatgacctggtcccctccatccatctgccatctgcacacactgaaatccatgggtccccaagctcctgccacggcacttctgccatgaggcctcccaggatgaccccttaactccatctttccaggaagacacctgcttagtcaattccacagcacctggacagacacacgctccgtcagtcacagagagcagcccttgctgtgcaggcacagtggctcatgcctgtaatcccagcattttgggaggccgaggcgggcagatcacttgagtgaggtcaggagtttgagaacagcctggccaacatggtgaaaccccgtctccactaaaaatacaaaattagctgggtgtggtggtgcttgcctataatctcaactacttgggaggctgaggcaggagaatcgcttcaacccaggaggtagaggttgcagtgagccgagatcgtgccattgcactcccgcctggcaacaacagcaaaactccatctcaaaaaaaaaaaaaaaaaatagaaaagaaagaaagcagctctcgctgccagctggtcacagacactgggtgctgagatggaccaagtcccactgcactccagcctgggtgacagagcgagactgtctcaaaacacacacacacacacacacacaaacacctgtttctctgtgggcatctgctgcctcttgcagcctgaccgttatgcactatgatacccgcagaggctgtttcctttttcttctttcaaaatgtgtctcctcatagcccatgcagcaccaggagcgagggagagaaggaagaaagtggccgaggggcaccgaccccatccctccacagcacacccttcacagtggtctgtgctgtcactctctgggtgttcgtctgcctgatgaggctggcagctcccagaacgcactggtgggggttcattcattctgggaccctccagttcctggtacagggccctgcatcagatcacaccacccagtccacatagcacgggatggggcagagatgaccacacacttcattcaccctccttgtgtcatacgattctggaagagtagaatccagtggcagtgacactgtgccaattccaggccaggccccaggaggctggcagctcctacatcccttcttcccttctctcagaacagtcactctggagcaaggagcttccacgtgagaaaccccactaccctcagactgccaggtgatggggagctccaggcaagccccatggagcccgcgtagagagacagttgcctaactagccccaggggttccagccctcccagtgaggggccagacacgtggacaaagaagccttgagaggactctagactcagccaccacctgactgcaagtgcatgggagaccctgcacaagaaccacctggctgagcccagcctgtcccagactcatgagctgctacactattgtcctaagccattacgtgttgagctgatttgttctgcagcaatagatagcccaagaagtggcttggtgaggaccaaaacaggctcccactctaggggggacgcattgttaaacagcactccctctgggctgacacagtccacaggaggctagtggacaccacctctgtgcagggaagcagaggccccatctttgagctggaggaggcccagccagaatgcacagggtgcccatgagtcgcaggctggcgccaggtgcttttgtacagtgaacaaactgtgcaactgtatgtggtggcccttcctagagctctcattgcagacaggaggcaggaagagtctgatgagagctccatcaccgtccttcacagtatccttactgactttcatccgcccagtccacagaggggccccttgctcatgctggggaactcagtgcagcagggacctggcagaatgctcaggcgaagggaggtggggtgccaggagaccatggagaagggcgctggctgggcttggcaacacacgggtcaggacctgactctacttcccgggcacagggctgcagtcactgcttgtcccagccttgttcgcccgaccaagctcttttgaagttcaatgccaggaacattaacaagtgtgctgatctggaactgagtgctgcctgacccccatctttggctcttctgccccggatgcacctaccccactccctggtatccctgcctgtccagaactgcctggtgtcattatccagccctgccccgcccaacctgaagggatttgcctcccagcctccagattctctctctgctgtgtccaccctgttctgggcccgggggcctctcttgccttcaggggcctctcttgcccacgggggcctctcttgcccactgtggcttccaactgggtttgtggctggattttcttccccagctccccactggagctctgctgtggggcatgcttctccaggaaggccagcagcccctccctgttgcagggatctcgggaccttctgggccctccctgtcctccctgagctcggggtccctggtcctgctctctcgaagcctcggtttcctaggcccttcccacactggcgaatactctctgtatcccaccctcctccccaccacgttcccaccacgaccctgcctgaggagggtcgaaaagaaaacaacatggctttgactgctgtcctgaggcttcccgggatgacccctcgactccacctttccaggaaggcacctgcttagtcaaacacatagcacctggacagacactttatcccatatcttggggtctgatgggcaggggcagcatgtggagagagagggcggatgggccgtcatccttccttccccagaggctgacctttctcgctggtctctggggcctcgtggccatggggcctccaacgccgcccagccatgttgctgagggcgaggcaccaggcctctctgtggcccgcttcctcccatgtcatagtggtcatcatagccctgccacctgcccatctgcctgtggctcacccagctgggaaggaactgagagttgtgagatccacacacactccccaggcaggggctctccccgccctgaccttggtgcatggacccctggcctttttttttttttttttttttgagatagagtcttgctctgtcacccaggctggagtacagtggcgcgaccttggctcgctacaacatccgcctctcgggttcaagcgattctcctacctcagcctcccaagtagctaggattacaggcatgcaccaccataccgggctaatttttttttttttttttttttgagacagagtttcactcttgttgccaaggctggagtgaagtggcacgatctcagctcaccacaacctccacctcccaggttcaagcaattctcctgcctcagcctcccgagtagctgggacaacaggcatgcaccaccaggcctggctaattttgtatttttagtagagacaggatttctccatgttgaggctggtctcgaactcctgacctcaggtgatccgcccgcctcggcctcccaaagtgctgggattacaggcatgagccaccatgccaggccaattttttgtatttttaatagagaagcggtttcaccatgttggccaggctggtctcgaactcctgacctcaggtgatccacctgcctcggcctcccaaacttacgggattacaggtgtgagccaccgtgcctggcgggccctgtgttttgatacctgagaaggtgcagctcacctggttctggagtttaattggaccctgagttctcccagtggaagtctgagaaggccaagctgagctcgatggctgtcagaatcctcatttacattggatgaacagggcgcagtttcccctgctccggaggatggtggggtgaggtgggagcccagcctgggggagtgggggcaatagaagctgtgggagcagcagccccccaggggccaggaccacgaagcctccagggacgagcaaggaggccgcagagggccaggcatcagagtggagagcagacgcacaggacacccagagaggcccctgcccctacctcgccccctccaagaacatgctcttccagtgaagtcactgcagccccactccctccccacacggaggaggaggcagctttagggtacctaggacacgaaggtgaccaagacacaccactgtggtcaaggggcgtgtggctgaggacgacatctgtcaacctcccttaccatgactcacgttcagaaatccacagacatacgcatacatgtgtcggaaacaaaagtggcaccgacagttctctcaaaggagccgtgttctgcgcagacacccgcagcccctgtccaacatacagccaggtaaagctgcagccgggcctcccggcaccccaggcccctccctttgcagccggggcacggcccacagctctttaaaaagcccactgccttacatccccacgctgtcctgcagaagactgcagtcaggtcttctgcctcccagaatcatttccccagcagcccggcggcgcccacccagccccaacggggcctgtcctgggaggtgcctgcagggcggctcttgttttctttcccacttctgtgcccacgtgcatttgtaagggctccgggaggagggggcttcccttttctgtgggtctctttcaggtcctccttccacagagctacacaaggccccactaattgctctaattgccttgccgccacctggtgcagatgcagccgcctttccaaacggagctgccgggcagggctgtaactcatacttcctgcttgaatcatgtctgcctcttacatcagccaccagcctctttttcatccagcatgggagggtgcagctggggcagagctgccgttgatgtaaagtcactaagccctgggggctgggttcatgagtgggatgggaatggaggtgccccgggggctcctctttctctccagaacatgctgcaccctttgtgggcaggttggcacctgtacaattggagataatgggtgtcatacggtccagttgctcctctgagctgctctgacacgcacctgccctcacctgggacacggcaggctcccctgtgagccacccctggaggcgcggttcctggaagcagggagggaggagggcagggaggttggggtggggccctttaaggagtcagccctgccctttaatcctcacagggacgatgggagccaggatggctgccagcgtttcgagataacgccagccatgcagggcctggaagggggagcatcacccaggcacctcacagagcacacatatgcaaagccacacggtccacaccccagcagacacgggagagaggcttcgcaccaccagctcccagtgatgatgctgcctgcctgcagcctggtgtttgcagctggacttagttcttaaccaggggatacagcaatgtttagaacaggggtgtccaatcttttggctttcctgggccaccctggaagaagaattgtcttgggccacacatcaaatgcactaacaatagctgatgagctaagagaaaatcacaaaaaaaatctcataatgttttaagcaagtttacgaatttgggctggatgcagtggctcatgcctatgatctcagcactttgggaagctgaggtgggtggatcactgaggtcaggagttcgagaccagcctggccaacatggtgaaaccccgtctctactaaaaatacaaaaattagccaggcgtggtggtgcctgcctgtagtcccagatacttgggaggctgaggcaggataatttcttgaacccaggaggcagaggttccagtgagctgagattacgccactgcactcctgcctgagcaacagagcaagactccatctcaaaaaaaaaaaaaaagtttataaatttgtgttgggcctcattcaaagctgcactgggccacaggtcggacaaacttggcgtaaaatatttttgggttgtcacaattaactaacggggaggttgctgctggcctccagtcggtggaggccaaggatgctgctaagcatcctgcaatgcacaggaaacaaccaattaaccccacagtgaagaattatccagcccccaatcccagtgaccaagactgaaaaacccgggctgggagagacagtgctgccatcgattgcttatgtctgccactggtgcagacagggtggtggtgatgcctgcaatcctaatcccacccggcagactgtcctgaatgtataacccatctcacctcccactgttctctctgggaccttcacacctatagtctcctttgctctgtgagctccaggttgaggagaggtgcttggacctgggccaccatgttgcacaactgcgtaggttctgcaacatgttggcctcctttggattgttgttgtcttgaggatggtttttatacaggccgggagttgaaatctcaaagagctacagggcccagacccaggaaagagatgagtgaagtgggcaggtgggaatgatggttaaatgcagaggcgtgccacaaccaaggggcaacagccttcagcccccgccacttccaggctctgaggatggtgagccccagattactaaatctttcatttttttaaaaggaagtaaaaaatgtgtttttcttttttaaatgtgaaattggccgggtgcaccttgacctccaaaactgctgggattacaggcatgagccatcacacctggtcaggaatctgttttttaaaagattttaaacaatgttctttatcttgatagggattcgggttaacaagtgtatgtgtctggcaaaactcatgaagtggtgcctcgtaggtagtttgcttcagtgtatgtgactgtacacaaagaagaaagaaggaaggggtggaaggaaaggagaaagggaaagagaggaccataaaccaatgctgaacactagttgaagcccaagtccagtatgatttccagaggtttccctaacacccgctatcccataactcaaccattttaccatgtcctgtgccactggtattcttttttttttgagacagaatctcgctctgtcacccaggctggggtgcagtggcatgattttggatcaacgttgtcagcggggtccccgcaggagatctgagcacaagttccttctgggagcagggaggtgcataggcacctggatcatcatttccgcttctggggtggcaattctcctagaacctgttcacagctgtggcattcgtgtcctggaactgctatcattagcttccacaaaacaggtggctctaacaacagaaactgagggtcctgcaatcctggagaactaaagtccaaaatcaagttgtcagcagggcctgctccctccagaggctctagaggaggctccttccttcctcttccggctcctggtggcccccagagtcccttggtgcctggctgcatcgctccaatccctgccttccccctcacacagtctctcctctgtgtctgtgtccaaatttcccccttcttataaggacacctggcattgggttcagggacggcccctcggtaagtatgactcatcttagataatcacatccgcaaagaccctgtttccaaacagagtcacattcacagataccggggttaggactcgagcatattgtaggctgcaactcacccacacagctgtagagaagcacagccactcccaaaccatgggcaggggcagcagcgtgcacactgagcactctttcgtttttttttttcttttgagacagtcttgctctattgcccaggttggagtgcagtggcatgatctcagctcaccacaacctccgcctcctgggttcaagtgattctcctgcctcagcttcccaagtaactgggactgcaggcacgcaccactacacccagctaatttttgtatttttagtagagacggggtttcactatgttggccaggctgatcgcgaactcctgacctcacgatccacctgccttggcctcccagtgtgctgggattacaggcgtgagccactgcgcccggccagcgctctgttctttctccaatggccccactgcaattccctggacaagagagcccctgaagcaggctgtagggctcaggccgcggcacagagatgggcagagggagcccaacagctgtgagtgggagggggcagctctgccccacacacccctccctcagaagagccagaagagagaaaatggtctcctcccacgtggggtctttgaagcagcccacaggtgctggtgactctggccgcagcgtggttgcctgcaggactgtccccaggccctggagacccaccttctcctctcagccagcaccctcggctttgcccaaccacagtaaagctccaaattccccaattctctgagtactttgatgcaaaactgccaaatggggaagtgattctgctgaggtaatgagcacctggggctgggacggagcagcatagagggatgggtgtgatcgggggggcccctgcaccccactgcagccccaggtggaccttgggtggcagcagagcctcttctgctgcaggaagaagtcaggtcctttcacctaaaacctgtcatgagctcgggcggctccagtgctgggcgccgattagaaaacaagccagggaaggccaggtgcagtggctcacgcttgtaatcccaacgctttgggaggccgaggtgggcagatcacctgaagtcaggagttcgagaccagcctggccaacatggtgaagcccccatctctactaaaaatgcaaaaattagccaggcatggtagcacacgcctgtagtctcagctactcagaagactgaggcaggagaattgcttaagcccgagaggcggaggttgcagtgagcagagatcacaccatgcactccagcctgggcaacagagtgagactccaactcaaaaaaaaaaaaaaaaaaaaaagagggattgagaccctaacgtaaaacccaaaactatcaaaaccctggaagacaacctaggcaataccatcctggacccaggaacgggcagagatttcatgaagacgacgccaaaagcaattgcaacaaagcaaaaattgacaagtgggatctaattaaacttagatcctgctgcaagtacttcctcccgggcccatctattcattttccccatgttttcccaactcactcatcacctggtctctgctgcctcttgcttcgaaggctccaatcacacagcggcagcttgtcaatccgactcttaccctatggattctcagcccggagcggagcagcccaggcgggcatgtgtgcaggactcagagaagagctctgtaggagggttttgcacagcaaaagaaactatcaacagagtaaacacacaacctacagaataggagaaaatatgtgcaaattatgcatctgacaaaggtctaaaatgcagcatctataaggaacttaaacaaatatagaagaagaaaacaaccccatttaaaagtggggaaagtacatgaacagacactttcccaaagaagacatacatgcagccaacaaacataagaaaaaaaactcaatatcactgttagagaaatgcaaatcaaaaccacaatgagataccatctcacaccagtcagaatggctattattgttattttttttgagactgagtcttgctctgttgccaggctggagtgcagtggtgcagtcttggctcactgcaacctctgcctcctaggttcaaacgattctgctgcctcagcctcccaagtagctgggactacaggcacctgccaccacacccggctaattttttgtgtttttagtagagacggggtttcaccgtgttagccaggatggtctcgatctcctgacctcatgatctgcccgcctcagcctcctaaagtgctgggattacaggtgtgagccaccgcacccggccctagagagttatttataagtgcacagtgataatgaatgttcagtcacatcaaacgttacattgtctttacatcttctcatagggaacgttgaaacattttgcgatagcttgaattcaaaccatcgcactcacagcaccgctacatgtctccagcctcacctggggagtgagcaaatgccagacaccctcctacggagctattctctgaaccctccacacaggcccggctgggctgctccgctccgggccgagagagtgattgataagctgccgctgtgtgattgcagcctttgaagcaagaggcagcagagaccaggtgatgagtgagttgggaaaacatggggaaaatgaacggatgggcccgggaggaagcacttgccgcaggaagccacccccagcccaggctgctggggcctgagacactgaacagagctgctgtttgccaagcattctggttacacttttgttgtgggatctgttacctgggggcggttgcctggctactgccaagacaggaacatgtgtcccttgtgacatctggacctgagccatctcagtgtggaagtcatggccagagaggtttctggaacctgagaccttgactattaccctaccctatctctctttctcctggcgacctggaatcccaggttgcaaagggtcttacaggtgtctaacccaaacccatggcctctactaaactttgactctgctctgtggcccccagcggcggccccaaggtctccttccatcctcacccatccttggttggtgaacacgaaccctctcatagacccacagggaaagccttgtaggtcctgcagcggctgctcccaagacagtctttgggttttcttgacactgttttcttctcctccaaagagattcccccttagaccgggcatggtggctcacacctgtaatcccagcactttgggaggccgaggcggtggatcacttaaggtcagcagtttgagaccagcctggccaacatgatgaaaaccctgtctctactaaaaatacagtaattagctaggcgtggtgatgtacgcctgtagtcccagctacttgggaggttgaagcaggagaattgtttgaacctgggaggtggaggttgcagtgagccaagatcatgccattgcactccagcctgggtgacagagcaagactctaaaaataaaaaatttaaaaaacccaaagatgttgccctttgttgggacctcctcaaagtgtgtgcctgggatatgaagataaaaataagacccagagacttggggtgaagaaccagaacccggccacacgtccattccctccttgcgtcagggagggagaagagctggccacgcttggagttcccaagagttcttcaggtgcctttcccaccctcccaccttgatatctttcctcctgggcttgcccttggcccctgaaattctatcatcaaagctttattgcaggccaggcgcggtggctcacgcctgtagtctcaggactttgggagaccaaggtgggtggatcacctgaggtcaggagttcgagaccagcctggccaacatggtgaaaccccatctctactaaaaatacaaaaattagctgggcatggtggcacacgcctgtaatcccagctacttgggagactgaggcaggagaatcgtttgaacccgggaggtggaggctgcagtgagcggagatcactccactacactccagcctaggcaacaaagcgagactccgtctcaaagaaaaaaaaaacctttattgctttcggtcaaaagacccaaaacaggccagctgaggtggctcacgcctgtaatccctgtgctttgggaggctaaggtgggaggaccacttgagcccaggagttcaaagcctgtaatcccagcactttgggaggccgaggcgggcggatcacgaggtcaggagatcgagaccagcctggccaacatggctaaaccccgtttctactaaaaatacaaaaattagccaggcatggtggtgggcgcctgtaatcccagctaccctggaggctgaggcaggagaatggtgtgaacccgggaggcggagcttgcagtgagccgagattgcgccactgcactccagcctgggagacagcaagactctgtctcacaaaaaaaaaaaaaaaaaaaaaaagaacagaaaagactacatgcctgtggacatctcactgcctgtccccccgcccttttttttgagatggagtttctctcttattgcccaggttggagtgtagtggcaccatctcggctcactgcaagctccgcctcccaggttcacaccattctcctgcctcagcctccagggtagctgggattacaggcgcccaccaccatgcctggctaatttttgtatttttagtagaaacggggtttagccatgttggccaggctggtctcgaactcctgacctcaggtgatccacctgcttcagcctcccaaagtgttaagattacaggtgtgagccattgtgcctggcttgtctcttctttaggtttggttttctgtgacccctatttttttttttttttgagacggagtttccctcttgttgcccaggatggaatgcaatggcgcgatcttggctcaccacaacctctgcctcccgggttcaagcaattatcctgcctcagcctccctagtagctgggattacaggcatgtgccaccatgcctggctagttttgtatttttagtagttttgtatttagtagttttgtatttttgtattttagtagagggtttctccgtgttggtcaggctggtcttgaactcccgacctcaggtgatccgcccgcctcagtctcccaaagtgctgggattaaggcatgagccaccgcgcccggtctttttttttttttttttttttttttttcagacagagtctcgctcttgtcgcccaggctggagtgcaatggtgcgatctccgctcactgcaacatctgcctcctgagttcaagcaattctcctgcctcagtctcctgagtaactgggattacaggcatgtgccactgcgcctggctaatttttttattttcagtagagacagggttttgccacattagccaggctggtcttgaactcctgacctcaggtgatccacccgcctcagcctcccaaagtgctgggattacaggcgtgagccaccacgcccagcctgaccctctattttaatgcagactttttaagtgtgatgtacatgccctaagtgtccaccgtttgatgaatttcacaaaggggctattgccgtgtacccagcactaaggatgagaatcagagtgaggccccacacagaagtccctcggttagaacccttttccgtcatgtgccacgcagaagaggccatcccccaaaatgcacacccacctggaactccagaatgtggccgtgtttggaagcagggtctttgcagatggaatgagctaggatgaggtcatgctcatcttagtgtggtaggtgggccctaaattctacgactaggcccttttaaggggagggagagggagatacacacatgcaggggagaggttgtgtgaaggccaaggctgagaccagaatggtgcagccacccaccaggggagtgcaaggaccctccccaagagccctcagagggagcacagccttgctgtcaccttgaccccagacatctgcctccagaactgggacagtgcattcctgttctctcagccaccccgtttgtccatttgtggtggatgtaactgcagccagagggcactcacactgccccatggccacatagctgctggccaacagaagggaggaacagctgtgggctccctctgaccaaaggcaagctgtgggctcagcagacagccgccggcagccagctgaggacagcaaggctcagggttcgcaccatctgggccacacccctcaacgtccactccagacctggaccaagccaggcagccagcaactcccaccctgagcagctcctggaagggacgggagctgtgacagccacaataataacattcatcggctgggtgtagtggctcatgactgtaatcccagcactttgggaggccgaggcgggcagatcacctgaggtcaggagttcgagatcagccttgccaacatggtgaaaccccatctctaccaaaaatataacaattagtagggcatggtggcatgcgactgtaatcccagctaatagggaggctgagggacaagaatcgctggaacccaggagtcaagggctgcagtgagctgaaattgcaccactgcactccatccttggcgacagcaagactctgtctcaagtaaataaataaataaatacaacattcttcgcagcccaccattgttggaggtgtcctaggtacccggcttcctgctcaaagctgcaggcaaagtgttggggtcatacaggacttgcccgagaacaggaaacccaagtcaaactgtggaagctgtgaggacatctgttggtttctgcaactggacgtctggagggagtgtgaacttccggtggcatctgcttctcccttccactcctggggctccagcatggtgggcctctctcaggatgggctggagcaccggcagcttcaggcctcaggggccttcggcaacgtccagaggaaggaaactgcctctttcaggagcctgtggcactaagaggaagccttctgcagatgcagccagcaggcttccccacggaccccagaggcacagctgctcctgccgggaaggggtgtaagttcaaccacggagcagccacagccctgcagcagctgtgggcttgagctccccagaagcgcctgggatcaggaaggtgcggtggctcctggagtgctgatgggtgtgtcacaggcatgtgaaccagagcaactccatcttgaatagaggctgtaaaatgaggctgagacctgctgggctgcatctccaggtgattaagacattctaagtcataggatgagatagaaggtcggcacaagacacaggtcataaagaccttgcagataagacaggttgcaataaagaaaccagccaaaacccaccaaaaccaagatggtgatgagagtgacctctggtcatcctcactggtacactcccaccagctccatgacagtttaccaatgccctggcaatgcaggaagttaccctgtatggtctaaaaaggggaggcatgaataatccaccccttgtttagcatatcatcaagaaataaccataaaaatgggcaaccagcagcccttggggctgctctgtctatggagtagccattctttattcctttcctttccttttttttttcaagacagagtttcgcttatgttgcccaggctggagtgcaatggcgtcatctaggctcgcggcaacctctgcctcctgggttgggtatcagtttagactgtgaagtctggctgaagccaacggatgcaggacacaacagtaaggatgagccaaaagtgtaaggaataaatatgtctgcgtttcctttgttcactgtcctcttggggcaagactgctggcgagtgtaccctttctgcagaaagtaaaaattgccttgctgagagaattaaatatatgttcaagtgctatttctttatggcaccagggaacaagcatttagcatttctaacacgggttcaagtgattctcctacctcagcctccccagtagctgggactataggcacctgccaccatacctggctaatttttgtatttttagtggagatggggtttcaccatgctggccagactggtctcgaactcctgacctcaggtaatccacccgcctgggcttcccaaagtgctgggatgacaggcgtgagcccctgtgcctggcccgatttattcctttactttcctaacaaatttgctctcactttgcagacttggcctgaattatttcttgcgtgagattcaaggactcttattggggtctggatcaggaaccctttctggtaacagatgtgcctgggggagaaggggccaggaggaaggtgatgcagaggccacctccactaaccctcaacagcgtacaccacctctgccactcccacttcacaggcgagaaaaccaaggcttagtgcggtggggccaagtgctcagcggacacagctggagagcggcgggccaggattccgcataaaaaaagcagccctctcagatcctgggaggacaaacaggagagctcattccctattctccagcttccatctcaaagtctccaggaacccccagcaaccaaaatattcttgtaagtgaataaggaaaagcaaagccaacaggtgattctcgatgctcccgtaggccccagggagtggagaagcaccacgctccaagtgcctggacagagagggatctgccaacgggagctcggtcagaaagaggaggagggggagccagggcagggggcaaagaaagagagttcagtgagggggcagcacgtgccaaggccccaaggagtgtcccgggcatggaatgttccggcaaccaagagaaggccgtgtgggtttgagtgcagacaaggggaaagcggctcagcacagccagggaaagccagccagagtgagggacaacggcccaggaatggctggggagctgcggctctgtctggaaagcagtgggtgggcgtcactggcacctgctgccatctatggattcacccaagccaaggatgaagatggggaaccagcaggctcaggacacaacatgggcccatccctcgttgactcccattagcagacagcgacccgtgcatgagctgctctgggggacggcagcttctggctcaggggccagcctgcgtgtctctgccatggcgggtcataacctcatcagcctccttcctgaaacccgaatgccacacgcctgctgagtttctcaggatctcacaaatcctaccccagtccccaacatcctggccagcctgacagttacttcctggagcatcttccagagttccgtcgggtttgctgaccctggttgagtgatggcattttctagctctttctgtctgtaccccagaatgtagcttgtctaagcccagtgacttaagcccaatctattcatttcaccactgtcccctggcaggaggaattcctctgaaaagaccccaggagcctggcgaggggtacgctggggaggcagctggtgacaaggcctgggcagaaagcctgcttttcactaagaattctttgaacattttgaattttgtactatttgcagatactgcctattcaaaaataagtaattaattgaaacaatgagatcattctctttgatacaaaaaggcaaaaccctaaccggagtcctgtcgttctgctgttatctcatcccgggctggaatctggtcaccccaaactccccacgccccagcctcagcgtctccatctgtaaaccaaggcccaggccctcggaccttggtgggggggctccactttgtgagtctgacttgtcatagcctgaagctgtggcctgggcccctgtctccgtcccactcgcaggctggttaaatcccgggagtcaaaacctccaggagcaggttccgtggtctgagagtccaggacagcttgtcactcagcaagacagcctggcggcggtggggggggggggggcgccaaccagggcgaccgaggacaccaaggtggggcctgtgggtgaggtgcccccaggagtctcagtggaagctccaggaaggtcacaagagatccctcctcccaggtggcccctaaagaggccagcacacagtccatggaggaagaggcacagaatcaatgaatctggctttcaaggagcgaataaacttaggcttgttggtgtctcaaaggcatctggtacctgaattgttcttggggttcctactggaggcgccagcccttagagactgagcagccagggacaacactcccgggcggctggcagtgccacccgtttcctgccaacccaggacccgtggagaccaggatcagcctctagcatccctggggcagcaggagagacccttgtccctcctccacccacacactggggatccccatgcctccctcatagcttgtgaggagccaggggtccggggtcaaagtcagatgccacgagctggagaggaagcgtcggcagacgtcccctgggtggggtcctggggtctgcaggtcacgtggagaaggcacagcaagaacaagacctaggccagacggcagcgtcagcgcacgctccacagcgggcttcccgcagctctgcacagcacggcgaatttccacctaagtgtgtccacggagcctccaccagatcaaagctggagacagccccagcttcccagacagcctgacgaccctcaaaactgcatttaaaaaccactgtttcggtgagtgggtgaatcattcacatggttcaaaattcaaaaggaacagaatgatgtcgcctggaaatgcgtgtcctgccccatcccagggactcagggtcctgcacctgaaacggcctttgcagaagtcctgtcagtgagacaattagaacaccaacctaagctaacccagcccccatcctgcccttcccttaattattcctgggctattgggccaagctaactttggaagacatttaggctacagtttaaatgattgataataggccttgccccaaacctgcttttgtaaagctaatgggaggcccccaggcttccaggaggagggaaccagagaccttataaggcgcagacacaaaggatggtcggccattatcccggaggttacaaatatgcaacttcccccattactcctgcaagtaacaccaccgctgtagatggaagtatcttctgagagatctttccaggttttttgcatgtctgacgcccacagctccactcagaccccatggctccacctggacctacagccccgctcctgtggccccaccagaagcaattcggctgcaggaggaaggcttccacccctgtgatttcatctccaccccaaccaatcagcagcaaacatctgttacctggccacccctacctaaacccctaatctaatccggttgcggtgactcacgcctgtaatctcagcactttgggaggccgaggcgggcggatcacaaggtcaagagatcaagactatcctggtcaacaaggtgaaaccccatctctactaaaaatacaaaaattagccaggcgtggtggcgggtgcctgtagtctcagtaactcgggaggctgaggcaggagaatcgcttgaacctgggaggtggaggttgaggtgagccgagatcgcgccaccgcactccagcctgggtgacacagtgagatccgtctcaaaaaaaataaagaaataaataataaaaaattgtcacaaggctggccatgccacaagggagatggaattattactcaaatcaacctccctgaaggcatggaggttaggggattttcaaaaactaaatttctcccaaagctagcttggcgcacgcccaggaatgaaggaagccagccagcctgcctgtgaggtgaggagcaagatggaggcagccatgtcagatttctcttcctgtcataattttgcaaaggcggtttcaggacagggcaggaagttgtctgtaaccagcaggtgctcgacaatgaaaaaaggagagtaaggccacgcacagcatctccacatctaaagtcccgaggaggggtgtcctgcagcgggggcagagggagagaccaccaggggccctagaaggggcagtgcctcgtgcagctcagcaaggaatccatcttcatctccacagcgtggaactcagccagtcccggaaagccctcccgtgtgttctggaaacagctcactgcaaacagcccccttcgcacaggactgagatgagactcgcggctgccgggtccgcctaggagaaggccagatcacggcctcatcagcgattccctgagctgttttgttcccacagaagcagcagaacaaaatgcttgtttaaaaaaacaacaaaaaaagcttgttcagcttctctgcctcccccaaaccctgaactgggagaccccccccagcctagttccccctgggtcagcctgtaaccccaccttagcccctgagactgggctggccagggggaacctgctgtatctgctgcccctcaggccccctcacgccactcccccaccgattctttccagccctgctccctctctccgtcaaagaaaacccctttccctggctctggaggccttgtaggccttgtaagttggagtggtacgtacccctactgtgaggcgctcccccaagccctgcaataatccttttggaataaagttccccttactaaatccggatttgttttttatttgacaatttcttctctgtggaattctcggctcaactcaagggacggagccgagcttagaaataaaacaggagcagcgtcaacagaagatgtcaggagtgggggcctcgtttctgcgtggtgaattctgagaccagagcacaccgtcccaagagggcagtggacgctggggaaagtgtcacggccgctgaaggagagggagggggccagtggaggatccaggctccttctggcccctggctgcctaaagatgaagcgtcgccctggcagcgtttgaaacacggtcattaaggagtgaaatcggcgcggtgagttgtgcaggagaacgtggcgaaacctccctggagacgaagagccccagagcgtgcaacctctccgggggagtctgggtccaagcccaccgtgtcctcacccagacctgcccacgcctctctcccagctgtcaggagttgtcaaggggattaagcggattctctttgccgttcatgggaacggcagcgggattagctggggcctcctaccgaggagggggtgggctcgggttagcacagacgacactcagagagcttggaggggcggtgaccaaagaggtaggtcacagccagataccaaggccttgactttggggtctcattttacgggtaagaaccctcccttggctgggggtgaggctagggccacacacccattccccagccagcctttgcagaggtcaatgagaaagaggcaaattctggaacctttcctcaccctctttgacccagagaggatttaatctggaatgaagctggttgagactagttttgtgagcgatctgtccacctggggtgccggtgtgttttacaaggctggctttcatggcgcagttgagttcccacttgcagaacatactcaccctgtggctataaggcaaagcgctggggcttgtaggcactggaccccaagcagtgaacaggtcagtgcagggcctgtttggtgtggctgcacaagcgcgagaaacaggaatgcaggcgtttctggctggagggagaaggttggatgagtgtaacagcaccttcggggtgagggtttgcatttccgctggagacgaggccaggtgtcttgcactcaggttaggctgtgaggaattgaggccaggcccagaaggagggtgggatggaagggaggggccgtcatgtggatggtgggccaggtgtccaggcccgccaggtgcccaggttggagaacccggattctccatgtgtgcgggtcctccaggtgcccacgtcctccaggtgcccgggccgtccgggtgcacaggtttgtgagatgctcccactgtgtgcttcctaccgttttgcatccaatgcacatggatgcactcccacctctcggctcccctggatcaccccaggcaggtgaaggaatgttttggagccctgttttctcctccctgagacagggtggcacccggcctcctcctctggctgctgcaggctcagttcactttcccacgctggaccccttcaggccaagcctcggggagcacagaaccatgggacagcggggatccaggacccccagaaatccggctggaggagcttcagggtgacccctcctcccctgtccctcagagcagatgctcctagaatgctccttcttagagcaagtgaattagcattcccaccaaggctgcccagaatggggtaggggcagggtgtgtggggaccagcatgggcaccgagccttcgtcatctgtggtctcagtggcaggcgggcagtgccagaagccccatctccatccactgtctcccctctgtgctctcccaaggcgtggcccctccccccaccatctcaccatctctgcagggtttctgctgaagaccaaggacttacaggctctttagaggccagagaggcaacctgtgtttgggacagttggcggggacccagcccaggtggggagtgaccagaggacacccaggcagagccactgctcccttggggactcctgggccccctgctcttcccaggtggggagtgaacagaggattcccaggcagagccactgttgcctctggggctcctgcacccctgctctgtccagatgttggcttcccaccctgcccgggctgggacccctgttcacctccctccgctattcctgcagcctgtgaagcccatgccccgcggtggttttggctgactccagggcagggttgcctcctcctgtcccaggtgtgcagctcgcacgcacacagccggcaaacacagcgtggtgagctcaggaggattgtctaggatgcaggagtcacaggaaggggtcccagcctgcagcccaccctcttctgcatccccctcttcccaccaccgccttctcctccctctgctttcctctgtcctccatcctcctctgcacaggaagcctctccaggcccgaaggcagagttgctggagctgttgcttgattagggccatggcccccatcccctggccaggggaattctctctcctctccccgtttttcctccacacttccctcttccctccctgttctctccctctgagctgggttaggctgatgggctccgagcacagaggcagaagcatattcatttcggtcctctcaggggccaagacccttttacatcggagctggagaacgcagccacccgtgggctagaggaggggccggggcgccccagaactgaggcccccgctttccaggccaatgccctccttccttctgtttcccaccctttcccaccccgggggtttaatgtgcgtctccatgcactactatcggcagttcccagcaggtcataagagctgccccggagttctgtccagtgggacctcacggggagacggggttccagcaaggagctctgaaggagggcgaggtagcaggagagggcgggccatggggagacccgggctttctgcaatgagggggcggtgagaggattggtcactggttcctttaggaagccctgctttcttggggagggcgcacctgacaggtggcttcattcgaatgtgtttggggctcccgccccaacaaacgcacccccctcatcctctctctgggggagagggagctgccacacaccattcgtttatgcccgccatctcccacggtgctcaaggcatcgaagcgccagttggagggagggcagagcttgctgggtccacccgggatgaggccgggacatacacagcccctttcttggcctcatcaatgattctctgagctgtttttatccccacagatccatcagaacaaaatacctgttgactagacttgagttcagctcctctccttcccgcaggcccttaacctggaccccctcagcctgggccagcccgtgactccccaccccctgagacagtgctggccaggggaagctgatttgttgtccctgaggccacccaccccacccccgacacaagaacaaagaacaaggttgaattctttccagccttgttcacatcccccataaaagaaaacctttggccaggcaccgtggctcatggctggaatcccagcacttggggaggctgaggccggcaggtcacttggggccaggagttcaagaccagcctggccaacatagtgaaaccccatctctactaaaaataaaaattaaaaaaagtagccaggcatagtggtaagtgcccgtaatcccagctactctggaggctgaggcaggagaatcactggagcccgggtggcggaggttgcagtgagctgagatcacaccattgcactccagcttgggtgacagagtgagactccatctcaattaaaaaaaaaaaaaaaaaaaaaaggccgggcgcggtggctcacgcctgtaatcccagcactttgggaggcctaggcgggtggatcacgaggtcaatagatcgagaccaccctggctaacacggtgaaaccccatctctactgaaaatacaaaaacaaaattagcctggcgtggtggcaggcacctgtagtcccagctactcgggaggctgaggcaggagaatggcgtgaaccctggaggcggagcttgcagtgagccaagattgcgccactgcactccagcctgggtggcaaagcaagactccatctcaaaaaaaaaaaaaaagtctggattggccaggtgctatggctcacacctgtagtcccagcactttgggaaccccccaggcaggcagatcacttaagcccgggagtttgagaccagcctgcctgggcaacatagcaagaccccatctctacaaaaagttaaaaaaaaattagccaggtgtggcggtgcacacctgtagtctcagctactcaggaggctgaggcaggaggatcacttgaccctgggaggtcgaggctgcagtgagctgagattgcaccactgcactccagcctgggtgacagagtgagaccctgtctcaaagaaaaacaaaaagtctgggtcgggctttgattttgacattcccctacctgtgtccacctccgtcgacagggctggacgttggtccctgcagtggcctggccggtctctgggcacccgtaactgctgcagcccagaagggagcccctcccaccttcccgcagacctgcgccccacccaaggggcccggccgccgctcactcggggcccccgagctgagatggggtgctggcttcattttttttcacctcttccacaaatactgaccaaggcttttgttcaaccagaccctggaactgggggacccagtgggggacagggcagatgacctgtcttcaggaaccttcccggggtgggggtgcacccatgggtgactgcaagaacgctaacaccagcactgcgggtgcagaccgtgctctggggggggacaggggctgggtcagggcaggcgtctgaccatgaagggtggcctggagggagagtgatccaggctaagtggaaggcagtggaaagccccgggacgggggcggatgggggtgcggggcagagcttcggggactccaggggcccagcctgactggaaaagggagattgggcagggccagggctggtggggctgcagctctgtggggcgtctgcatttctcttcaagggcaggaggagcttttctgactggtgttcggcaggggactgagggatgaagaacaaatcagggtttttaaaggagttgacttgaaaaggttgcaggccgagcgcggtggctcacgcttgtcatcctagcagtttgggaggcctgtaatcccagctactcaggaggctgaggcaggagaattgcttgaacctgggaggcaaaggttgcagtgagctgagatcataccactgcactccagcctgggtgagagtgagacttcgtctcaaaaaaaaaaaaaaaggttattgcagcaccgaggactatcgcaatgggggatctctgctcccaccacagggtctacaaggagctccagggttaggcaaaggctttttgttttttttgagacggagtttcgctcttgttgcccaggctggagtgcaatggtgcgatctctgctaactgcaacctccacctcctgggttcaagcgattctcctgccccagtctcccaagtagctgggattacagatgccccccaccatgcctggctaatttttgtatttttagttgagaaggggtttcaccatgttggtcaggctggtctggaactcctgaccttaggtgatctgcctgccttggcctcccaaagtgctgggattacaggtgtgagccactgcacccagcctgggttttttattttatgggggtgtgaacaaggctagaatctgtgtggggagttgggcgcggggcctgaggggcagtagatagaggggttccccgggccagcctggtctcagggagtgggaagtcacaggctggcccaggctgagggggtccaggtcctgggcctaggggagggagagcagccgagctgggtttggtcagcaagcattttgttctgatggatccctgccggtcatcggcgaggtcaaggggactcagggcctgggctgggccttgccctaggtagacccggggtgggggcatctctgagtctccctcaagtcacatgggaagaggtttctctgcacaagcagaacacaggggtcaggggtttcttaaccttcactgtttccaggagcccaaggctctttgagctccatgttggcaccaagcatctcgaaggagccagctgggctgggggccaggcgggctggcagtcactgaaatgccacctgggagggccgccgaggctgaggctgctcaccatgctggtagcagcacctgcagggctggctcacctgtggctcccagccccaccctcggatatcactcagcaggcccccagggagtccccagatgctggtgcaggtgtgttggggcctgtctcaccggtgacctcacatggccagtgtcgggggtggggcagcctgtgagttctctccttcctgtccctcgacaagcccaccctaacggtcaagtccgcaaaggggtacgcacctgccgcagggccatccaaggtccccagctccaaaaattgctttccaaattccagctcccttagagggcagccagttctcaattgtgagggggtgagctattggattaatttgcctttgaacagcactgagaggcctgggcctcaacttcccagtagtgaagacattactacaatgcgcccgaatccttccagaacccatgggaggtgggtgggcccttcctgcctgggtggtcagagtggggggctcacacagatcctgagccagggctctaggtgaccctggttgctgcaaaggttcccagctgcaccccagaatgccctggtccatcactgggcaaggtctccctaaagaaagggctgcggggaggggggtgcccagcctactagggaaaagccgcccaacccccagtcccaggagacctgcagccaggaggcctctttgctaataccctgtggagctgactgctcactccagtgactttgtatttctggagccctcccagctcctcgcgggactcggtggctccaggataagactcagactatggggcccactcagggcctgtcccccacctcccgttcagctgggactgcgtgagtcctgcagataggagcagccttcactggatccaggacggagccctatggttgccttcccaccccgtgctgggaggtggatgaggggctcatgctctgagccccggactcgcccccttaactgagaggctcgggagtgtcctgggaacacagaatcggtgccgcttcctctcctgctctgatcccaggctggagaaaggcttccttcctgacctcccaggagctggagccccgcatcctctcagcgggtgacccccaaacccctcccaacttcacccctgcagctccctgggactggaaccttccccctcctccccggtggtctccacctgaacatccctgcgcaggctgcctgccccccactcccgaggcagatccgatatcttggctcggcacccccaccctcgaggggtgcgtgctcacatgtgtgcaacccgcccatggctcacccccacccagcggcctaagtgggctgtcggtgaatgaatgaatgaatgtgtgaaggtgggaaggaatgaggtggccaagagggggccaggaacgttcctatacacagaacctggcgcagaagaaaagaacacagaacatcagcggtaggatgattgagtgtttctttaaaaataaaaaccccacaaaaaagccagaacaccctacccaacccagcccagtgtaacaggttagccattaacacagaataaagaaggtcccagccacacacgtcattactcggcagagggtgtccagcctggtcggccgacgtcacagtggatggccctgcgtggctgggacacagacagggagcaggcatggcacctgcgccacgcagagcagcaaggctgagcatgaccactggaaataaataaacatggtgccgacagcatctttaaattagtaagacgttagcacaaaacaaaaaagcacaacgactgaaaatgcacttgcttgttgtggtgggttgtgcttgaaaacacctgaagcccacaagtggaaaccgctggggacgtttgtcagtggagtgtggagaaaaagggacggaaaaatcaagtcttctgagacagtcccctgcggtggccctggtccctgtggaattccagcacagcaggagggggagggggaagcaggcctcagtcagcaccgcgggacacggcccctaccttctgaagtggggtccccaggctggagtggggcacacagcaccaaggatcacagactggaccccccaccaaccttctgcggaggagctcccaccccagctcagacgcccagaagagacctgcgcagtgtgaagacggaccccagcggccccagccatttcactagcagctactttccacaacagacgctggcagcccccatgctcgcccacagccgcagcagccaacaggcaagtgcgtgccgtcgagaggccgccggctccctgtatccttgaggcatgtccacgtcccagagcaggaggttggaacagaacggcatcccgaggacccctagccgaggcgggaaggtaagaggctgacgtcgtgcgtgggccccgccggccccagtgggaagcagtggtgcgtgcctccagggagcacttctcctggacccggggccgtggctgcctacgatgtccactgcctcctggattcacacagcaatgcaccaggcaggtggggcaccagctgctgtccttatttgcagccaagagaacaggcccagagggaagaggtcttgcccaacacagtcagtccacctgcctgctggtggtcctcggcctccagaccgtgggctgtcccttggacgagtggaattcgtccccaggaaggatgcaggtcctatgagcagacgctgtgaagtctgtccatgtgcagcgggaagcaacggggcaggggtgaataaaggtcttcattcctcaagcaagagagacggacatctggtcctgagtccccaaactgttcatcaggtttctccgggcccactggatggtgagggggtcccggtgcccaggcgggggcggcaggctccactgggcacttgctgagagcttgcggcttgagcagccgctggtcagtgaagccgtgtccggcttcgttggctcccggcttgggacactcagggctgtgccacaggccagctcctccagccacagctgagcactggagtgacgctggaccacttggctccacctctggctggggagaagggaagcccggggcctgagaaggcagagccccccgagctcaggagggatcctgcggggtcttcttgttctgggggtccctggctgctgccatggaggcagcgacagctcaggaaagtgggccgcattggccaggcctcggctgcctcccatagcgaaaaaaattcacgggaacaacagaaacaaggggtgccctagttccctctctgcaggcgggtggggactgggtgagagcccaggggcctccaaacgcaggcggcagagacgtgagcagtgcttggctctgtctcctagacaacgggcatcaggaccaggacaggacatgagcgtgacagggagagcggggaggtgcctaggccgggagtgggaacccagcaccggccagaaggggctgccgggcggtacagaggccaatgcattggaggctgagggtagctgcgacctctggggcaggggacactgctgtgtggagcccagggtgggcgcccacatgggtgcctggccgcggtgtgtctgcctttcttgtctctgtttctagaagactgaaggacagggctttgtctgcatgaaccagaactcagcctccaaaactggacacagaaatagccaagaggccacactgcccagaggccaggcctggtgagctaggggagatgccggcaccccccaaccctggggctgttccctggctcaggatggtgtctcggggctaggattatggtcaggagtccatcggggcctcaagcacctcctgggaggaatcacccaccttgcccagatcccccaccccctcccagtgccaccctacggctgagtttccactctgcaaaccctaaggcagagacataagcccacagggttggttttcacgaatgtcacaagcccatgtgtctgggcagctgtccggcttcagtgcaagtctgtggtagcaatgaggttccaagtctcagtagctctgtttgcccagggtctgggcccttggggcaggagaaaggaaggctcctgccttcccccagctccttaaaaaatcatcttagtggtgtcaagttgacccaaaatttaagtttaaaaaaaatatatatataagtaaacaaaggagggaagggaaaaagggcccaaggagaccaaaagctgctcctgggcaggagcacaggcacacctgggtccctggccctcagttgagggatgagattcgtaccagagttttcacagcagcctccactgcccgacctgggagggacggcgagggactgggatgggcagctgagctgtgggttgcggggaaccggagtgggttcgaggaggtgatctactttaactggcctctgcgcatgctcctccggcagccactcggcctcctggctatgtctcctgggggaccacctgcatgagcttctgacacaggacggtcgtggagactgtcaggagagaagacagctgtgttagcctgggggctgggtaggcacccgtgggacacgggggcgtgagctggggctcccccagccctgctgtcaccaaacccagcgccgctgcccagcgctgggattttaaggaaccttcccttgtgtacttgcgcatgtgggtgccgggtgcccgaggcgctgtcttcaactgaaatgcggaagtgccacatcccactcggcccacccctcgcctgcttcagaaccctggggaggcagagtgcggcccctggggcacacgaaccaggccctggtgtctcagcaaagtgcaacggggggatgacaggccttcctgcaggtccacacccgggccaccacctggacacatgcctggactgttcacagcaggcagggccggaggggccaatctgctaacgggtcctcggaagacctgtcgcgcctgggactgtctacagagacatcactctgtggagggggactgctttcaggatagagacgggggtttgctttaagctcttggtgtcctgaatgacagttaatgcagatcccactgcaaagcttgaggcaaatgttctaccatgaccctggcggtgatcagagtgtggggtaggggtggggggtctccctgcctgtgttgctgccatcccgggaattctccaagccacccagtgacatggggatcagcatgtaggcccgcaagcaccccggcctttttctacgagcctggccacatttgcaggcgctgaggacggggtcctgagcttggtgacaaagcacccctggggctgccgctgcacacagggccggggggcgggtttctccttctgcctttttttttttttttgagaagagtctcgctctgtcgcccaggctggagtgcaatggtgcgatctcggctcactgcaacctccgtctcccgggttcaagtgattctcctgcctcagcctcctgagtagctgggattacaggtgtgtgccactacacccagctgatctgtgtatttttagtagagacagagtttcaccatgttggccaggctggtcttgaactcctgacctcaagtgatccgcctgcctctgcctctttctgcctttctgggtaagtctgctgtgtccgctggtggcagccagcaggattttgttacttggcagcagtagcctggttttccggaatccctcgtcctgagagattagctggtgctgcgctgtgtgtcttatccctgaaccatgtgggctgcgtgtcactggcggacactgcagtgacctgaaccctcctgccacccaacacgcttcgccccatgtgggtggagacggccgacgcctctcaactcccttcgctgcccagggcagagggtaccacgggctgtgggccagcgagatactcacagatgccctggaggagccacttgggcttgtttttccaccagaccccgaagaagtagacgggcagcccgctgaggatgatggtgaagccgatgccacactccacgggtgtcttccagaaggagacggcgatcaggaagaggcaggccaggatgaagaacacaggcagggccaggttcacctggggcagaggacagggcctgggtgagccctctcctgtccagcctccctcccccatgccccgaggttcctcagccctcctgggccctccacacccacggctgctgacttccaggtcaccaagatgcgatctgcactccatctgcctcacacaccgggctgtcccgccctcgactctgcatacagtgctgggcatgttgccaggggctcaggcggcttatgatgagggatggaaggagacagcttcgtctcccgaggcctcccacgggcagggaaggtcacggctccattcccacatcacaggcctggaaaccctgagccgccaggacgcacaggggcctgatgcttccaggagacagtggccacccactaataagccaggagaccaccctcttggagacgccgctgtggacagcgctgagcaaaagcccatccctgaagctgcagcctaaactgtcaccttcagcagatgagctccacccggcacagaagccaggcagggctgcaaggagcctgcaggccgcaacctgcggctcggcatggctgggggattgactcagctgtcctgaatccatacttggacagggcaccctgggagatgcagggctgaccacaggtcccagcccatcagtgtgggctgcatgactgccctgtccccagggaacagacgccaacccgtgcccaggctcacaacagtgggtagagcctaccccatgcccaggtccccatgggggctgagcccccgctgtgcgcagtgactgccctgtgccctaggcactgccccaggctggcacagcaggcacaagctggtgcccatgtagggcggctcctccctgccctctgcagccttctcttggggcagcatctgggttcttgtgctgactgtattttaaagcccctgttttttttgtttgtttgagacggagtctcactctgtcgtccaggctggagtacagtggcgcgacctcggcctcccaggttcatgccattctcctgcctccacctcccgagtagctgcaactataggcgcccgccaccacgcccagctaatttttttgtatttttagtagagacggggtttcaccgtgttagccaggatggtctctatctcctgactttgtgatctgcccgcctcggcctcccaaagtgctgggattacaggcgtgagccaccgcgcccagcctaaagcccgttcaacagcattcacaggcacccccggggcccccaggcttcgggaacacagagggagagatggtccgggcagggaagcaggggctactgtgacagccataggccagctgagtgacaaaagctgctggctagcagccaccaggggctctggcctcttgttctgtgtcagggccagggcggcgggacttgctgggccccaggcaagagcatggcctctgctggacggccccgtttttggagaaggcagcccacggataacagctacccctctgaatgagccgctggggacggggagagtccaggagagtccagctgggcccaggcgctcctcgggccgggttccctgcattcctcctgccagcacagccccgacggccctttgaatgctgcgccaggcccggctctgccccgcccctgccggggctcaccaccgcccacctatgactgcagtgtccttatctgcttccctccacccaacggagcacaagctctgtgccatctgctgtcctttgaggaaccccggctcctgcagtcacacttggcaccctcgtagctggtggtcaagtcatcaccggaattagtcgacccaggtgcatgcaggcaggggcaggtccagaggctgagctgggatgctggctcccaactcagggtccttaggacccacggaccctgcctctgtgaagggtgcctgggtgagcgggaggccccgggctcaccttgatgggccgctcaagctcaggctttctgtggcgcagccagatcatgccgatgatggccagggccacgcagagccagttgaagaagctgaagaagttgatgacggagaagatgtccttggagaaggcgtagagcagcgtcatcacacactggaagagagaggcggctggctgagccctggggcccacgagcagggctgtggacggccgtggtggccaccggggactgtccagcctggctgggcccagctgagcaccagggaattttgttttaaaggagaaacctcatctgagcaacatgcaaggtcttgaaggaggaaaggagggaaggagggaggagaggaggagggaagaggcggggaggagggaaggagggaggagaggagggaaggagggaggagaggaggaaatggagaccacatttgggttaaggacaggtgaagaacacagtgtacatacacagctgggctctgctggactgtggctctgtgtgcgagggccacaacctgacctaacccagtggtcaccaagaaaacagtttctgtaacccccggcacagccgtgctcccgaggaccgtgcagctgccaaagagtccaggacttgctgcccttcctgactggcttctaactcagggaaggagtagtaagcaagggccaggacctctgaggccagcccacagctgccagaccccagcttcctctgctgtatctcactggctttgggggaagcagcctgttgggggagcccagtgtgctcaggggtggggcctgcagcccacagccctggaggaagccactgtggagtggcctctccagccctggtcacaccctacgatgagaacacagcttcaggcaccagctccctgaattcctgacttacggaaactgtgagataataagtgcttttccttttagaacactacattttggagtgatgtgtgacacagccagagggaacaaaggcagtcacgcgggctggcacggaaagatgcaggagaagcggaaggaaactgtgtgtgatgcaccccgctgagaaacgaacagagtgggcgcccacggaggtgcagtgagccaggcggctggcagagcagcaccccgggtcagcttctgcctcccgcatttccgatggtctgaatcgtttgtggcagccaccatatattatttttggaataaaatctaaagcccctccagcgctctctggcattcagcggagctcggcaggaggccacatttgagctgtcacccagtccacaccccagacagagctgcaagctgtggcagcctccctctgggagcccccggacaacccccagggatgtagggcacagggccgtgcagcaggcttaccgtgaacacgagggacggcacgggggtgaggagctgtgggtggatcatggagaggatggagggcaggtggccttcccgggaccccacgaagaagagcctgtggacagacaagagtggcagagtcagccaccgccccacaactcagcacgtggacaggggacacgcaggctggggagtggcagggcctgtgcctggcttgtctgggcctctctggccacagtgggaaccaggcccctccagccgctggctgtgggcctctcagttcccccaaccaactcggcaaggacagcaacttgggagccactgctcactccagcccggggggtcaagcggcggccacagggcatctaggacaccacagctgtgtcacctccaggcaggagtggggaggcgagggccaaagttcatgcttcctttatttctgtattatttgggcttgctgctgccttttttttttttttttttttgagatggtctcactttgtcacccaggctggagtgcagtggcaccatctcggctcactgcagtctcaatcttctggtctcaagcaatccttcgacctcagccccccaagtagctgggactacgggcacgtgccaccacgcctggctaatttttgtatatttttgtagaaacggggttttgccatattgctcaggctggtctcgaactcctgagctcaagcgatctgctcacctcggcctcctaaagtgctgggattacaggtatgagccaccatgcctggcctatttgagcaattatgcatccccagtatcacagagacaaaccttttacagacatggaacatgttgaacctggccatgaggcctgggcctccctcacctgtggtgggtcgggctgtgctcacctggaggatgtgaacagggacccattgacggagccgaagcaggacaggcccacgaagacggggatgatccaggacatgacgcccaggtgatagttcccgaagtcctaggcaggcacaaccagtgagctgggccccaccgggccggccctcgccctccctgtgctcactgggagccctctgcaccgggccagccctcgccctctgtgctcacaagagccctctgcagaggacctctcaggctggattctggcctctggggggacttcccaggacagggctttccagtgacccctgcccagcctgcttgttggggagcccttgctggtcctgatttgccccctcctctgggactccctggagcaagctacggcctgcaggtggggatcttgccttcccccgtggggtcctccacaggctcagcacggtgccctgccggcagcgggctgggagtcagagcttgttcagtaggaagctggccagagcacccactccctgttcccccagccctgggagggcagtgggagaagcctcgggaactgcgaggccagcctggctgagctgcccggtgacaccgcccgggcctggcctcccgcctgccaagccagcagcagccgtgccttctaacgaaccccactctgtggcagactccaatctttctgtactcagatttaaaatgacctctgccctggactccccaggcattctggcttatagctggttctgggtgtggcttggtatcagattttaaacccttctcccctttgactcccccagcagctgagcttgaggatgatccccagacacttcctctgcggtcgctgtgaggggagaccaccactccacccctccgggtaggggaggcttagagacgcggggccccctctgcgtaggggaggcttagagatgtggggcaccactccggtctggaagggacgggctggccacagcctctcaggcccctggtggaagctggcgggtagcggctcaccacggccacggcctcggacgacagcatctgctcggtggacagggtggtgaagtaggccaggttggtcagcacgtacaccagcgtcacgatgggcagggagatgatgatggccaggggcaggtttctggaaagaacagggacgacatgtcacccaacgcagcccgggctgaaggccaaaccctgtgcccaggagccaggtgggctcctcgcaagcagtagctccagcctctgtgctgggcttctcggggaaggtgggaagcagcaagagaacacaggctggcggcaggaggctgtgcctggagcgggacactgcacagccctggctggtgccttggccgcggcctcagcttccccacctgagaaatggggattcttcggggtgacctcaagggctcaggagagttaagtcaggccacctggtctgaattctaaggctctgcccacgagctgcacagccggggaccagagccgagagcccaggcagctcctctgtaccgtcccgccctgagtggggccctcacttgccacccgttctctggagaaaccgtgctcaaggacacacggccagaagccacccgccccacatcctgctggccccagaggccccaatcacggcccgactgtgaactggcctgagccgaccaacaggcttcgagtggaatgtggctgcttcctgcctcacattaaaataatgaaaaaagacggctccatccattcttgcacgtacctgtaggggttgatcatttcctctgtgacgaaattcaagtaattcctaaaatttagagaacagcgttcaaattatatgatcctcatcagggaaaataaatcaccggggagagagcatcccagggcagctggtgagcctgccccccggtggtctgctcgctgggctggaaagcggacctggagtgggagggagctcagcctcctgcgtgttccggggggtccctgctaccccttccaggccctcccgcacattccctgcctgttcgccctactggggtgattctcaggtccctgtgaggcccgcctgagcgcaggagtcaggctggggacctggaggaaaggggccgcagggctcagccgcctccacctgccaccttcgccaagactgcgacgtggagctagagccagagtagggctgcagcgggcggcctccccacgcttcgtcgggatgtgggtgactctggagggtcacctgccactctttaactgccaaggggcagttaaagggaggggcagtccactccctttaactgccccttgatggctgggagatttgggattcctggacacgtcagggactgtatgtccccagaccaagggacccagacattccagaacctaccatcctccataggcaaagaggccgctgtataatgccagcacaatgttccccacatccagtttggtgccttcaaatgagaagttgggatctagattggacacatcacctggcagggccaaagaaaggaatgctgggttagagagcgctgaacagaggtcatgctaccagttctagaatgttcctggagcaaaatacatagcaaacaaaaatgctggagtgaaggcttttcactgtgacaaatggtatgtacctgctgagccacatggagggtgcagggttccaaccacaaccagggggatgtggccctgccagaggccctgtgcccacctgagagggcacaggcagttctgaccactgcccaggagggctcctcagacgcttgtctacaggaggtcaggatggaggggtcaaccagccccagttgccttcaagaaggttccctgagacctcacgacatgagtgtcaaggcagtataaagccaggagacctcggtttgcatcctggctacggcaacaaggaaggcccagagccactagggccctgcttcttggggtgcgaggagctcggaacagactgccctccctccagggctggcaggacaggcctgggcaagaacataggtttgtcctggaccgtgctgagtgtgtggccagctgcagccggggcaggggcaggagcagggctgccagggccgagaacgatccccgtgctgtgtgcagagctctctcctttgccctctgaggacacgcgtcactggacttcgtgactgctccaccctattccagaaggacctcatttcaaaacttgaacttcagtcacatctgcgaagaccctttttccaaataaggccaccagcattcacaggttccccaggaggacatgtcttttgggggaaggggtgtctccggaaggtcacgtggctgctgggacagcactggccctttctgtggctgttgcctcctctgtgaaatgggcctggtgtgttcgagcccggaatatattgcccagacatcagtctcacagaccactgcgcttcaggaaggagaacttggaaagaagaccaaagacaccaccggaacaaaggagccgggtcccctcctgcctacctgccaggtgcatatacagctggaggcacaagtggaaatcttggtcaggctgtggactgttagttcattagagaaccgtgtgtgacagtatccttcctgctggaaagtcaccagcccgtctcacagggccaggcagggacgggccctggggctgctgtgtcccaacatgtggccttggaccacaggtcaccatgggggcccaagaaggggaaccaccttggtggtccagggaacaccgcagagtgacgaggtgagcaaatttcaaaggggacccgtgaagggaggttcccataagaccttggcaattaccccaaacaaagtgcgcacttcaaaggtggcaccagatttcctacggcagagcccacggtggggtcccttcctgatgggtggacccagttcctgttttgcacctgcttccccgtggcgtgctggatgcctgcggctctgcctccagctctgtctgtcccagatgccaggtgtgctggggcctttgatcttcagcctacactgggggtgctggtgggttccctgagggctgcccgccaccctgccctgctgaggccttgatctcctgagaaggagctccagggcccactgcctgcgtgtgatgtattctggtcaccaggtggtcagcaggcggagcttgactctgcaggcctggagcgggggcagctcagagcagctcaggacagggcactttgcacagcacctcggcacagcccctctggcctctctcccatctgctctctgatggaatgttctggaatgtgcagacccttcacatctgcatagccctactgtgtctcgcccacttacttctgctggggggagcatctgtcctacaagtgggggaatgcagacctgccaggctgcttgagaatcaaggtcctgcctcccccatctggcactcatggtgggagggggtgaaggtgagccctggaggccagaaacacgtgccccattcactgtgaccacccccggactcagcctgagctgatggacaggaggcctcagtccaaggtccccgccagacacatcaatcctcatagctgacctccagcctcatgacagaaaggcggctgatcctacacagagggtggctgcttttgctaaggacaatataccgaggcttgacatggtatgaggtcttcagtcaggagccagatattggcagccctaaggcctgagtaactttttttttttttttttttttttttttttttttttttttgagacagagttccaccacgcttggctaatttttgtatttttagtagagatggggtttcaccatgttggccaggctggtccagctctgcttaagggtggcctggagggctgcaggagggacctgcttgcagcccagggcagctggacacagggaggtcaccacactcatccagtgactccacgctacacacaggggagagacacaccagaggtgggagttagacagcgttcaaaccctgggggcagcacccctgtacctctcagcatgaccagcgggcattctgcacaccgggagacctgggctgtcacgacggcggggtgcggcgctactggcacggagcaggaggccggggatgctgctggatgtcctgcaatgcacgggacacccccacacaacagagagcccacggtggcagaggtgccaggctgaggccctgtgcaagaagaccatgacaaggcatcagccacgagcctctacccctgccgggaggacaggaccagctcctctcagctttctctcccatggaccctagactcgggcgtggtcctggcttcgacatgaagccccaggcactgggcaggactggaaggaatggctgagcggcccactcatccagcagccacccagcctccacacctgacagtctgctatccagtcagcctccacccacaaggaggggacagcgtgacagggaagtgaggaagagaatcaccgtggacagacggtgacatctgccagagcccacagagacgcgagaacagactcagcgcagagcctgagtggggccctccagccccttccttgtccctaagaggcatcttcctcaggggctggtggagctgccatgaaagcaaacgcacagccaaaccccgggtggggggaaggcaaactgcaaacgccgcggcgaccccggcacagcagccctgtcagcaggattcccccgagagcggggtaattgcggtgggaacgagcgctccaaaggccctggggagatgatttcagggaaaagtggccttgatccctgagtcaggcagatgcggccatgggaaccatccaccccgaggctggaggggagactccgccggtggctaaagccatcctgctgacggggcccagggacgcccccagtggccaaacgcacgtgggaacgggatcttccccctcctctgtgatgcggccaaccctccaagcctctggctcctgactcagaggacgatgtctccccatgaacgcagtgtccctggagagaagagcctgcccagcgtggggaacatgggaatgtggagatggagggcatcccggaacctcagggctgacgggcccctgccccagccctggaaacacctcagggacaagagagtcactcctcaagcgcggactttccactgtgctggggccttccgccttccaaccactctggccccttggggctctaggtggagtgtgctgaacagtgtccccaaaattcacgtccagtggagctgcgggatgtgtcctagctgcaaatgcggtctccgcaggtgcaattagcgaaggaccttgagatgagatcatcccggattagagtaggcactaaggccgacgacaagtgtcctcagcgacacagagacagatccaggggagacagagccagagccagcccaggatgcctggagccacgggcagctggaaggggaaggtggcaccttgggtctggacctctggctgccaggaccaggaccgtctgcatgtctgttgctaaagccagtctgtaggcatctgtcaccacacatgaggggccaaccgtgccacccaggggagacctcccggcttctcagtgcatcaggcatggtcaggggcaggacagctgcagctcacaccccacttctcagtcaccagccgagtgcacagccaatggcacctcatctaagagggggctgtgagtcccatgtggtcagcaccctggagctagctgccctgtgggctcagggaagtcgtgcagtgaccgccacatgggttcagtccagagcccaggccagagtccatgcccaccccacagagtccacgcccaccccagagtccatgcccactccaggcagagtccacgcccaccccacagagtccacgcccaccccagagtccatgcccactccaggcagagtccacgcccaccccacggagtccacgcccaccctaggccacggcgccgcttttcagatgcctgtttcgctctggccatctaatgcctgggaaccgtgatggggcaggaatttgggtttgggggttctggcggcaaccagatggcacttttggaccaccagcagtgtctgtcggtcttggaaactcatgaaggagtgggccctttgcttagagctgccaacctcacaccagaagtaaaagctttttccaactccacaggcggggaaagaccctgagaactgtccccagcacagggctgtggctgccctggcctctgtccatgcgtctgacgaagggcaccgggaggtgaaggccgcgggaaaacaagccccgctcccgtcctttgattctgtcccagcacacggcaccggcagagccccagcttccccagcctgtcatcctcccgaggccgacggcacagaagaatggcaggcccaggacacactgagctcccagagcaagcggcgggtcaagcatcctttatcaactgcgaggtcttcgaggcccaaaagaggtgccctgagtcgcgaagtacccacccttggggcagccaacgccgcagccctggctccaggcccaggttgtccggagtggagccacactcgagcctggcaccaatctgggagctcctgagcgcaatgtcctgtctgtccctgcatgaccctgagactgtctgagatgcctcacagagagatgccctggagtcccccacaggcaggccagcctggaagcttctctggaaagtgagctttggcagctcgaggccgagctgtggccgactcctcccttggttaacacagcctgtacccagctgggattcactttgaggccctggggcttgccctatttcctgccaggagagcggggcccgaagctccatcctgtcccccaaaactcagacgtggaagccctaaccccggtgtggctgtacgtggacatggggcctctacagattaagggtaagtggggtcctcagggtggggcctgatctgacaggatccttgtccacacaagaggaggccccagacagctcactctcccacaaggaaacacagcgagggggtgtctaggagccaggaggccgagcaccccgcccagggcatcagggtccctggcctggcggggcctctcaccgactctcccgccggcatccaggtagcagggccctggcaccagaccctctgaagctgagacccacccacccaggcctgctccgctcttgctgtcacccccggagaaagcggcagtcagggcgtgaggtgaggaaaaggggctgttggaccctgcatggcagtggctcccgtgccggggacgcggtgagcctggcctcctccctgcaagggaggacagcccatttcccaggggaagacaccgaggctcagacaccctggccggggggcggcaaaactagaatcccaaggcagctgcacatctagcacctgcccttgccctctctccgggagggcaccctagaagcccacagtcctgatctggggttcggagagcaggctgggctgagctctgctgggagcgcctagaagcccagctatgggtccacgcacacactcaggtgaagccaggcccagaagaaggaacagctctaagccacagcccaggggggcttctcagtccacgaggcgacccctccacaccccagagccacagacagccaaggtgtgggtgaaacgtttttctcaccagaacagcccagcagctgggcatgtgctgtgaccactgagggggcctttgtcagaaacatcgtctgggggctggacgcccccacccacaggaagaggagaccaagacagggccgcacacccccagccagatgagggccagatgagggaggcggcacctcttcctccaggaagctcctcaggagggacatcgggaggggctcagggggctgccttcaaggaagctcagtgaagctcagagaccagtctgaaaaggaatgtcctccagacctccaccctctcaggatggacgtgttactcaggaactgtcccgtcagcttttcccgtaacacatgacaccccacgtgaacctcccaagagcagatgggcccagtgctgtccacccgaacgcaccttgggaacagaggtgtgggcctccccccagcagcgcatgaccctgcacactgcacccagggtcacagtgggggtggggagggacctgcccactgctcacggctgtgggacctggggcagggcaccccacttctctgagtctaaggggccctactagctgaagaaccaaaggaaaaccatcatttcaaaactgtcacgtgacacacaaatgcaggcccctgccccacagcccagtggcacacacgtatttaccgcctgggacacgggaccgtccagaagtgccctactcataggtgtaggtcacatccaggggtctcggccaccgggacccagggcccagcagctcagcaaagccattcagccggggtctgagccctgcccaggggaagcattttcccctcctggggtgaaggacagcaagaggcacgccgccctggcaggctgcggctttctttcctttttgtggacagagtgaaagggcaaatttgctccaggggaatactgacctccaacagtacaatgtgggaggagaaggaaaagaaagtttttatgcaaccttttttttaaatctgcccaactatccaatctgtaactgttcaaggagagattagtttgttctgccgctgacggctgcagcccaagcaaagcacaaagcgccccattgtgtcctccaggagggacgtgctgctgctgctgggctgggacggcagagcctgtgccctcgctcccaccctccgccctgcaggcgaaggcccagccaccctctccttaggcaacagcctgcgagtggactcatgggacggtgggtcagatctgaaccctcatgagtactgtctccctttcgaaaaggctgggactaactgtagaacctcatgtgacacctaagcctgcgtgtccccatgccccagcctaggggcagccatgactcccccaagacgcggaggaggcaagggctcccgaccactcaggcccctgcagagtcgcccctgtcactcagccagctgcccctcccagcccgcatctcaggaaaggcccaacccctcagaagggcttttctggtctgcaccagggccccgcttattccccactgcgactctcccattcacgtgcctatggctctcaggtccccccatgagctctggatgcggggccatgttctcattgggacccggcatagatgcggcacacgggacagaagatggttctgcggatggccaactgggaaggggtgattacaaacttccctgacgaggaggaaacaggtcagccaaggcctacaggaccctagggccagtgcctttccatagcacagggcccacctgggggccaagggcagcaaggaggagccttttcagccccaatggagcagggcacccagggtgcgggacaggcaggaacaggtgcgtgggccaggcctgctctgccagattttcgctgcattctccagacccggaaagggccacttgccagtcgttgcaaaattgaggccggagtctctgccttgaagtatctgggggcgctgctgccaggtgccagcgaggggagggggcagctgcccaagggctttgcgtccactggggggtataaagttggacaactgctttgggagaaaggggtcaacacaatgtatcttctaaaagcaaggcattcatctggtaacaaaataaatctgttgaagccaaacaggagacaggaattctgcagacactgcactgtatcccaaagctcagaagggaattgctggggggagcacggtgggaggacgctttcaacagctaacggaattataaacctattatgtattcaagtcgaacaaaagctctttgctctccctaccgaaatttgtttttacaaaaatcacgttcccctcctaaatctttcctggctatctgatgagcgcagccaagcaaaggccttcacgagcaaagcaccccttccgtgcccacttctgggaggcacaggatggatttgtctcctgcccgtaaaatgtcactcaggcccaaccacctccctgggcaacttctgagtgcccgggagccatggaatgagctcgtcttgccttgagtaaggtgccggaacctgaggtcccaggaaggttcagaattgggacttcctgccagccctgtcctgccagctcttgggtggctctggtaccccgggcgactctgagaatccctggtcagacacatgcatgggggatgggctcgagctcctgaaggattgacctgggcaaccttccagagccacctgggaatcaagtgggacttcccctcgacgatgaggcaggtaactaacacctgctgcagactttgtacagattgatacatttgataaagacagtctggccccagcccctggagctcgcctcgctgtggtgaggtcagtatagcccggcactgcatccccctgcaggcccaggttacctgcttggtgtggagacccctccccagctgcagccagactttgtcctaaggcgaagtgccacgtacagccagcagggggcgccaggagcaaggcggaggctcagctaaagctgcgtgctgggtgctgggtgctgcggggcactgttcagttcacagcccaccagtggcacggtgcacacaggagagcctcccagccctgaggcagggccccacacaggaggaggcagcgtccttgtgtctgcatgttttggcctggccgtgcatgggggcggggcagctcacagcttgctgggtgaggaccttcctgcctctaggagcaaggtccttgccctgtcctctgcagccctggggtcctacctgcctcccctacagccatgtgggaccaggcagcctctctgcagccatcggtgactgcgagtcaccagagcgtgcatccgccgggtgcctgcactcagcgaaagctccacagctccaggactgggatcatctctacctgaggctctgggagagaagagaaggaggccagctcctaactgctctgctcctaggctggctccaacatggatggagacaaactcagaaggaactgcagacagaggcatccctgctggactcaagcaacagggccccccacttcaactgtacccaaccacgggtgggatccagtgccaaggacagtgtgtcccagggtctgtgaccacacaaatgggaactgcttatgaaaccccagcccgacctcaccgcggaatggcagtgtggaaagggtggaggctctgcaggcagacacagaacacagatctatggagtgtgtgttaaagggtccagagacacccagcaaaataccaactgtgtcagtccacgtcaacagagaacacaggtgcaaaggggcgggggctgtttcacactcactctctttattccttctaccagccccaagagaaaaagcagctgggaaaaaggctcagaatcagtgatttccccaagatcacacagcacaagaccaaagtctgggccagccagccttaaaacctgtgcgccagactgctctcacctgttcccgaatgctaacagtggacacgtctgagtgatggggttaccacgtttgttttgttttccatgcttacctcatcttctttaaaaagcagacagaaacacagagacaatcccacacctgcccatggaatgatgaatgaatcacagcatgaccaggagcatggccccgtcgggggtgggtgaggggcgacagcacgtgggactctgacagacccagggtgagatggctcgggtgaggtctgcatggcaggcatagcccctgccaggcctggaatgttccacatcgcccccaggtgaggttacaacgcatcagctgggctctcaagattcacagacatcgcagcgtaaaaaacaagaaaaactgccagagcccctcccagtggtggccacgctgtcccacgggagcactcctgtgtccccctctgggtcggatttcacttgctgggtgattttcccagagggaaatctccacgttgtacagcactgcagagctgcggactgggaggcacccggggacgggacctcatgccctgtgaaggacacacaggcaaagcctcgaggggccgccggtggggcctgggggacgtactcacccttcccgatctggacgaagcccagcaggatgatcagggccagggccaggagcttggcggcggcaaaggcatcctggacccgggtggcggccttcacgctgtagcagttcacggccgtgagcagcactgtggagacagagggcagcggtgagttccacgggcagacagacgccagctcaggggtaggctgggaggtgacgaccccacccccaccccagggccaggtccaccagaaaaacaagctccttaaacagctccagtcccctgccagcccttagggcacgttctgactttctgagacctgttttgataaacttcgcagtcctttcaggtctaagggctggatcccaggtgccccttaagatctgcaagggacctttcctcaccccccaccacaccaggccatggagtcccacctgtagtcaggacttcaagtggggtcactgcctccagagacccaggtgagcaaggtgaccctgccacttggaaggcgcccattacacctttttgtacctactcagcaccctgacctgactgtgagacccacgcacagcccgactgccggactccatgagggcggggccctttcctcaaagaggatcttctgtggattccaacagaagtggggtgtcccgctttcccggaactacctggccagtcacctggggacggcagcctgggaggggccacaggggcctgtggtgagcagagcagaccctgctgccctgctgctttgggggcatacgatgaaacccaaaatagcaccgtgtgcttcagaagcctgagtgaccccacacagatggccagaacgcctgccccaggaggcgctgagatgtggggtcaggcacgctcagacaggtctccagacaccagcacgtcctcctgggccctgtaaggcacccagctctgagcctctgtgtgtgtgtgtgtgtgtgtgtgtgtgtgtgtgtgtgtgtgtgtgtgttgggggttctgttgcaatatataggcacgctgagccactgtgtgtgtgtgcgtgtgtgtgtgtgttttggggggttctgttgcaatatgtgcgcacgctgagccactattcagggatctgtgagctggtggggaaacagccacccccacaacttaaaatgaagtaaaatcatattaatcccgaggcactgactccacgacacccctcactgcctgctgcactacccttcactcctctgctcacgaggttatctgtcgctgtcagcagcttgaaatctgccagtgggaacgtctacaccccagaagtgggcaaaggcccagcacgggccacccacacagctcagatctcacagccctcccggcaccgcaccactaagactgcaggaaggtgagagcatcagaaaggccgtgggctcctcttctctctttccccttgggagtaacgctcagaaaggtctggccagccaaggccttgaggactccagtggcttttccccagctgaacaaatcctgtggaatcttacaatgtaagcaacagaccccgaggaaagacatccatgctaattaactaatgacaccggaaacgtcctgaggtgcgggacgggctgccgcctgcctatctctcagaaattaaccaccccgctacaattctgtggatgccagagcggagacggctactacacaccaggaaagtctggttgaaaaatgtctgaaagtcagtgttttcgctgctattcctaaaataaaatacttgaaattccggaacttccactcctcacccaaactgaagaggtgattcttcacctcttcccagggctcccagggacatggagatgttaccagtccagagctctccagtccaaccctcagggctcagcagggtcaggtcagtgggtctaggcagctccttgtccgctgcacagggcaaggggcaggtcctggcttgccagtcccatttccttatggttggggggagcacgaccataaaagaaactgagcctcggggacctagccggcttctggagagctttctggattcgcaagaggccggctgattgcatcactcgctcattcatgcccggagggaggcggggagtgggtgtggccaagccgcactcgaggctgcctctccccaaaagggagagaggcacgctgccaccactgaactccagacaccagacaggcgctgcggagacactgagcactgccctcgcggctgtcacgtctgcggctgtcacgtctgctagggggttggggggtccaggaagggcagcgagttgcccagaattgcccaaccacgggctgtcctgccacactgacgtggtgctgggtaatgacgccatcagggctgtcactgtgggtgggacagaggccaggacccccccgcccccccccccaccgccagcctgaccctgcctgcccagttccaacccagccgctccccaaccaaaaacagtctggaggggctgacgggtgccaccgggagggttcaccagatcatctcctgacgttggaaataaccacaggacagacaggcgggggccgggtcttgaagtcaggtggggagcaaaatggccatagaacaaaggggaccttatatttattccttttataacaagaacataaattttcatgttcactgactttgggtgatgagtaaacaaaggtttcattattctccacagtgtccttttttttacgttttaagatgagataaaatcttaaacaaatacatgaattcatctgggttcagtacctttcgaccttaaggaggcgaggcagtcacaggataagtctggggtttgaacctcagtccctgctggcacttgccctctcccaagcctcagtgtccacaccatggaggggctgctggctgcccccacagcagggagatcgacagggctgtgccctgagtcagagtgagggggctgagcacacagggccagccacccccagataagtgtggccgcgccagcctgcggggacagctgggccaggagataaaacccgtccggggataccccgtggcgtggcttggcttgattggcagatagccgggcaggctgagctgggggcccctcccagtctggggtgctgtcttccccgtcctcacctggctgcctcccacctggctggctggcaggggctccagaggagctggggtgccttgggggcagtgcattggaggaacccctgccctcctcctcccttcacctgtgtctccaccacccttcagggccatcagccacagaaacatcctcatcttcgggtgggcattgacagcaaggcccacagcccggtgaaggaaggacagccctggccatacccagagccagcgccagggccttggccaggacacctgtcacagtgaggcccaagctgtggtcctggtcctgactcaaaagccacttcagataccctgaggctcacgcaggagggattggggacgcggccagcccatttctcctcaggaccctggggtgggcaccaaggcctcccactgctctcgccacgtgccctgctgctcagagctggggcgtcccggggaggttgccaccacccagcatgaggtgggggacacccccacccccttgtgcctccccatctctggggtggggccggcagtgatactgacctcagagaccatgcaagaaggcacctgaacagggagggcccacagacgggacaggtgcatactgctggctgggcccacagacgggacaggtgcataccgctggctgaccccccaactctgctcaatcacacacgtgcacacacacgcacagcacccccacaacttgtaaaccaggaggctgccttctcctggcccctggccttacccctctcccctcggggggatgactctctgaggtgcctccctgcctgatgcccgtgaacgctcacctctgcggcagccggctctgctcacctcccctgatgctggcatcttggtctcctggccccaactctgtccagctcctgataaaatcccgctacaagcaaagggatgatcccccagggtccagtgttggaggagaggggtgggggaagggccagtaacaggtgtgttcaatatggagagcaggtgggacctgtgggccccggctgggtggggaccccgcaggccccatgaacccaccccacacggactaatgcctgattctttcaggtaataaacatgtaccaggtacaggagcatccgtggatagggttcagggtcagccacaatgaaaatcctctctgttggccacagaggctgctccctgggccgccggtcctcacctgcccccgagccaggcacagcagtgagtcctgcagggctcagcaccttggcctgtctgtaagtgggagtacccagtgaacatgatcctcccgggccccttcgagcccaaacacagccactgtgagtgccccaggcaggcgtccagcccaggcaggcatcctgcagtcccttctgtcattttcagacccaacagaaacagaagtgctcctgccaggcccccgaggactgcctccaggagtcatctgtaatgacaggctgtgttccgcgcacggtttcagagtctgtccagagggccaatgctggggctggggcagagatggtccaaggcctgtgagctgtgcagctttataggcaaatgacgattgtttacccagaactgcctgctggagacagcacagaggaagtggccggcagcttcatcagttccaggaagcccaggcagcctggtcccccagggtgcaccgggcacagcagttcgcacggggccggagagcggcagctgaccacagcaactacagctggcccgacaccgggcacaggtaccagcccagcccagtcccgcccagtgcagcctgtggcccctagcggagccagcacctggcaaacctgacacccagccttggagcttgggcccccctctgcagctggctggggctcctgagacagcttctttgtcggaatccactcggtacgcacagggccccgaacttggtggctgcccagtgcacatggggctttagtagaaccagtaccttcctccctggccccttcaagtctaaatatcccctgctctgagtacaagcctccaccttctccaccgacagacagcccccaccatctcccgtgtcatcccccgggggaacttataaaagcagtggtgggggaggcggatggaaacccagagcttctgatcaggcaggtccgggagatggagacaacacatctgcacagaacaaggtcccagggaggctggtgctgccggcctggggagcgcccccagcacaggcgcgtgcttccctgatggacacgtcaccgccccgggctccagaaaatgaatgtgtctgacccagtgacccctgtcctcacccaaggccaacctcaccccagaatgggctggaatgccaagcctgcccatgccggctccagatccacctgcctccctgccactgctggccagagagagaggtcaaagtggtccggaaaccccaaggaaaatgaagcagttccggggcagggaagcaaaggcagcgttcacattttttttttttttgagacgaagtctcgctcttgtcgcccaggctggagtgcagtggtacgatcttggctcactgcaacctccgcctcctgagttcaagccattctctcacatctacctcccgagtagctgcagcctccgcctctggggatcaagtgattctcctgcctcagcctcctgcctcagtagctgggattactgacacctgccaccacaccggcctaatttttgtatttttagtagagacaagcgttcaccatgttggccgggctggtctcgaactcctgacctcaggcgatccgcccaccttggcctcccaaagtgttgggattacaggcgtgagccaccgcgcctggccgggatggtctgcttataatggctcaattttgatgcccagtctctgcagagcacaaggccccacctttgggccggacatacagatgtccctgggcaaacagagagatgatcccaaggccctggccccacctgtctgctcagtgttgaaacagatttctgtgaaaacaaattactaacaggctggtgtcacattttcaaattctgtcaccagcccttgaacacatgtctttgtacttttttccatttttaaccggggctgagttacgcccaaccacactgtcctggctggcacgggggaggaggtgtcagctgctgtccagaatggggctgacacattcattttaaacaggccaggaagatgcagatttggcaagctctgaaatttgccaacatcccaagtccagggtaagcaggagaactggaaaagggcagcttctcatgtggtcaggttctcctgacacaagcgtcctggtggatttgggtttcccaagggtcctgactccaggagacccccagggctgacaggaagggccaccgctccctctgaaactctgaaaccaggccacccggtgctgaaatgctgtgtgaactccggcaagttcctttgcagggactgagcctccctttcctgtttccaacagactggaacaactgcctcctgctgcatgggcgaaatacctcgcggacgtgtcttacggcgccccatgaaagcatcaccattaatctgaccagtcaccgcagcatgagtatcttcagggcacagatgaagccgtgggcaccagtgataaggagttgccactgctggctaagtgcggagcctcacacatctgtggtccggaaacccacgccccactccaaaccctctacagctccaacagttatgctaacaagaaaaaggagtgaaaacccgctccagtcacggtattgtggaggtggaaggacacttgtggcagccaatccaacacctccattttatagccggggtaaacgtagttcagagaggttgtcccacttggtgaaagtcacacagcagttcctgggcggcaaagtgaggacatccaggtctcctaaatctcaccctcgtgctctggccacttgactgggattttcaatcccggctgtcaaagagaagcaccaagtccacttgggctcctggccagcgtccaagccagtccaactcaacagcaagcggaagcaaataccacacaatgaactcgttgaacagactctgcgctcaggcttaaccagtgcacagcctgtacacccgacaggaggatgcagctgttccaagctaaggccagggcctctccccaatcccgatgggctctgcagatgcagtgatggaagaatccctggtgacggggagcccttagctctgagcaggacctgaagccatctcagggcttgcaccggcccagatgctgctgcacaagtgctccaggggctcctgccctgccctcctcacctgccccctcacctgtcagggatgtttgattcctggctggcccctcccctacctgacccctgccaaagacccacgtcaccccaggcttccagctctgaagcaaacgaccagagaagtcaagcgcctggctccgggccacacagcttgagggactcagagctccagggacagtgcccgggccctgctcaggccttctgcagaggccctgggctcttccagttgactcagctcacaaggcccctacacggtagcaggtgaagacagggccccaagaaccctcaggctctgaagccacacatgagagccgtggacagaatcctgcattggcctccagcagctcgagagcacagggacaaagctggactggccccggggtcaccatggccttggttttgtagcagctgcagtttgagcacgtacaccaaaaataaaattctaagccccgtaactgactaaagggacccctcctattgccaaagggatattccaaagttaacctgaaaaacgagctcaggtcacgatgggaagagggggtcacacaggccttgttataccccctccctctggaattcaggtacagcggaccagcactaacactcaaacacagatcttggcctggctcagtggctcatgcctgtaatcccagcactttgggaggctgaggtgggcagatcacgaggtcaggagttcgagaccagcccgaccaacatggagaaaccccatctctactaaaaatacaaaattagccaggcatggtggcggcaggcacctgcaatcccagctacttgcgaggctgaggcaggagaatcgcttgaaccgggttgcagtgagctgagatcatgccactgcactccagcctgggtgacaaaaacaaaacaaaacaaaacaaaacaaaacacaatattcgtctccacaacctcctgtcttacccagatactcctttctattgataccaggtctttagctaataactctttcaaccaattgtgaatcagaaaatcttttgccaggcacggtggctcacacctgtaatcccagcactttgggaagccaaggtgggcggatcacctgagatcaagagttcgaaaccagcctgaccaacatggtgaaacccccgtctctactaaaaacacaaaattagctgggcatggtggtgcatgcctgtagtcccagctactcgggaagctaaggcaggagaatcacttgaacccaggaggcggaggttgcagtgaactgagatcataccactgcactccagcccgagtaacaaaagcatctcaaaaaaaaaaaaaaatacacacacacacacacacacacacacacacacacacacacacacacacacacacacacatatatatataaagaaaaaggaaatcttcgaacccacctgtgaccaggaagcccatccccgccttggagttgtcccgcctttctcggcagaaccaacaaatacctttcatgtactgactgatgtctgcctgtaacttctgtccttgtaggaggtatgaactccagctgtggcccaccccctggggcacatgtcctcagggcctccaggccttggtcctcacatttgactccggataaatctcttcaaacattttacagagtctggctttctcgttaacaagcagctcacacatacagtgtctcagtagtgacagatgctggcccaccccgaggtcaggatgactcagcagggatcgagtttgcgggcgtcacgctccaaggcccagaataggaggtcggtgctcattcctcacgtagtgggcaaatcctagggcaggggaggggcgggcaatgccagagaacggtccccacctggggtggtctgacggccagggatgcagggagagacgcctcccacactcccggaggcacgcacgtgctgtggccaccccggagggtccgccttccagagggagaattcaggattcggccagtatcagggaaggagacgctgtggggggccctcctgttggaaaagggcagcagcgggaagagggtgctgccacagggcctctggggagcgtgcgggcacacagtaccaatctgcatgcatacacgtgtcctgtccctgcagacgggccaggcaaggcctgcccatggccagctatccaggtgatgctccagggagggccaggcctactggggggcagaaccctgtggctgtccagggtacctggatgtgagtctgggaaggatggagaagggtggaggagcgcaaagggcccctaggggatgctggggaacacagatgagcctctgacccacctgtgtccttacctgggccgactgggccacccagtcttgctgactgacacctccccagacccctggcacccaccagactccccaggcgtggctttgtgctcccctatgcctgatgacaaatggtggcctcagtgtagaggtgggcactgtggcccctggctcctggctcgctcctgcctcagtttccccagctgtaaattggggattatcactggcttcaaaggctggagtgcaaagtggtggccaagaggtggccaagaggtgccaagaggtggtccaagagtgtgccctaccttggacacccctctcctgggggtggctctcaacctggcctgggcccccgggggtctgcgcaacccacccttctgtgtgaaggcggctgatacacatttctgggcaagattctgcacattctgctggattatgaaagaggtctgtgacccaagaaaaaagggtcacaagtgcccgttaggctctcctgtgtggctcaggtcatgtgcttctgtgagctccccctacggccttgccccgaatcccgtgatgcagcgtgacctgcctaggtgccggcggcactttcatgtgcggctgggaaagtcagatttcagcactaatcactggctgccgcctgcaatgagcccacggcttgagctctggggcccacccagctccttaaacacgcagaacctttgccagctgagccaggatcccagctgtggggggttgggggtggaggggtgcagggatcccaaaacccaacccggggccaggttttacacaggcctggactgagaagtggggctacaggctacaggtgcttgataccccaggggggccctggaacaggcctggactgagaagcggggctacaggttacaggtgctggataccccagcggttgggggggtggtgctggacacccagggggcagatagaggcagccaggcagcctgaagaccctggggcaaaacacacacaggccccctctgctctctggtcactgctaactggccaactggcctttgagtccactgaccacagctaagcccacagccatcaaaacccaccccttacacccttcaccctttagggaggggctcagagacagttgtggcgattcctacttccacccatagccccccgaccctgggcctgtgccgagcgtgggtgggtgacatcatctcgcacccagagctccagactaaaggaaaccctggctcctgtctctggctcttccctccctctctttgttcccttgctccttccttcttttgccagaggagaagacagtgaggctgagggctgctccatgtgcacagtgagcaggagatacaggcacgtggagggacggtcacagcccgtgcaactggcaccttcacacgcagaggcctgggattcccagacacctggcgctggggccaatcccattccacagtcagaaacaggctcggcggggccaggtggatttctcaaagccttggttgcttttggcctgatgctagctggacagtgtctcagctcacaggttcctaaacgcatacccgcccacaccaatctgctgaggagtgacagccatggggaggagagccacctcactccagggaccctggcaccgtctcccatgaggccaggtgtcctcagccacccgcagccagagtcccgcgagaccgacggacggcctgcccctgcgtgacggcacgcctgggactgtctcagcagccccccatgcttcacccaactgggacagggaaacaggagggggctacttctgctttcaaggcatggaggagctgtctgcaggccacttcccgaacacctatgcgcttggagaagtgactgagactgagccagggtatcttctccacgatgcagtgagcccatcgggcccttcttctgagagcacctccctggaggtggaagcccctgaggcccacagcatcttctgaacctgtgagttcccacttactgagaactcgcctggatcagtgccgggccacagtggaccgggactttgagtggatgctaccctactcgctatgcagagccagctggggcccagggaggtcagataaactgcccaaaccaaatccaggcccagccagaatctcagctccagcctttgcgccttctgataaaacccagcatcgcttgaatttccagtacacgctgccaagtcttcgttaagcaataaataaccacacaaccctactgtcatgccaagttccatatggccatccagaaagagacacatggagctggttcctctcacctttatgaccagtgaaaagcgcaccaacacgaagacacgcgtgaaaggacctcatctcctacccagactgacaagcaagggatttttttcactcaccgtcagtgggatggttctaagcaccgaggccaacccatttcacacgattatttcacaaaaagaaaccttctgtgggacgtgcctgggcgactgaaaagacagccagcaaaactgagaaccttgttctcaaatctataccctctcccaaggcagcctcagaggcccgagggctgaggatccagacccgaaagccactgtaccttctgtaggatcaggctcaaggaataagggggtaaaaggtgccctttcccttcctaagcagaaaattccagaacccaaccttatgtgtgatcatttaaaaatatatatatatatatatatatcagccgagtaggctgactcacgcctgtaatcccagcactttgggaggccgaggtgggcggatcacctgaggtcaggagttcgagaccagcctggccaacgtggagaaaccctgtctctactaaaaaatacaaaatcagccaggcatggtggtgcatgcctgtaatcccagctactcgggaggctgaggcaggacagtcgcttgaacccaggaggcagaggttgcagtgagccgagatcgtgccattgcactccagcctggacaaaaagagcgaaactccacctcaaaataaataaataaataaataataaataagtaaaataaatcactttctatggcttttcactgctccaggagcaatgtccacagatcaaacgcccggcctctccttcacaccctggagcgcccatcctgcccactggtccgggctccaggctgccccctgcacctgtcagaagcccccctataagggcagggtctcccttcccgggacatccactgcccttctccgagctgaagtcagaatgacctgagaatcagcttggagttctaccagcctcagcaaagcccacctctgcgacagcactccttgcagacccctgacccggtgacagatgaataaagtacagacacacagatattctgctctgccagtccagctgagggtcccagccgcttataggctccctgctgagtcctgtaaacagttgctacttggccctgatcagctagtcagacgtgcatttattcagtatgattaactaacaaaagcttgagtcaacaccattagaatgtaacagacattgtggacttcccaagtaaaaagcacttaaacacccacggtcttaagattatgcgagtaaacaagctagctaggtaaactacgctgcctttcttttatcactatttttatttgtttaattaaaggtaaagggatcaggccgccttcagccagagctaattaccgaagttatgccaacttctcggccttccaagatttgtgtctatttctataactatctctaatatctttcccaccagaatgattgaaccccaacacacctccctctctcagcagggtctgcctgttcagagaacacagcttctctttcttgccttacacacaggggcaagaatagattcactcttgcagagagtacatccctttctgttactgaaaatcactttccaaaaaaaaaagcaacacatacacacatactcaccacacacacaggtgggtcagagaaaaaaaacaagtacaaatggcttagggacatgagaagtgtggccctaactttcgctgaaagggaccctattaacattaaccctcacctctgggtcagagagggttggcactctagggcctgccttgaagctttacctactgggaccaaaaggactgcttggaaagctattttaggccaggtgtggtggctcaagcctgtaatcccagcactttgggaggcagaggcgggtggatcacctgaggtcaggagttcaagacaagcctggccaacatggtgaagccccgtctctgctaaaaatacaaaaaattagctgggcatggtgggcacctgtagtcccagctactcgggaggctgaggcaggagagtcgcttgaacccgggatgcggaggttgtagtgagccaagatcgtgccattgtactccagcctgggtaagagcaaaactccatctcaaagataaaataaaataaaaataaatttaaaaaatactttttaaagccctattaccacaaaataaatccaggaacgcgtgacttggtacagcctctttggaaggcacattagctattacattagaatccacaccccgccgggtgcgatggctcatgcctgtaatcccagcaaattgggaggctgaggcacatgcctgtaatctaagctccggaggttgaggcaggagaatcgtttaaacccaggaagcagaggttgcagtgagcaacgagcctgggcaacagacacagactctgtctcaaaacaaaatcaaaaacaaaaagcaaaaaaccacatacccttttcccatttgcacaaagctgggaaaccccaaatgccctccacagggttctatgggggggcgggggtgcggtgagcacacttgttcctgccgacacagggaagtcttcttagcagctaaagagggcagcctctgcgtactgcctgggaacatggcaaaaccattttaggctttaaaaaaaaggtggagaacaagttgtacattatgatcttttaaataaataggccagcgatatatttgtaacagaagcagctccggaagcatacactgtcagccgcagaaactctgggggtcgggggtggtaaaggaggagaaatgtgtcacccaggcaggagctcagtggcaccatgcttggttcaagcagttctcctgcctcagcctccgagtagctgggactacaggtgtgcgccatgacgcccagctgatttttgctttttttttgagatggagtttcgccttgttgcccaggctggagtgcagtggtgcgatctcagctcactgcaacctccacctcctgggttctagtgattctcctgcctcagcctcccgagtagctgggattacaggcatctgccaccacacccagctaattttttgtatttttagtagagatggggtttcaccatgttggccaggctggtctcgaactcctgacttcaggtgatccgcctgcctcggcctcccaagtgctgggattacaggtgtgagccacagtgcctggctggtttgaatttttaaatgatgatgaattcatgtatgactgatgtgatttttattagaaagagaaaactaggcagcgccccatcctacgtctccttcctggtggccaatgaagcatttcccacgactcactcctggcaccagcaggaagtcagagactcagcacccaggggctgcttttttttttttgagacaggcttgctctgtcacccagactggagtgcagtggcgggatctcaactcactgcaacctccacatcccggagcatgcctcagactcataagcagctgggattacaggcgtgagccactctgcccggctaatttttgtatttttagtagagatggggtttcaccatgttggtcaggctggtctcgaactcctgacctcggtagatccgcccgtctcggcctcccaaagtgctgggattataggcgtgggccatcacacccagccaaccaggggttcattttttaaagataagagtgcaggctgcgtaagctactatccatgtcgttacataccgggccgacatgtacctaggcgggagggagactgaaccagtgaaattctaatgacaaaaaaagaaatcagagtcatcccctacattcacatctccaacgcccagctggaaggcacaggctctccccactgctgtcctgctacgatttttcccggctttgacctgcatggtggtgcggctgctcgactcagagcctcagagaaaccacacagagccctgctgagtcttgccctcggggcattctcacatttatgaagaaatgcctccccctccccctcccccccaaagtacggtgtggcagaaaacagcgccaacaggtcctgccagtcagaagccactcccctgatttcatggctcaagaccccaactataaattagcccttcccaccttgaatgtgtacacacactattgagatgcaggccgatccatgccatgggatgaatctgagaattgccaagacccaccttcccacgccacccaaccaaatcatgtggcatctgctacaagtgattttccccctgaaatcccacaagaaaactattttgaggccgggcacggtggctcacgcctgtaatcccagcactttgggaggccgaggcgggcggatcacaaggtcaggagatcgagaccatcctggctaacacggtgaaacgccgtctctactaaaaatacaaaaaaaattacccgggcgtagtggcgggcacctgtagtcccagctactcgggaggctgagccaggagaatggcatgaacctgggaggcgggcttgcggtgagccgagatcgtgccactgtactccagcctgggcgactgagcgggactcagtgtcaaaaaaaaaaaaaaaaaagaaagaaaaagaaaaagaaaactattttgaaaagcagttatctctggcctggtgaagaacacaccagcaccatgcccaccaaaacaggagccccatggctgtttcccagagaaacctgggacccgcacgtccattcactgcaacacagactgaatctgcagccaagctccgctctctcactactgggaaccctcaggggggatcccttagcctaaatcagcaccagtcactacccgcacacgatgttattactactgttttcttatgagtcagcccgtgtcactgattcctgacgagctggtgtggagagcagaaatgaatgattttttttttaactgcaatttccttctcaccaaccagtcagcaatcggagctctaacagtaaaccgattgctcagttactccacgtgggtgccacgcaagaggctgggagtattgctcagcggggccaacgggagggtggcacttgcctaaaccgcttaagtgggggaatggaatgcccaccgaagggcagggcagggaccctgctgtcccgtcactgaagatattcccagcctgtggggagaagtgtaaaagaatgaatgaaagaaacgcacgtggtttctgggaccaatgaccttagcctagaactgccgggatggtccaggaacgtaaagatgtagagatgtgggagccaggggcgtagtgatgcaaggatgcagggacccagagactacgacctcccaacccccggcccgcgccccgtactcacgcacgcagaggcaggccacgagcttggctgcctcctcgggcaccgggcaggtggggaagagcggcttgagcaggtaggtggcgaagaccagggccacgatgtactgcgatgaaggccggatgatgagcagctcgatccagagcttgaggaaggcgggcagcgagccgtagacctccagcatgtaggcgtagtcgccgcccgatttggagatggtggtgccgagctccgcgtagcagagcgcgcccacgatggagaagacgccgcacgcggcccacaccaccagcgccagccccggcgagcctgcctccttgagcacgcccgtgggcgtcacgaagatgcccgagccgataatggtccccacgatgatggccacgccgttgagcagcgtgatgttccgctgcagggtcacgccctcgccctcgcctgccggcgccgagccgtccgcgctcttggcggccagcatcttctcccgcgcctcttccttctcctcggccgccggcgccgctagcgcgcgccgcttcgggcccgcacccgccatgctctgcgcaccggccgggcctgggacacccgggagccgcggcccagcgagcagtgtgcgcgccgcccgccgcccgcagctgcgtcaggaaccccgcccgcgccgccttttaggccccggcccgccggccccgcccaccgtccgcggctcctccccgccccgtggcccggccccgtccctcagccccgccccctcggcccagctcggagcacgtgcgtcgtccggcccagcctggcgggctattcccaggcccgcgtggtcctcgaaggccccagtcctcctgcgccatggagaccccggcctcgcgacctcccccctcccggcgcccgcgtcatcccagcccgtcctcccggatgcgcctgggcggggcctggcagtcagggcgcgccccttcacccactggcccgcagcctctcgtcaagcctgggagcgggcagtgcaccagggctggcctgaggccaaggatggagtttggggtaccccccgaagggaacctaggctcctgtcccggatgggccgaggggatggaaccgcccccacaaccagctcctggggcacgggggagggatgagaggatgacctgaggggaagctcctgcagcctccttccagcctgggggctgcatcagtggggctggtgagccgcgaactgggacgagggaagaaccgaaccgaggccacccagtaattcccattgtatcccaaaagaatcttgccaaagacggcgatccggtgcccgtagctttgagaagcagtaataacacaggctttgggaagccagcaatctgcctgagctcaatttaatcaacagaaccgggggttcgctgggagccataagacccccacccccaaatctacctggggaattcaaaggcaggcttcagtgtgaaggggctttaaagcttgttattcctagggaatgcgagaggcatcttagctaaaaagggttgagaggtaatttcagttagaggcgagagcaggatgccaaggctcctaggcctggaaatgggaaggaatataaatactgccccgagattgaccagactggtgagcggccaaagacctgttcaaagggtgtgtgtgggtcagggaggaagctcctcagtatcaccccaccccggggttccttggcgtgtgtgcaaacgagtccttggaagctcacagcaggcatgtggggaggcctttgttctgggtgagcgttcagcctcccagggcaaacacgcaaacaccggttgcagagctgggtgttcacagcaagacagtctgctgggcagatgcctctggaatccacagaattctgaacaatagccgtggtggaggggggtcagaatccctgtcgtgctgggacctctagctgcagccaggaatgtccaggccccaccccagggagggggcggctgaggaatgccagggcttgtcattctggaccttgctcgccccccggtatgtcgggcattcctctgcggtgataaaaccgagcgaaatctcagcagcccaggcagccacaggcgggggagtgcggaggtcacacagatactaacttgtaatctgccgtccacattgctggctgtggaaggtgcagagacccctccatctgccctattcttcccgctgtgcctgcagagggaaggagacagtaccaccatggctgggcaaactcaccgagtgctcactgagtcctcccctagacagcttcttatgcaatagggtaggtgccagttagagccattttgcaaataaggaagctgaggcttggtagggttacctcgcttgtccggccagcaagtagcctgggagctgtccttttgactctgaacttatatggtacttttaatcattccaccattcttctttgagtaacaagaaaggcaaccaacagtcataccccaaagcataaaattacaaccatgataagccaaggacatgacagggtgagccagcgacagcgacagggaccaggcaggtccagatagacttttctgaggtggtacctggagctgagagcccagggtgagtgagaattaataagggaggtgcaggggtccccaccggcacagagggggccctgcacagttggtgcaagtcatggttggtgcccccagagccaggctcctggcaagtgctggagcccttaagcaggaagggtgacaacagccatgagcgtgttcaagtcacacagctattacgccacctctgtcggtttttactgggttttcatatgacaacattctagatttatccagcaaatctactcctctcagacgtccctgatgccggccctgaaacgccttcgcctgaaagctatgactctagaatcttagcaaagagtgccatctgttggaaagattcggcagcgttttgatttttacagaggcaggacaatggtcttttcagctccagtcagtaatttatcacatgttgtgtattttcagaggttaaaaaaaagaaagaaagaaaagaaaaaaaagttgtggcactctcgcttgagctggttgggagaatactttcttttcttttttttttttttgaaacggagtctcactctgtcacccaggctggagtgcagtggcacagtctcaactcactgcaacctccgcctcccgggttcaagcaattctcctgcctcagcctccggagtagctgggattacaggcacccgccaccatgctcggctaattttttattttttgtatttttagtagaattggggttagccaggatggtcccaatctcctgatctcgtgatccgcccgcctcagcctcccaaagtgctgggattacaggcgtgagccaccacgcccagcgccctgcaggtcctttttaaggctgtttgcaacataaatgagacgaggcatcttctgcccccctcagagcgccagcgtggagttgagcaggccaccctctctcacaaggcgaacccgtcattattttgtcatttggagcaactgcaggggagcagcaaggccacagggcgaggggagagaacccggtggataatcctttgttttctaattatgagatgagtctcgcagtgcagggattgtggttttcatctcagcaaaatataggagtgaggtccggagcggatccttgctcttcctttcaactcgttctttttcccaggaaaacgacttacctggtaaaccctgtaaaccaaaaataaaattctaagggccaccccagacatctaaacagacttcctcctcagccagggctcttaacatttaacctgaaagactggtttgggccaggaagagaatcgggggttggacggcctctttagacctctccagcactaacaccaacacatacttgaagtctatcagacttaaagattaacattttacagcctgttctctttgaagcctcctagctaaaagcttcatctgcatgatacagctttcatctccacagcctcaccacaacccaaacattccttccttcctttctttctttctttctttctttctttctttctttctttctttctttctttcttccttccttccttccttccttccttccttccttccttccttccttcctttctttctctctctctctctctctctctctctttctctctttctctctttctttctttcttgtctcacttatcgcccaggctagagtgtggtggcgcgatctcggctcactgcaagctccgcctcctgggttcaagtgattctcctgcctcagcctccagagtagctgggactacaggcgcctgccaccacgcccggctaatttttttgtatttttagtacaaacggggtttcaccgtgttagtcaggatggtctccatctcctgacctcgtgatccgcccgccttggcctcccagagtgctgggattacaggtgtgagccactgtgcccggcctccaaacattgctttctactgatcccaggtcttttgtgtttttctttttttttttgagacagagtctcactgtcgccctggctggagtgcaatggcacgatcttggctcactgcaacctctgcctcccgggatcaagtgattctcctgcctcagcctcccgagtagctgggattacaggcacctgccaccacacctggctaatttttgtatttttagtagaggctgggttccaccaggttgaccacgctggtctcgaactcctggtgatctgcccacctcggcctcccaaagtgctgggattacaggcgtgagccaccatgctcggcaacaatcccaggtctttagacaacaaactcaaacaattgtcaaccagaaaatgtttaaattggttgggcgcggtggctcacacttgtaatcccagcgatttgggaactttgggaggccgaggcggggggatctcgaggtcatgagttaaagaccagcctggccaacatggtgaaaccccatctctactaaaaatataaacattggccgagtgcggtggctcatgcctgtaatcccagcactttgggaggccgaagcaggcagatcacttgaggtcaggagtttaagaccagcctggccaacatggtgaaaccccgtctctaccaaaaatacaaaaaaattagctgggcgtggtggtgggcgcctgtagtcccagctactcgggaggctgaggcaggagaatggcatgaacgtgggaggcggaggttgcagtgacgggagatcgcaccactgcactccagcctgggtgacaaagcgagactccgtctcaaaaaaaaaatatatatatatatatatatatatatacacacatatatatacacacatatatacacatatatacacacatatatatacacatatatacacacatatatatacatatatgtatatacacatatatacatatatacgtatatatacacatatatacacatatatatacacacacacacatatatatacacacacatatatatatataaacatcagctgggcgtgttggtgcaccgcctgtaatgggaggctgaggcaagagaatcgcttgaaaccagaaggcagaggttgcagtgaaccaagattgtgccactgcactccagcctgggtggaagagcgaaactcttgtctcaaaaaaaaaaaaaaagaaaatgtttacatttacctctagcctggaagcccccctcctgctttgagttgtcccgcctttctgaaccaaaccaatgtattttttaaatgtacttgattgatgtctcatgtctccttaaaatgtataagaccaagctgcaccccaaccaccttgggcacatgcggtccggacctcccgaggctgtgtcacgggtgcgccctcaaccttagcaaaatacgctttctaaattaaaggaggcctgtctcagatttgctggcttcacaacccttaattgaagtggggcttcctggggccgcctctctcctgtgagtcccctgccgggctggttctcagtcacaggggagaaatgcctgcatcttttaacatagcaagggtccttgcttcttctggaggttgtttttgaaagccatgcttttattatgctcagaggtgagcttttcctatctgcatgcttgacaaggtggggctgccctgagtacgatcagaaattccgttctgtttccaggcagataggtgtgtagggcagccactcagtcagtgttcggccttaaagactcttgccagtcaaggaagacgaccgaggcaagtctccgtcattttagctttaaatgccaacattagggacgcgcacctgagagactggtctatgcctttctccgaagatgattttgagggcttcaatattgaaagggggaagggcaggatattgggcagtacacaattttcatgtgaagggggtaggggaaaattcaagtttttgtctggtttagtgactctgccgtttcacgtaagataccctagacgatagggcagcggaaacaatgagatatgcatttgcttcaggtgggcggagggatgactcagttctgcccctcgtcccagcacctgtgaagataagctaacggttcacattgccagggtgaactttaacagaagcgcttagggtaaagatcttggagcccacaaggaatttccttatgggcaaaatgtgagggaggtgtgtcgcttttcatctttttttttttttttttttgagacggagtctcactctgtcaccaggctggagtgtagtgggtcgatctcagctcactgcaacctctgcctcccgggttcaactgattcttctgcctcagtctcccaagtagctgggattacaggcgcctgccaccatgcccggctaagttttgcagttttagtagggacggggtttcatcatgttggccaggcgggtctggaattcctaacctcaagtgatccacccgccttggcctcccaaagtgctgggattacaggggtgagccaccaagcccagccaaacttttcatctctgtagctgtttgttaaataattaggagccgaaacaggaggctggttcccatgacacggtcaccagcttcacttttccctttcgttagcaagtgtggggtcccaggatttatgttcctttcacactctctatgccatttaatttttgcagcaactatagttagttgtcatttatggttggagaaaaagggcagttcagtaagtggccaagcccagcttcagacccagggcaggcctttaatcctcgtggcaatgctgactgccacgctgatggcgccacttacataggcagccagattcataagcatgcggattctcccagttaaaagagaattttggccgggggcggtggctcacgcctgtaatcccagcactttgggaggctgaggtgggcagatcacaaggtcaagagttcaagaccagcctggccaacatggtgaaactccgtctctaccaaaaatacaaaaattagcctggcgcagtggcaggcacctgtaatcccagctactcgggaggctgaggcaggagaattgcttgaacccagcaggcagaggttgcagtgagccaagattgtgccactgcactccagcctgggcaacacactgagaatccatctaacaacaaaaaaaagagaacttcatttcagctgcccctggtggcaccttgaaagcctcattgcctcttcactggaaacatccaccattcttgttaaagaaaagacactcatgactttccttcaccgaatccttctagcttctgtttgaacacttgggtagtccccccacccgtttcctgaagttcgtatgggggaacggtaaacagtgtccatgcctgcaagtaaaatccgaagccctgcgattgctcagtaacagctaggagcaaggttagggattgtagggccagattttttgcttaggttcaactaggtaaaataaaaatagactttgcatgcatttcaggcactgggctgatgaccggccaccagggaggctccgccccacttcttaactttggccccaacgttagtcttgttgctgctctcagatgtgctctgcgtgtcaaagatgacttggaggctgggcgctgtggctcatgcctgtaatgccagccctttgggagaccaaggtgggagaatttcttgagcccaggagttcaagaccagcctggacaacatagggagaccccgtctctacaaaaaatacaaaaactagcccagcgtggtggtggtgcacctgtagttccagctgccggggaggctgaggtagaaggatcacctgagatcaggaaggttgaggctgctgtgagctgagatcatgccactgcactccagcctaggcgacagagcgagaccggtctttttttttttttgagacggagtctcgctctgtcacccaggctggagtgcagtggcgcgatctcggctcactgcaaactctgcctcccgggttcacgccattctcctgcttcagcctcctgagtagctgggactacaggtgcccgccaccatgcctggctaattttttgtatttttagtagagacggggtttcaccgtgttagccaggatggtcttgatctcctgacctcgtgatccaccctcctcggcctcccaaagtgctgggattacaggcttgagccaccgcgcctggcgagactggtcttgaaaaaaaaaaaaaaaagatgacatggaagcaacagtaggagccggggtcagagttcaggcccgtccatccgtggatgatggataaacccagtgtagtccgccatcccttggagcgtcattcagccgcacacaggaagacacgctgcaacgtgcaggacccctgaaaacactgggctgcgtgaaagggtcagtgaccacgagttgtatgattccgagtgcacgaatgtccaggacaggcggatccagagagatggacgagattcgtggctgcttagggcggggggaaggggtgatggagagtgagggctgagtggatggggtctctctttggggtgataaaatgtcttggaactagatgatggggatggttgcccaacactgggagtgacttaaacaccacggatttgtacgtgtttaaatgactaacggttaatgtgatgttatgtgtgaactatacatccaaaagataaaagcagttcaggcctggaatcgaacggtcctgggttcacatctcacctctaccacttggtggcaccaggcgagtgactcggctcagctttcgaagtctcagtttcctcttctgtgaagcagggagacacctgtgcctgcctcctggggaccagcaggtagaagaccctgagccgctggcattgccatcactgcagaactgtgctcccaagaccagccagtggaggaccctgaggtactgctgtgtccctgtcactgcagaactgtgctcccagggctggcggatggaggaccctgagccgctggtgtcatcctcactgcagaactgtgctcccggggccagcaggtggaggaccctgagctgctggtgttgccatcactgcagaactgtgctcccagggccggccgaatgcctggcttccaccctcagactttctttccaatgtgggcgaagggaacacggagggacagcggtcgcagcagcccacacttgctgtgtcgggcgtggtctcagtggctggagtgtgaagatggaggcggggatgggagtgggcggccctgagtcaagggacacctgtagcccccagaagctggaagaggcaggaggggtcctggagcctcccgagggagcctggccctgccaccaccttgaagttggcctctggcctccaggactgtgagagaacaaaagggctgttgtcttaagcccctgtttgcggacaaagggaataatctcaacattgaaaaaatatggccttaatctttagtgctgtaggtggcaaacttaccttcaggatggcagagacagatctttttttcctgttgacaggcattctaacatttccagagacacgggagccaggttctcctgctgggcctctgcactatgagccaaacctgcctattgttaagtgattgaatgagttgacgctcaccttgaactttcttccactctgccctggattacaagaagaattcattgctcagcccatgtcccagcatgaggctggaagcagctgtgaattttgtagagcctggagggccctgcactctttgcagctgccagcttcagcgctgctctcttcggccactttgccccgcctctgttttgggcagtggctgcagggcagatgccacccaaccaggtcaaatttccctgtgaggatggaagtttgtaggttataattcagttctccatcttggaaaatatccaggtggatattgtttaccaccaaaacaatgacttctatcgcgtgagcccgaaaaccaggctgatgcgtgctacggcatgcgtgcgtggtgcctgctccatgtgtgaactgtgtctgttccatgtgtgaaccgtgtctgttccatgtgtgaactgtgtctgttccatgtgtgatccatgctgctccatatgtgttccatgctgctccatgtgtgaaccatgtctgttccatgtgtgattcatgctgctccgtgtgtgatccatgctgctccatgtgggaaccatgtctgttccatgtgtgaaccatgtctgttccatgtgtgaaccgtgtctgttccatgtgtgaaccgtgtctgttccatgtgtgattcatgctgctccatgtgtgatccatgctgctccatgtgggaaccatgtctgttccatgtgtgaaccatgtctgttccatgtgtgaaccatgtctgttccatgtgtgaaccgtgtctgttccatgtgtgatccatgctgctccacatgtgaaccatgtcttttccatgtgtgaaccatgtctgctccatgtgtgatccatgctcttccatgtgtgaaccgtgtctattccatgtgagatccatgctgctccatgtgtgaaccgtgtctgttccatgtgtgatctgtgtctgttccatgtatggtccatgctgctccatgtgtgaactgtgtctgttccatgtgtgaactgtgtctgttccatgtgtgagccatgtctgttccatgtgtgatccatgtctgctccatgtctgatcacacctgctccctgtcactcattttgtctagacttctcaatgatgacagcccccagttacccagatttaaggtagtttctaaatatttgtagccagatccatctagtatcctgcaattcattcattgactcagcaaacatttcacgatagctagacatacgcctggctttgtgagaatgtgtgtccgtatgacaccccagcctgcgggtgaccctttcatgtgcacccctgtgataacaggggatgtgcaggagcccaggtgcggggggaggggatgctgctgcctggggctggcactgacgaaggtgtggtggagaggaggggctgcgctgggccttggcagagaggagaaagtgcatctagcagagcagggaggacagcccaggagagggagcagcgcctagaggacctgcggcagcgcacagcagtccccgagcttacaagtgggagcactgcagcccatggcgcccgaccacgtttattgtgtgctgtgggcaagcagaacagttgaggatcccgcccctgggggctcacattccagagggggatgcaagcatcatgcagcaacacgtgcctgatgccaacagctggggaggggacacagggagaccgtggttggggcaggtgtctgagaactggttgaggatggaaaggagtgactgtgaagcagccttggggacagcaaccccagccagaggcccacacacacaaggtgacgtggaagagggccaggctgcgaatcttgctgggagaagctcgtgctcattcccaagcctagtggaaagcctcagttttgaacagggcagcagaatggccaagtgtcggtttctcaaaaaaacccactgttaaaagaaaaatggatttgggggaagaggggaagaggctggaaagaaagtggctaaactggaaggccagcttgtcactcaggctgcagcagaagggacagagaaaagtggacagacttggaataggcggcagtttgagggtcctccagcagagcctgctgctgccctgggtgcaaggagtgaggggagaggaggtcccaagggggctcccgagattgcctgtggcgtcgggtggatggaggaaccatttatcaagacggggttggtgggcacagagttggggacgcagcagtgcacggacagcccacctttcagcaggagggacaagtgtcaaaaaatgacacttactgctccgttaacggagtaatggagcagacactccgttactgctgggcaccgctgtgtgccaggtgccatctgggggctcagctcaggccgaggaaacaggaggagcaggtgttgagcaggtggtatggggcgggcggggaagggtgccctcaggtccatcagaacagccacaagagccctggggtgggagggggccgatattctggtcggcacagagtgggctgccaggagagggcgggggcggaggggcaggaatgtggattctgtcccaagggggcaaggctgaggggatgtagctgggcacatggtctgctctgaattgagcttggttctctagagggtcgatgggaaggacgtgctggggatggggaggaagcggaggaggaggaggcggtggcagctgggaacaggcaatgcttctcacacaggcgtatctttattaaacaagaaaataagataaaagcaaagggaggaagccttgaaccttaaaagctgggccagaaattctacaatacaatcagaagccacaatctggtcacagtgagagcccttcccgcagagccgcagacaccggccgctgcccctggggcgggagggaagcctcctgtttgttttttgtcccgttgctttgagggctggaatcaatgtcttttcctctcggcgtgtttgtggtttcatctcagtgtgtccaggctcggatggcttcccgggagtatctccgtgtctcaggattagcaccagtttttaaaaataactgacaaaggccatttttcaggagacaaagatgttggtgggtgcagagggccccctgtgtgttgatacggaaaatgaaggtcagccactccctgcttctcttggtgtcttgttggacacgatgtcaacatggggccggtagaactggagcccagggcccctctggccgcttgggcctttctctgtccccaagcccacctggaaatgggcagcccatggagaatggctgaatagctgctctctgcccccatcccaagccccaggttcagagaccaccccctccattgactgtgtcaccccttccccagcagaggagcgggctgttctcagagcgctgcaggaagcccagacaagtgccttcctctggctgctgcttccatcagcgtgaactgcccggcattgtaggataagttttctcctgggttttaaggttcaggactttctctctttgctgcgctttttccttgactgattgcacaaatcagagaaggcaagagtgaaatgctgcgtatcccttggcctagcgggtcagcgacaactttcttaacttctcaagtgagcctcagtttccttattaaaaaccagggacgattttgtggaacttgtcgcaactcaatgggagtgccgtggcccttacgcccaacgacaccatcctgtcacttcgggagtttttcctaaaacaccattccccagaccaacggcgctgcgagcttctggggcgtgggctgggcccaacatgtcagtgcgacccacagcggggctggagctgctgaatgtgcacaacacacttcacccgggcctggttcaggagcgggcgaggcagccgtacaccctgtccttcagcagactcctcttgatcgatggaatcgaagtcaggcgcagcagcttagagcagaacagaaacgtgcccatttccccgcttggtgctttcccgcttccacttcgactccttcaacccaatcctctttcacccgcatcgccaccaagtgtgatctcctttaaagagccagacgctttattttgggggggcgtggaggggtggagtctcactctgttgcccaggctagagggcagtggcacaatctcagctcactgcgacctccacctcctgggttcaagcgatttctggctagattttgttttgttttgttttgagacggagtctcgctctgtcgcccaggctggagtgcggtggccaccatctcggctcactgcaagctctgcctcccaggttcaagcaattctcctgcctcagcctccacagtagctgggattataggtgcgtgccaacacgcccggctgatttttctttgtatttttagaagagacagggtttcacaatattgcccaggctcgtctcaaactcctgacctcatgatctgcccacctcagccttccaaagtgctgggattacaggcgtgagccaccgcgcctagccttagtttttttttttttttctttttgagatggagtctcactctgttgcccaggctggagtacagtggcacgatctcggctcactgaaacctccacctcctgggttcaagcaattctccctgcctcagtctcccgagtcgctgggactacaggtacacaccagcacacccggctagttttttgtatttttagtagagacggggtttcaccgtgttagccaggatggtcttgatctcctgacctcatgatctacctgcctcagccttccaaagtgctgggattacaggcgtgagccaccgcacccggcctacttttcgtatttttttttttttggaggcggagtctcgctctgttgcccagactggagtgcagtggcacaatcttggctcattgcaacgtctgcatcctgggttcaagcaattctcctgcctcagcctcccaagtagctgggattacaggtgcctgccaccacgcccagcgaattttttgcatttttttttagtagagacggggcttcaccgttttgcccaggctggtctcgaactcctgacctcaggtgatctgcccacctcagcctcccaaagtgctgggattgcaggcgtgagccaccgcgcctgacctaacctacttattctttatctccccggaatgaaatggcctttatcaccttgggaaacagattagcatctgcttatttttctgtgctcatctgactgtaaggtaatgttggaagataatgtaattaggtttattgtaaaactttctctcttctggcgggaatattttttaatgctatgaaaataaaaatactgggccaggcgcggtggctcatgcctgtaatcccagcactttggggggccaaggtaggcagatcacctgaggtcaggagttcgagaccagcctgaccaacatggtgaaaccgaatctctactaaaaatgcaaaaaaaaaaaaaaaaaaaaaaaagactgggcacagtggctcgcgtctgtaatcccagcactttgggaggctgaggcgggcagatcacctgaggttgagagtttgagaccagcctgaccaacatggagaaaccccgtctctcgtaaaaatacaaaattagccaggcgtggtggcccatgcctgtaatctcagctaattgggaggctgaggcaggagaatcacttgaacctgggaggcagaggttgtggtgaaccaagatcgcatcaatgcactccagcctaggcgacaagagcaaaactctgtctcaaaaaaaaaaaaaaaaattcgctgggcgtggtggcgggcacctgtaatcccagctactccggaggctgaggcaggagaattgtttgaacccgggaggcagaggttgcagtgagctgagatcgtgacattgcactctagcctgggcaacagagctacactccatctaaaaaaaaggaaaagaaaaacactgtactgattttggattttttccaagcaagtaataggtaaaaagaaacccaaactggcttacatgaaagggcacctattggcttgtgtaactgatcaggtgcaaccattgctataagcttgatccagacccgactcagtgactcatgccagtaatctcagcagtttgggaggacgaggcaggcggatcacctgaggtcgggagatcgagaccagcctgaccaacatggagaaaccccgtctctactaaaaatacaaaattagccaggcacggtggtgtatgcctgtaatcccagctacttgtgaggctgaggcaggagaatcacctgaacccgggaggtgaaggttgcagtgagccaagattgcgccactgcactccagcctgggtgacaaagcaagactccatctcaaaaacaaaacaaaacaaaacaaaacaaaacaacaacaacaacaaaaaaaagagggtgaaaggcagccccagagtgggagaagagatttgtaaaatggacaaaggccttataattggaatatataaagaactcctaaaaatcaataagaaaaccacagacagcccaagagaaaaatgggcaaatggctcaagcaggtatctggtgaaagaggatatgcagacggccaatgaatctgcacaaagtgctccacgtcatgaatcattagggaagtgcaaattaaatccacaggagacacctgggcacaccctccagaaagcacacaatgacctgctggcaaggacaggaatgaccactttggaaaactctttggcagcacagccgaactgagcctctccacttgaaaatgccctttgctcagaacccagcagcagctccaaagtctccacccagcctgtggggccccagtacccacccttgcctcccatgcctctctcctcacccctgcacttggctgccctcaccctcgggctgcaccttgaacaccagaagggcgctcctgcctccagcctctgcctggaattctctgcccttgggtagccacgtggttcactcctcctttggtctctgcccaaatggcccctgtagaagagacctccccacccagccatgtcctcttcctgtgacttaccactccagactttctgtgtggatgcatcatggtctacctccttccatcagaatgtgagctccgaggcaaaggctcttcagaccttaaacagtctaggctccgtccccagagtctagaatagagcctgccacgtaattggcactcaataaatgttacatgaattaatggaaaccatcctggcacgagtggtagctctctttcctccaaaagaatgagcttgccgagagagacaacatcatgaaagagagacagaaaagccacactcagacccaacattgagttctggatcaagtttttttttttttttttttttttgagacaaagtttcgctcttgtttcccaggctggaatgcaatggcgcgatctcggctcactacaacctccgcctcacgggttcaagcaattctcctgcctcagcctcccgagtagctgggattacaggcatgcaccaccaagctcggctaattttgtatttttagtagagatggggtttctccatgttggtcaggctagtctggaacttggcctccgaaagtgctgggtttacaggcgtgagccacagcgcccagctcctgttattttttaggagctttattgttttacctttcctgtttagatctataatctgtcaggaattaatttttgtgtgtgctgtgaggtaggggtgtgaggtatggtgagaaaaaagattcatggttccccatttggatatcccgttggctcggtggggtggctaatgcctgtaatcccagcactttgggaggtcaaggcaggagaactattggagcccaggagttcaggaccaacctgggcaacatagtgagaccccatggatcgactgatgaattgatcgatcaatcaatagatagatcaatcaatagatatccaaatgatccaaaactattcacagaagagcccatccattccctacagcatgagtcagggatcacaaatgtgtggaaccttctagacacgctattctttttcattggttgatttgtccttctctgacaggtaccacattatcttaattaatatagctttttatttttatttatttatttattttgagatggagtctcgctctgtcaccctggctggagtgcagtggcatgatctcggctcactgcaagctctgcctcccgggttcaagcgattctcctgcctcagtctcctgagtagctgggattacaggcatgagccaccacacctagctcatttttgtatttttagcagagacggggtttcgccatgttggtcaggctggtgtcgaacttctgacctcaggtggtcttcccgcctcggcctcccaaagtgctgggattacaggcatgagccactgcacctggcctactacagcttttgaagtaggtcttgacatcaaattgtgtatgttttctggttttatcctgccagattatttttggttgtatttttggtagagacggggtttcaccatgttggccaggctggtctcaaactcctgacctcaagtgatctgcctgccttggcctcccaaagtgctgggattacaggcgtgaaccacggtgcctggcctcacaagaattcctttttactttgagacagagttttgctcttgttgcccacgctggagtgcaatagtgtgatcttggctcactgcaacctctgcctcccgggttcaagcaattcttctgcctcagcctcccaagtagctgggattacagacatgcagcaccacacccagctaatttttgtgttttttatagagatggggtttcaccgtgttggccaggatggtctcgatctcctgacctcgtgatccgcccgcctcggcctcccaaagtgctgggattaaaggcatgaggcaatgcaccccgccagttcttacaaggaggaggcagaagctggaaaggcaaggaaaaagatcctgccctagagcctcagaaggaagcagccgtgaggacaccttggtgtcgggcttctggctcactgaaccgtaagagaatcaatctccattgttttaatccaccaagtttgtggtacttcgttacagtgaaactaagcaccctgcacttgcgttgggtgccatggcacacccctccatcccagcgttatgttccccacggtacttacacatctttctttcacttgcagctgaaaagtacttcgactaaaacaataacctcatgctctctttttaatttcagaagtcatgtacaatcacattgtgaaacttgggaaacaacgcttccttccttcaaagtcagttctgctattcatgtggacctaatgtctctaggaccttgtgccctcattagtggcctggaaggacgcccagaccttccggttcatcaagggttgaagtgggcgatagttgttcaccatcatcttctcctcttcaccaagtgcagaaaacaggagagtacgaaatgcagagagctggaatagagggcagccagggtgagcttggtatgagtgcagggtgagccagcctctgggtgtccctcaggccttatgtggtcccctcccatgctgaatcaggatggcccgaaatgatcaataaatatggtggaagtgatggtgtgtgcagggccagattataaaaggcattgccgcttccgccttggtctttaggatcacttgctctggggggaagctggtcgccatattgggagggtactcaagcagccccgaggagaggcccatagggagaggaactgaggctcccagcgaactgccagcaccaacttgctagctactcgagagggccaaccttggaatgaatcctctagccctagttgagctttcagattgctacagtcccagctgacactgggctacaattcatgaaagatggtaagccagagccacccaaattcacaacccaaggaaactatgggagataataaatgattggtttttgttgttgttgtttgagacagtgtttcgctcttgtttcccaggctggagtgtcattggcgagatctcagctcgctgcaacctccgcctcccaggttcaagcgattctcctgcctcggcctcctgagtagttggaattacaggcacaagccaccacgcccggctaatttttttttttttttttgagatggagtttcgctcctgttgcccagactggagtgcaatggtgtgatctttgctcaccgcaacttctgcctcctgggttcaagggattctcctgcctcagcctcctgagtagctgggcttacaggcatgcaccaccatgcccagttaattttgtatttttagtagagatggggtttctccatgttggtcaggctgctctcaaactcctgacctcaggttatccacctgcctcggcctcccaaagtactgggattataggcgtttagccactgtgctaggcctaattttgtatttttagtagagacagggtttcaccatgttggtcaggctggtcttgaactcctgacctcaggtgatcgacttgcctaggcccccaaagtgctgggattacaggcatgagctactgcacccggctcaaatgattgttttctaaagccactatgttttggagctatttgttacacagcaatagataactaacacctataatgtaaatgctaaagtaacatttgaatttacttttcactgaaggaactaaaagactactttttatggctggatgtggtgcctcacgcctgtaatcccagcactttgggaggccgaggtgggtgaatcacctgaggtcaggagtttgagaccagcctggccaacatggagaaaccctgtttctactaaaaatacaaaattagccaggtgtggtggctcatgcttgtaatccagctacttgggagggtgaggcaggagaagctctttaacctgggaggcggagcttgtggtgagcgagatcacgccattgcactccagcccgggcaagaagagggaaactccatctcaaaaaaaaataataaaataaaaaataaaaaaagactttttatgtattatctcacttgttcacagaatatacttatgaaccctgtgaggcaactcacgcatttgattacattcagaagtgagattatgtctacatgctgacagcatactggtccagttagccctgcgtgatgatgcagcgccccctagagttgcgcgcatggtgcacgtggcctcctgggccgtgaccacggtgtgctcatccacatttgtggtctgcacatttgttgactgtgcagcctttctcctcccctggaaaactccccgccttccaggacatgtgcctccctggctcccctgctcaggataaggggctcctgccctgcatttttatatgacaccggccaccctggcttaatactattggcttcgtttctactttcctgccatacagcagtgttctgagacgaatgccctgttcctgtaccgcccctccacacctgcccccctcccaccctctcttggtggcacagacccagaatgggcacttgtcacatatatgcttgttgagtggcataagggccttgctgacaaggggccaccttcaacaaaagccttccccgtttgtatataagggaatattttcacaggcccgggagactgaaagaccctctaagagctcacctggagccctcggaaagagatgagccagagatgctaagtcgcgctgcgactgctgagaaacgtctgccgggcgggggcggggcataggcagcacgtctgtggctctgaactgccttggacagacagaattgctacagattcttaagatttccagaaaaaaatgatagtataacttttatttattttttattttatttttttgaggcagagtgtcactctgtcacccaggttggagtgcagtggtgccatctcagctcactgcaacctccgccttccaggttcaagtgattctcctacctcagcctcccaagtagctgggattacaggcaaacgccaccatgcctggctaatttttgtatttttatttatttatttatttgagatggagttttgctcttgttgtccaggctggagtgcagtggcgtgatctcagctcactgcagcctctgcctcccggcttcaagttattctcttgccccagcctcccaagtagctgatattacaggcatgcaccaccacgcctggctaattttgtagatttagtagagacggggtttcaccatgttggtcaggctggtctcgaactcctggcctcaagtgatctggctgccttggcctctttaagtcctaaaattatgggcatgagccatgacgcccagcccaagagtataactttaaaaagtgtatacaaatattattaattaattttcgaaaaaaaaaaaagcaatgaaactatttagataagaaaaaggaggccgggctcggtggcttatgcctggaatcccagcgctttgggaggccaaggtgggcagatcacctgaggtcaagagttcaagaccagcctggccaacatggtgaaactccgtctctactaaaaatacaaaaattagccaggcgtggtgatgggtgcctgtaatcccagctatttgggaggctgaggcaggagaatcgcttgaacccaggaggtggaggttgtagtgagccgagatcgcaccactgcactccagcctgggcgatagaacgagactctgtctcaaaaaaaaaaaaggaaagaaaagaaaaaggaagaaaacaaaaaccatgcagacccatgaccctgggacaactcccatggatgcctcgtgtgtctgtgtgtgatagattagggcgttgctcaggacatgcttgctgtgatcactggaaccgctgtccaatctcaacaagctcctacttcagttggaattttcttcttgtgtaagaatgccccaaatgcatgaaagaatatatataactccacaacgctctcatgcagcatcttagtgacgctgccaagcaagagggacgccttccatgaagcgccatcgtgccagttacgggcacggctcacctggcttggggccacttcaacgggctccttctggatgatccaggtgaccgactcggtcagcggcggggtggtgagcgagcccgcgtaggtccagtaatcccagcaggtgggcagcagagtggaggggtcgaaggggcgcatggccgcccgcgcgtcctgagagaccgagaagcacaggacgtgtcagtcctcaggggagactaggagcttccatcttgtctcagcacgtgaggccttcatggtgcttggaaggaagtgctttcccccagataaggccatgaggccactgctgtcacacttgcaagcagtgatgagaaaatgtgacccttctatacagagcaaggattcctgccaacttacattggtgggaattacgttacattacaccagcttacgttggtgctcacatttttccttttgaagtcatttcttggggcgcagtagctcacccctgtaatctcagcactttgggaggccgaggcgggtgcatcacttgaggtcaggagttcgagaccagcctggtcaacgtggtgaaaccctgtctctactaaaaatacaaaaattatccagatgtggtggtgggcgcctgtagtcccagctactcaggaggctgaggcaggagaatcgcttgagcccaggaggcagaggttgcagtgagccgagatcatgccactgcactccagcctgggcaacagagtgagactctgtctcaaataataataataataataataataataataataataataataataaattaattaataataaaaataaaaataaagccatttcttttagcataccttggctgcaaaaaatattactttttattgtgataaaatatacataacataaaatttaccatcttaaccttttttttttttttttcgagatggagttttgctcttgttgcccaggctggagtgcaatggtgtgatcttggctcaccgcaacctctgcctcccaggttcaagcgattctcctgcctcagcctccagcgcctgccaccacgcccagctaatttttgtatttttagtagagacagggtctcaccatgttagccaggctggtcttgaactcctgacctcggatgatccacccgccttggcctcccaaagtgctggggtgagccactgtgcccggcctatgggctcctttttaaggagggagtcatggtggccaagaaggatgtccacatgcctaagcacccggagatggcagacaagaatgtgcccaaccttcatgtcacgaaggccatgcagtctctcaagccccgaggctgcctgaaggaacagtttgcctagagacatttctttctttcttcctttctttctttctttctttcttttttttttcagacagagtctccaggctggagtgcagtggtgcgatctcagctcactgcagcctctgcttcctgggttccagcgatcctcctgcctcagcctccctagtagctgggactacatcttcacgccatcgcgaccagctaattttttatatttttagtagagacggggtttcaccatattagtcaggatggtctcgatctcctgacctcgtgatctgcccacctcggcctcccaaagtgttgggattacaggcgtgagccaccacgcccggcttgcctggagacatttctactgctaccttaccaatgagggcatccagtatctccgtgattaccttcatctgtccctggaaactgtgcctgccaccctatgctgcagccgtccagggactggcaggcctcggcctaaaggtctggagggtgggcgacctgcaagactcacaagaggggaagctgacagacatacctacagacggagtgctgtgcccctggtgccgacaagatagccgaggctcgggctgggtcagcaaccgaattccagtttaaaggcagatttggtcgtggacatggccagctacctcagtaaaatcagagaggattattttgcattgaatacactcacagccaaaaaacaaaaagagtcagggtcttactttgtcacccaggcaggagtgcaatgatgccatcatagctcactgcaggctctaattcctgggctcaagcgatccccccgcctcagtttcccaagtagctaggacaccacaccagggtttaaaattaattgtttgtagccagggggtcttgccatcttgcccaagctgttctccaactcctgggctcaagcgatcctcctgccttggcttctcaaaatattgggattacaggcataagccactgtgcccagccagctcttttggatatatacccagaagtgtgtgattgctgaatcatagggtagttctatttataactttttattttttttattttttttgaggcagagtctcactctgtcttccaggctggagtgccgtggcatgatctcagctcacggtggttgggcctggccgcaacacagccctcatcagcgtcccatgccaaccaagcatagctctgcacctgcccctggccagcactgtgggacaagagtccagtccaaagtgacagagtccctgtctgcaaggaagatggcctccctgctcagccacatcacatcaccttgactttgctgggccctggccttccaaggtggaagctggcaacccagatgccttgggcttgtctcctaacatcaagcagtgagggtcagggtcaagagaggtggctgagctaccagaaggaagcccgggagtgtccacactggcagacacatgcatcagttctatgcacgcatgttcacgtttataattatccagttaattaaaaaaaaaaaaacagcattataggctgggcacagtggctcatgcctgtaatcgcagcattttgggaggccaaggcaggcagatcacctgaagtcaggagttcaagaccagcctgaccaacatggcgaaaccccatctctactaaaaatacaaaaattagccaggcatggtggcaggtgcctgtcatcgcagctgctcgggagactgagacacaggaactgctttggcacaggatgcagaggttgcagtgagccgagatggcaccattgcactccagcctgggcaacagagagagagactctgtctcaaacaacagcagcagcagcaaaacccacagcattattgtgatagaattcacataccatgcaactctcccatctaaagtgtacagcctggttgggcgcaatggatcatgtctgtaatcccagcactttgggaggccgatgtgggaggactgcttgaggccaggagtttgagaccagcctaagcaacataacgagaccctgactctacaaaaaatacaaaaactagccaggtgcagtggtgcacgcctgtggtcccaggtagttgggaggctgaggtgggaggatggcttgagccccggaggttgaggctgcagtgagctgtgatcataccactgcactctagcctcggtgacggagtgagatcctttcttaaaataagtaaataggctgggcacggtggctcacgcctgtaatcccagcactttgggaggccgaggcggatggatcacctgaggtcaggagttcgagaccagcctgaccaacatggcgaaaccatgtctctactaaaaatacaaaattagccaggcgtggtggcgcatgcctgtaatcccagctactcgggaggctgaggcaggagaatcacttaaacccgggaggcagaggttgcagtgagctgagctcatgccattgcactccagcctgggcaacaagagtgaaactccatctcaaaaagaaaacaaaaaacaaaaaacaaaaaaagtaaataaaaattgaagggtacagttctatggttttgggtatattcacagttgtgcagccatcccaagtcaattttagaacttccacctcaagggggaagcttggtactttttagctatggtccccacccccgccctgctgcttctgtctctgtgggtttcataggaactgagtcatgtaacatgtggaacatttgtgtcttgtgtctctcactcagcacggcgcttttgaggctcacccacaccgcagcatgagttagagctgtgtcctttctgattgccaagtaatatctcactgcatggtctagctgggttgacatcccattgcacgctctagctgggctgtgaaggagcagactgcttgtgcatgtgggtaacaggcgggtgtgcagtgagacatcagtctggtgcacgtgggtaacaggcgggtgtgcagtgagacgtccgtctcctcctgcctgccacacatccccagggcacagatgtgccagtcactttctgagcaactacttcaaatcttcagaacaaccctttgagaagtatttctagtttactgatgaagatagacagacagatataaaaaacttgcccaaagccacgttgccagtcagggccactgaggcctggcccgttccgaggtgcgggctcttccttccctccccaaggctgcaggaatcagtcaggggagtggcaggctccagccatgccactgcgggtaggtttcttgccaattaagctttctgccttgggctgagaagaggatgcctgtgtgttgcctcatcgtccccaggagttcctgtcctgtctctaagatgcatgagggctggagcagccatgtggttacagaaaactgctccccctcagggcccccaaagcaaatcagggcccttcctttatgcatgtggtgatcctcaggcagctagaatgggacaccggtgagcacaccaatgaggctgaagaccatcacatccattatctgagcacggatggcccagctacctgtggaaagcaccacaagcctttgctggtggaagtgggttggtgacttgttccacttttcttttatttatttattgtttttgagacagagtttcactcttgttgctcaggctggagtgcaatggcacgatctcggctcaccacaacctccaccgcccaggttcaagcgattctcctgccttagcctccctagtagctgggattacacgcatgcgccatcacgcctggctacttttctgtttttaatagagatggggtttctctatgttggtcaggctcgtctcaaactcctgacctcaggtgatccgcccgcctcagcctcccacagtgctgggattataggcgtgagccacgctctgttcctggttttgtcttctttctcttaaacaggaccccacattttatgagcgtcaagccccacccagcctaactccgcccttgctttgtcctcttagagtctcagtttccccaggtgtacgacaggcagtgtggtggcggtaatgggcttccatcagtgcctgccacgtgggcgtggggctcagtaggtgctgccgctgctgctgccaaagctagaagagcccccacagggcacagagccgttccctggatcccctggacctggtgggctgtttccacctccacaaggcagccaattccccggtagctctgactgttgcgaaggcagggaggaggggggaccccagcagcctgaggagcttgcggcttgtccaggcatggagggtggggaccctctgtgggcagtttttgccaaaacttctggctatggtgagagggtcaaaggcgaagccttgaggtctccattctggaattgtctgcccggggtcaccaggaccacactggggctgtgcctgcgtgctgggagctgagtgcatagtgacaggtcggcactggtaggggcctgtgcagatgggatggtgctgggggtgggggtgggggtccaggcttccaggcagcgcctgatgtggttttggttacagacactgcctgtgtttccctctaagctgctgaaaagctcagaaatgtgcagcaggggctggagctcagcctgggttctgactgcatgcgggaggtgggcgccaggatgactgggacttcaggctgcgtggacccacttcctgggtttaaaaacgggctcttcacctgccagctgtgtgctcgggcaaggccttctctgcctctctgagctttggttttcctgtgtgtgcaagacagatgaatcacaggccctgccccgtggagtgattggaagattcagtgtgataatttatgtggagggctgtcgcttctttgaaccccttccgccgaggtgtagggtgatgtccccttgccctgagcctgggcaggtgctcctgacgggagtggtaaacaggatgccgcaggagcagtgctttgtgactctggaagccagggcagaaaaggacatcgtgtccatctggctctttctggaaatgcacccttggagccctgagcactgcatagaagccagctgggtccccagggagtgaccgtggcaggcattcctggagggtctctgccgagtcagtcccacagcagggcccggaccagcctggaaccaggagagatgatggggactacgtgactctggtctttcctgccctaattcaggacaacttgttccttaactggaggaaaccaggaaagcagcccagaagctgcaggtgagcccgtccctgggtgagaactgctgagtccgcgggggagtggcagagctgggatttgaagccaaggccatctgcccttgagcctgaggccaccatggccctgtcctgccctgcactgcccaccaatcaggaattagattcaaccacacttctagcattttccatcacaaggccatcattctaaaatttcatgggctcccagaaggtaatagctctctctgggaatcacctgacagaaagcacccgcagcaacaaaaagcgattttaaccttagtgattgggctggtggattttcgtttcgtgacgggcagcagcagcctgtgccttccacagcagacttgagtgtgtgagtgttggccacagctgggccttaaactcaactgcacatttcaccaagaaccagacatgctccttattccattacatggtgagaatgctgctctagtgtggattttttttttttttttttttttggagacggattctcgagctgtcacccagactggagtgcagtggcacgatctcggctcactgcaacctccgtctcctgggttcaagcgattctcctgcctcagcctcctgagtagctgggattacaggagtgtgccacgatacccagctaatttttgtatttttagtagagacggggttttgccatgttggccaggctggtcttgaactcctgacctcaggtgatctattcacctcagtctccctaagtgctggggttacatgtgtgagccaccatacctgggctactgtggatgtttaatatctccatttcacaggcgaggaagctgaggctcagaggtgcgcagctcaggagtggtggatctgggctctgaacccaggagtccaactgtggggctctctgatacactgtgctatgggagaagctcccagaagtcctaggctaggagcctctaggcgagagagttgttcaagtctcttcccattccctggcccatgaagcacagactcttgctcccaaggctgggccttttacctcctaaggtcttttttttttttttttttttttttttgagatgagtctcgctgtgtcactcggcctggagtgtagtggcacaatctgagctcactgcaacctccaccgcccagattcaagcaattctcctgcctcagcctcctgagtagctgggattacaggcacccgccaccacgcctggctaatttttgtatttttagtagagatgaggttttatcatgttggccaggctggttttgaacacctgacctcaagtgataagcccgccttggcctcccaaagtgctaggattacaggcgtgagccaccgcacccagcctcttaaggtcttttaatttctcaaaggtctaactcggccaggtgcggtggttcacgccggtaatcccagcaatttgggaggccaaggtgggcagatcacttgaggtcaggagtttgacaccagcctggccaacatggtgaaatcccgtctctactaaaaatacaaaaattagccaggcatggtggtgggcgccggtacttccagctactcatgaggttgaggcaggagaatcacttgaacctggaaggcggaggttgcagtgagccgaggtcgcaccattgcactccagcctgggcaacagagcgagattttatctcaaaaaaaaaaaaaaaaaaaaaaaaaaaaaaaaagagtctaactctttattttcagctgaggggatgagcccagagatcagcatcaggaccagagctcagtccgcggtggcacttcctcccctgtcccgggcatcattcctcccctgtggtttgcctagaaaattctgacttaccccatggagaagaaatgctccagaaccttccccgggaggaaaacagcccttgggtaaagggtccttcacaatcagctcttttctttcccaccaagaggtgggaccacctggtgtgggaggtggaggctggctgggaaaacaacccctgcccaggtttcctctggctgtggagccgcgtggaggaagaggatggggcgtcagagctctcagaaccgtggccttgtgaagttcctgagcaggcagatggggcggcagggggtgatctggtcccagtcccaggaggccaccccgaagccagcatcaaggcgaaggccacgtacagatcaaacgtctccttgaaccgcgaggaagggctggtcccagctccatctggaccagcctccaccattgttaacacaggttgaagcctcatccgtccgcacatgtgaggcttgcgttgactccttctgccctggaattcttttgtatgctgctgaataaataaactacatttctttggaatttctccttctccctcaaagccttttctcagctgatcttggagaaaggcgacactgttgtccccaccatcttttcgagctgcgctggatacagggaagcctatggatcgctgggcggagagctgcggtttgggcaggtttctctccgcccttgggcttggggtcggacagggacgttcaaggagagtgctgggtggtacatgagtcaacattcttaaatgttattagttagggatttgaggtttttgtttcaatctgttttaaaacaaactttatcattagtgaataccatcacccaggacaaggctaaaaatttttcgagctaatcaatttaaagaaaaatattaactaggctgggcgcggtgattcacgcctgtaatcccagcaccttgggacgccaaggcgggcggatcacctgaagtcagcagtttgagaccagccagcctggccaacatggtgaaaccccgtctctactaaaaatacaaaaattagctgggtatggtggcgcacacctattgtcccagccgcatgggaggctgaggcaagagaattgcttgaacccgggaggcggaggttgcagtgagccaagatcgcgccactgcattccagcctgagtgacagagggagactcctcgaaaaaataaaaaagaaaagaaaagaaaaatattcagtagaaagttgtcccattggcaggcagatatgtcaaacgtcttcaggatctcgcctgcatggctgaattttgggaacttctgttgagctcaacacccttattttatggaggaggaaacagggtcccagagcagtggtgatgcattcgaagtcagagagacctagctgtggacacaccagcatcaaccctgcggaatcccatttccagaactggaaccacagccccttggcggggctctttccactacgccatttctttttccttgcaaatgaatcgctgcactaaacaattttgcttgtcagattatactgatttctttcttttcttttctttttttttttttgagatgggatttcactcttgtcacccaggctggagtgcaatgacacgatctcagctcactgcaacctccacctctgggttcaaacgattctcctgcctcagcctcccgagtagctgggattgcaggcatgtgccaccgcacccagctagttttgtatttttagtggagacggggtttctccatgttggtcaggctggtctcgaactcccaacctcacgtgatccacctgcctcagcctcccaaagtgctgggattacaggcgtgagcctccgcgcccggcctgctgatttcaaatatgcagcttaccttatgttttatttccggcaagatgtccaccagcctctgcagcgtctgatgatgggccccgagctgcatggcagacaaaggaggggttagctgcaaaggcagtggatggggggggaagctcactccactgtaaatacaccacgttttaaaagcaatcctaggccaggtgcggtggctcatgcctgtgatcctagcactgtgggaggccgaggtgggcggatcatctaaggtcaggagttcgaaaccagcctggccaatatggtgaaaccctgtctctactaaaaatacaaaaattagctgggtgtggtggcacactcctatagtcccagctactggggaggctgaggcaggagaatcacttgaacccaggaggtgcaggttgcaatgagccgagactgtgccactgcactccagcctgtgtgacacagcgagtcctgtctcaaaaaaaaaaaagcaatcctaatgatggatcaccactttcttcattagatctacacccgagcaagtgattacctttaaaaacacgcctatcacagccaaaccattctctcccacgacagcttccttgtaattttggtatttcacagaattccagtgaactaaatgcagctgaaacacaatggaaagagaacttaaattgatcagcaagaaataagacagtcacttccccttctgaatggctgacctatgtgtccacttaatcataatgaaatggccaggcgcggtggctcacacctgtaatcccagcactttgggaggcggaggcgggtggatcacgaggtcaggagatcgagaccatgctggctaacatgctgaaatcctgtctctactaaaaatacaaaaaaaaaaaattagctgggcgtggtggcgggagcctgtagtcccaggtactcaggaggctgaggcaggagaatggtgtgaacccaggaggtagagcttgcagtgagctgagattgtgccactgcactccagcctgggtgacagagcgagactccatctcacaaaaaaaaaaaaaaagaactaagttgttgcagccagatgagtaagatcccagcaccagcagcacctctgagctcccaggcccttgacgaagccacaggaaggaacagcctcagtcttcctggtggggggggaaaggagaggatcatgttaacctcatccaatagaaatgggtggtttcattattttctacttcctagttatccttggacaagaattaccagaagaaactcaggcctcggctgggcgcggtggctcacgcctataatctcagcactctgggaggccgaggtgggtggatcacgaggtcaggagttcaagaccagcctggccaagatggtgaaaccccgtccctactaaaactacaaaaactagccaggcgcagtggcaggtgcctgtaatcccagctactcagaaggctgaggcaggagaatcacttgaacctgggcagcagaggttgcagtgagccaagatcgtgagatagcgccactgcactccagcctaggcaacagagtgatactcagtctcaaaaacagataaataaataaataaaatatctgttcatcaaaaacaaagttgcagatagagatactaaaataaaagtcatgttgttaaatgaaaggaagcacacagaagccattgttgtgctcattcttggaacaatttataaatatgtgtatgatgatgacaatagatatcactccctatttataaaatgtccggaggtcacctctgggtgtgagattacaagcaattttcattttttggtttgggtggactctagttccacattaactgcagcattactttcataacaacaacaagttcaaaaaacagaaagagtcctcagcttgaaaaagcatcaaaaagttaggtgagtgggtgagcagaggtgtgataaagtgaatatggcaaaaatgatcatcacaggactgagacatcaaactcgtagattcttctcgttcatttcttttcattttttcgtatgttgcaaaaatttcataatgaaatatttggggaaatctataaggcatcacttatcaccccaaaaaaactacaaaaaccaattcccaacattgatatgcactgattttctctactgactcccactttggaaggttgaaaataagactgctttaagatgatcttagccgggtacggtggctcacgcctgttatcctagcactttgggaggctgaggtgggtggatcacttgaggtcaggagttcgagaccagcctggccaacatggcgaaaccccatctctactaaaaatacaaaaattagcagggcctggtggcacgcacctgtaatcccagctactcgggaggctgaggcaggagaatcgcttgagcctgggagacggaggttgtggtgagccaagattgcaccaatgcactccagtctgggtgacagagtgaaccctgtttcaaaaaaaaaaaaccaaaaaccaaaaaacaaacaaacaaacaaacaaaagaagatgatctctattgcaaagatgttcagcttctcagcagagggccttgtggatttgctagtccctacagctgcaagcacacagctgagtgaagtgcggcaaagagctcaagctctgactttgcatcccggctgtctggctttggcaagttccgtaaccattcagaacctcagtctcttcttccgttaaatgagagagaacttacagcgccttcctcgtaggagaggtgtgactaaacgggtggggcggccgacggttctggtttgagcactgacagtcccaggccccaggaaatccttcacatctgagcggcgcgcatggcttgttcaccccccaccatagagccggagacatggaaagtgtgcagatatgtgctgttaggccacgtctacaaacctctgcggggtacgcgtggccgtccactgtgtgctctgagcccccctcgttcactgctccccagtggaagtgaaattgcttcagtctgtagtggttttccaagggcccaccactaattcctggaaataaaggcagtgagacgtgtgtgtcattttgtctgtttgttgagctgtggtgttacctgaggcattgtctacattagggttatatgagttcactcgcaaggggttgctgtatggttgaagtgacaagccaaaggtgggctccgtgaaaggtgggctctgtctgtcccattcactctgcccccccccagcccagcgcctgcccagaggttcacagtaaatgtggaatgaaggcagggtcccagtgctgccactgggtggtggtgagggcctcaactccctgcaggcagaaatccgtaaagaacgtttctgtgatgcctgcctgtcctataagatttccagactttaattaaaaaaaaaggtgtcttccaaatattttttaaaagcagcttaaatcctatcaccaaataacattataaaataacacacaatgagcaaagtttttgttttgtcttgttttgttttattttaagacagaatcttactctattgcccaggctggagtacaatggcatgatctcagctcactgcaacctccacctctgggttctagtgattctcctgccccagcctcctgagtagctgggattacaggcatgtgccaccaggccaagccaatttttgtattttaagtagagacggggtttcaccatgttagccaggctggtctcaaactcctgatctcaggtgatccacccgcctctgcctcccaaagcgctgggatgacaggtgtgagccaccgctcctgggtgagcaaggtctttaaataagaagaccctgagctgtagcatcagtcctgatctctggcagtccctgcttaatctaggcccaccacagggccagcttttattggaacactccttccttcctaagtcaccctaaacactcaccttggagtcagcactctctacctgcaggcctcggggtgcccctctccatggcacagtgccaggtgcagcctcccaggagcttgcttctcctgacatgtggggctcagccataagcatcgctcgctgaggcctctggctctggcccccagagtcatggctgccattcccacgtccaggtagtgctgggagtctgccttttaacgagctccccaggggttcggatgtgggtggcttctcctgtgtctaagtactttgtcactaacagatttccatcagcagctgctacaaatggggtacccgttccacacgttttcactgaaagcagcacagcgtgctcctgggatggctgggcaaggctggaaggcgccagcagaactggagcactgatcccgaattcagggtggcccgagtgcctcccatagctgtggaggagcctcatgtcacctcccgctgtggcaaaagccaggaaagcactgagcgcgtgatgaatgccttggggagcttgacactgctgactcctggtggtttcccgacaccagaagtacttgggctgggcgtggtggctcacacctgtactcctagcgctttgggaggccgaggcgggcggatcacttgaggtcaggagttagagaccagcctggccaacgtggtgtaacccatctctactgaaaatacaaaaattagctgggtgtggtggcgggtgcctgtaatcccagctactcgggaggctgaggcaggagaattgctcgaacctgggaggcggaggttgcagtgagctgagaacgtgccactgtactccagactgggcgacggagtgagaatcagtctcaaaaaaaaaagtactcatagttggaggcaccaaggtgtaaactggaaaatggaaaatggatttggctttagtccagtcaggggctaggcaagtgctggaccaagccacagagctgctcactgcccctcttcactcaaaatctcagtgttggtctggagcaacctcagagtcatatctagttttaaaattctaccattatgagcaaatcttctattctccttaaacatacacagatgaattacatctcaatttttaaaaatacacagaaagagtccttcccacaataagcacataaaatcactttgttaggccaggcacagtggctcacgcctgtaatcctagcactttgggaggccaaggcgggtgtatcacttgaggtcaggtgtttgaaaccagcctggccaacatgataaaacctcatctctactaaaaatacacaaaattagccaggtgtattggtgggtgcctgtaatcccagctacttgggaggctgaggcaggagaatcgcttgaacctggcgggtggaggttgcagtgagccgagattgcgccaatgcacttcagcctgggcgacagagtgagactctgtctcaaaaacaaaacacaggcgtgagccaccgtgcctggcctccaaaacacaatctaaggaacttacagaaccacaaaatgggagcacggtgagctctgtgctcgcttctgcctcggcctgtgtctgtgggggaaagggggtttgcagccgaccagccccagcagcatcaaagtgcattgatgggtgactgagggtggagcctcccagggggtctgcctctctctcttgggatgggctcactcatgataagtttactgtgtggaaattcacgcatgtctgtatcatctcttctagaatagaaatgcctagaaggcagggatgatggatgcttcatggacaaattagactggacccagcctggtagatgccatttgtaagactgagttaagtcccatccagttgcactcttagagcagaggctgtttctaggctgggtgtggtggctcacgcctgtaatcccagcactttgggaggccaaggtaggcagatcacccaaggtcaggaattcaagaccagcctgaccaacatggtcaaaccccacctctactaaaaatacaaaaaattagccaggtgtggtggcaggtgcctgtaatcccagctacttgggaggctgaggcaggagaattgcttgaacttggcaggcggaggttgcagtgagccgagatagcgccactgcactccagcctgggcaacaagagtgaaactccgtctcaaaaacaaacaaacaaacaaacaaaagcggttgtttccgtctggaccatcactgtatcaacaggacttagtgcaggaaggggtcatcgaaggcacacaacgaaccctcatgggatgaatgaatacaggaacgaatgggattagtcagtccactgatttattcatcgaatcacttggtcggtaagcagctctgtgtgttacagtggaatcgagcctttcccacggcagttggggaaccgcctgggatctctaggaaagtccacagaacacagaaatagttaaagacctggatttgcaactcagctctgcttctaacttgctgtgtgaccctgggcaagtagcttagcctctctgagcctaagcctctctacctgttaaatgagaagggcgggcaggataaatggagacaaggcaggaggcattttgtaaagtgttgtctgatgatggcagtggtggtgattgcgcatcgcacacccttcaggggctccgcagcttcgtctgtgtaaagagagttactacacgtttctcctggtcccagctcaagcaccctagggttctacgtaggcacataaatagggttccaaagagagcgacgccaactgcatgaggcataagtccactgacagccgatgcctgccggatccccacccacaaaacctagtagaaaagtcaccctccagactgtggccaaccaacaagggccaggaacgggagctgctgggaccggaagggacttgtgagccctgagcctctgcagggtaaggtgctgtgctaactctggggctggaagactttcccaagggtttccagcagggctggagcccacaggcatctcttcatccttcccgaccccgagctgtcccagaattcttcttctcctccttcttcttctgctttttcttctttttgagacagagtttcactctgtcgcccaggctggaatgcggtggcgtgatctcagctcactgcaacctccacctcccgggttcaagagattctcctgcctcactgcctcagcctcccaagtagctgggactacaggtgcgcaccaccacacccggctatttttttttttttttgtatttttagtagagacggggtttcaccatgttggccaggatgatctcgatctcctgacctcatgatccgcctgccttggcttcccaaagtgctgggattacagacgtgagccactgtgcccagcctctcacagaattctttactgcagcagcctctgatgggccggatcccccgcctctctactcactggagtaagagacaagtcagccctttccaatctgcctcctgaggggaaccatggggccctcgggacatgcggcccctcctcaggctggctcggggcatctgcacgcctgtacctgaacaagggacttgcttgaaacggcggccaccctgggctggggaccaagcacgctcaggggaaaacccaaaaaggctactgggtctctctggctctatgatacgcaaatgaggagggaagcgaaacgttcgttcttctaagaggataactgcaaaggaaggctgggccgctgcgttttcgggaacagcaggtgcaggggccgatggatcactcgggctgggctggagcggcccctggtggcagttcggtgaagagcaacgtagcccgcgcggggcgcacgcatttcaggaagacacagaggcctttttactggaaatgccagcgggtgtggattccacaggctcctcttcagcatcagtctagtgtgggattcatacaccttgagcctctttcaaggtgaaacagagaatctcactgcaaattttaaatcccactgtaaattccgaaattagacctgcgccgcgaagaccgcccaccagcaaaatgccaagcgtatttctttaaaaactggaaagccgtgtttcgttactcttcctgtagacaacacagcatggggtcaggagtggggtctggagtcggacgcacgttcagaagctggggccaccactcccaaactgtgtgctctaggtccagcttttgcaccccttctagcctcagtttccccatttgtaaagtgcggatgatccttgaacccccaccataggactgctgttacggttaagtcacatgggaaatacgaagtccttagcacaacgcttgacgtaaaggaagcactctaaaacaaacaaacaaacaaaaaacaacgaactggaagccactgaagccttcatggggtgaaacagctgattaaggggcaaaggctctcactggccaggttctgccgtgtcccgggcaccacgcatcctgtccatgagctcacgtcgttgtcgtgatggagaaggcttggtgtgtaccagagtgcagcggaggagctggcgttcgctgggcacctgctacctgctgggcattgcgaggtaactttatgttcctcccaggatgaactcctcacaatggccctacagagcaggtcctgtgagtccaactttgagatgaggaaattgagacgcagagaggttcggtcacctgccccagtttagccggcaacctcacccaggtctgacggtccaggccctcagcttttgtagtagggttcaggccaaactctgctacttgccttgccagtaaagttagggacccaatttaaggctgcagacctggataaaataatctcaaagtgacttctttttttttaggtggagtctcactctgttacccaggctggagcgcggtggggtgctctcggctcacttcaacctctgcctcccaggttccagtgattctcctgcctcagcctcctgagttgctgggactacagacatgtgttaccacaccccactaatttttgtttttgtttttgtttctttgagatggagccttgctgtcacctaggctggagtgcaatggccagatcttggctcactgcaacctccacctcctgagctcaagcgattctctcacctgtgcttcccgagtagctgggattataggcacccaccagcatgcccagctaatttttgtatttttagtagagacggggtttcaccatgttggccaggctggtcttgaactcttgacctcaagggatctgccgcctcagcctccccaagtgctgggattacaagcatgagccactgtgcccagcctaaagtgacttttcataatgacaatacaatgtcagggtattctccttaatcaaaaaaaaaaaaaaaaaaaaaggcaagcccaattcacgaaaaggggtctttaagctgccagcccccatcccccggactctgctatcagcagggctggtccaccgggcagcactggccactgttgcctcagcgttctgtgtaagcaggtgcgtcagaaccggctcatggagatataattgaacgattgcctcagcgcgtgccagactctccaaacataataacagatgacgtttggggccggctccaggctgtgacgtgctggccccagagaatattgtctctgctattacaacagatgctgttaatagccatctatttgtagttcggggcttttaccaagatgagcaggcttttggcaggcacgggttgtttgaaggcttaaaattagtacacgagaagtttgagatgttctaattactggaaatttcaaataacatgatgctgcaaaggaccggcctgcttccggtgccactctgggaggtagtgcacgttcccaagctgtaaagggtgacacggctgagggcttctgtgtgccacctccccaggcaggcaggggccgcagccactgcaagcccctgcccacagaactccgcgacgatggaacctagactgctccctggaagttagcctctgagaccatcacatattggcactggtttgaaagccaggcaaatgtgggctccaatcctggcttcacacggtggggctttgcaagttgttttataggtctgtggcccagactagacgtttataaaaggataatgatgcctacttcaggggcccatggcaaggattgagtacggtgatgcttacaaagtacctccctcacagtccctggcacgcagtgagagctcaaataatggtagccacttactattattatgactggtgttattgttattattaaaattactgtcatcgcccaggcacggtggctcatacctgtaatcccagcactttgggaggctgaggcgggcagatcacttgaggtcagatgtctgagaccagcctgggcaacatggtgaaaccccgtctctactaaaaatacaaaaattagctgggcgtggtggcacgcgactgtagtgccagctacttgggaggcggaggtgagagaatcgcttgaacccgggaggtgcatgttgcagtgagccgaggtcgtgtcactgaactccagcctgggcgacagagggagactccatctcaataaataaataaacaataaaataaactaaaattgctatcctcactgccatcaccatcatctcaccacggcagagatccgcagtcccctgaagcagataccacgattctcaaggtgagacctgcacgtaaagacgtcgaaagataaatatgtcttaagaacacgtccataagaaagggctttgccaaccatgcaagcataaaagaagaaaagtccctcattcatccgaaaacacccactgactttctcccacgtgccgggcaccacgctcagtacaagggacagagggaggaggctctgggctcagacttgccctcgcagagcgtggaatccaggaggggcagacggtggtagagataaaaagctgtgtgtctgagaggtgagagtgtgggctttggggccctaaacttgcttgggacgcccaggagggcccccgtggaagcggcgtttcagtggagccctgaagatgggtttctatttgtcaggtgaagataatggcggctccaggcagaaagggacgaccagcggaaaggaccctggtgacagcagccaccacaacggaacaggcggaagcaccagccggcgaaggcactgtcaggggcagcaggagatgggattacaggggcaacagggtcggcgccggtggtggctaaaggaagtggggccttcgccaacaaaccgcaacatggtttttttttttttgagacagagtctcgctctgtcacccaggctggatgcagtggtacaatcttggctcactgcagcctccgcctcctaggttcaagcaattctgcctcagcctcctgtagctgggattacaggcaggcaccaccacaactggctaatttttgtattattaccagagacagggttccaccatgttggccaggctggtctcaaactcctgacctcaggtgatccacctgcctcggcctcccaaagtgctgggattacaggcgtgagccaccacacctggcccatcaacaggttttgaatgttccagtcttttttttttttttgagtcaggggtctcattctgtcacccaggctggagtgcaatggtgtgatcatgcctcactgcagcctcaacctcctgggcgcaagccatcctcccctctctgcctcctgagtagctgggaccaccatgcccggctaattttttttacaagaccactgttaaaagcccggaagaatcctgcagctcactgtggtgggctgttttgcgtgtgctagagtctattcagcatttcagatggaaaagcctcagcattcctcttccgtgggcctccaccgtagctcctttgaaatctctgctctttcttgcaccttcccatctgagtgtctgtgccgtggcccccccctcctctccaatacgaagagcccacactcagcttccctccctcctcctccaccccacactgcccgagcacctcacctcccagtgactgactcgtccccggtcttgcacacacctggggagcgtagctggcccgtcctgcacaccagccttgcaggctcgctgagtagaccatccttgtctgctcttgctgggtgcagccgtgtgtagtggcccaaggggggtcatctgggagggcataaggaagcttaagtgacgtctaccacgaggaagcgtaagtgatgttcaccacaagaggcgtggggagcggcggcagcgcgttcatccactgtgcttgacgtcgcttatttccccgatgaccttttcccggacttcctagctggatctccgtgagtgccagggctgggtctgggaagggtctgggacccagcacatcacctggcacagtcagtgtttgctcaatatttgctgagagaaaactgcagccatgtcaccgatttacaataggaacttctcgtatggagcagaaatgtgttgttgcctgtggctttgcaggagctccgagcagtggcgagaggaagtcacgggtgaccatggtaggcattaccgcctgatggggttgctggctggtcctgagctcatcaccgtccatctcctgcatccacagtgatttctattaagtgcagcttttcgtcaggcaaccgccagcagcactgaggggtgggatgatggcatattgaccaaaacactcagggggtgctagccacgcggcgggtgcagatgcggacccccagccccacgagcttgcagtgccgttcagccccgctgcacccccgtctgtctccaaggctgaggaactggggtgggaggaggaggaggcacagagccgtctgaacacagctagagccactcactggcccctgcaggggagcaacgcagtggggaagccagcagggagggaaggggcagttgcagtgggtgggcatgggggctcagctactggcacagcaacacgagggaaccacggagagcaggagggaggacgtgggggcgggcgcagggcgggagcaccgggcagtccacaaggtggtcaggacctcagctggcggctgggcttgggaggggctggcatggagtcacgggccaccgtcccctaagtgtttccctaggcaaggttctcattcccctcgtcaggggaggggatgggcacagagaagtgcagccatgagccaggaacagagctgagatgaaacctcggcctcccgtcttcggaacgagagttaatccacagaggagctaaggaaaacgccgggcaccgagttgacgggtgaggggtgtgagcgatggggccagcatggccgccgcaccaccagctccatcctgagcgtttcacggacatggccctcttcatccacacaactgccccaggagccaccgaatgaggctcgatgaaacctcgactcgcgttgcagcgcacgtccgaccacactcgcctttgatcgcatttatcactggggatccagaggtcagggctttgtgtctgcagcggtccctgggaaacaatctacaattcgaagctccaccaaactccctcagagtcacgaaatttctatcactgactgctttcctccaaggcccaaactggatttataaacttccaaaggaaactttatattgaaaaagcgatgtacccacagcattgtagaacgatgtttacaaaggaaaaacaaggccaggcgtggtggagtgagcctgtagtcccagctacttgggaggctaaggtgagagggtggtttgagctcaggaga

SEQ ID NO: 40 - DNA, 153191 bp, Homo sapiens
gctttattgcaggccaggcgcggtggctcacgcctgtagtctcaggactttgggagaccaaggtgggtggatcacctgaggtcaggagttcgagaccagcctggccaacatggtgaaaccccatctctactaaaaatacaaaaattagctgggcatggtggcacacgcctgtaatcccagctacttgggagactgaggcaggagaatcgtttgaacccgggaggtggaggctgcagtgagcggagatcactccactacactccagcctaggcaacaaagcgagactccgtctcaaagaaaaaaaaaacctttattgctttcggtcaaaagacccaaaacaggccagctgaggtggctcacgcctgtaatccctgtgctttgggaggctaaggtgggaggaccacttgagcccaggagttcaaagcctgtaatcccagcactttgggaggccgaggcgggcggatcacgaggtcaggagatcgagaccagcctggccaacatggctaaaccccgtttctactaaaaatacaaaaattagccaggcatggtggtgggcgcctgtaatcccagctaccctggaggctgaggcaggagaatggtgtgaacccgggaggcggagcttgcagtgagccgagattgcgccactgcactccagcctgggagacagcaagactctgtctcacaaaaaaaaaaaaaaaaaaaaaaagaacagaaaagactacatgcctgtggacatctcactgcctgtccccccgcccttttttttgagatggagtttctctcttattgcccaggttggagtgtagtggcaccatctcggctcactgcaagctccgcctcccaggttcacaccattctcctgcctcagcctccagggtagctgggattacaggcgcccaccaccatgcctggctaatttttgtatttttagtagaaacggggtttagccatgttggccaggctggtctcgaactcctgacctcaggtgatccacctgcttcagcctcccaaagtgttaagattacaggtgtgagccattgtgcctggcttgtctcttctttaggtttggttttctgtgacccctatttttttttttttttgagacggagtttccctcttgttgcccaggatggaatgcaatggcgcgatcttggctcaccacaacctctgcctcccgggttcaagcaattatcctgcctcagcctccctagtagctgggattacaggcatgtgccaccatgcctggctagttttgtatttttagtagttttgtatttagtagttttgtatttttgtattttagtagagggtttctccgtgttggtcaggctggtcttgaactcccgacctcaggtgatccgcccgcctcagtctcccaaagtgctgggattaaggcatgagccaccgcgcccggtctttttttttttttttttttttttttttcagacagagtctcgctcttgtcgcccaggctggagtgcaatggtgcgatctccgctcactgcaacatctgcctcctgagttcaagcaattctcctgcctcagtctcctgagtaactgggattacaggcatgtgccactgcgcctggctaatttttttattttcagtagagacagggttttgccacattagccaggctggtcttgaactcctgacctcaggtgatccacccgcctcagcctcccaaagtgctgggattacaggcgtgagccaccacgcccagcctgaccctctattttaatgcagactttttaagtgtgatgtacatgccctaagtgtccaccgtttgatgaatttcacaaaggggctattgccgtgtacccagcactaaggatgagaatcagagtgaggccccacacagaagtccctcggttagaacccttttccgtcatgtgccacgcagaagaggccatcccccaaaatgcacacccacctggaactccagaatgtggccgtgtttggaagcagggtctttgcagatggaatgagctaggatgaggtcatgctcatcttagtgtggtaggtgggccctaaattctacgactaggcccttttaaggggagggagagggagatacacacatgcaggggagaggttgtgtgaaggccaaggctgagaccagaatggtgcagccacccaccaggggagtgcaaggaccctccccaagagccctcagagggagcacagccttgctgtcaccttgaccccagacatctgcctccagaactgggacagtgcattcctgttctctcagccaccccgtttgtccatttgtggtggatgtaactgcagccagagggcactcacactgccccatggccacatagctgctggccaacagaagggaggaacagctgtgggctccctctgaccaaaggcaagctgtgggctcagcagacagccgccggcagccagctgaggacagcaaggctcagggttcgcaccatctgggccacacccctcaacgtccactccagacctggaccaagccaggcagccagcaactcccaccctgagcagctcctggaagggacgggagctgtgacagccacaataataacattcatcggctgggtgtagtggctcatgactgtaatcccagcactttgggaggccgaggcgggcagatcacctgaggtcaggagttcgagatcagccttgccaacatggtgaaaccccatctctaccaaaaatataacaattagtagggcatggtggcatgcgactgtaatcccagctaatagggaggctgagggacaagaatcgctggaacccaggagtcaagggctgcagtgagctgaaattgcaccactgcactccatccttggcgacagcaagactctgtctcaagtaaataaataaataaatacaacattcttcgcagcccaccattgttggaggtgtcctaggtacccggcttcctgctcaaagctgcaggcaaagtgttggggtcatacaggacttgcccgagaacaggaaacccaagtcaaactgtggaagctgtgaggacatctgttggtttctgcaactggacgtctggagggagtgtgaacttccggtggcatctgcttctcccttccactcctggggctccagcatggtgggcctctctcaggatgggctggagcaccggcagcttcaggcctcaggggccttcggcaacgtccagaggaaggaaactgcctctttcaggagcctgtggcactaagaggaagccttctgcagatgcagccagcaggcttccccacggaccccagaggcacagctgctcctgccgggaaggggtgtaagttcaaccacggagcagccacagccctgcagcagctgtgggcttgagctccccagaagcgcctgggatcaggaaggtgcggtggctcctggagtgctgatgggtgtgtcacaggcatgtgaaccagagcaactccatcttgaatagaggctgtaaaatgaggctgagacctgctgggctgcatctccaggtgattaagacattctaagtcataggatgagatagaaggtcggcacaagacacaggtcataaagaccttgcagataagacaggttgcaataaagaaaccagccaaaacccaccaaaaccaagatggtgatgagagtgacctctggtcatcctcactggtacactcccaccagctccatgacagtttaccaatgccctggcaatgcaggaagttaccctgtatggtctaaaaaggggaggcatgaataatccaccccttgtttagcatatcatcaagaaataaccataaaaatgggcaaccagcagcccttggggctgctctgtctatggagtagccattctttattcctttcctttccttttttttttcaagacagagtttcgcttatgttgcccaggctggagtgcaatggcgtcatctaggctcgcggcaacctctgcctcctgggttgggtatcagtttagactgtgaagtctggctgaagccaacggatgcaggacacaacagtaaggatgagccaaaagtgtaaggaataaatatgtctgcgtttcctttgttcactgtcctcttggggcaagactgctggcgagtgtaccctttctgcagaaagtaaaaattgccttgctgagagaattaaatatatgttcaagtgctatttctttatggcaccagggaacaagcatttagcatttctaacacgggttcaagtgattctcctacctcagcctccccagtagctgggactataggcacctgccaccatacctggctaatttttgtatttttagtggagatggggtttcaccatgctggccagactggtctcgaactcctgacctcaggtaatccacccgcctgggcttcccaaagtgctgggatgacaggcgtgagcccctgtgcctggcccgatttattcctttactttcctaacaaatttgctctcactttgcagacttggcctgaattatttcttgcgtgagattcaaggactcttattggggtctggatcaggaaccctttctggtaacagatgtgcctgggggagaaggggccaggaggaaggtgatgcagaggccacctccactaaccctcaacagcgtacaccacctctgccactcccacttcacaggcgagaaaaccaaggcttagtgcggtggggccaagtgctcagcggacacagctggagagcggcgggccaggattccgcataaaaaaagcagccctctcagatcctgggaggacaaacaggagagctcattccctattctccagcttccatctcaaagtctccaggaacccccagcaaccaaaatattcttgtaagtgaataaggaaaagcaaagccaacaggtgattctcgatgctcccgtaggccccagggagtggagaagcaccacgctccaagtgcctggacagagagggatctgccaacgggagctcggtcagaaagaggaggagggggagccagggcagggggcaaagaaagagagttcagtgagggggcagcacgtgccaaggccccaaggagtgtcccgggcatggaatgttccggcaaccaagagaaggccgtgtgggtttgagtgcagacaaggggaaagcggctcagcacagccagggaaagccagccagagtgagggacaacggcccaggaatggctggggagctgcggctctgtctggaaagcagtgggtgggcgtcactggcacctgctgccatctatggattcacccaagccaaggatgaagatggggaaccagcaggctcaggacacaacatgggcccatccctcgttgactcccattagcagacagcgacccgtgcatgagctgctctgggggacggcagcttctggctcaggggccagcctgcgtgtctctgccatggcgggtcataacctcatcagcctccttcctgaaacccgaatgccacacgcctgctgagtttctcaggatctcacaaatcctaccccagtccccaacatcctggccagcctgacagttacttcctggagcatcttccagagttccgtcgggtttgctgaccctggttgagtgatggcattttctagctctttctgtctgtaccccagaatgtagcttgtctaagcccagtgacttaagcccaatctattcatttcaccactgtcccctggcaggaggaattcctctgaaaagaccccaggagcctggcgaggggtacgctggggaggcagctggtgacaaggcctgggcagaaagcctgcttttcactaagaattctttgaacattttgaattttgtactatttgcagatactgcctattcaaaaataagtaattaattgaaacaatgagatcattctctttgatacaaaaaggcaaaaccctaaccggagtcctgtcgttctgctgttatctcatcccgggctggaatctggtcaccccaaactccccacgccccagcctcagcgtctccatctgtaaaccaaggcccaggccctcggaccttggtgggggggctccactttgtgagtctgacttgtcatagcctgaagctgtggcctgggcccctgtctccgtcccactcgcaggctggttaaatcccgggagtcaaaacctccaggagcaggttccgtggtctgagagtccaggacagcttgtcactcagcaagacagcctggcggcggtggggggggggggggcgccaaccagggcgaccgaggacaccaaggtggggcctgtgggtgaggtgcccccaggagtctcagtggaagctccaggaaggtcacaagagatccctcctcccaggtggcccctaaagaggccagcacacagtccatggaggaagaggcacagaatcaatgaatctggctttcaaggagcgaataaacttaggcttgttggtgtctcaaaggcatctggtacctgaattgttcttggggttcctactggaggcgccagcccttagagactgagcagccagggacaacactcccgggcggctggcagtgccacccgtttcctgccaacccaggacccgtggagaccaggatcagcctctagcatccctggggcagcaggagagacccttgtccctcctccacccacacactggggatccccatgcctccctcatagcttgtgaggagccaggggtccggggtcaaagtcagatgccacgagctggagaggaagcgtcggcagacgtcccctgggtggggtcctggggtctgcaggtcacgtggagaaggcacagcaagaacaagacctaggccagacggcagcgtcagcgcacgctccacagcgggcttcccgcagctctgcacagcacggcgaatttccacctaagtgtgtccacggagcctccaccagatcaaagctggagacagccccagcttcccagacagcctgacgaccctcaaaactgcatttaaaaaccactgtttcggtgagtgggtgaatcattcacatggttcaaaattcaaaaggaacagaatgatgtcgcctggaaatgcgtgtcctgccccatcccagggactcagggtcctgcacctgaaacggcctttgcagaagtcctgtcagtgagacaattagaacaccaacctaagctaacccagcccccatcctgcccttcccttaattattcctgggctattgggccaagctaactttggaagacatttaggctacagtttaaatgattgataataggccttgccccaaacctgcttttgtaaagctaatgggaggcccccaggcttccaggaggagggaaccagagaccttataaggcgcagacacaaaggatggtcggccattatcccggaggttacaaatatgcaacttcccccattactcctgcaagtaacaccaccgctgtagatggaagtatcttctgagagatctttccaggttttttgcatgtctgacgcccacagctccactcagaccccatggctccacctggacctacagccccgctcctgtggccccaccagaagcaattcggctgcaggaggaaggcttccacccctgtgatttcatctccaccccaaccaatcagcagcaaacatctgttacctggccacccctacctaaacccctaatctaatccggttgcggtgactcacgcctgtaatctcagcactttgggaggccgaggcgggcggatcacaaggtcaagagatcaagactatcctggtcaacaaggtgaaaccccatctctactaaaaatacaaaaattagccaggcgtggtggcgggtgcctgtagtctcagtaactcgggaggctgaggcaggagaatcgcttgaacctgggaggtggaggttgaggtgagccgagatcgcgccaccgcactccagcctgggtgacacagtgagatccgtctcaaaaaaaataaagaaataaataataaaaaattgtcacaaggctggccatgccacaagggagatggaattattactcaaatcaacctccctgaaggcatggaggttaggggattttcaaaaactaaatttctcccaaagctagcttggcgcacgcccaggaatgaaggaagccagccagcctgcctgtgaggtgaggagcaagatggaggcagccatgtcagatttctcttcctgtcataattttgcaaaggcggtttcaggacagggcaggaagttgtctgtaaccagcaggtgctcgacaatgaaaaaaggagagtaaggccacgcacagcatctccacatctaaagtcccgaggaggggtgtcctgcagcgggggcagagggagagaccaccaggggccctagaaggggcagtgcctcgtgcagctcagcaaggaatccatcttcatctccacagcgtggaactcagccagtcccggaaagccctcccgtgtgttctggaaacagctcactgcaaacagcccccttcgcacaggactgagatgagactcgcggctgccgggtccgcctaggagaaggccagatcacggcctcatcagcgattccctgagctgttttgttcccacagaagcagcagaacaaaatgcttgtttaaaaaaacaacaaaaaaagcttgttcagcttctctgcctcccccaaaccctgaactgggagaccccccccagcctagttccccctgggtcagcctgtaaccccaccttagcccctgagactgggctggccagggggaacctgctgtatctgctgcccctcaggccccctcacgccactcccccaccgattctttccagccctgctccctctctccgtcaaagaaaacccctttccctggctctggaggccttgtaggccttgtaagttggagtggtacgtacccctactgtgaggcgctcccccaagccctgcaataatccttttggaataaagttccccttactaaatccggatttgttttttatttgacaatttcttctctgtggaattctcggctcaactcaagggacggagccgagcttagaaataaaacaggagcagcgtcaacagaagatgtcaggagtgggggcctcgtttctgcgtggtgaattctgagaccagagcacaccgtcccaagagggcagtggacgctggggaaagtgtcacggccgctgaaggagagggagggggccagtggaggatccaggctccttctggcccctggctgcctaaagatgaagcgtcgccctggcagcgtttgaaacacggtcattaaggagtgaaatcggcgcggtgagttgtgcaggagaacgtggcgaaacctccctggagacgaagagccccagagcgtgcaacctctccgggggagtctgggtccaagcccaccgtgtcctcacccagacctgcccacgcctctctcccagctgtcaggagttgtcaaggggattaagcggattctctttgccgttcatgggaacggcagcgggattagctggggcctcctaccgaggagggggtgggctcgggttagcacagacgacactcagagagcttggaggggcggtgaccaaagaggtaggtcacagccagataccaaggccttgactttggggtctcattttacgggtaagaaccctcccttggctgggggtgaggctagggccacacacccattccccagccagcctttgcagaggtcaatgagaaagaggcaaattctggaacctttcctcaccctctttgacccagagaggatttaatctggaatgaagctggttgagactagttttgtgagcgatctgtccacctggggtgccggtgtgttttacaaggctggctttcatggcgcagttgagttcccacttgcagaacatactcaccctgtggctataaggcaaagcgctggggcttgtaggcactggaccccaagcagtgaacaggtcagtgcagggcctgtttggtgtggctgcacaagcgcgagaaacaggaatgcaggcgtttctggctggagggagaaggttggatgagtgtaacagcaccttcggggtgagggtttgcatttccgctggagacgaggccaggtgtcttgcactcaggttaggctgtgaggaattgaggccaggcccagaaggagggtgggatggaagggaggggccgtcatgtggatggtgggccaggtgtccaggcccgccaggtgcccaggttggagaacccggattctccatgtgtgcgggtcctccaggtgcccacgtcctccaggtgcccgggccgtccgggtgcacaggtttgtgagatgctcccactgtgtgcttcctaccgttttgcatccaatgcacatggatgcactcccacctctcggctcccctggatcaccccaggcaggtgaaggaatgttttggagccctgttttctcctccctgagacagggtggcacccggcctcctcctctggctgctgcaggctcagttcactttcccacgctggaccccttcaggccaagcctcggggagcacagaaccatgggacagcggggatccaggacccccagaaatccggctggaggagcttcagggtgacccctcctcccctgtccctcagagcagatgctcctagaatgctccttcttagagcaagtgaattagcattcccaccaaggctgcccagaatggggtaggggcagggtgtgtggggaccagcatgggcaccgagccttcgtcatctgtggtctcagtggcaggcgggcagtgccagaagccccatctccatccactgtctcccctctgtgctctcccaaggcgtggcccctccccccaccatctcaccatctctgcagggtttctgctgaagaccaaggacttacaggctctttagaggccagagaggcaacctgtgtttgggacagttggcggggacccagcccaggtggggagtgaccagaggacacccaggcagagccactgctcccttggggactcctgggccccctgctcttcccaggtggggagtgaacagaggattcccaggcagagccactgttgcctctggggctcctgcacccctgctctgtccagatgttggcttcccaccctgcccgggctgggacccctgttcacctccctccgctattcctgcagcctgtgaagcccatgccccgcggtggttttggctgactccagggcagggttgcctcctcctgtcccaggtgtgcagctcgcacgcacacagccggcaaacacagcgtggtgagctcaggaggattgtctaggatgcaggagtcacaggaaggggtcccagcctgcagcccaccctcttctgcatccccctcttcccaccaccgccttctcctccctctgctttcctctgtcctccatcctcctctgcacaggaagcctctccaggcccgaaggcagagttgctggagctgttgcttgattagggccatggcccccatcccctggccaggggaattctctctcctctccccgtttttcctccacacttccctcttccctccctgttctctccctctgagctgggttaggctgatgggctccgagcacagaggcagaagcatattcatttcggtcctctcaggggccaagacccttttacatcggagctggagaacgcagccacccgtgggctagaggaggggccggggcgccccagaactgaggcccccgctttccaggccaatgccctccttccttctgtttcccaccctttcccaccccgggggtttaatgtgcgtctccatgcactactatcggcagttcccagcaggtcataagagctgccccggagttctgtccagtgggacctcacggggagacggggttccagcaaggagctctgaaggagggcgaggtagcaggagagggcgggccatggggagacccgggctttctgcaatgagggggcggtgagaggattggtcactggttcctttaggaagccctgctttcttggggagggcgcacctgacaggtggcttcattcgaatgtgtttggggctcccgccccaacaaacgcacccccctcatcctctctctgggggagagggagctgccacacaccattcgtttatgcccgccatctcccacggtgctcaaggcatcgaagcgccagttggagggagggcagagcttgctgggtccacccgggatgaggccgggacatacacagcccctttcttggcctcatcaatgattctctgagctgtttttatccccacagatccatcagaacaaaatacctgttgactagacttgagttcagctcctctccttcccgcaggcccttaacctggaccccctcagcctgggccagcccgtgactccccaccccctgagacagtgctggccaggggaagctgatttgttgtccctgaggccacccaccccacccccgacacaagaacaaagaacaaggttgaattctttccagccttgttcacatcccccataaaagaaaacctttggccaggcaccgtggctcatggctggaatcccagcacttggggaggctgaggccggcaggtcacttggggccaggagttcaagaccagcctggccaacatagtgaaaccccatctctactaaaaataaaaattaaaaaaagtagccaggcatagtggtaagtgcccgtaatcccagctactctggaggctgaggcaggagaatcactggagcccgggtggcggaggttgcagtgagctgagatcacaccattgcactccagcttgggtgacagagtgagactccatctcaattaaaaaaaaaaaaaaaaaaaaaaggccgggcgcggtggctcacgcctgtaatcccagcactttgggaggcctaggcgggtggatcacgaggtcaatagatcgagaccaccctggctaacacggtgaaaccccatctctactgaaaatacaaaaacaaaattagcctggcgtggtggcaggcacctgtagtcccagctactcgggaggctgaggcaggagaatggcgtgaaccctggaggcggagcttgcagtgagccaagattgcgccactgcactccagcctgggtggcaaagcaagactccatctcaaaaaaaaaaaaaaagtctggattggccaggtgctatggctcacacctgtagtcccagcactttgggaaccccccaggcaggcagatcacttaagcccgggagtttgagaccagcctgcctgggcaacatagcaagaccccatctctacaaaaagttaaaaaaaaattagccaggtgtggcggtgcacacctgtagtctcagctactcaggaggctgaggcaggaggatcacttgaccctgggaggtcgaggctgcagtgagctgagattgcaccactgcactccagcctgggtgacagagtgagaccctgtctcaaagaaaaacaaaaagtctgggtcgggctttgattttgacattcccctacctgtgtccacctccgtcgacagggctggacgttggtccctgcagtggcctggccggtctctgggcacccgtaactgctgcagcccagaagggagcccctcccaccttcccgcagacctgcgccccacccaaggggcccggccgccgctcactcggggcccccgagctgagatggggtgctggcttcattttttttcacctcttccacaaatactgaccaaggcttttgttcaaccagaccctggaactgggggacccagtgggggacagggcagatgacctgtcttcaggaaccttcccggggtgggggtgcacccatgggtgactgcaagaacgctaacaccagcactgcgggtgcagaccgtgctctggggggggacaggggctgggtcagggcaggcgtctgaccatgaagggtggcctggagggagagtgatccaggctaagtggaaggcagtggaaagccccgggacgggggcggatgggggtgcggggcagagcttcggggactccaggggcccagcctgactggaaaagggagattgggcagggccagggctggtggggctgcagctctgtggggcgtctgcatttctcttcaagggcaggaggagcttttctgactggtgttcggcaggggactgagggatgaagaacaaatcagggtttttaaaggagttgacttgaaaaggttgcaggccgagcgcggtggctcacgcttgtcatcctagcagtttgggaggcctgtaatcccagctactcaggaggctgaggcaggagaattgcttgaacctgggaggcaaaggttgcagtgagctgagatcataccactgcactccagcctgggtgagagtgagacttcgtctcaaaaaaaaaaaaaaaggttattgcagcaccgaggactatcgcaatgggggatctctgctcccaccacagggtctacaaggagctccagggttaggcaaaggctttttgttttttttgagacggagtttcgctcttgttgcccaggctggagtgcaatggtgcgatctctgctaactgcaacctccacctcctgggttcaagcgattctcctgccccagtctcccaagtagctgggattacagatgccccccaccatgcctggctaatttttgtatttttagttgagaaggggtttcaccatgttggtcaggctggtctggaactcctgaccttaggtgatctgcctgccttggcctcccaaagtgctgggattacaggtgtgagccactgcacccagcctgggttttttattttatgggggtgtgaacaaggctagaatctgtgtggggagttgggcgcggggcctgaggggcagtagatagaggggttccccgggccagcctggtctcagggagtgggaagtcacaggctggcccaggctgagggggtccaggtcctgggcctaggggagggagagcagccgagctgggtttggtcagcaagcattttgttctgatggatccctgccggtcatcggcgaggtcaaggggactcagggcctgggctgggccttgccctaggtagacccggggtgggggcatctctgagtctccctcaagtcacatgggaagaggtttctctgcacaagcagaacacaggggtcaggggtttcttaaccttcactgtttccaggagcccaaggctctttgagctccatgttggcaccaagcatctcgaaggagccagctgggctgggggccaggcgggctggcagtcactgaaatgccacctgggagggccgccgaggctgaggctgctcaccatgctggtagcagcacctgcagggctggctcacctgtggctcccagccccaccctcggatatcactcagcaggcccccagggagtccccagatgctggtgcaggtgtgttggggcctgtctcaccggtgacctcacatggccagtgtcgggggtggggcagcctgtgagttctctccttcctgtccctcgacaagcccaccctaacggtcaagtccgcaaaggggtacgcacctgccgcagggccatccaaggtccccagctccaaaaattgctttccaaattccagctcccttagagggcagccagttctcaattgtgagggggtgagctattggattaatttgcctttgaacagcactgagaggcctgggcctcaacttcccagtagtgaagacattactacaatgcgcccgaatccttccagaacccatgggaggtgggtgggcccttcctgcctgggtggtcagagtggggggctcacacagatcctgagccagggctctaggtgaccctggttgctgcaaaggttcccagctgcaccccagaatgccctggtccatcactgggcaaggtctccctaaagaaagggctgcggggaggggggtgcccagcctactagggaaaagccgcccaacccccagtcccaggagacctgcagccaggaggcctctttgctaataccctgtggagctgactgctcactccagtgactttgtatttctggagccctcccagctcctcgcgggactcggtggctccaggataagactcagactatggggcccactcagggcctgtcccccacctcccgttcagctgggactgcgtgagtcctgcagataggagcagccttcactggatccaggacggagccctatggttgccttcccaccccgtgctgggaggtggatgaggggctcatgctctgagccccggactcgcccccttaactgagaggctcgggagtgtcctgggaacacagaatcggtgccgcttcctctcctgctctgatcccaggctggagaaaggcttccttcctgacctcccaggagctggagccccgcatcctctcagcgggtgacccccaaacccctcccaacttcacccctgcagctccctgggactggaaccttccccctcctccccggtggtctccacctgaacatccctgcgcaggctgcctgccccccactcccgaggcagatccgatatcttggctcggcacccccaccctcgaggggtgcgtgctcacatgtgtgcaacccgcccatggctcacccccacccagcggcctaagtgggctgtcggtgaatgaatgaatgaatgtgtgaaggtgggaaggaatgaggtggccaagagggggccaggaacgttcctatacacagaacctggcgcagaagaaaagaacacagaacatcagcggtaggatgattgagtgtttctttaaaaataaaaaccccacaaaaaagccagaacaccctacccaacccagcccagtgtaacaggttagccattaacacagaataaagaaggtcccagccacacacgtcattactcggcagagggtgtccagcctggtcggccgacgtcacagtggatggccctgcgtggctgggacacagacagggagcaggcatggcacctgcgccacgcagagcagcaaggctgagcatgaccactggaaataaataaacatggtgccgacagcatctttaaattagtaagacgttagcacaaaacaaaaaagcacaacgactgaaaatgcacttgcttgttgtggtgggttgtgcttgaaaacacctgaagcccacaagtggaaaccgctggggacgtttgtcagtggagtgtggagaaaaagggacggaaaaatcaagtcttctgagacagtcccctgcggtggccctggtccctgtggaattccagcacagcaggagggggagggggaagcaggcctcagtcagcaccgcgggacacggcccctaccttctgaagtggggtccccaggctggagtggggcacacagcaccaaggatcacagactggaccccccaccaaccttctgcggaggagctcccaccccagctcagacgcccagaagagacctgcgcagtgtgaagacggaccccagcggccccagccatttcactagcagctactttccacaacagacgctggcagcccccatgctcgcccacagccgcagcagccaacaggcaagtgcgtgccgtcgagaggccgccggctccctgtatccttgaggcatgtccacgtcccagagcaggaggttggaacagaacggcatcccgaggacccctagccgaggcgggaaggtaagaggctgacgtcgtgcgtgggccccgccggccccagtgggaagcagtggtgcgtgcctccagggagcacttctcctggacccggggccgtggctgcctacgatgtccactgcctcctggattcacacagcaatgcaccaggcaggtggggcaccagctgctgtccttatttgcagccaagagaacaggcccagagggaagaggtcttgcccaacacagtcagtccacctgcctgctggtggtcctcggcctccagaccgtgggctgtcccttggacgagtggaattcgtccccaggaaggatgcaggtcctatgagcagacgctgtgaagtctgtccatgtgcagcgggaagcaacggggcaggggtgaataaaggtcttcattcctcaagcaagagagacggacatctggtcctgagtccccaaactgttcatcaggtttctccgggcccactggatggtgagggggtcccggtgcccaggcgggggcggcaggctccactgggcacttgctgagagcttgcggcttgagcagccgctggtcagtgaagccgtgtccggcttcgttggctcccggcttgggacactcagggctgtgccacaggccagctcctccagccacagctgagcactggagtgacgctggaccacttggctccacctctggctggggagaagggaagcccggggcctgagaaggcagagccccccgagctcaggagggatcctgcggggtcttcttgttctgggggtccctggctgctgccatggaggcagcgacagctcaggaaagtgggccgcattggccaggcctcggctgcctcccatagcgaaaaaaattcacgggaacaacagaaacaaggggtgccctagttccctctctgcaggcgggtggggactgggtgagagcccaggggcctccaaacgcaggcggcagagacgtgagcagtgcttggctctgtctcctagacaacgggcatcaggaccaggacaggacatgagcgtgacagggagagcggggaggtgcctaggccgggagtgggaacccagcaccggccagaaggggctgccgggcggtacagaggccaatgcattggaggctgagggtagctgcgacctctggggcaggggacactgctgtgtggagcccagggtgggcgcccacatgggtgcctggccgcggtgtgtctgcctttcttgtctctgtttctagaagactgaaggacagggctttgtctgcatgaaccagaactcagcctccaaaactggacacagaaatagccaagaggccacactgcccagaggccaggcctggtgagctaggggagatgccggcaccccccaaccctggggctgttccctggctcaggatggtgtctcggggctaggattatggtcaggagtccatcggggcctcaagcacctcctgggaggaatcacccaccttgcccagatcccccaccccctcccagtgccaccctacggctgagtttccactctgcaaaccctaaggcagagacataagcccacagggttggttttcacgaatgtcacaagcccatgtgtctgggcagctgtccggcttcagtgcaagtctgtggtagcaatgaggttccaagtctcagtagctctgtttgcccagggtctgggcccttggggcaggagaaaggaaggctcctgccttcccccagctccttaaaaaatcatcttagtggtgtcaagttgacccaaaatttaagtttaaaaaaaatatatatataagtaaacaaaggagggaagggaaaaagggcccaaggagaccaaaagctgctcctgggcaggagcacaggcacacctgggtccctggccctcagttgagggatgagattcgtaccagagttttcacagcagcctccactgcccgacctgggagggacggcgagggactgggatgggcagctgagctgtgggttgcggggaaccggagtgggttcgaggaggtgatctactttaactggcctctgcgcatgctcctccggcagccactcggcctcctggctatgtctcctgggggaccacctgcatgagcttctgacacaggacggtcgtggagactgtcaggagagaagacagctgtgttagcctgggggctgggtaggcacccgtgggacacgggggcgtgagctggggctcccccagccctgctgtcaccaaacccagcgccgctgcccagcgctgggattttaaggaaccttcccttgtgtacttgcgcatgtgggtgccgggtgcccgaggcgctgtcttcaactgaaatgcggaagtgccacatcccactcggcccacccctcgcctgcttcagaaccctggggaggcagagtgcggcccctggggcacacgaaccaggccctggtgtctcagcaaagtgcaacggggggatgacaggccttcctgcaggtccacacccgggccaccacctggacacatgcctggactgttcacagcaggcagggccggaggggccaatctgctaacgggtcctcggaagacctgtcgcgcctgggactgtctacagagacatcactctgtggagggggactgctttcaggatagagacgggggtttgctttaagctcttggtgtcctgaatgacagttaatgcagatcccactgcaaagcttgaggcaaatgttctaccatgaccctggcggtgatcagagtgtggggtaggggtggggggtctccctgcctgtgttgctgccatcccgggaattctccaagccacccagtgacatggggatcagcatgtaggcccgcaagcaccccggcctttttctacgagcctggccacatttgcaggcgctgaggacggggtcctgagcttggtgacaaagcacccctggggctgccgctgcacacagggccggggggcgggtttctccttctgcctttttttttttttttgagaagagtctcgctctgtcgcccaggctggagtgcaatggtgcgatctcggctcactgcaacctccgtctcccgggttcaagtgattctcctgcctcagcctcctgagtagctgggattacaggtgtgtgccactacacccagctgatctgtgtatttttagtagagacagagtttcaccatgttggccaggctggtcttgaactcctgacctcaagtgatccgcctgcctctgcctctttctgcctttctgggtaagtctgctgtgtccgctggtggcagccagcaggattttgttacttggcagcagtagcctggttttccggaatccctcgtcctgagagattagctggtgctgcgctgtgtgtcttatccctgaaccatgtgggctgcgtgtcactggcggacactgcagtgacctgaaccctcctgccacccaacacgcttcgccccatgtgggtggagacggccgacgcctctcaactcccttcgctgcccagggcagagggtaccacgggctgtgggccagcgagatactcacagatgccctggaggagccacttgggcttgtttttccaccagaccccgaagaagtagacgggcagcccgctgaggatgatggtgaagccgatgccacactccacgggtgtcttccagaaggagacggcgatcaggaagaggcaggccaggatgaagaacacaggcagggccaggttcacctggggcagaggacagggcctgggtgagccctctcctgtccagcctccctcccccatgccccgaggttcctcagccctcctgggccctccacacccacggctgctgacttccaggtcaccaagatgcgatctgcactccatctgcctcacacaccgggctgtcccgccctcgactctgcatacagtgctgggcatgttgccaggggctcaggcggcttatgatgagggatggaaggagacagcttcgtctcccgaggcctcccacgggcagggaaggtcacggctccattcccacatcacaggcctggaaaccctgagccgccaggacgcacaggggcctgatgcttccaggagacagtggccacccactaataagccaggagaccaccctcttggagacgccgctgtggacagcgctgagcaaaagcccatccctgaagctgcagcctaaactgtcaccttcagcagatgagctccacccggcacagaagccaggcagggctgcaaggagcctgcaggccgcaacctgcggctcggcatggctgggggattgactcagctgtcctgaatccatacttggacagggcaccctgggagatgcagggctgaccacaggtcccagcccatcagtgtgggctgcatgactgccctgtccccagggaacagacgccaacccgtgcccaggctcacaacagtgggtagagcctaccccatgcccaggtccccatgggggctgagcccccgctgtgcgcagtgactgccctgtgccctaggcactgccccaggctggcacagcaggcacaagctggtgcccatgtagggcggctcctccctgccctctgcagccttctcttggggcagcatctgggttcttgtgctgactgtattttaaagcccctgttttttttgtttgtttgagacggagtctcactctgtcgtccaggctggagtacagtggcgcgacctcggcctcccaggttcatgccattctcctgcctccacctcccgagtagctgcaactataggcgcccgccaccacgcccagctaatttttttgtatttttagtagagacggggtttcaccgtgttagccaggatggtctctatctcctgactttgtgatctgcccgcctcggcctcccaaagtgctgggattacaggcgtgagccaccgcgcccagcctaaagcccgttcaacagcattcacaggcacccccggggcccccaggcttcgggaacacagagggagagatggtccgggcagggaagcaggggctactgtgacagccataggccagctgagtgacaaaagctgctggctagcagccaccaggggctctggcctcttgttctgtgtcagggccagggcggcgggacttgctgggccccaggcaagagcatggcctctgctggacggccccgtttttggagaaggcagcccacggataacagctacccctctgaatgagccgctggggacggggagagtccaggagagtccagctgggcccaggcgctcctcgggccgggttccctgcattcctcctgccagcacagccccgacggccctttgaatgctgcgccaggcccggctctgccccgcccctgccggggctcaccaccgcccacctatgactgcagtgtccttatctgcttccctccacccaacggagcacaagctctgtgccatctgctgtcctttgaggaaccccggctcctgcagtcacacttggcaccctcgtagctggtggtcaagtcatcaccggaattagtcgacccaggtgcatgcaggcaggggcaggtccagaggctgagctgggatgctggctcccaactcagggtccttaggacccacggaccctgcctctgtgaagggtgcctgggtgagcgggaggccccgggctcaccttgatgggccgctcaagctcaggctttctgtggcgcagccagatcatgccgatgatggccagggccacgcagagccagttgaagaagctgaagaagttgatgacggagaagatgtccttggagaaggcgtagagcagcgtcatcacacactggaagagagaggcggctggctgagccctggggcccacgagcagggctgtggacggccgtggtggccaccggggactgtccagcctggctgggcccagctgagcaccagggaattttgttttaaaggagaaacctcatctgagcaacatgcaaggtcttgaaggaggaaaggagggaaggagggaggagaggaggagggaagaggcggggaggagggaaggagggaggagaggagggaaggagggaggagaggaggaaatggagaccacatttgggttaaggacaggtgaagaacacagtgtacatacacagctgggctctgctggactgtggctctgtgtgcgagggccacaacctgacctaacccagtggtcaccaagaaaacagtttctgtaacccccggcacagccgtgctcccgaggaccgtgcagctgccaaagagtccaggacttgctgcccttcctgactggcttctaactcagggaaggagtagtaagcaagggccaggacctctgaggccagcccacagctgccagaccccagcttcctctgctgtatctcactggctttgggggaagcagcctgttgggggagcccagtgtgctcaggggtggggcctgcagcccacagccctggaggaagccactgtggagtggcctctccagccctggtcacaccctacgatgagaacacagcttcaggcaccagctccctgaattcctgacttacggaaactgtgagataataagtgcttttccttttagaacactacattttggagtgatgtgtgacacagccagagggaacaaaggcagtcacgcgggctggcacggaaagatgcaggagaagcggaaggaaactgtgtgtgatgcaccccgctgagaaacgaacagagtgggcgcccacggaggtgcagtgagccaggcggctggcagagcagcaccccgggtcagcttctgcctcccgcatttccgatggtctgaatcgtttgtggcagccaccatatattatttttggaataaaatctaaagcccctccagcgctctctggcattcagcggagctcggcaggaggccacatttgagctgtcacccagtccacaccccagacagagctgcaagctgtggcagcctccctctgggagcccccggacaacccccagggatgtagggcacagggccgtgcagcaggcttaccgtgaacacgagggacggcacgggggtgaggagctgtgggtggatcatggagaggatggagggcaggtggccttcccgggaccccacgaagaagagcctgtggacagacaagagtggcagagtcagccaccgccccacaactcagcacgtggacaggggacacgcaggctggggagtggcagggcctgtgcctggcttgtctgggcctctctggccacagtgggaaccaggcccctccagccgctggctgtgggcctctcagttcccccaaccaactcggcaaggacagcaacttgggagccactgctcactccagcccggggggtcaagcggcggccacagggcatctaggacaccacagctgtgtcacctccaggcaggagtggggaggcgagggccaaagttcatgcttcctttatttctgtattatttgggcttgctgctgccttttttttttttttttttttgagatggtctcactttgtcacccaggctggagtgcagtggcaccatctcggctcactgcagtctcaatcttctggtctcaagcaatccttcgacctcagccccccaagtagctgggactacgggcacgtgccaccacgcctggctaatttttgtatatttttgtagaaacggggttttgccatattgctcaggctggtctcgaactcctgagctcaagcgatctgctcacctcggcctcctaaagtgctgggattacaggtatgagccaccatgcctggcctatttgagcaattatgcatccccagtatcacagagacaaaccttttacagacatggaacatgttgaacctggccatgaggcctgggcctccctcacctgtggtgggtcgggctgtgctcacctggaggatgtgaacagggacccattgacggagccgaagcaggacaggcccacgaagacggggatgatccaggacatgacgcccaggtgatagttcccgaagtcctaggcaggcacaaccagtgagctgggccccaccgggccggccctcgccctccctgtgctcactgggagccctctgcaccgggccagccctcgccctctgtgctcacaagagccctctgcagaggacctctcaggctggattctggcctctggggggacttcccaggacagggctttccagtgacccctgcccagcctgcttgttggggagcccttgctggtcctgatttgccccctcctctgggactccctggagcaagctacggcctgcaggtggggatcttgccttcccccgtggggtcctccacaggctcagcacggtgccctgccggcagcgggctgggagtcagagcttgttcagtaggaagctggccagagcacccactccctgttcccccagccctgggagggcagtgggagaagcctcgggaactgcgaggccagcctggctgagctgcccggtgacaccgcccgggcctggcctcccgcctgccaagccagcagcagccgtgccttctaacgaaccccactctgtggcagactccaatctttctgtactcagatttaaaatgacctctgccctggactccccaggcattctggcttatagctggttctgggtgtggcttggtatcagattttaaacccttctcccctttgactcccccagcagctgagcttgaggatgatccccagacacttcctctgcggtcgctgtgaggggagaccaccactccacccctccgggtaggggaggcttagagacgcggggccccctctgcgtaggggaggcttagagatgtggggcaccactccggtctggaagggacgggctggccacagcctctcaggcccctggtggaagctggcgggtagcggctcaccacggccacggcctcggacgacagcatctgctcggtggacagggtggtgaagtaggccaggttggtcagcacgtacaccagcgtcacgatgggcagggagatgatgatggccaggggcaggtttctggaaagaacagggacgacatgtcacccaacgcagcccgggctgaaggccaaaccctgtgcccaggagccaggtgggctcctcgcaagcagtagctccagcctctgtgctgggcttctcggggaaggtgggaagcagcaagagaacacaggctggcggcaggaggctgtgcctggagcgggacactgcacagccctggctggtgccttggccgcggcctcagcttccccacctgagaaatggggattcttcggggtgacctcaagggctcaggagagttaagtcaggccacctggtctgaattctaaggctctgcccacgagctgcacagccggggaccagagccgagagcccaggcagctcctctgtaccgtcccgccctgagtggggccctcacttgccacccgttctctggagaaaccgtgctcaaggacacacggccagaagccacccgccccacatcctgctggccccagaggccccaatcacggcccgactgtgaactggcctgagccgaccaacaggcttcgagtggaatgtggctgcttcctgcctcacattaaaataatgaaaaaagacggctccatccattcttgcacgtacctgtaggggttgatcatttcctctgtgacgaaattcaagtaattcctaaaatttagagaacagcgttcaaattatatgatcctcatcagggaaaataaatcaccggggagagagcatcccagggcagctggtgagcctgccccccggtggtctgctcgctgggctggaaagcggacctggagtgggagggagctcagcctcctgcgtgttccggggggtccctgctaccccttccaggccctcccgcacattccctgcctgttcgccctactggggtgattctcaggtccctgtgaggcccgcctgagcgcaggagtcaggctggggacctggaggaaaggggccgcagggctcagccgcctccacctgccaccttcgccaagactgcgacgtggagctagagccagagtagggctgcagcgggcggcctccccacgcttcgtcgggatgtgggtgactctggagggtcacctgccactctttaactgccaaggggcagttaaagggaggggcagtccactccctttaactgccccttgatggctgggagatttgggattcctggacacgtcagggactgtatgtccccagaccaagggacccagacattccagaacctaccatcctccataggcaaagaggccgctgtataatgccagcacaatgttccccacatccagtttggtgccttcaaatgagaagttgggatctagattggacacatcacctggcagggccaaagaaaggaatgctgggttagagagcgctgaacagaggtcatgctaccagttctagaatgttcctggagcaaaatacatagcaaacaaaaatgctggagtgaaggcttttcactgtgacaaatggtatgtacctgctgagccacatggagggtgcagggttccaaccacaaccagggggatgtggccctgccagaggccctgtgcccacctgagagggcacaggcagttctgaccactgcccaggagggctcctcagacgcttgtctacaggaggtcaggatggaggggtcaaccagccccagttgccttcaagaaggttccctgagacctcacgacatgagtgtcaaggcagtataaagccaggagacctcggtttgcatcctggctacggcaacaaggaaggcccagagccactagggccctgcttcttggggtgcgaggagctcggaacagactgccctccctccagggctggcaggacaggcctgggcaagaacataggtttgtcctggaccgtgctgagtgtgtggccagctgcagccggggcaggggcaggagcagggctgccagggccgagaacgatccccgtgctgtgtgcagagctctctcctttgccctctgaggacacgcgtcactggacttcgtgactgctccaccctattccagaaggacctcatttcaaaacttgaacttcagtcacatctgcgaagaccctttttccaaataaggccaccagcattcacaggttccccaggaggacatgtcttttgggggaaggggtgtctccggaaggtcacgtggctgctgggacagcactggccctttctgtggctgttgcctcctctgtgaaatgggcctggtgtgttcgagcccggaatatattgcccagacatcagtctcacagaccactgcgcttcaggaaggagaacttggaaagaagaccaaagacaccaccggaacaaaggagccgggtcccctcctgcctacctgccaggtgcatatacagctggaggcacaagtggaaatcttggtcaggctgtggactgttagttcattagagaaccgtgtgtgacagtatccttcctgctggaaagtcaccagcccgtctcacagggccaggcagggacgggccctggggctgctgtgtcccaacatgtggccttggaccacaggtcaccatgggggcccaagaaggggaaccaccttggtggtccagggaacaccgcagagtgacgaggtgagcaaatttcaaaggggacccgtgaagggaggttcccataagaccttggcaattaccccaaacaaagtgcgcacttcaaaggtggcaccagatttcctacggcagagcccacggtggggtcccttcctgatgggtggacccagttcctgttttgcacctgcttccccgtggcgtgctggatgcctgcggctctgcctccagctctgtctgtcccagatgccaggtgtgctggggcctttgatcttcagcctacactgggggtgctggtgggttccctgagggctgcccgccaccctgccctgctgaggccttgatctcctgagaaggagctccagggcccactgcctgcgtgtgatgtattctggtcaccaggtggtcagcaggcggagcttgactctgcaggcctggagcgggggcagctcagagcagctcaggacagggcactttgcacagcacctcggcacagcccctctggcctctctcccatctgctctctgatggaatgttctggaatgtgcagacccttcacatctgcatagccctactgtgtctcgcccacttacttctgctggggggagcatctgtcctacaagtgggggaatgcagacctgccaggctgcttgagaatcaaggtcctgcctcccccatctggcactcatggtgggagggggtgaaggtgagccctggaggccagaaacacgtgccccattcactgtgaccacccccggactcagcctgagctgatggacaggaggcctcagtccaaggtccccgccagacacatcaatcctcatagctgacctccagcctcatgacagaaaggcggctgatcctacacagagggtggctgcttttgctaaggacaatataccgaggcttgacatggtatgaggtcttcagtcaggagccagatattggcagccctaaggcctgagtaactttttttttttttttttttttttttttttttttttttttgagacagagttccaccacgcttggctaatttttgtatttttagtagagatggggtttcaccatgttggccaggctggtccagctctgcttaagggtggcctggagggctgcaggagggacctgcttgcagcccagggcagctggacacagggaggtcaccacactcatccagtgactccacgctacacacaggggagagacacaccagaggtgggagttagacagcgttcaaaccctgggggcagcacccctgtacctctcagcatgaccagcgggcattctgcacaccgggagacctgggctgtcacgacggcggggtgcggcgctactggcacggagcaggaggccggggatgctgctggatgtcctgcaatgcacgggacacccccacacaacagagagcccacggtggcagaggtgccaggctgaggccctgtgcaagaagaccatgacaaggcatcagccacgagcctctacccctgccgggaggacaggaccagctcctctcagctttctctcccatggaccctagactcgggcgtggtcctggcttcgacatgaagccccaggcactgggcaggactggaaggaatggctgagcggcccactcatccagcagccacccagcctccacacctgacagtctgctatccagtcagcctccacccacaaggaggggacagcgtgacagggaagtgaggaagagaatcaccgtggacagacggtgacatctgccagagcccacagagacgcgagaacagactcagcgcagagcctgagtggggccctccagccccttccttgtccctaagaggcatcttcctcaggggctggtggagctgccatgaaagcaaacgcacagccaaaccccgggtggggggaaggcaaactgcaaacgccgcggcgaccccggcacagcagccctgtcagcaggattcccccgagagcggggtaattgcggtgggaacgagcgctccaaaggccctggggagatgatttcagggaaaagtggccttgatccctgagtcaggcagatgcggccatgggaaccatccaccccgaggctggaggggagactccgccggtggctaaagccatcctgctgacggggcccagggacgcccccagtggccaaacgcacgtgggaacgggatcttccccctcctctgtgatgcggccaaccctccaagcctctggctcctgactcagaggacgatgtctccccatgaacgcagtgtccctggagagaagagcctgcccagcgtggggaacatgggaatgtggagatggagggcatcccggaacctcagggctgacgggcccctgccccagccctggaaacacctcagggacaagagagtcactcctcaagcgcggactttccactgtgctggggccttccgccttccaaccactctggccccttggggctctaggtggagtgtgctgaacagtgtccccaaaattcacgtccagtggagctgcgggatgtgtcctagctgcaaatgcggtctccgcaggtgcaattagcgaaggaccttgagatgagatcatcccggattagagtaggcactaaggccgacgacaagtgtcctcagcgacacagagacagatccaggggagacagagccagagccagcccaggatgcctggagccacgggcagctggaaggggaaggtggcaccttgggtctggacctctggctgccaggaccaggaccgtctgcatgtctgttgctaaagccagtctgtaggcatctgtcaccacacatgaggggccaaccgtgccacccaggggagacctcccggcttctcagtgcatcaggcatggtcaggggcaggacagctgcagctcacaccccacttctcagtcaccagccgagtgcacagccaatggcacctcatctaagagggggctgtgagtcccatgtggtcagcaccctggagctagctgccctgtgggctcagggaagtcgtgcagtgaccgccacatgggttcagtccagagcccaggccagagtccatgcccaccccacagagtccacgcccaccccagagtccatgcccactccaggcagagtccacgcccaccccacagagtccacgcccaccccagagtccatgcccactccaggcagagtccacgcccaccccacggagtccacgcccaccctaggccacggcgccgcttttcagatgcctgtttcgctctggccatctaatgcctgggaaccgtgatggggcaggaatttgggtttgggggttctggcggcaaccagatggcacttttggaccaccagcagtgtctgtcggtcttggaaactcatgaaggagtgggccctttgcttagagctgccaacctcacaccagaagtaaaagctttttccaactccacaggcggggaaagaccctgagaactgtccccagcacagggctgtggctgccctggcctctgtccatgcgtctgacgaagggcaccgggaggtgaaggccgcgggaaaacaagccccgctcccgtcctttgattctgtcccagcacacggcaccggcagagccccagcttccccagcctgtcatcctcccgaggccgacggcacagaagaatggcaggcccaggacacactgagctcccagagcaagcggcgggtcaagcatcctttatcaactgcgaggtcttcgaggcccaaaagaggtgccctgagtcgcgaagtacccacccttggggcagccaacgccgcagccctggctccaggcccaggttgtccggagtggagccacactcgagcctggcaccaatctgggagctcctgagcgcaatgtcctgtctgtccctgcatgaccctgagactgtctgagatgcctcacagagagatgccctggagtcccccacaggcaggccagcctggaagcttctctggaaagtgagctttggcagctcgaggccgagctgtggccgactcctcccttggttaacacagcctgtacccagctgggattcactttgaggccctggggcttgccctatttcctgccaggagagcggggcccgaagctccatcctgtcccccaaaactcagacgtggaagccctaaccccggtgtggctgtacgtggacatggggcctctacagattaagggtaagtggggtcctcagggtggggcctgatctgacaggatccttgtccacacaagaggaggccccagacagctcactctcccacaaggaaacacagcgagggggtgtctaggagccaggaggccgagcaccccgcccagggcatcagggtccctggcctggcggggcctctcaccgactctcccgccggcatccaggtagcagggccctggcaccagaccctctgaagctgagacccacccacccaggcctgctccgctcttgctgtcacccccggagaaagcggcagtcagggcgtgaggtgaggaaaaggggctgttggaccctgcatggcagtggctcccgtgccggggacgcggtgagcctggcctcctccctgcaagggaggacagcccatttcccaggggaagacaccgaggctcagacaccctggccggggggcggcaaaactagaatcccaaggcagctgcacatctagcacctgcccttgccctctctccgggagggcaccctagaagcccacagtcctgatctggggttcggagagcaggctgggctgagctctgctgggagcgcctagaagcccagctatgggtccacgcacacactcaggtgaagccaggcccagaagaaggaacagctctaagccacagcccaggggggcttctcagtccacgaggcgacccctccacaccccagagccacagacagccaaggtgtgggtgaaacgtttttctcaccagaacagcccagcagctgggcatgtgctgtgaccactgagggggcctttgtcagaaacatcgtctgggggctggacgcccccacccacaggaagaggagaccaagacagggccgcacacccccagccagatgagggccagatgagggaggcggcacctcttcctccaggaagctcctcaggagggacatcgggaggggctcagggggctgccttcaaggaagctcagtgaagctcagagaccagtctgaaaaggaatgtcctccagacctccaccctctcaggatggacgtgttactcaggaactgtcccgtcagcttttcccgtaacacatgacaccccacgtgaacctcccaagagcagatgggcccagtgctgtccacccgaacgcaccttgggaacagaggtgtgggcctccccccagcagcgcatgaccctgcacactgcacccagggtcacagtgggggtggggagggacctgcccactgctcacggctgtgggacctggggcagggcaccccacttctctgagtctaaggggccctactagctgaagaaccaaaggaaaaccatcatttcaaaactgtcacgtgacacacaaatgcaggcccctgccccacagcccagtggcacacacgtatttaccgcctgggacacgggaccgtccagaagtgccctactcataggtgtaggtcacatccaggggtctcggccaccgggacccagggcccagcagctcagcaaagccattcagccggggtctgagccctgcccaggggaagcattttcccctcctggggtgaaggacagcaagaggcacgccgccctggcaggctgcggctttctttcctttttgtggacagagtgaaagggcaaatttgctccaggggaatactgacctccaacagtacaatgtgggaggagaaggaaaagaaagtttttatgcaaccttttttttaaatctgcccaactatccaatctgtaactgttcaaggagagattagtttgttctgccgctgacggctgcagcccaagcaaagcacaaagcgccccattgtgtcctccaggagggacgtgctgctgctgctgggctgggacggcagagcctgtgccctcgctcccaccctccgccctgcaggcgaaggcccagccaccctctccttaggcaacagcctgcgagtggactcatgggacggtgggtcagatctgaaccctcatgagtactgtctccctttcgaaaaggctgggactaactgtagaacctcatgtgacacctaagcctgcgtgtccccatgccccagcctaggggcagccatgactcccccaagacgcggaggaggcaagggctcccgaccactcaggcccctgcagagtcgcccctgtcactcagccagctgcccctcccagcccgcatctcaggaaaggcccaacccctcagaagggcttttctggtctgcaccagggccccgcttattccccactgcgactctcccattcacgtgcctatggctctcaggtccccccatgagctctggatgcggggccatgttctcattgggacccggcatagatgcggcacacgggacagaagatggttctgcggatggccaactgggaaggggtgattacaaacttccctgacgaggaggaaacaggtcagccaaggcctacaggaccctagggccagtgcctttccatagcacagggcccacctgggggccaagggcagcaaggaggagccttttcagccccaatggagcagggcacccagggtgcgggacaggcaggaacaggtgcgtgggccaggcctgctctgccagattttcgctgcattctccagacccggaaagggccacttgccagtcgttgcaaaattgaggccggagtctctgccttgaagtatctgggggcgctgctgccaggtgccagcgaggggagggggcagctgcccaagggctttgcgtccactggggggtataaagttggacaactgctttgggagaaaggggtcaacacaatgtatcttctaaaagcaaggcattcatctggtaacaaaataaatctgttgaagccaaacaggagacaggaattctgcagacactgcactgtatcccaaagctcagaagggaattgctggggggagcacggtgggaggacgctttcaacagctaacggaattataaacctattatgtattcaagtcgaacaaaagctctttgctctccctaccgaaatttgtttttacaaaaatcacgttcccctcctaaatctttcctggctatctgatgagcgcagccaagcaaaggccttcacgagcaaagcaccccttccgtgcccacttctgggaggcacaggatggatttgtctcctgcccgtaaaatgtcactcaggcccaaccacctccctgggcaacttctgagtgcccgggagccatggaatgagctcgtcttgccttgagtaaggtgccggaacctgaggtcccaggaaggttcagaattgggacttcctgccagccctgtcctgccagctcttgggtggctctggtaccccgggcgactctgagaatccctggtcagacacatgcatgggggatgggctcgagctcctgaaggattgacctgggcaaccttccagagccacctgggaatcaagtgggacttcccctcgacgatgaggcaggtaactaacacctgctgcagactttgtacagattgatacatttgataaagacagtctggccccagcccctggagctcgcctcgctgtggtgaggtcagtatagcccggcactgcatccccctgcaggcccaggttacctgcttggtgtggagacccctccccagctgcagccagactttgtcctaaggcgaagtgccacgtacagccagcagggggcgccaggagcaaggcggaggctcagctaaagctgcgtgctgggtgctgggtgctgcggggcactgttcagttcacagcccaccagtggcacggtgcacacaggagagcctcccagccctgaggcagggccccacacaggaggaggcagcgtccttgtgtctgcatgttttggcctggccgtgcatgggggcggggcagctcacagcttgctgggtgaggaccttcctgcctctaggagcaaggtccttgccctgtcctctgcagccctggggtcctacctgcctcccctacagccatgtgggaccaggcagcctctctgcagccatcggtgactgcgagtcaccagagcgtgcatccgccgggtgcctgcactcagcgaaagctccacagctccaggactgggatcatctctacctgaggctctgggagagaagagaaggaggccagctcctaactgctctgctcctaggctggctccaacatggatggagacaaactcagaaggaactgcagacagaggcatccctgctggactcaagcaacagggccccccacttcaactgtacccaaccacgggtgggatccagtgccaaggacagtgtgtcccagggtctgtgaccacacaaatgggaactgcttatgaaaccccagcccgacctcaccgcggaatggcagtgtggaaagggtggaggctctgcaggcagacacagaacacagatctatggagtgtgtgttaaagggtccagagacacccagcaaaataccaactgtgtcagtccacgtcaacagagaacacaggtgcaaaggggcgggggctgtttcacactcactctctttattccttctaccagccccaagagaaaaagcagctgggaaaaaggctcagaatcagtgatttccccaagatcacacagcacaagaccaaagtctgggccagccagccttaaaacctgtgcgccagactgctctcacctgttcccgaatgctaacagtggacacgtctgagtgatggggttaccacgtttgttttgttttccatgcttacctcatcttctttaaaaagcagacagaaacacagagacaatcccacacctgcccatggaatgatgaatgaatcacagcatgaccaggagcatggccccgtcgggggtgggtgaggggcgacagcacgtgggactctgacagacccagggtgagatggctcgggtgaggtctgcatggcaggcatagcccctgccaggcctggaatgttccacatcgcccccaggtgaggttacaacgcatcagctgggctctcaagattcacagacatcgcagcgtaaaaaacaagaaaaactgccagagcccctcccagtggtggccacgctgtcccacgggagcactcctgtgtccccctctgggtcggatttcacttgctgggtgattttcccagagggaaatctccacgttgtacagcactgcagagctgcggactgggaggcacccggggacgggacctcatgccctgtgaaggacacacaggcaaagcctcgaggggccgccggtggggcctgggggacgtactcacccttcccgatctggacgaagcccagcaggatgatcagggccagggccaggagcttggcggcggcaaaggcatcctggacccgggtggcggccttcacgctgtagcagttcacggccgtgagcagcactgtggagacagagggcagcggtgagttccacgggcagacagacgccagctcaggggtaggctgggaggtgacgaccccacccccaccccagggccaggtccaccagaaaaacaagctccttaaacagctccagtcccctgccagcccttagggcacgttctgactttctgagacctgttttgataaacttcgcagtcctttcaggtctaagggctggatcccaggtgccccttaagatctgcaagggacctttcctcaccccccaccacaccaggccatggagtcccacctgtagtcaggacttcaagtggggtcactgcctccagagacccaggtgagcaaggtgaccctgccacttggaaggcgcccattacacctttttgtacctactcagcaccctgacctgactgtgagacccacgcacagcccgactgccggactccatgagggcggggccctttcctcaaagaggatcttctgtggattccaacagaagtggggtgtcccgctttcccggaactacctggccagtcacctggggacggcagcctgggaggggccacaggggcctgtggtgagcagagcagaccctgctgccctgctgctttgggggcatacgatgaaacccaaaatagcaccgtgtgcttcagaagcctgagtgaccccacacagatggccagaacgcctgccccaggaggcgctgagatgtggggtcaggcacgctcagacaggtctccagacaccagcacgtcctcctgggccctgtaaggcacccagctctgagcctctgtgtgtgtgtgtgtgtgtgtgtgtgtgtgtgtgtgtgtgtgtgtgtgttgggggttctgttgcaatatataggcacgctgagccactgtgtgtgtgtgcgtgtgtgtgtgtgttttggggggttctgttgcaatatgtgcgcacgctgagccactattcagggatctgtgagctggtggggaaacagccacccccacaacttaaaatgaagtaaaatcatattaatcccgaggcactgactccacgacacccctcactgcctgctgcactacccttcactcctctgctcacgaggttatctgtcgctgtcagcagcttgaaatctgccagtgggaacgtctacaccccagaagtgggcaaaggcccagcacgggccacccacacagctcagatctcacagccctcccggcaccgcaccactaagactgcaggaaggtgagagcatcagaaaggccgtgggctcctcttctctctttccccttgggagtaacgctcagaaaggtctggccagccaaggccttgaggactccagtggcttttccccagctgaacaaatcctgtggaatcttacaatgtaagcaacagaccccgaggaaagacatccatgctaattaactaatgacaccggaaacgtcctgaggtgcgggacgggctgccgcctgcctatctctcagaaattaaccaccccgctacaattctgtggatgccagagcggagacggctactacacaccaggaaagtctggttgaaaaatgtctgaaagtcagtgttttcgctgctattcctaaaataaaatacttgaaattccggaacttccactcctcacccaaactgaagaggtgattcttcacctcttcccagggctcccagggacatggagatgttaccagtccagagctctccagtccaaccctcagggctcagcagggtcaggtcagtgggtctaggcagctccttgtccgctgcacagggcaaggggcaggtcctggcttgccagtcccatttccttatggttggggggagcacgaccataaaagaaactgagcctcggggacctagccggcttctggagagctttctggattcgcaagaggccggctgattgcatcactcgctcattcatgcccggagggaggcggggagtgggtgtggccaagccgcactcgaggctgcctctccccaaaagggagagaggcacgctgccaccactgaactccagacaccagacaggcgctgcggagacactgagcactgccctcgcggctgtcacgtctgcggctgtcacgtctgctagggggttggggggtccaggaagggcagcgagttgcccagaattgcccaaccacgggctgtcctgccacactgacgtggtgctgggtaatgacgccatcagggctgtcactgtgggtgggacagaggccaggacccccccgcccccccccccaccgccagcctgaccctgcctgcccagttccaacccagccgctccccaaccaaaaacagtctggaggggctgacgggtgccaccgggagggttcaccagatcatctcctgacgttggaaataaccacaggacagacaggcgggggccgggtcttgaagtcaggtggggagcaaaatggccatagaacaaaggggaccttatatttattccttttataacaagaacataaattttcatgttcactgactttgggtgatgagtaaacaaaggtttcattattctccacagtgtccttttttttacgttttaagatgagataaaatcttaaacaaatacatgaattcatctgggttcagtacctttcgaccttaaggaggcgaggcagtcacaggataagtctggggtttgaacctcagtccctgctggcacttgccctctcccaagcctcagtgtccacaccatggaggggctgctggctgcccccacagcagggagatcgacagggctgtgccctgagtcagagtgagggggctgagcacacagggccagccacccccagataagtgtggccgcgccagcctgcggggacagctgggccaggagataaaacccgtccggggataccccgtggcgtggcttggcttgattggcagatagccgggcaggctgagctgggggcccctcccagtctggggtgctgtcttccccgtcctcacctggctgcctcccacctggctggctggcaggggctccagaggagctggggtgccttgggggcagtgcattggaggaacccctgccctcctcctcccttcacctgtgtctccaccacccttcagggccatcagccacagaaacatcctcatcttcgggtgggcattgacagcaaggcccacagcccggtgaaggaaggacagccctggccatacccagagccagcgccagggccttggccaggacacctgtcacagtgaggcccaagctgtggtcctggtcctgactcaaaagccacttcagataccctgaggctcacgcaggagggattggggacgcggccagcccatttctcctcaggaccctggggtgggcaccaaggcctcccactgctctcgccacgtgccctgctgctcagagctggggcgtcccggggaggttgccaccacccagcatgaggtgggggacacccccacccccttgtgcctccccatctctggggtggggccggcagtgatactgacctcagagaccatgcaagaaggcacctgaacagggagggcccacagacgggacaggtgcatactgctggctgggcccacagacgggacaggtgcataccgctggctgaccccccaactctgctcaatcacacacgtgcacacacacgcacagcacccccacaacttgtaaaccaggaggctgccttctcctggcccctggccttacccctctcccctcggggggatgactctctgaggtgcctccctgcctgatgcccgtgaacgctcacctctgcggcagccggctctgctcacctcccctgatgctggcatcttggtctcctggccccaactctgtccagctcctgataaaatcccgctacaagcaaagggatgatcccccagggtccagtgttggaggagaggggtgggggaagggccagtaacaggtgtgttcaatatggagagcaggtgggacctgtgggccccggctgggtggggaccccgcaggccccatgaacccaccccacacggactaatgcctgattctttcaggtaataaacatgtaccaggtacaggagcatccgtggatagggttcagggtcagccacaatgaaaatcctctctgttggccacagaggctgctccctgggccgccggtcctcacctgcccccgagccaggcacagcagtgagtcctgcagggctcagcaccttggcctgtctgtaagtgggagtacccagtgaacatgatcctcccgggccccttcgagcccaaacacagccactgtgagtgccccaggcaggcgtccagcccaggcaggcatcctgcagtcccttctgtcattttcagacccaacagaaacagaagtgctcctgccaggcccccgaggactgcctccaggagtcatctgtaatgacaggctgtgttccgcgcacggtttcagagtctgtccagagggccaatgctggggctggggcagagatggtccaaggcctgtgagctgtgcagctttataggcaaatgacgattgtttacccagaactgcctgctggagacagcacagaggaagtggccggcagcttcatcagttccaggaagcccaggcagcctggtcccccagggtgcaccgggcacagcagttcgcacggggccggagagcggcagctgaccacagcaactacagctggcccgacaccgggcacaggtaccagcccagcccagtcccgcccagtgcagcctgtggcccctagcggagccagcacctggcaaacctgacacccagccttggagcttgggcccccctctgcagctggctggggctcctgagacagcttctttgtcggaatccactcggtacgcacagggccccgaacttggtggctgcccagtgcacatggggctttagtagaaccagtaccttcctccctggccccttcaagtctaaatatcccctgctctgagtacaagcctccaccttctccaccgacagacagcccccaccatctcccgtgtcatcccccgggggaacttataaaagcagtggtgggggaggcggatggaaacccagagcttctgatcaggcaggtccgggagatggagacaacacatctgcacagaacaaggtcccagggaggctggtgctgccggcctggggagcgcccccagcacaggcgcgtgcttccctgatggacacgtcaccgccccgggctccagaaaatgaatgtgtctgacccagtgacccctgtcctcacccaaggccaacctcaccccagaatgggctggaatgccaagcctgcccatgccggctccagatccacctgcctccctgccactgctggccagagagagaggtcaaagtggtccggaaaccccaaggaaaatgaagcagttccggggcagggaagcaaaggcagcgttcacattttttttttttttgagacgaagtctcgctcttgtcgcccaggctggagtgcagtggtacgatcttggctcactgcaacctccgcctcctgagttcaagccattctctcacatctacctcccgagtagctgcagcctccgcctctggggatcaagtgattctcctgcctcagcctcctgcctcagtagctgggattactgacacctgccaccacaccggcctaatttttgtatttttagtagagacaagcgttcaccatgttggccgggctggtctcgaactcctgacctcaggcgatccgcccaccttggcctcccaaagtgttgggattacaggcgtgagccaccgcgcctggccgggatggtctgcttataatggctcaattttgatgcccagtctctgcagagcacaaggccccacctttgggccggacatacagatgtccctgggcaaacagagagatgatcccaaggccctggccccacctgtctgctcagtgttgaaacagatttctgtgaaaacaaattactaacaggctggtgtcacattttcaaattctgtcaccagcccttgaacacatgtctttgtacttttttccatttttaaccggggctgagttacgcccaaccacactgtcctggctggcacgggggaggaggtgtcagctgctgtccagaatggggctgacacattcattttaaacaggccaggaagatgcagatttggcaagctctgaaatttgccaacatcccaagtccagggtaagcaggagaactggaaaagggcagcttctcatgtggtcaggttctcctgacacaagcgtcctggtggatttgggtttcccaagggtcctgactccaggagacccccagggctgacaggaagggccaccgctccctctgaaactctgaaaccaggccacccggtgctgaaatgctgtgtgaactccggcaagttcctttgcagggactgagcctccctttcctgtttccaacagactggaacaactgcctcctgctgcatgggcgaaatacctcgcggacgtgtcttacggcgccccatgaaagcatcaccattaatctgaccagtcaccgcagcatgagtatcttcagggcacagatgaagccgtgggcaccagtgataaggagttgccactgctggctaagtgcggagcctcacacatctgtggtccggaaacccacgccccactccaaaccctctacagctccaacagttatgctaacaagaaaaaggagtgaaaacccgctccagtcacggtattgtggaggtggaaggacacttgtggcagccaatccaacacctccattttatagccggggtaaacgtagttcagagaggttgtcccacttggtgaaagtcacacagcagttcctgggcggcaaagtgaggacatccaggtctcctaaatctcaccctcgtgctctggccacttgactgggattttcaatcccggctgtcaaagagaagcaccaagtccacttgggctcctggccagcgtccaagccagtccaactcaacagcaagcggaagcaaataccacacaatgaactcgttgaacagactctgcgctcaggcttaaccagtgcacagcctgtacacccgacaggaggatgcagctgttccaagctaaggccagggcctctccccaatcccgatgggctctgcagatgcagtgatggaagaatccctggtgacggggagcccttagctctgagcaggacctgaagccatctcagggcttgcaccggcccagatgctgctgcacaagtgctccaggggctcctgccctgccctcctcacctgccccctcacctgtcagggatgtttgattcctggctggcccctcccctacctgacccctgccaaagacccacgtcaccccaggcttccagctctgaagcaaacgaccagagaagtcaagcgcctggctccgggccacacagcttgagggactcagagctccagggacagtgcccgggccctgctcaggccttctgcagaggccctgggctcttccagttgactcagctcacaaggcccctacacggtagcaggtgaagacagggccccaagaaccctcaggctctgaagccacacatgagagccgtggacagaatcctgcattggcctccagcagctcgagagcacagggacaaagctggactggccccggggtcaccatggccttggttttgtagcagctgcagtttgagcacgtacaccaaaaataaaattctaagccccgtaactgactaaagggacccctcctattgccaaagggatattccaaagttaacctgaaaaacgagctcaggtcacgatgggaagagggggtcacacaggccttgttataccccctccctctggaattcaggtacagcggaccagcactaacactcaaacacagatcttggcctggctcagtggctcatgcctgtaatcccagcactttgggaggctgaggtgggcagatcacgaggtcaggagttcgagaccagcccgaccaacatggagaaaccccatctctactaaaaatacaaaattagccaggcatggtggcggcaggcacctgcaatcccagctacttgcgaggctgaggcaggagaatcgcttgaaccgggttgcagtgagctgagatcatgccactgcactccagcctgggtgacaaaaacaaaacaaaacaaaacaaaacaaaacacaatattcgtctccacaacctcctgtcttacccagatactcctttctattgataccaggtctttagctaataactctttcaaccaattgtgaatcagaaaatcttttgccaggcacggtggctcacacctgtaatcccagcactttgggaagccaaggtgggcggatcacctgagatcaagagttcgaaaccagcctgaccaacatggtgaaacccccgtctctactaaaaacacaaaattagctgggcatggtggtgcatgcctgtagtcccagctactcgggaagctaaggcaggagaatcacttgaacccaggaggcggaggttgcagtgaactgagatcataccactgcactccagcccgagtaacaaaagcatctcaaaaaaaaaaaaaaatacacacacacacacacacacacacacacacacacacacacacacacacacacacacacatatatatataaagaaaaaggaaatcttcgaacccacctgtgaccaggaagcccatccccgccttggagttgtcccgcctttctcggcagaaccaacaaatacctttcatgtactgactgatgtctgcctgtaacttctgtccttgtaggaggtatgaactccagctgtggcccaccccctggggcacatgtcctcagggcctccaggccttggtcctcacatttgactccggataaatctcttcaaacattttacagagtctggctttctcgttaacaagcagctcacacatacagtgtctcagtagtgacagatgctggcccaccccgaggtcaggatgactcagcagggatcgagtttgcgggcgtcacgctccaaggcccagaataggaggtcggtgctcattcctcacgtagtgggcaaatcctagggcaggggaggggcgggcaatgccagagaacggtccccacctggggtggtctgacggccagggatgcagggagagacgcctcccacactcccggaggcacgcacgtgctgtggccaccccggagggtccgccttccagagggagaattcaggattcggccagtatcagggaaggagacgctgtggggggccctcctgttggaaaagggcagcagcgggaagagggtgctgccacagggcctctggggagcgtgcgggcacacagtaccaatctgcatgcatacacgtgtcctgtccctgcagacgggccaggcaaggcctgcccatggccagctatccaggtgatgctccagggagggccaggcctactggggggcagaaccctgtggctgtccagggtacctggatgtgagtctgggaaggatggagaagggtggaggagcgcaaagggcccctaggggatgctggggaacacagatgagcctctgacccacctgtgtccttacctgggccgactgggccacccagtcttgctgactgacacctccccagacccctggcacccaccagactccccaggcgtggctttgtgctcccctatgcctgatgacaaatggtggcctcagtgtagaggtgggcactgtggcccctggctcctggctcgctcctgcctcagtttccccagctgtaaattggggattatcactggcttcaaaggctggagtgcaaagtggtggccaagaggtggccaagaggtgccaagaggtggtccaagagtgtgccctaccttggacacccctctcctgggggtggctctcaacctggcctgggcccccgggggtctgcgcaacccacccttctgtgtgaaggcggctgatacacatttctgggcaagattctgcacattctgctggattatgaaagaggtctgtgacccaagaaaaaagggtcacaagtgcccgttaggctctcctgtgtggctcaggtcatgtgcttctgtgagctccccctacggccttgccccgaatcccgtgatgcagcgtgacctgcctaggtgccggcggcactttcatgtgcggctgggaaagtcagatttcagcactaatcactggctgccgcctgcaatgagcccacggcttgagctctggggcccacccagctccttaaacacgcagaacctttgccagctgagccaggatcccagctgtggggggttgggggtggaggggtgcagggatcccaaaacccaacccggggccaggttttacacaggcctggactgagaagtggggctacaggctacaggtgcttgataccccaggggggccctggaacaggcctggactgagaagcggggctacaggttacaggtgctggataccccagcggttgggggggtggtgctggacacccagggggcagatagaggcagccaggcagcctgaagaccctggggcaaaacacacacaggccccctctgctctctggtcactgctaactggccaactggcctttgagtccactgaccacagctaagcccacagccatcaaaacccaccccttacacccttcaccctttagggaggggctcagagacagttgtggcgattcctacttccacccatagccccccgaccctgggcctgtgccgagcgtgggtgggtgacatcatctcgcacccagagctccagactaaaggaaaccctggctcctgtctctggctcttccctccctctctttgttcccttgctccttccttcttttgccagaggagaagacagtgaggctgagggctgctccatgtgcacagtgagcaggagatacaggcacgtggagggacggtcacagcccgtgcaactggcaccttcacacgcagaggcctgggattcccagacacctggcgctggggccaatcccattccacagtcagaaacaggctcggcggggccaggtggatttctcaaagccttggttgcttttggcctgatgctagctggacagtgtctcagctcacaggttcctaaacgcatacccgcccacaccaatctgctgaggagtgacagccatggggaggagagccacctcactccagggaccctggcaccgtctcccatgaggccaggtgtcctcagccacccgcagccagagtcccgcgagaccgacggacggcctgcccctgcgtgacggcacgcctgggactgtctcagcagccccccatgcttcacccaactgggacagggaaacaggagggggctacttctgctttcaaggcatggaggagctgtctgcaggccacttcccgaacacctatgcgcttggagaagtgactgagactgagccagggtatcttctccacgatgcagtgagcccatcgggcccttcttctgagagcacctccctggaggtggaagcccctgaggcccacagcatcttctgaacctgtgagttcccacttactgagaactcgcctggatcagtgccgggccacagtggaccgggactttgagtggatgctaccctactcgctatgcagagccagctggggcccagggaggtcagataaactgcccaaaccaaatccaggcccagccagaatctcagctccagcctttgcgccttctgataaaacccagcatcgcttgaatttccagtacacgctgccaagtcttcgttaagcaataaataaccacacaaccctactgtcatgccaagttccatatggccatccagaaagagacacatggagctggttcctctcacctttatgaccagtgaaaagcgcaccaacacgaagacacgcgtgaaaggacctcatctcctacccagactgacaagcaagggatttttttcactcaccgtcagtgggatggttctaagcaccgaggccaacccatttcacacgattatttcacaaaaagaaaccttctgtgggacgtgcctgggcgactgaaaagacagccagcaaaactgagaaccttgttctcaaatctataccctctcccaaggcagcctcagaggcccgagggctgaggatccagacccgaaagccactgtaccttctgtaggatcaggctcaaggaataagggggtaaaaggtgccctttcccttcctaagcagaaaattccagaacccaaccttatgtgtgatcatttaaaaatatatatatatatatatatatcagccgagtaggctgactcacgcctgtaatcccagcactttgggaggccgaggtgggcggatcacctgaggtcaggagttcgagaccagcctggccaacgtggagaaaccctgtctctactaaaaaatacaaaatcagccaggcatggtggtgcatgcctgtaatcccagctactcgggaggctgaggcaggacagtcgcttgaacccaggaggcagaggttgcagtgagccgagatcgtgccattgcactccagcctggacaaaaagagcgaaactccacctcaaaataaataaataaataaataataaataagtaaaataaatcactttctatggcttttcactgctccaggagcaatgtccacagatcaaacgcccggcctctccttcacaccctggagcgcccatcctgcccactggtccgggctccaggctgccccctgcacctgtcagaagcccccctataagggcagggtctcccttcccgggacatccactgcccttctccgagctgaagtcagaatgacctgagaatcagcttggagttctaccagcctcagcaaagcccacctctgcgacagcactccttgcagacccctgacccggtgacagatgaataaagtacagacacacagatattctgctctgccagtccagctgagggtcccagccgcttataggctccctgctgagtcctgtaaacagttgctacttggccctgatcagctagtcagacgtgcatttattcagtatgattaactaacaaaagcttgagtcaacaccattagaatgtaacagacattgtggacttcccaagtaaaaagcacttaaacacccacggtcttaagattatgcgagtaaacaagctagctaggtaaactacgctgcctttcttttatcactatttttatttgtttaattaaaggtaaagggatcaggccgccttcagccagagctaattaccgaagttatgccaacttctcggccttccaagatttgtgtctatttctataactatctctaatatctttcccaccagaatgattgaaccccaacacacctccctctctcagcagggtctgcctgttcagagaacacagcttctctttcttgccttacacacaggggcaagaatagattcactcttgcagagagtacatccctttctgttactgaaaatcactttccaaaaaaaaaagcaacacatacacacatactcaccacacacacaggtgggtcagagaaaaaaaacaagtacaaatggcttagggacatgagaagtgtggccctaactttcgctgaaagggaccctattaacattaaccctcacctctgggtcagagagggttggcactctagggcctgccttgaagctttacctactgggaccaaaaggactgcttggaaagctattttaggccaggtgtggtggctcaagcctgtaatcccagcactttgggaggcagaggcgggtggatcacctgaggtcaggagttcaagacaagcctggccaacatggtgaagccccgtctctgctaaaaatacaaaaaattagctgggcatggtgggcacctgtagtcccagctactcgggaggctgaggcaggagagtcgcttgaacccgggatgcggaggttgtagtgagccaagatcgtgccattgtactccagcctgggtaagagcaaaactccatctcaaagataaaataaaataaaaataaatttaaaaaatactttttaaagccctattaccacaaaataaatccaggaacgcgtgacttggtacagcctctttggaaggcacattagctattacattagaatccacaccccgccgggtgcgatggctcatgcctgtaatcccagcaaattgggaggctgaggcacatgcctgtaatctaagctccggaggttgaggcaggagaatcgtttaaacccaggaagcagaggttgcagtgagcaacgagcctgggcaacagacacagactctgtctcaaaacaaaatcaaaaacaaaaagcaaaaaaccacatacccttttcccatttgcacaaagctgggaaaccccaaatgccctccacagggttctatgggggggcgggggtgcggtgagcacacttgttcctgccgacacagggaagtcttcttagcagctaaagagggcagcctctgcgtactgcctgggaacatggcaaaaccattttaggctttaaaaaaaaggtggagaacaagttgtacattatgatcttttaaataaataggccagcgatatatttgtaacagaagcagctccggaagcatacactgtcagccgcagaaactctgggggtcgggggtggtaaaggaggagaaatgtgtcacccaggcaggagctcagtggcaccatgcttggttcaagcagttctcctgcctcagcctccgagtagctgggactacaggtgtgcgccatgacgcccagctgatttttgctttttttttgagatggagtttcgccttgttgcccaggctggagtgcagtggtgcgatctcagctcactgcaacctccacctcctgggttctagtgattctcctgcctcagcctcccgagtagctgggattacaggcatctgccaccacacccagctaattttttgtatttttagtagagatggggtttcaccatgttggccaggctggtctcgaactcctgacttcaggtgatccgcctgcctcggcctcccaagtgctgggattacaggtgtgagccacagtgcctggctggtttgaatttttaaatgatgatgaattcatgtatgactgatgtgatttttattagaaagagaaaactaggcagcgccccatcctacgtctccttcctggtggccaatgaagcatttcccacgactcactcctggcaccagcaggaagtcagagactcagcacccaggggctgcttttttttttttgagacaggcttgctctgtcacccagactggagtgcagtggcgggatctcaactcactgcaacctccacatcccggagcatgcctcagactcataagcagctgggattacaggcgtgagccactctgcccggctaatttttgtatttttagtagagatggggtttcaccatgttggtcaggctggtctcgaactcctgacctcggtagatccgcccgtctcggcctcccaaagtgctgggattataggcgtgggccatcacacccagccaaccaggggttcattttttaaagataagagtgcaggctgcgtaagctactatccatgtcgttacataccgggccgacatgtacctaggcgggagggagactgaaccagtgaaattctaatgacaaaaaaagaaatcagagtcatcccctacattcacatctccaacgcccagctggaaggcacaggctctccccactgctgtcctgctacgatttttcccggctttgacctgcatggtggtgcggctgctcgactcagagcctcagagaaaccacacagagccctgctgagtcttgccctcggggcattctcacatttatgaagaaatgcctccccctccccctcccccccaaagtacggtgtggcagaaaacagcgccaacaggtcctgccagtcagaagccactcccctgatttcatggctcaagaccccaactataaattagcccttcccaccttgaatgtgtacacacactattgagatgcaggccgatccatgccatgggatgaatctgagaattgccaagacccaccttcccacgccacccaaccaaatcatgtggcatctgctacaagtgattttccccctgaaatcccacaagaaaactattttgaggccgggcacggtggctcacgcctgtaatcccagcactttgggaggccgaggcgggcggatcacaaggtcaggagatcgagaccatcctggctaacacggtgaaacgccgtctctactaaaaatacaaaaaaaattacccgggcgtagtggcgggcacctgtagtcccagctactcgggaggctgagccaggagaatggcatgaacctgggaggcgggcttgcggtgagccgagatcgtgccactgtactccagcctgggcgactgagcgggactcagtgtcaaaaaaaaaaaaaaaaaagaaagaaaaagaaaaagaaaactattttgaaaagcagttatctctggcctggtgaagaacacaccagcaccatgcccaccaaaacaggagccccatggctgtttcccagagaaacctgggacccgcacgtccattcactgcaacacagactgaatctgcagccaagctccgctctctcactactgggaaccctcaggggggatcccttagcctaaatcagcaccagtcactacccgcacacgatgttattactactgttttcttatgagtcagcccgtgtcactgattcctgacgagctggtgtggagagcagaaatgaatgattttttttttaactgcaatttccttctcaccaaccagtcagcaatcggagctctaacagtaaaccgattgctcagttactccacgtgggtgccacgcaagaggctgggagtattgctcagcggggccaacgggagggtggcacttgcctaaaccgcttaagtgggggaatggaatgcccaccgaagggcagggcagggaccctgctgtcccgtcactgaagatattcccagcctgtggggagaagtgtaaaagaatgaatgaaagaaacgcacgtggtttctgggaccaatgaccttagcctagaactgccgggatggtccaggaacgtaaagatgtagagatgtgggagccaggggcgtagtgatgcaaggatgcagggacccagagactacgacctcccaacccccggcccgcgccccgtactcacgcacgcagaggcaggccacgagcttggctgcctcctcgggcaccgggcaggtggggaagagcggcttgagcaggtaggtggcgaagaccagggccacgatgtactgcgatgaaggccggatgatgagcagctcgatccagagcttgaggaaggcgggcagcgagccgtagacctccagcatgtaggcgtagtcgccgcccgatttggagatggtggtgccgagctccgcgtagcagagcgcgcccacgatggagaagacgccgcacgcggcccacaccaccagcgccagccccggcgagcctgcctccttgagcacgcccgtgggcgtcacgaagatgcccgagccgataatggtccccacgatgatggccacgccgttgagcagcgtgatgttccgctgcagggtcacgccctcgccctcgcctgccggcgccgagccgtccgcgctcttggcggccagcatcttctcccgcgcctcttccttctcctcggccgccggcgccgctagcgcgcgccgcttcgggcccgcacccgccatgctctgcgcaccggccgggcctgggacacccgggagccgcggcccagcgagcagtgtgcgcgccgcccgccgcccgcagctgcgtcaggaaccccgcccgcgccgccttttaggccccggcccgccggccccgcccaccgtccgcggctcctccccgccccgtggcccggccccgtccctcagccccgccccctcggcccagctcggagcacgtgcgtcgtccggcccagcctggcgggctattcccaggcccgcgtggtcctcgaaggccccagtcctcctgcgccatggagaccccggcctcgcgacctcccccctcccggcgcccgcgtcatcccagcccgtcctcccggatgcgcctgggcggggcctggcagtcagggcgcgccccttcacccactggcccgcagcctctcgtcaagcctgggagcgggcagtgcaccagggctggcctgaggccaaggatggagtttggggtaccccccgaagggaacctaggctcctgtcccggatgggccgaggggatggaaccgcccccacaaccagctcctggggcacgggggagggatgagaggatgacctgaggggaagctcctgcagcctccttccagcctgggggctgcatcagtggggctggtgagccgcgaactgggacgagggaagaaccgaaccgaggccacccagtaattcccattgtatcccaaaagaatcttgccaaagacggcgatccggtgcccgtagctttgagaagcagtaataacacaggctttgggaagccagcaatctgcctgagctcaatttaatcaacagaaccgggggttcgctgggagccataagacccccacccccaaatctacctggggaattcaaaggcaggcttcagtgtgaaggggctttaaagcttgttattcctagggaatgcgagaggcatcttagctaaaaagggttgagaggtaatttcagttagaggcgagagcaggatgccaaggctcctaggcctggaaatgggaaggaatataaatactgccccgagattgaccagactggtgagcggccaaagacctgttcaaagggtgtgtgtgggtcagggaggaagctcctcagtatcaccccaccccggggttccttggcgtgtgtgcaaacgagtccttggaagctcacagcaggcatgtggggaggcctttgttctgggtgagcgttcagcctcccagggcaaacacgcaaacaccggttgcagagctgggtgttcacagcaagacagtctgctgggcagatgcctctggaatccacagaattctgaacaatagccgtggtggaggggggtcagaatccctgtcgtgctgggacctctagctgcagccaggaatgtccaggccccaccccagggagggggcggctgaggaatgccagggcttgtcattctggaccttgctcgccccccggtatgtcgggcattcctctgcggtgataaaaccgagcgaaatctcagcagcccaggcagccacaggcgggggagtgcggaggtcacacagatactaacttgtaatctgccgtccacattgctggctgtggaaggtgcagagacccctccatctgccctattcttcccgctgtgcctgcagagggaaggagacagtaccaccatggctgggcaaactcaccgagtgctcactgagtcctcccctagacagcttcttatgcaatagggtaggtgccagttagagccattttgcaaataaggaagctgaggcttggtagggttacctcgcttgtccggccagcaagtagcctgggagctgtccttttgactctgaacttatatggtacttttaatcattccaccattcttctttgagtaacaagaaaggcaaccaacagtcataccccaaagcataaaattacaaccatgataagccaaggacatgacagggtgagccagcgacagcgacagggaccaggcaggtccagatagacttttctgaggtggtacctggagctgagagcccagggtgagtgagaattaataagggaggtgcaggggtccccaccggcacagagggggccctgcacagttggtgcaagtcatggttggtgcccccagagccaggctcctggcaagtgctggagcccttaagcaggaagggtgacaacagccatgagcgtgttcaagtcacacagctattacgccacctctgtcggtttttactgggttttcatatgacaacattctagatttatccagcaaatctactcctctcagacgtccctgatgccggccctgaaacgccttcgcctgaaagctatgactctagaatcttagcaaagagtgccatctgttggaaagattcggcagcgttttgatttttacagaggcaggacaatggtcttttcagctccagtcagtaatttatcacatgttgtgtattttcagaggttaaaaaaaagaaagaaagaaaagaaaaaaaagttgtggcactctcgcttgagctggttgggagaatactttcttttcttttttttttttttgaaacggagtctcactctgtcacccaggctggagtgcagtggcacagtctcaactcactgcaacctccgcctcccgggttcaagcaattctcctgcctcagcctccggagtagctgggattacaggcacccgccaccatgctcggctaattttttattttttgtatttttagtagaattggggttagccaggatggtcccaatctcctgatctcgtgatccgcccgcctcagcctcccaaagtgctgggattacaggcgtgagccaccacgcccagcgccctgcaggtcctttttaaggctgtttgcaacataaatgagacgaggcatcttctgcccccctcagagcgccagcgtggagttgagcaggccaccctctctcacaaggcgaacccgtcattattttgtcatttggagcaactgcaggggagcagcaaggccacagggcgaggggagagaacccggtggataatcctttgttttctaattatgagatgagtctcgcagtgcagggattgtggttttcatctcagcaaaatataggagtgaggtccggagcggatccttgctcttcctttcaactcgttctttttcccaggaaaacgacttacctggtaaaccctgtaaaccaaaaataaaattctaagggccaccccagacatctaaacagacttcctcctcagccagggctcttaacatttaacctgaaagactggtttgggccaggaagagaatcgggggttggacggcctctttagacctctccagcactaacaccaacacatacttgaagtctatcagacttaaagattaacattttacagcctgttctctttgaagcctcctagctaaaagcttcatctgcatgatacagctttcatctccacagcctcaccacaacccaaacattccttccttcctttctttctttctttctttctttctttctttctttctttctttctttctttcttccttccttccttccttccttccttccttccttccttccttccttcctttctttctctctctctctctctctctctctctttctctctttctctctttctttctttcttgtctcacttatcgcccaggctagagtgtggtggcgcgatctcggctcactgcaagctccgcctcctgggttcaagtgattctcctgcctcagcctccagagtagctgggactacaggcgcctgccaccacgcccggctaatttttttgtatttttagtacaaacggggtttcaccgtgttagtcaggatggtctccatctcctgacctcgtgatccgcccgccttggcctcccagagtgctgggattacaggtgtgagccactgtgcccggcctccaaacattgctttctactgatcccaggtcttttgtgtttttctttttttttttgagacagagtctcactgtcgccctggctggagtgcaatggcacgatcttggctcactgcaacctctgcctcccgggatcaagtgattctcctgcctcagcctcccgagtagctgggattacaggcacctgccaccacacctggctaatttttgtatttttagtagaggctgggttccaccaggttgaccacgctggtctcgaactcctggtgatctgcccacctcggcctcccaaagtgctgggattacaggcgtgagccaccatgctcggcaacaatcccaggtctttagacaacaaactcaaacaattgtcaaccagaaaatgtttaaattggttgggcgcggtggctcacacttgtaatcccagcgatttgggaactttgggaggccgaggcggggggatctcgaggtcatgagttaaagaccagcctggccaacatggtgaaaccccatctctactaaaaatataaacattggccgagtgcggtggctcatgcctgtaatcccagcactttgggaggccgaagcaggcagatcacttgaggtcaggagtttaagaccagcctggccaacatggtgaaaccccgtctctaccaaaaatacaaaaaaattagctgggcgtggtggtgggcgcctgtagtcccagctactcgggaggctgaggcaggagaatggcatgaacgtgggaggcggaggttgcagtgacgggagatcgcaccactgcactccagcctgggtgacaaagcgagactccgtctcaaaaaaaaaatatatatatatatatatatatatatacacacatatatatacacacatatatacacatatatacacacatatatatacacatatatacacacatatatatacatatatgtatatacacatatatacatatatacgtatatatacacatatatacacatatatatacacacacacacatatatatacacacacatatatatatataaacatcagctgggcgtgttggtgcaccgcctgtaatgggaggctgaggcaagagaatcgcttgaaaccagaaggcagaggttgcagtgaaccaagattgtgccactgcactccagcctgggtggaagagcgaaactcttgtctcaaaaaaaaaaaaaaagaaaatgtttacatttacctctagcctggaagcccccctcctgctttgagttgtcccgcctttctgaaccaaaccaatgtattttttaaatgtacttgattgatgtctcatgtctccttaaaatgtataagaccaagctgcaccccaaccaccttgggcacatgcggtccggacctcccgaggctgtgtcacgggtgcgccctcaaccttagcaaaatacgctttctaaattaaaggaggcctgtctcagatttgctggcttcacaacccttaattgaagtggggcttcctggggccgcctctctcctgtgagtcccctgccgggctggttctcagtcacaggggagaaatgcctgcatcttttaacatagcaagggtccttgcttcttctggaggttgtttttgaaagccatgcttttattatgctcagaggtgagcttttcctatctgcatgcttgacaaggtggggctgccctgagtacgatcagaaattccgttctgtttccaggcagataggtgtgtagggcagccactcagtcagtgttcggccttaaagactcttgccagtcaaggaagacgaccgaggcaagtctccgtcattttagctttaaatgccaacattagggacgcgcacctgagagactggtctatgcctttctccgaagatgattttgagggcttcaatattgaaagggggaagggcaggatattgggcagtacacaattttcatgtgaagggggtaggggaaaattcaagtttttgtctggtttagtgactctgccgtttcacgtaagataccctagacgatagggcagcggaaacaatgagatatgcatttgcttcaggtgggcggagggatgactcagttctgcccctcgtcccagcacctgtgaagataagctaacggttcacattgccagggtgaactttaacagaagcgcttagggtaaagatcttggagcccacaaggaatttccttatgggcaaaatgtgagggaggtgtgtcgcttttcatctttttttttttttttttttgagacggagtctcactctgtcaccaggctggagtgtagtgggtcgatctcagctcactgcaacctctgcctcccgggttcaactgattcttctgcctcagtctcccaagtagctgggattacaggcgcctgccaccatgcccggctaagttttgcagttttagtagggacggggtttcatcatgttggccaggcgggtctggaattcctaacctcaagtgatccacccgccttggcctcccaaagtgctgggattacaggggtgagccaccaagcccagccaaacttttcatctctgtagctgtttgttaaataattaggagccgaaacaggaggctggttcccatgacacggtcaccagcttcacttttccctttcgttagcaagtgtggggtcccaggatttatgttcctttcacactctctatgccatttaatttttgcagcaactatagttagttgtcatttatggttggagaaaaagggcagttcagtaagtggccaagcccagcttcagacccagggcaggcctttaatcctcgtggcaatgctgactgccacgctgatggcgccacttacataggcagccagattcataagcatgcggattctcccagttaaaagagaattttggccgggggcggtggctcacgcctgtaatcccagcactttgggaggctgaggtgggcagatcacaaggtcaagagttcaagaccagcctggccaacatggtgaaactccgtctctaccaaaaatacaaaaattagcctggcgcagtggcaggcacctgtaatcccagctactcgggaggctgaggcaggagaattgcttgaacccagcaggcagaggttgcagtgagccaagattgtgccactgcactccagcctgggcaacacactgagaatccatctaacaacaaaaaaaagagaacttcatttcagctgcccctggtggcaccttgaaagcctcattgcctcttcactggaaacatccaccattcttgttaaagaaaagacactcatgactttccttcaccgaatccttctagcttctgtttgaacacttgggtagtccccccacccgtttcctgaagttcgtatgggggaacggtaaacagtgtccatgcctgcaagtaaaatccgaagccctgcgattgctcagtaacagctaggagcaaggttagggattgtagggccagattttttgcttaggttcaactaggtaaaataaaaatagactttgcatgcatttcaggcactgggctgatgaccggccaccagggaggctccgccccacttcttaactttggccccaacgttagtcttgttgctgctctcagatgtgctctgcgtgtcaaagatgacttggaggctgggcgctgtggctcatgcctgtaatgccagccctttgggagaccaaggtgggagaatttcttgagcccaggagttcaagaccagcctggacaacatagggagaccccgtctctacaaaaaatacaaaaactagcccagcgtggtggtggtgcacctgtagttccagctgccggggaggctgaggtagaaggatcacctgagatcaggaaggttgaggctgctgtgagctgagatcatgccactgcactccagcctaggcgacagagcgagaccggtctttttttttttttgagacggagtctcgctctgtcacccaggctggagtgcagtggcgcgatctcggctcactgcaaactctgcctcccgggttcacgccattctcctgcttcagcctcctgagtagctgggactacaggtgcccgccaccatgcctggctaattttttgtatttttagtagagacggggtttcaccgtgttagccaggatggtcttgatctcctgacctcgtgatccaccctcctcggcctcccaaagtgctgggattacaggcttgagccaccgcgcctggcgagactggtcttgaaaaaaaaaaaaaaaagatgacatggaagcaacagtaggagccggggtcagagttcaggcccgtccatccgtggatgatggataaacccagtgtagtccgccatcccttggagcgtcattcagccgcacacaggaagacacgctgcaacgtgcaggacccctgaaaacactgggctgcgtgaaagggtcagtgaccacgagttgtatgattccgagtgcacgaatgtccaggacaggcggatccagagagatggacgagattcgtggctgcttagggcggggggaaggggtgatggagagtgagggctgagtggatggggtctctctttggggtgataaaatgtcttggaactagatgatggggatggttgcccaacactgggagtgacttaaacaccacggatttgtacgtgtttaaatgactaacggttaatgtgatgttatgtgtgaactatacatccaaaagataaaagcagttcaggcctggaatcgaacggtcctgggttcacatctcacctctaccacttggtggcaccaggcgagtgactcggctcagctttcgaagtctcagtttcctcttctgtgaagcagggagacacctgtgcctgcctcctggggaccagcaggtagaagaccctgagccgctggcattgccatcactgcagaactgtgctcccaagaccagccagtggaggaccctgaggtactgctgtgtccctgtcactgcagaactgtgctcccagggctggcggatggaggaccctgagccgctggtgtcatcctcactgcagaactgtgctcccggggccagcaggtggaggaccctgagctgctggtgttgccatcactgcagaactgtgctcccagggccggccgaatgcctggcttccaccctcagactttctttccaatgtgggcgaagggaacacggagggacagcggtcgcagcagcccacacttgctgtgtcgggcgtggtctcagtggctggagtgtgaagatggaggcggggatgggagtgggcggccctgagtcaagggacacctgtagcccccagaagctggaagaggcaggaggggtcctggagcctcccgagggagcctggccctgccaccaccttgaagttggcctctggcctccaggactgtgagagaacaaaagggctgttgtcttaagcccctgtttgcggacaaagggaataatctcaacattgaaaaaatatggccttaatctttagtgctgtaggtggcaaacttaccttcaggatggcagagacagatctttttttcctgttgacaggcattctaacatttccagagacacgggagccaggttctcctgctgggcctctgcactatgagccaaacctgcctattgttaagtgattgaatgagttgacgctcaccttgaactttcttccactctgccctggattacaagaagaattcattgctcagcccatgtcccagcatgaggctggaagcagctgtgaattttgtagagcctggagggccctgcactctttgcagctgccagcttcagcgctgctctcttcggccactttgccccgcctctgttttgggcagtggctgcagggcagatgccacccaaccaggtcaaatttccctgtgaggatggaagtttgtaggttataattcagttctccatcttggaaaatatccaggtggatattgtttaccaccaaaacaatgacttctatcgcgtgagcccgaaaaccaggctgatgcgtgctacggcatgcgtgcgtggtgcctgctccatgtgtgaactgtgtctgttccatgtgtgaaccgtgtctgttccatgtgtgaactgtgtctgttccatgtgtgatccatgctgctccatatgtgttccatgctgctccatgtgtgaaccatgtctgttccatgtgtgattcatgctgctccgtgtgtgatccatgctgctccatgtgggaaccatgtctgttccatgtgtgaaccatgtctgttccatgtgtgaaccgtgtctgttccatgtgtgaaccgtgtctgttccatgtgtgattcatgctgctccatgtgtgatccatgctgctccatgtgggaaccatgtctgttccatgtgtgaaccatgtctgttccatgtgtgaaccatgtctgttccatgtgtgaaccgtgtctgttccatgtgtgatccatgctgctccacatgtgaaccatgtcttttccatgtgtgaaccatgtctgctccatgtgtgatccatgctcttccatgtgtgaaccgtgtctattccatgtgagatccatgctgctccatgtgtgaaccgtgtctgttccatgtgtgatctgtgtctgttccatgtatggtccatgctgctccatgtgtgaactgtgtctgttccatgtgtgaactgtgtctgttccatgtgtgagccatgtctgttccatgtgtgatccatgtctgctccatgtctgatcacacctgctccctgtcactcattttgtctagacttctcaatgatgacagcccccagttacccagatttaaggtagtttctaaatatttgtagccagatccatctagtatcctgcaattcattcattgactcagcaaacatttcacgatagctagacatacgcctggctttgtgagaatgtgtgtccgtatgacaccccagcctgcgggtgaccctttcatgtgcacccctgtgataacaggggatgtgcaggagcccaggtgcggggggaggggatgctgctgcctggggctggcactgacgaaggtgtggtggagaggaggggctgcgctgggccttggcagagaggagaaagtgcatctagcagagcagggaggacagcccaggagagggagcagcgcctagaggacctgcggcagcgcacagcagtccccgagcttacaagtgggagcactgcagcccatggcgcccgaccacgtttattgtgtgctgtgggcaagcagaacagttgaggatcccgcccctgggggctcacattccagagggggatgcaagcatcatgcagcaacacgtgcctgatgccaacagctggggaggggacacagggagaccgtggttggggcaggtgtctgagaactggttgaggatggaaaggagtgactgtgaagcagccttggggacagcaaccccagccagaggcccacacacacaaggtgacgtggaagagggccaggctgcgaatcttgctgggagaagctcgtgctcattcccaagcctagtggaaagcctcagttttgaacagggcagcagaatggccaagtgtcggtttctcaaaaaaacccactgttaaaagaaaaatggatttgggggaagaggggaagaggctggaaagaaagtggctaaactggaaggccagcttgtcactcaggctgcagcagaagggacagagaaaagtggacagacttggaataggcggcagtttgagggtcctccagcagagcctgctgctgccctgggtgcaaggagtgaggggagaggaggtcccaagggggctcccgagattgcctgtggcgtcgggtggatggaggaaccatttatcaagacggggttggtgggcacagagttggggacgcagcagtgcacggacagcccacctttcagcaggagggacaagtgtcaaaaaatgacacttactgctccgttaacggagtaatggagcagacactccgttactgctgggcaccgctgtgtgccaggtgccatctgggggctcagctcaggccgaggaaacaggaggagcaggtgttgagcaggtggtatggggcgggcggggaagggtgccctcaggtccatcagaacagccacaagagccctggggtgggagggggccgatattctggtcggcacagagtgggctgccaggagagggcgggggcggaggggcaggaatgtggattctgtcccaagggggcaaggctgaggggatgtagctgggcacatggtctgctctgaattgagcttggttctctagagggtcgatgggaaggacgtgctggggatggggaggaagcggaggaggaggaggcggtggcagctgggaacaggcaatgcttctcacacaggcgtatctttattaaacaagaaaataagataaaagcaaagggaggaagccttgaaccttaaaagctgggccagaaattctacaatacaatcagaagccacaatctggtcacagtgagagcccttcccgcagagccgcagacaccggccgctgcccctggggcgggagggaagcctcctgtttgttttttgtcccgttgctttgagggctggaatcaatgtcttttcctctcggcgtgtttgtggtttcatctcagtgtgtccaggctcggatggcttcccgggagtatctccgtgtctcaggattagcaccagtttttaaaaataactgacaaaggccatttttcaggagacaaagatgttggtgggtgcagagggccccctgtgtgttgatacggaaaatgaaggtcagccactccctgcttctcttggtgtcttgttggacacgatgtcaacatggggccggtagaactggagcccagggcccctctggccgcttgggcctttctctgtccccaagcccacctggaaatgggcagcccatggagaatggctgaatagctgctctctgcccccatcccaagccccaggttcagagaccaccccctccattgactgtgtcaccccttccccagcagaggagcgggctgttctcagagcgctgcaggaagcccagacaagtgccttcctctggctgctgcttccatcagcgtgaactgcccggcattgtaggataagttttctcctgggttttaaggttcaggactttctctctttgctgcgctttttccttgactgattgcacaaatcagagaaggcaagagtgaaatgctgcgtatcccttggcctagcgggtcagcgacaactttcttaacttctcaagtgagcctcagtttccttattaaaaaccagggacgattttgtggaacttgtcgcaactcaatgggagtgccgtggcccttacgcccaacgacaccatcctgtcacttcgggagtttttcctaaaacaccattccccagaccaacggcgctgcgagcttctggggcgtgggctgggcccaacatgtcagtgcgacccacagcggggctggagctgctgaatgtgcacaacacacttcacccgggcctggttcaggagcgggcgaggcagccgtacaccctgtccttcagcagactcctcttgatcgatggaatcgaagtcaggcgcagcagcttagagcagaacagaaacgtgcccatttccccgcttggtgctttcccgcttccacttcgactccttcaacccaatcctctttcacccgcatcgccaccaagtgtgatctcctttaaagagccagacgctttattttgggggggcgtggaggggtggagtctcactctgttgcccaggctagagggcagtggcacaatctcagctcactgcgacctccacctcctgggttcaagcgatttctggctagattttgttttgttttgttttgagacggagtctcgctctgtcgcccaggctggagtgcggtggccaccatctcggctcactgcaagctctgcctcccaggttcaagcaattctcctgcctcagcctccacagtagctgggattataggtgcgtgccaacacgcccggctgatttttctttgtatttttagaagagacagggtttcacaatattgcccaggctcgtctcaaactcctgacctcatgatctgcccacctcagccttccaaagtgctgggattacaggcgtgagccaccgcgcctagccttagtttttttttttttttctttttgagatggagtctcactctgttgcccaggctggagtacagtggcacgatctcggctcactgaaacctccacctcctgggttcaagcaattctccctgcctcagtctcccgagtcgctgggactacaggtacacaccagcacacccggctagttttttgtatttttagtagagacggggtttcaccgtgttagccaggatggtcttgatctcctgacctcatgatctacctgcctcagccttccaaagtgctgggattacaggcgtgagccaccgcacccggcctacttttcgtatttttttttttttggaggcggagtctcgctctgttgcccagactggagtgcagtggcacaatcttggctcattgcaacgtctgcatcctgggttcaagcaattctcctgcctcagcctcccaagtagctgggattacaggtgcctgccaccacgcccagcgaattttttgcatttttttttagtagagacggggcttcaccgttttgcccaggctggtctcgaactcctgacctcaggtgatctgcccacctcagcctcccaaagtgctgggattgcaggcgtgagccaccgcgcctgacctaacctacttattctttatctccccggaatgaaatggcctttatcaccttgggaaacagattagcatctgcttatttttctgtgctcatctgactgtaaggtaatgttggaagataatgtaattaggtttattgtaaaactttctctcttctggcgggaatattttttaatgctatgaaaataaaaatactgggccaggcgcggtggctcatgcctgtaatcccagcactttggggggccaaggtaggcagatcacctgaggtcaggagttcgagaccagcctgaccaacatggtgaaaccgaatctctactaaaaatgcaaaaaaaaaaaaaaaaaaaaaaaagactgggcacagtggctcgcgtctgtaatcccagcactttgggaggctgaggcgggcagatcacctgaggttgagagtttgagaccagcctgaccaacatggagaaaccccgtctctcgtaaaaatacaaaattagccaggcgtggtggcccatgcctgtaatctcagctaattgggaggctgaggcaggagaatcacttgaacctgggaggcagaggttgtggtgaaccaagatcgcatcaatgcactccagcctaggcgacaagagcaaaactctgtctcaaaaaaaaaaaaaaaaattcgctgggcgtggtggcgggcacctgtaatcccagctactccggaggctgaggcaggagaattgtttgaacccgggaggcagaggttgcagtgagctgagatcgtgacattgcactctagcctgggcaacagagctacactccatctaaaaaaaaggaaaagaaaaacactgtactgattttggattttttccaagcaagtaataggtaaaaagaaacccaaactggcttacatgaaagggcacctattggcttgtgtaactgatcaggtgcaaccattgctataagcttgatccagacccgactcagtgactcatgccagtaatctcagcagtttgggaggacgaggcaggcggatcacctgaggtcgggagatcgagaccagcctgaccaacatggagaaaccccgtctctactaaaaatacaaaattagccaggcacggtggtgtatgcctgtaatcccagctacttgtgaggctgaggcaggagaatcacctgaacccgggaggtgaaggttgcagtgagccaagattgcgccactgcactccagcctgggtgacaaagcaagactccatctcaaaaacaaaacaaaacaaaacaaaacaaaacaacaacaacaacaaaaaaaagagggtgaaaggcagccccagagtgggagaagagatttgtaaaatggacaaaggccttataattggaatatataaagaactcctaaaaatcaataagaaaaccacagacagcccaagagaaaaatgggcaaatggctcaagcaggtatctggtgaaagaggatatgcagacggccaatgaatctgcacaaagtgctccacgtcatgaatcattagggaagtgcaaattaaatccacaggagacacctgggcacaccctccagaaagcacacaatgacctgctggcaaggacaggaatgaccactttggaaaactctttggcagcacagccgaactgagcctctccacttgaaaatgccctttgctcagaacccagcagcagctccaaagtctccacccagcctgtggggccccagtacccacccttgcctcccatgcctctctcctcacccctgcacttggctgccctcaccctcgggctgcaccttgaacaccagaagggcgctcctgcctccagcctctgcctggaattctctgcccttgggtagccacgtggttcactcctcctttggtctctgcccaaatggcccctgtagaagagacctccccacccagccatgtcctcttcctgtgacttaccactccagactttctgtgtggatgcatcatggtctacctccttccatcagaatgtgagctccgaggcaaaggctcttcagaccttaaacagtctaggctccgtccccagagtctagaatagagcctgccacgtaattggcactcaataaatgttacatgaattaatggaaaccatcctggcacgagtggtagctctctttcctccaaaagaatgagcttgccgagagagacaacatcatgaaagagagacagaaaagccacactcagacccaacattgagttctggatcaagtttttttttttttttttttttttgagacaaagtttcgctcttgtttcccaggctggaatgcaatggcgcgatctcggctcactacaacctccgcctcacgggttcaagcaattctcctgcctcagcctcccgagtagctgggattacaggcatgcaccaccaagctcggctaattttgtatttttagtagagatggggtttctccatgttggtcaggctagtctggaacttggcctccgaaagtgctgggtttacaggcgtgagccacagcgcccagctcctgttattttttaggagctttattgttttacctttcctgtttagatctataatctgtcaggaattaatttttgtgtgtgctgtgaggtaggggtgtgaggtatggtgagaaaaaagattcatggttccccatttggatatcccgttggctcggtggggtggctaatgcctgtaatcccagcactttgggaggtcaaggcaggagaactattggagcccaggagttcaggaccaacctgggcaacatagtgagaccccatggatcgactgatgaattgatcgatcaatcaatagatagatcaatcaatagatatccaaatgatccaaaactattcacagaagagcccatccattccctacagcatgagtcagggatcacaaatgtgtggaaccttctagacacgctattctttttcattggttgatttgtccttctctgacaggtaccacattatcttaattaatatagctttttatttttatttatttatttattttgagatggagtctcgctctgtcaccctggctggagtgcagtggcatgatctcggctcactgcaagctctgcctcccgggttcaagcgattctcctgcctcagtctcctgagtagctgggattacaggcatgagccaccacacctagctcatttttgtatttttagcagagacggggtttcgccatgttggtcaggctggtgtcgaacttctgacctcaggtggtcttcccgcctcggcctcccaaagtgctgggattacaggcatgagccactgcacctggcctactacagcttttgaagtaggtcttgacatcaaattgtgtatgttttctggttttatcctgccagattatttttggttgtatttttggtagagacggggtttcaccatgttggccaggctggtctcaaactcctgacctcaagtgatctgcctgccttggcctcccaaagtgctgggattacaggcgtgaaccacggtgcctggcctcacaagaattcctttttactttgagacagagttttgctcttgttgcccacgctggagtgcaatagtgtgatcttggctcactgcaacctctgcctcccgggttcaagcaattcttctgcctcagcctcccaagtagctgggattacagacatgcagcaccacacccagctaatttttgtgttttttatagagatggggtttcaccgtgttggccaggatggtctcgatctcctgacctcgtgatccgcccgcctcggcctcccaaagtgctgggattaaaggcatgaggcaatgcaccccgccagttcttacaaggaggaggcagaagctggaaaggcaaggaaaaagatcctgccctagagcctcagaaggaagcagccgtgaggacaccttggtgtcgggcttctggctcactgaaccgtaagagaatcaatctccattgttttaatccaccaagtttgtggtacttcgttacagtgaaactaagcaccctgcacttgcgttgggtgccatggcacacccctccatcccagcgttatgttccccacggtacttacacatctttctttcacttgcagctgaaaagtacttcgactaaaacaataacctcatgctctctttttaatttcagaagtcatgtacaatcacattgtgaaacttgggaaacaacgcttccttccttcaaagtcagttctgctattcatgtggacctaatgtctctaggaccttgtgccctcattagtggcctggaaggacgcccagaccttccggttcatcaagggttgaagtgggcgatagttgttcaccatcatcttctcctcttcaccaagtgcagaaaacaggagagtacgaaatgcagagagctggaatagagggcagccagggtgagcttggtatgagtgcagggtgagccagcctctgggtgtccctcaggccttatgtggtcccctcccatgctgaatcaggatggcccgaaatgatcaataaatatggtggaagtgatggtgtgtgcagggccagattataaaaggcattgccgcttccgccttggtctttaggatcacttgctctggggggaagctggtcgccatattgggagggtactcaagcagccccgaggagaggcccatagggagaggaactgaggctcccagcgaactgccagcaccaacttgctagctactcgagagggccaaccttggaatgaatcctctagccctagttgagctttcagattgctacagtcccagctgacactgggctacaattcatgaaagatggtaagccagagccacccaaattcacaacccaaggaaactatgggagataataaatgattggtttttgttgttgttgtttgagacagtgtttcgctcttgtttcccaggctggagtgtcattggcgagatctcagctcgctgcaacctccgcctcccaggttcaagcgattctcctgcctcggcctcctgagtagttggaattacaggcacaagccaccacgcccggctaatttttttttttttttttgagatggagtttcgctcctgttgcccagactggagtgcaatggtgtgatctttgctcaccgcaacttctgcctcctgggttcaagggattctcctgcctcagcctcctgagtagctgggcttacaggcatgcaccaccatgcccagttaattttgtatttttagtagagatggggtttctccatgttggtcaggctgctctcaaactcctgacctcaggttatccacctgcctcggcctcccaaagtactgggattataggcgtttagccactgtgctaggcctaattttgtatttttagtagagacagggtttcaccatgttggtcaggctggtcttgaactcctgacctcaggtgatcgacttgcctaggcccccaaagtgctgggattacaggcatgagctactgcacccggctcaaatgattgttttctaaagccactatgttttggagctatttgttacacagcaatagataactaacacctataatgtaaatgctaaagtaacatttgaatttacttttcactgaaggaactaaaagactactttttatggctggatgtggtgcctcacgcctgtaatcccagcactttgggaggccgaggtgggtgaatcacctgaggtcaggagtttgagaccagcctggccaacatggagaaaccctgtttctactaaaaatacaaaattagccaggtgtggtggctcatgcttgtaatccagctacttgggagggtgaggcaggagaagctctttaacctgggaggcggagcttgtggtgagcgagatcacgccattgcactccagcccgggcaagaagagggaaactccatctcaaaaaaaaataataaaataaaaaataaaaaaagactttttatgtattatctcacttgttcacagaatatacttatgaaccctgtgaggcaactcacgcatttgattacattcagaagtgagattatgtctacatgctgacagcatactggtccagttagccctgcgtgatgatgcagcgccccctagagttgcgcgcatggtgcacgtggcctcctgggccgtgaccacggtgtgctcatccacatttgtggtctgcacatttgttgactgtgcagcctttctcctcccctggaaaactccccgccttccaggacatgtgcctccctggctcccctgctcaggataaggggctcctgccctgcatttttatatgacaccggccaccctggcttaatactattggcttcgtttctactttcctgccatacagcagtgttctgagacgaatgccctgttcctgtaccgcccctccacacctgcccccctcccaccctctcttggtggcacagacccagaatgggcacttgtcacatatatgcttgttgagtggcataagggccttgctgacaaggggccaccttcaacaaaagccttccccgtttgtatataagggaatattttcacaggcccgggagactgaaagaccctctaagagctcacctggagccctcggaaagagatgagccagagatgctaagtcgcgctgcgactgctgagaaacgtctgccgggcgggggcggggcataggcagcacgtctgtggctctgaactgccttggacagacagaattgctacagattcttaagatttccagaaaaaaatgatagtataacttttatttattttttattttatttttttgaggcagagtgtcactctgtcacccaggttggagtgcagtggtgccatctcagctcactgcaacctccgccttccaggttcaagtgattctcctacctcagcctcccaagtagctgggattacaggcaaacgccaccatgcctggctaatttttgtatttttatttatttatttatttgagatggagttttgctcttgttgtccaggctggagtgcagtggcgtgatctcagctcactgcagcctctgcctcccggcttcaagttattctcttgccccagcctcccaagtagctgatattacaggcatgcaccaccacgcctggctaattttgtagatttagtagagacggggtttcaccatgttggtcaggctggtctcgaactcctggcctcaagtgatctggctgccttggcctctttaagtcctaaaattatgggcatgagccatgacgcccagcccaagagtataactttaaaaagtgtatacaaatattattaattaattttcgaaaaaaaaaaaagcaatgaaactatttagataagaaaaaggaggccgggctcggtggcttatgcctggaatcccagcgctttgggaggccaaggtgggcagatcacctgaggtcaagagttcaagaccagcctggccaacatggtgaaactccgtctctactaaaaatacaaaaattagccaggcgtggtgatgggtgcctgtaatcccagctatttgggaggctgaggcaggagaatcgcttgaacccaggaggtggaggttgtagtgagccgagatcgcaccactgcactccagcctgggcgatagaacgagactctgtctcaaaaaaaaaaaaggaaagaaaagaaaaaggaagaaaacaaaaaccatgcagacccatgaccctgggacaactcccatggatgcctcgtgtgtctgtgtgtgatagattagggcgttgctcaggacatgcttgctgtgatcactggaaccgctgtccaatctcaacaagctcctacttcagttggaattttcttcttgtgtaagaatgccccaaatgcatgaaagaatatatataactccacaacgctctcatgcagcatcttagtgacgctgccaagcaagagggacgccttccatgaagcgccatcgtgccagttacgggcacggctcacctggcttggggccacttcaacgggctccttctggatgatccaggtgaccgactcggtcagcggcggggtggtgagcgagcccgcgtaggtccagtaatcccagcaggtgggcagcagagtggaggggtcgaaggggcgcatggccgcccgcgcgtcctgagagaccgagaagcacaggacgtgtcagtcctcaggggagactaggagcttccatcttgtctcagcacgtgaggccttcatggtgcttggaaggaagtgctttcccccagataaggccatgaggccactgctgtcacacttgcaagcagtgatgagaaaatgtgacccttctatacagagcaaggattcctgccaacttacattggtgggaattacgttacattacaccagcttacgttggtgctcacatttttccttttgaagtcatttcttggggcgcagtagctcacccctgtaatctcagcactttgggaggccgaggcgggtgcatcacttgaggtcaggagttcgagaccagcctggtcaacgtggtgaaaccctgtctctactaaaaatacaaaaattatccagatgtggtggtgggcgcctgtagtcccagctactcaggaggctgaggcaggagaatcgcttgagcccaggaggcagaggttgcagtgagccgagatcatgccactgcactccagcctgggcaacagagtgagactctgtctcaaataataataataataataataataataataataataataataataaattaattaataataaaaataaaaataaagccatttcttttagcataccttggctgcaaaaaatattactttttattgtgataaaatatacataacataaaatttaccatcttaaccttttttttttttttttcgagatggagttttgctcttgttgcccaggctggagtgcaatggtgtgatcttggctcaccgcaacctctgcctcccaggttcaagcgattctcctgcctcagcctccagcgcctgccaccacgcccagctaatttttgtatttttagtagagacagggtctcaccatgttagccaggctggtcttgaactcctgacctcggatgatccacccgccttggcctcccaaagtgctggggtgagccactgtgcccggcctatgggctcctttttaaggagggagtcatggtggccaagaaggatgtccacatgcctaagcacccggagatggcagacaagaatgtgcccaaccttcatgtcacgaaggccatgcagtctctcaagccccgaggctgcctgaaggaacagtttgcctagagacatttctttctttcttcctttctttctttctttctttcttttttttttcagacagagtctccaggctggagtgcagtggtgcgatctcagctcactgcagcctctgcttcctgggttccagcgatcctcctgcctcagcctccctagtagctgggactacatcttcacgccatcgcgaccagctaattttttatatttttagtagagacggggtttcaccatattagtcaggatggtctcgatctcctgacctcgtgatctgcccacctcggcctcccaaagtgttgggattacaggcgtgagccaccacgcccggcttgcctggagacatttctactgctaccttaccaatgagggcatccagtatctccgtgattaccttcatctgtccctggaaactgtgcctgccaccctatgctgcagccgtccagggactggcaggcctcggcctaaaggtctggagggtgggcgacctgcaagactcacaagaggggaagctgacagacatacctacagacggagtgctgtgcccctggtgccgacaagatagccgaggctcgggctgggtcagcaaccgaattccagtttaaaggcagatttggtcgtggacatggccagctacctcagtaaaatcagagaggattattttgcattgaatacactcacagccaaaaaacaaaaagagtcagggtcttactttgtcacccaggcaggagtgcaatgatgccatcatagctcactgcaggctctaattcctgggctcaagcgatccccccgcctcagtttcccaagtagctaggacaccacaccagggtttaaaattaattgtttgtagccagggggtcttgccatcttgcccaagctgttctccaactcctgggctcaagcgatcctcctgccttggcttctcaaaatattgggattacaggcataagccactgtgcccagccagctcttttggatatatacccagaagtgtgtgattgctgaatcatagggtagttctatttataactttttattttttttattttttttgaggcagagtctcactctgtcttccaggctggagtgccgtggcatgatctcagctcacggtggttgggcctggccgcaacacagccctcatcagcgtcccatgccaaccaagcatagctctgcacctgcccctggccagcactgtgggacaagagtccagtccaaagtgacagagtccctgtctgcaaggaagatggcctccctgctcagccacatcacatcaccttgactttgctgggccctggccttccaaggtggaagctggcaacccagatgccttgggcttgtctcctaacatcaagcagtgagggtcagggtcaagagaggtggctgagctaccagaaggaagcccgggagtgtccacactggcagacacatgcatcagttctatgcacgcatgttcacgtttataattatccagttaattaaaaaaaaaaaaacagcattataggctgggcacagtggctcatgcctgtaatcgcagcattttgggaggccaaggcaggcagatcacctgaagtcaggagttcaagaccagcctgaccaacatggcgaaaccccatctctactaaaaatacaaaaattagccaggcatggtggcaggtgcctgtcatcgcagctgctcgggagactgagacacaggaactgctttggcacaggatgcagaggttgcagtgagccgagatggcaccattgcactccagcctgggcaacagagagagagactctgtctcaaacaacagcagcagcagcaaaacccacagcattattgtgatagaattcacataccatgcaactctcccatctaaagtgtacagcctggttgggcgcaatggatcatgtctgtaatcccagcactttgggaggccgatgtgggaggactgcttgaggccaggagtttgagaccagcctaagcaacataacgagaccctgactctacaaaaaatacaaaaactagccaggtgcagtggtgcacgcctgtggtcccaggtagttgggaggctgaggtgggaggatggcttgagccccggaggttgaggctgcagtgagctgtgatcataccactgcactctagcctcggtgacggagtgagatcctttcttaaaataagtaaataggctgggcacggtggctcacgcctgtaatcccagcactttgggaggccgaggcggatggatcacctgaggtcaggagttcgagaccagcctgaccaacatggcgaaaccatgtctctactaaaaatacaaaattagccaggcgtggtggcgcatgcctgtaatcccagctactcgggaggctgaggcaggagaatcacttaaacccgggaggcagaggttgcagtgagctgagctcatgccattgcactccagcctgggcaacaagagtgaaactccatctcaaaaagaaaacaaaaaacaaaaaacaaaaaaagtaaataaaaattgaagggtacagttctatggttttgggtatattcacagttgtgcagccatcccaagtcaattttagaacttccacctcaagggggaagcttggtactttttagctatggtccccacccccgccctgctgcttctgtctctgtgggtttcataggaactgagtcatgtaacatgtggaacatttgtgtcttgtgtctctcactcagcacggcgcttttgaggctcacccacaccgcagcatgagttagagctgtgtcctttctgattgccaagtaatatctcactgcatggtctagctgggttgacatcccattgcacgctctagctgggctgtgaaggagcagactgcttgtgcatgtgggtaacaggcgggtgtgcagtgagacatcagtctggtgcacgtgggtaacaggcgggtgtgcagtgagacgtccgtctcctcctgcctgccacacatccccagggcacagatgtgccagtcactttctgagcaactacttcaaatcttcagaacaaccctttgagaagtatttctagtttactgatgaagatagacagacagatataaaaaacttgcccaaagccacgttgccagtcagggccactgaggcctggcccgttccgaggtgcgggctcttccttccctccccaaggctgcaggaatcagtcaggggagtggcaggctccagccatgccactgcgggtaggtttcttgccaattaagctttctgccttgggctgagaagaggatgcctgtgtgttgcctcatcgtccccaggagttcctgtcctgtctctaagatgcatgagggctggagcagccatgtggttacagaaaactgctccccctcagggcccccaaagcaaatcagggcccttcctttatgcatgtggtgatcctcaggcagctagaatgggacaccggtgagcacaccaatgaggctgaagaccatcacatccattatctgagcacggatggcccagctacctgtggaaagcaccacaagcctttgctggtggaagtgggttggtgacttgttccacttttcttttatttatttattgtttttgagacagagtttcactcttgttgctcaggctggagtgcaatggcacgatctcggctcaccacaacctccaccgcccaggttcaagcgattctcctgccttagcctccctagtagctgggattacacgcatgcgccatcacgcctggctacttttctgtttttaatagagatggggtttctctatgttggtcaggctcgtctcaaactcctgacctcaggtgatccgcccgcctcagcctcccacagtgctgggattataggcgtgagccacgctctgttcctggttttgtcttctttctcttaaacaggaccccacattttatgagcgtcaagccccacccagcctaactccgcccttgctttgtcctcttagagtctcagtttccccaggtgtacgacaggcagtgtggtggcggtaatgggcttccatcagtgcctgccacgtgggcgtggggctcagtaggtgctgccgctgctgctgccaaagctagaagagcccccacagggcacagagccgttccctggatcccctggacctggtgggctgtttccacctccacaaggcagccaattccccggtagctctgactgttgcgaaggcagggaggaggggggaccccagcagcctgaggagcttgcggcttgtccaggcatggagggtggggaccctctgtgggcagtttttgccaaaacttctggctatggtgagagggtcaaaggcgaagccttgaggtctccattctggaattgtctgcccggggtcaccaggaccacactggggctgtgcctgcgtgctgggagctgagtgcatagtgacaggtcggcactggtaggggcctgtgcagatgggatggtgctgggggtgggggtgggggtccaggcttccaggcagcgcctgatgtggttttggttacagacactgcctgtgtttccctctaagctgctgaaaagctcagaaatgtgcagcaggggctggagctcagcctgggttctgactgcatgcgggaggtgggcgccaggatgactgggacttcaggctgcgtggacccacttcctgggtttaaaaacgggctcttcacctgccagctgtgtgctcgggcaaggccttctctgcctctctgagctttggttttcctgtgtgtgcaagacagatgaatcacaggccctgccccgtggagtgattggaagattcagtgtgataatttatgtggagggctgtcgcttctttgaaccccttccgccgaggtgtagggtgatgtccccttgccctgagcctgggcaggtgctcctgacgggagtggtaaacaggatgccgcaggagcagtgctttgtgactctggaagccagggcagaaaaggacatcgtgtccatctggctctttctggaaatgcacccttggagccctgagcactgcatagaagccagctgggtccccagggagtgaccgtggcaggcattcctggagggtctctgccgagtcagtcccacagcagggcccggaccagcctggaaccaggagagatgatggggactacgtgactctggtctttcctgccctaattcaggacaacttgttccttaactggaggaaaccaggaaagcagcccagaagctgcaggtgagcccgtccctgggtgagaactgctgagtccgcgggggagtggcagagctgggatttgaagccaaggccatctgcccttgagcctgaggccaccatggccctgtcctgccctgcactgcccaccaatcaggaattagattcaaccacacttctagcattttccatcacaaggccatcattctaaaatttcatgggctcccagaaggtaatagctctctctgggaatcacctgacagaaagcacccgcagcaacaaaaagcgattttaaccttagtgattgggctggtggattttcgtttcgtgacgggcagcagcagcctgtgccttccacagcagacttgagtgtgtgagtgttggccacagctgggccttaaactcaactgcacatttcaccaagaaccagacatgctccttattccattacatggtgagaatgctgctctagtgtggattttttttttttttttttttttggagacggattctcgagctgtcacccagactggagtgcagtggcacgatctcggctcactgcaacctccgtctcctgggttcaagcgattctcctgcctcagcctcctgagtagctgggattacaggagtgtgccacgatacccagctaatttttgtatttttagtagagacggggttttgccatgttggccaggctggtcttgaactcctgacctcaggtgatctattcacctcagtctccctaagtgctggggttacatgtgtgagccaccatacctgggctactgtggatgtttaatatctccatttcacaggcgaggaagctgaggctcagaggtgcgcagctcaggagtggtggatctgggctctgaacccaggagtccaactgtggggctctctgatacactgtgctatgggagaagctcccagaagtcctaggctaggagcctctaggcgagagagttgttcaagtctcttcccattccctggcccatgaagcacagactcttgctcccaaggctgggccttttacctcctaaggtcttttttttttttttttttttttttttgagatgagtctcgctgtgtcactcggcctggagtgtagtggcacaatctgagctcactgcaacctccaccgcccagattcaagcaattctcctgcctcagcctcctgagtagctgggattacaggcacccgccaccacgcctggctaatttttgtatttttagtagagatgaggttttatcatgttggccaggctggttttgaacacctgacctcaagtgataagcccgccttggcctcccaaagtgctaggattacaggcgtgagccaccgcacccagcctcttaaggtcttttaatttctcaaaggtctaactcggccaggtgcggtggttcacgccggtaatcccagcaatttgggaggccaaggtgggcagatcacttgaggtcaggagtttgacaccagcctggccaacatggtgaaatcccgtctctactaaaaatacaaaaattagccaggcatggtggtgggcgccggtacttccagctactcatgaggttgaggcaggagaatcacttgaacctggaaggcggaggttgcagtgagccgaggtcgcaccattgcactccagcctgggcaacagagcgagattttatctcaaaaaaaaaaaaaaaaaaaaaaaaaaaaaaaaagagtctaactctttattttcagctgaggggatgagcccagagatcagcatcaggaccagagctcagtccgcggtggcacttcctcccctgtcccgggcatcattcctcccctgtggtttgcctagaaaattctgacttaccccatggagaagaaatgctccagaaccttccccgggaggaaaacagcccttgggtaaagggtccttcacaatcagctcttttctttcccaccaagaggtgggaccacctggtgtgggaggtggaggctggctgggaaaacaacccctgcccaggtttcctctggctgtggagccgcgtggaggaagaggatggggcgtcagagctctcagaaccgtggccttgtgaagttcctgagcaggcagatggggcggcagggggtgatctggtcccagtcccaggaggccaccccgaagccagcatcaaggcgaaggccacgtacagatcaaacgtctccttgaaccgcgaggaagggctggtcccagctccatctggaccagcctccaccattgttaacacaggttgaagcctcatccgtccgcacatgtgaggcttgcgttgactccttctgccctggaattcttttgtatgctgctgaataaataaactacatttctttggaatttctccttctccctcaaagccttttctcagctgatcttggagaaaggcgacactgttgtccccaccatcttttcgagctgcgctggatacagggaagcctatggatcgctgggcggagagctgcggtttgggcaggtttctctccgcccttgggcttggggtcggacagggacgttcaaggagagtgctgggtggtacatgagtcaacattcttaaatgttattagttagggatttgaggtttttgtttcaatctgttttaaaacaaactttatcattagtgaataccatcacccaggacaaggctaaaaatttttcgagctaatcaatttaaagaaaaatattaactaggctgggcgcggtgattcacgcctgtaatcccagcaccttgggacgccaaggcgggcggatcacctgaagtcagcagtttgagaccagccagcctggccaacatggtgaaaccccgtctctactaaaaatacaaaaattagctgggtatggtggcgcacacctattgtcccagccgcatgggaggctgaggcaagagaattgcttgaacccgggaggcggaggttgcagtgagccaagatcgcgccactgcattccagcctgagtgacagagggagactcctcgaaaaaataaaaaagaaaagaaaagaaaaatattcagtagaaagttgtcccattggcaggcagatatgtcaaacgtcttcaggatctcgcctgcatggctgaattttgggaacttctgttgagctcaacacccttattttatggaggaggaaacagggtcccagagcagtggtgatgcattcgaagtcagagagacctagctgtggacacaccagcatcaaccctgcggaatcccatttccagaactggaaccacagccccttggcggggctctttccactacgccatttctttttccttgcaaatgaatcgctgcactaaacaattttgcttgtcagattatactgatttctttcttttcttttctttttttttttttgagatgggatttcactcttgtcacccaggctggagtgcaatgacacgatctcagctcactgcaacctccacctctgggttcaaacgattctcctgcctcagcctcccgagtagctgggattgcaggcatgtgccaccgcacccagctagttttgtatttttagtggagacggggtttctccatgttggtcaggctggtctcgaactcccaacctcacgtgatccacctgcctcagcctcccaaagtgctgggattacaggcgtgagcctccgcgcccggcctgctgatttcaaatatgcagcttaccttatgttttatttccggcaagatgtccaccagcctctgcagcgtctgatgatgggccccgagctgcatggcagacaaaggaggggttagctgcaaaggcagtggatggggggggaagctcactccactgtaaatacaccacgttttaaaagcaatcctaggccaggtgcggtggctcatgcctgtgatcctagcactgtgggaggccgaggtgggcggatcatctaaggtcaggagttcgaaaccagcctggccaatatggtgaaaccctgtctctactaaaaatacaaaaattagctgggtgtggtggcacactcctatagtcccagctactggggaggctgaggcaggagaatcacttgaacccaggaggtgcaggttgcaatgagccgagactgtgccactgcactccagcctgtgtgacacagcgagtcctgtctcaaaaaaaaaaaagcaatcctaatgatggatcaccactttcttcattagatctacacccgagcaagtgattacctttaaaaacacgcctatcacagccaaaccattctctcccacgacagcttccttgtaattttggtatttcacagaattccagtgaactaaatgcagctgaaacacaatggaaagagaacttaaattgatcagcaagaaataagacagtcacttccccttctgaatggctgacctatgtgtccacttaatcataatgaaatggccaggcgcggtggctcacacctgtaatcccagcactttgggaggcggaggcgggtggatcacgaggtcaggagatcgagaccatgctggctaacatgctgaaatcctgtctctactaaaaatacaaaaaaaaaaaattagctgggcgtggtggcgggagcctgtagtcccaggtactcaggaggctgaggcaggagaatggtgtgaacccaggaggtagagcttgcagtgagctgagattgtgccactgcactccagcctgggtgacagagcgagactccatctcacaaaaaaaaaaaaaaagaactaagttgttgcagccagatgagtaagatcccagcaccagcagcacctctgagctcccaggcccttgacgaagccacaggaaggaacagcctcagtcttcctggtggggggggaaaggagaggatcatgttaacctcatccaatagaaatgggtggtttcattattttctacttcctagttatccttggacaagaattaccagaagaaactcaggcctcggctgggcgcggtggctcacgcctataatctcagcactctgggaggccgaggtgggtggatcacgaggtcaggagttcaagaccagcctggccaagatggtgaaaccccgtccctactaaaactacaaaaactagccaggcgcagtggcaggtgcctgtaatcccagctactcagaaggctgaggcaggagaatcacttgaacctgggcagcagaggttgcagtgagccaagatcgtgagatagcgccactgcactccagcctaggcaacagagtgatactcagtctcaaaaacagataaataaataaataaaatatctgttcatcaaaaacaaagttgcagatagagatactaaaataaaagtcatgttgttaaatgaaaggaagcacacagaagccattgttgtgctcattcttggaacaatttataaatatgtgtatgatgatgacaatagatatcactccctatttataaaatgtccggaggtcacctctgggtgtgagattacaagcaattttcattttttggtttgggtggactctagttccacattaactgcagcattactttcataacaacaacaagttcaaaaaacagaaagagtcctcagcttgaaaaagcatcaaaaagttaggtgagtgggtgagcagaggtgtgataaagtgaatatggcaaaaatgatcatcacaggactgagacatcaaactcgtagattcttctcgttcatttcttttcattttttcgtatgttgcaaaaatttcataatgaaatatttggggaaatctataaggcatcacttatcaccccaaaaaaactacaaaaaccaattcccaacattgatatgcactgattttctctactgactcccactttggaaggttgaaaataagactgctttaagatgatcttagccgggtacggtggctcacgcctgttatcctagcactttgggaggctgaggtgggtggatcacttgaggtcaggagttcgagaccagcctggccaacatggcgaaaccccatctctactaaaaatacaaaaattagcagggcctggtggcacgcacctgtaatcccagctactcgggaggctgaggcaggagaatcgcttgagcctgggagacggaggttgtggtgagccaagattgcaccaatgcactccagtctgggtgacagagtgaaccctgtttcaaaaaaaaaaaaccaaaaaccaaaaaacaaacaaacaaacaaacaaaagaagatgatctctattgcaaagatgttcagcttctcagcagagggccttgtggatttgctagtccctacagctgcaagcacacagctgagtgaagtgcggcaaagagctcaagctctgactttgcatcccggctgtctggctttggcaagttccgtaaccattcagaacctcagtctcttcttccgttaaatgagagagaacttacagcgccttcctcgtaggagaggtgtgactaaacgggtggggcggccgacggttctggtttgagcactgacagtcccaggccccaggaaatccttcacatctgagcggcgcgcatggcttgttcaccccccaccatagagccggagacatggaaagtgtgcagatatgtgctgttaggccacgtctacaaacctctgcggggtacgcgtggccgtccactgtgtgctctgagcccccctcgttcactgctccccagtggaagtgaaattgcttcagtctgtagtggttttccaagggcccaccactaattcctggaaataaaggcagtgagacgtgtgtgtcattttgtctgtttgttgagctgtggtgttacctgaggcattgtctacattagggttatatgagttcactcgcaaggggttgctgtatggttgaagtgacaagccaaaggtgggctccgtgaaaggtgggctctgtctgtcccattcactctgcccccccccagcccagcgcctgcccagaggttcacagtaaatgtggaatgaaggcagggtcccagtgctgccactgggtggtggtgagggcctcaactccctgcaggcagaaatccgtaaagaacgtttctgtgatgcctgcctgtcctataagatttccagactttaattaaaaaaaaaggtgtcttccaaatattttttaaaagcagcttaaatcctatcaccaaataacattataaaataacacacaatgagcaaagtttttgttttgtcttgttttgttttattttaagacagaatcttactctattgcccaggctggagtacaatggcatgatctcagctcactgcaacctccacctctgggttctagtgattctcctgccccagcctcctgagtagctgggattacaggcatgtgccaccaggccaagccaatttttgtattttaagtagagacggggtttcaccatgttagccaggctggtctcaaactcctgatctcaggtgatccacccgcctctgcctcccaaagcgctgggatgacaggtgtgagccaccgctcctgggtgagcaaggtctttaaataagaagaccctgagctgtagcatcagtcctgatctctggcagtccctgcttaatctaggcccaccacagggccagcttttattggaacactccttccttcctaagtcaccctaaacactcaccttggagtcagcactctctacctgcaggcctcggggtgcccctctccatggcacagtgccaggtgcagcctcccaggagcttgcttctcctgacatgtggggctcagccataagcatcgctcgctgaggcctctggctctggcccccagagtcatggctgccattcccacgtccaggtagtgctgggagtctgccttttaacgagctccccaggggttcggatgtgggtggcttctcctgtgtctaagtactttgtcactaacagatttccatcagcagctgctacaaatggggtacccgttccacacgttttcactgaaagcagcacagcgtgctcctgggatggctgggcaaggctggaaggcgccagcagaactggagcactgatcccgaattcagggtggcccgagtgcctcccatagctgtggaggagcctcatgtcacctcccgctgtggcaaaagccaggaaagcactgagcgcgtgatgaatgccttggggagcttgacactgctgactcctggtggtttcccgacaccagaagtacttgggctgggcgtggtggctcacacctgtactcctagcgctttgggaggccgaggcgggcggatcacttgaggtcaggagttagagaccagcctggccaacgtggtgtaacccatctctactgaaaatacaaaaattagctgggtgtggtggcgggtgcctgtaatcccagctactcgggaggctgaggcaggagaattgctcgaacctgggaggcggaggttgcagtgagctgagaacgtgccactgtactccagactgggcgacggagtgagaatcagtctcaaaaaaaaaagtactcatagttggaggcaccaaggtgtaaactggaaaatggaaaatggatttggctttagtccagtcaggggctaggcaagtgctggaccaagccacagagctgctcactgcccctcttcactcaaaatctcagtgttggtctggagcaacctcagagtcatatctagttttaaaattctaccattatgagcaaatcttctattctccttaaacatacacagatgaattacatctcaatttttaaaaatacacagaaagagtccttcccacaataagcacataaaatcactttgttaggccaggcacagtggctcacgcctgtaatcctagcactttgggaggccaaggcgggtgtatcacttgaggtcaggtgtttgaaaccagcctggccaacatgataaaacctcatctctactaaaaatacacaaaattagccaggtgtattggtgggtgcctgtaatcccagctacttgggaggctgaggcaggagaatcgcttgaacctggcgggtggaggttgcagtgagccgagattgcgccaatgcacttcagcctgggcgacagagtgagactctgtctcaaaaacaaaacacaggcgtgagccaccgtgcctggcctccaaaacacaatctaaggaacttacagaaccacaaaatgggagcacggtgagctctgtgctcgcttctgcctcggcctgtgtctgtgggggaaagggggtttgcagccgaccagccccagcagcatcaaagtgcattgatgggtgactgagggtggagcctcccagggggtctgcctctctctcttgggatgggctcactcatgataagtttactgtgtggaaattcacgcatgtctgtatcatctcttctagaatagaaatgcctagaaggcagggatgatggatgcttcatggacaaattagactggacccagcctggtagatgccatttgtaagactgagttaagtcccatccagttgcactcttagagcagaggctgtttctaggctgggtgtggtggctcacgcctgtaatcccagcactttgggaggccaaggtaggcagatcacccaaggtcaggaattcaagaccagcctgaccaacatggtcaaaccccacctctactaaaaatacaaaaaattagccaggtgtggtggcaggtgcctgtaatcccagctacttgggaggctgaggcaggagaattgcttgaacttggcaggcggaggttgcagtgagccgagatagcgccactgcactccagcctgggcaacaagagtgaaactccgtctcaaaaacaaacaaacaaacaaacaaaagcggttgtttccgtctggaccatcactgtatcaacaggacttagtgcaggaaggggtcatcgaaggcacacaacgaaccctcatgggatgaatgaatacaggaacgaatgggattagtcagtccactgatttattcatcgaatcacttggtcggtaagcagctctgtgtgttacagtggaatcgagcctttcccacggcagttggggaaccgcctgggatctctaggaaagtccacagaacacagaaatagttaaagacctggatttgcaactcagctctgcttctaacttgctgtgtgaccctgggcaagtagcttagcctctctgagcctaagcctctctacctgttaaatgagaagggcgggcaggataaatggagacaaggcaggaggcattttgtaaagtgttgtctgatgatggcagtggtggtgattgcgcatcgcacacccttcaggggctccgcagcttcgtctgtgtaaagagagttactacacgtttctcctggtcccagctcaagcaccctagggttctacgtaggcacataaatagggttccaaagagagcgacgccaactgcatgaggcataagtccactgacagccgatgcctgccggatccccacccacaaaacctagtagaaaagtcaccctccagactgtggccaaccaacaagggccaggaacgggagctgctgggaccggaagggacttgtgagccctgagcctctgcagggtaaggtgctgtgctaactctggggctggaagactttcccaagggtttccagcagggctggagcccacaggcatctcttcatccttcccgaccccgagctgtcccagaattcttcttctcctccttcttcttctgctttttcttctttttgagacagagtttcactctgtcgcccaggctggaatgcggtggcgtgatctcagctcactgcaacctccacctcccgggttcaagagattctcctgcctcactgcctcagcctcccaagtagctgggactacaggtgcgcaccaccacacccggctatttttttttttttttgtatttttagtagagacggggtttcaccatgttggccaggatgatctcgatctcctgacctcatgatccgcctgccttggcttcccaaagtgctgggattacagacgtgagccactgtgcccagcctctcacagaattctttactgcagcagcctctgatgggccggatcccccgcctctctactcactggagtaagagacaagtcagccctttccaatctgcctcctgaggggaaccatggggccctcgggacatgcggcccctcctcaggctggctcggggcatctgcacgcctgtacctgaacaagggacttgcttgaaacggcggccaccctgggctggggaccaagcacgctcaggggaaaacccaaaaaggctactgggtctctctggctctatgatacgcaaatgaggagggaagcgaaacgttcgttcttctaagaggataactgcaaaggaaggctgggccgctgcgttttcgggaacagcaggtgcaggggccgatggatcactcgggctgggctggagcggcccctggtggcagttcggtgaagagcaacgtagcccgcgcggggcgcacgcatttcaggaagacacagaggcctttttactggaaatgccagcgggtgtggattccacaggctcctcttcagcatcagtctagtgtgggattcatacaccttgagcctctttcaaggtgaaacagagaatctcactgcaaattttaaatcccactgtaaattccgaaattagacctgcgccgcgaagaccgcccaccagcaaaatgccaagcgtatttctttaaaaactggaaagccgtgtttcgttactcttcctgtagacaacacagcatggggtcaggagtggggtctggagtcggacgcacgttcagaagctggggccaccactcccaaactgtgtgctctaggtccagcttttgcaccccttctagcctcagtttccccatttgtaaagtgcggatgatccttgaacccccaccataggactgctgttacggttaagtcacatgggaaatacgaagtccttagcacaacgcttgacgtaaaggaagcactctaaaacaaacaaacaaacaaaaaacaacgaactggaagccactgaagccttcatggggtgaaacagctgattaaggggcaaaggctctcactggccaggttctgccgtgtcccgggcaccacgcatcctgtccatgagctcacgtcgttgtcgtgatggagaaggcttggtgtgtaccagagtgcagcggaggagctggcgttcgctgggcacctgctacctgctgggcattgcgaggtaactttatgttcctcccaggatgaactcctcacaatggccctacagagcaggtcctgtgagtccaactttgagatgaggaaattgagacgcagagaggttcggtcacctgccccagtttagccggcaacctcacccaggtctgacggtccaggccctcagcttttgtagtagggttcaggccaaactctgctacttgccttgccagtaaagttagggacccaatttaaggctgcagacctggataaaataatctcaaagtgacttctttttttttaggtggagtctcactctgttacccaggctggagcgcggtggggtgctctcggctcacttcaacctctgcctcccaggttccagtgattctcctgcctcagcctcctgagttgctgggactacagacatgtgttaccacaccccactaatttttgtttttgtttttgtttctttgagatggagccttgctgtcacctaggctggagtgcaatggccagatcttggctcactgcaacctccacctcctgagctcaagcgattctctcacctgtgcttcccgagtagctgggattataggcacccaccagcatgcccagctaatttttgtatttttagtagagacggggtttcaccatgttggccaggctggtcttgaactcttgacctcaagggatctgccgcctcagcctccccaagtgctgggattacaagcatgagccactgtgcccagcctaaagtgacttttcataatgacaatacaatgtcagggtattctccttaatcaaaaaaaaaaaaaaaaaaaaaggcaagcccaattcacgaaaaggggtctttaagctgccagcccccatcccccggactctgctatcagcagggctggtccaccgggcagcactggccactgttgcctcagcgttctgtgtaagcaggtgcgtcagaaccggctcatggagatataattgaacgattgcctcagcgcgtgccagactctccaaacataataacagatgacgtttggggccggctccaggctgtgacgtgctggccccagagaatattgtctctgctattacaacagatgctgttaatagccatctatttgtagttcggggcttttaccaagatgagcaggcttttggcaggcacgggttgtttgaaggcttaaaattagtacacgagaagtttgagatgttctaattactggaaatttcaaataacatgatgctgcaaaggaccggcctgcttccggtgccactctgggaggtagtgcacgttcccaagctgtaaagggtgacacggctgagggcttctgtgtgccacctccccaggcaggcaggggccgcagccactgcaagcccctgcccacagaactccgcgacgatggaacctagactgctccctggaagttagcctctgagaccatcacatattggcactggtttgaaagccaggcaaatgtgggctccaatcctggcttcacacggtggggctttgcaagttgttttataggtctgtggcccagactagacgtttataaaaggataatgatgcctacttcaggggcccatggcaaggattgagtacggtgatgcttacaaagtacctccctcacagtccctggcacgcagtgagagctcaaataatggtagccacttactattattatgactggtgttattgttattattaaaattactgtcatcgcccaggcacggtggctcatacctgtaatcccagcactttgggaggctgaggcgggcagatcacttgaggtcagatgtctgagaccagcctgggcaacatggtgaaaccccgtctctactaaaaatacaaaaattagctgggcgtggtggcacgcgactgtagtgccagctacttgggaggcggaggtgagagaatcgcttgaacccgggaggtgcatgttgcagtgagccgaggtcgtgtcactgaactccagcctgggcgacagagggagactccatctcaataaataaataaacaataaaataaactaaaattgctatcctcactgccatcaccatcatctcaccacggcagagatccgcagtcccctgaagcagataccacgattctcaaggtgagacctgcacgtaaagacgtcgaaagataaatatgtcttaagaacacgtccataagaaagggctttgccaaccatgcaagcataaaagaagaaaagtccctcattcatccgaaaacacccactgactttctcccacgtgccgggcaccacgctcagtacaagggacagagggaggaggctctgggctcagacttgccctcgcagagcgtggaatccaggaggggcagacggtggtagagataaaaagctgtgtgtctgagaggtgagagtgtgggctttggggccctaaacttgcttgggacgcccaggagggcccccgtggaagcggcgtttcagtggagccctgaagatgggtttctatttgtcaggtgaagataatggcggctccaggcagaaagggacgaccagcggaaaggaccctggtgacagcagccaccacaacggaacaggcggaagcaccagccggcgaaggcactgtcaggggcagcaggagatgggattacaggggcaacagggtcggcgccggtggtggctaaaggaagtggggccttcgccaacaaaccgcaacatggtttttttttttttgagacagagtctcgctctgtcacccaggctggatgcagtggtacaatcttggctcactgcagcctccgcctcctaggttcaagcaattctgcctcagcctcctgtagctgggattacaggcaggcaccaccacaactggctaatttttgtattattaccagagacagggttccaccatgttggccaggctggtctcaaactcctgacctcaggtgatccacctgcctcggcctcccaaagtgctgggattacaggcgtgagccaccacacctggcccatcaacaggttttgaatgttccagtcttttttttttttttgagtcaggggtctcattctgtcacccaggctggagtgcaatggtgtgatcatgcctcactgcagcctcaacctcctgggcgcaagccatcctcccctctctgcctcctgagtagctgggaccaccatgcccggctaattttttttacaagaccactgttaaaagcccggaagaatcctgcagctcactgtggtgggctgttttgcgtgtgctagagtctattcagcatttcagatggaaaagcctcagcattcctcttccgtgggcctccaccgtagctcctttgaaatctctgctctttcttgcaccttcccatctgagtgtctgtgccgtggcccccccctcctctccaatacgaagagcccacactcagcttccctccctcctcctccaccccacactgcccgagcacctcacctcccagtgactgactcgtccccggtcttgcacacacctggggagcgtagctggcccgtcctgcacaccagccttgcaggctcgctgagtagaccatccttgtctgctcttgctgggtgcagccgtgtgtagtggcccaaggggggtcatctgggagggcataaggaagcttaagtgacgtctaccacgaggaagcgtaagtgatgttcaccacaagaggcgtggggagcggcggcagcgcgttcatccactgtgcttgacgtcgcttatttccccgatgaccttttcccggacttcctagctggatctccgtgagtgccagggctgggtctgggaagggtctgggacccagcacatcacctggcacagtcagtgtttgctcaatatttgctgagagaaaactgcagccatgtcaccgatttacaataggaacttctcgtatggagcagaaatgtgttgttgcctgtggctttgcaggagctccgagcagtggcgagaggaagtcacgggtgaccatggtaggcattaccgcctgatggggttgctggctggtcctgagctcatcaccgtccatctcctgcatccacagtgatttctattaagtgcagcttttcgtcaggcaaccgccagcagcactgaggggtgggatgatggcatattgaccaaaacactcagggggtgctagccacgcggcgggtgcagatgcggacccccagccccacgagcttgcagtgccgttcagccccgctgcacccccgtctgtctccaaggctgaggaactggggtgggaggaggaggaggcacagagccgtctgaacacagctagagccactcactggcccctgcaggggagcaacgcagtggggaagccagcagggagggaaggggcagttgcagtgggtgggcatgggggctcagctactggcacagcaacacgagggaaccacggagagcaggagggaggacgtgggggcgggcgcagggcgggagcaccgggcagtccacaaggtggtcaggacctcagctggcggctgggcttgggaggggctggcatggagtcacgggccaccgtcccctaagtgtttccctaggcaaggttctcattcccctcgtcaggggaggggatgggcacagagaagtgcagccatgagccaggaacagagctgagatgaaacctcggcctcccgtcttcggaacgagagttaatccacagaggagctaaggaaaacgccgggcaccgagttgacgggtgaggggtgtgagcgatggggccagcatggccgccgcaccaccagctccatcctgagcgtttcacggacatggccctcttcatccacacaactgccccaggagccaccgaatgaggctcgatgaaacctcgactcgcgttgcagcgcacgtccgaccacactcgcctttgatcgcatttatcactggggatccagaggtcagggctttgtgtctgcagcggtccctgggaaacaatctacaattcgaagctccaccaaactccctcagagtcacgaaatttctatcactgactgctttcctccaaggcccaaactggatttataaacttccaaaggaaactttatattgaaaaagcgatgtacccacagcattgtagaacgatgtttacaaaggaaaaacaaggccaggcgtggtggagtgagcctgtagtcccagctacttgggaggctaaggtgagagggtggtttgagctcaggagaagcttgcagtgagcccagatgcacttcagcttgggcaacagtaccagatcctgtgtcaaaattttttttttttttttttttttttttgtggctcacacctgtagatgcaactacccaggaggctgaggtgggaggatcaattgagctcaggaggtcgaggctgcagtgggctgtgattgcaccactgcactgcagcctgggcgacagagcaagatcctgtctccaaaaaaaaaaaaaaaaaaaaaaaaaggaaaaactattgtttatgccatcaccacccagtaaacatagttactgatatttttacttgcagtgtaactttctggccccttcccataaccacatgtatttggtaagcttttgttttcaaaataagccaataacatttaataagaaacaacagtgtattagtctgttttcatgctgctgataaagccatacccgagactgggtaatttacaaagaaaaagaggttgaatggactcacagttccacgtggctggggaggcctcgcaatcacggcagaaggcgaaaggcaggtcttgcatgggggcagccaagagacagaatgagaaccaagcaaaaggggttactcgggagcctgcggcaggagaatggcgtgaacccgggaggtggagcttgcagtgagcagagatcgcgccactgcactccagcctgggtgacagagcaagactccgtctcaaaaaaaaaaaaaacaaaaaaccatcggattggctgagtgcagtggctcacgcctataatcccagcactttgggaggctgaggtgggtggatagcttgaggttgggagttcgagaccagcctggcccacatggtgaaaccccatttttacactacactacatttttagtgtagatcccaaatatttagcataagtatggtttgtgtaatatttaggatgctcgtattttaaaacggtgatgctggaatgctcctccccaccgtcatgaagctggcactttcttaccagctgggacttgggtccagtggggtcttttctgaccatgttgtgtaatgctcacaacctccctcagtggagtcaccgctggcctatcacctgctttcattttcatcacagcacttatcactatccaaaaccatcttctttcttatgtacatattcgtttatttttctgtaaacttgtgtagagaagtacctatttattaattaatgtttactaattttcttatcccaccagaaggcaagctccatgggagcaggggtttcactgtcttgattgatccttcctccctacaaaagaccacacagcacacaggggtcgcggtgcacctgggaagcgtctgggaagctggacgatcagaaatgggcttttgggctgggcatggtggctcacgcctgtaatcccagcactttgggaggccgaggcaggaggatcacgaggtcaggagatcgaggccatcctggctaacacagtgaaaccccgtctttactaaaaatacaaacaaaaattagccaggcgtggtggtaggcgcctgtagtcccagttactcgggaggctgaggcaggagaatggtgtgaacccgggaggcggaggttgcagtgagccaagacagctccactgcactccagcctgggtgacagagcgagagtctgtctcaaaaaaaaaaaaaaaaagaaaagaaaagaaagaaaagaaaaaagaaatgggcttctggatccaaatgataacaacagtggctccactgcctgacattttgtccaacatgatcgcacccctggtcacagttgattggacagggatgggcactcaaaccatgctggaccaatcagagcctcttcctcagtcccgctcctaattagtgcagggctgggccaatcagagtcactgctctgggaatttagaattggaagtgagcaagaacaggaacagtggctccccagtggctgaatctctaacaggtaaactttggaagctgtttggtacgttttcatttttcagtcttgaggaccagaaagcagagaaaatatctgtagagagagaggggacactgacttctacctaacttccccaaaaatattcacacccaggcctgagggaagaaacaggagctacatacagaatggagatggaaacacacgtgtgcacacatgcacacaccacacatgtgcacacacaaacacacatgtgcgcacacacatgaacacacgtgcacatagagacacatgcacacagtgcacaatgcacacccgcacacgaacacacacatgaacacgtgcacacacacatgaacacacatgcacacatgtatacacagtgcacatgtgcacacatgcacacatgtatacacagtgcacatgtgcacacatgcacacgaacacacatgcacacacacgtgcacacacatgtagtcgctttaggaactagactgccagtttatgaacttgtgatgataaatcactttcccaggatataagcgtgatgctcacatcgtttcctctcagtccaggggtcgtccttgaaccgcacagccacagtcccagtcccgacactgccaggattcccctccaaggaattcactcttcccctgtctctcatcttggagctgccgatttgtgccccactagaggagccaagaggtccctagagcctcctcctctgatgcggacagcctggcaggcaccccccaattccgggctctcaggcctcgtttggatttattttgaaggaagctattgtctactaaatgcttaattctcccagaatggtgccaagtgcttcacacagccctgcccaatgagctgggccctcccgcacctttagggaatgagctgagctgtctgtggggggcactcaaggtgggacaggcacagtgtggcagcgcgtggatctggctgctgttttcctttgtgactggcacctctcctctcccccttccctcctccccccgctttgctcccccagcctttcctccttggccttcaaggccatacacgctccctggaaagagcccttgccgccacctctgttactcatcgtccttggcccatgcttgctccaagtgctggcacccccagctcctaggaaaactgctggcagtgtccacgccgacggaaatttccttggcctgtccgtttgtttcgctttgtttctggccctgccacggcatggcccaggcctcgggagcctgtccgtgtgcagttctctgcaccttgtccgctcccttccctttctcttatgggcactgcccctccttccatgcagggtttgctgtgttttcatctcattcttctctgtttctctctgaaaacctttctctagccctacctgtccttcatctgaggttctcattccctccatccccagcggctcccgattcccaatccaggtgaacaaagaggacagaaaatctgtgaaggagaggaccgagaacctggaaaaatgggctgcagagacggggaggggaccgggagcacgtgaagctgagtgggagagaaataaaaaggaaactgggttttggagaaaatgacaaagtgaaaccagattggcccgcgtggacgggagccaaaggagggatgacccagctcatttccatggcccgggagacacaccggatccttctttcagtctgtggcagggagggcctagatcctttaagcagatgtgaagccggtggggaagccaaaagtggggtcgggacaaggtcagaggctgacgctgggagacagagacagcagcagtggccttggacctgagagcaaccgagtcagggaggggccgaggtcagctcggggtccatggccagggtgcacgtccagtgaggagggcgccccatccttactctgggaacagcgtcctcggctgtcctgcgggagtgctgcctcccactctccaaacacaccttgctccaggcggggtcaccctcgggctggccagacgagcagccaaagccgggcccctgagaatcagccatgggatggtggctggaactgccgggaaagaggcgacatcgctccactggaagccaagccacagcctcgggcggccaccttcgccccatcagggaacccccgtgagtgtcccctggggaaagcagagtctgggggagcactcacaggaaagcagagcctgggggagcactcagagccctggcagtcgacgacccctgcacccggttgcagcccggactctttaggatcggagccggcaaatctccctctttgcttaagccactttgaggtggggttctgccaggtaaaccaaaaagaagtcttaagacggcttactggaattcctcacttggagagcagcagtgagatcccaggctgcatggacaagagagaggaaggcagggggcagcggcgggtgggagatggctcatgctggctctggagctgactttgcaaatctcttcccaactccactatcggtgactgcaccttcaaaacttgaactcggccgtgcaggagtatttgcaccatggaaagtggcgaacaccacacatcaccgctctcgtccctccacccagccccggaaagccagctgctaggcctgtaccagcattccccatccatggactcaggagggccgggcttacctgggaccacttctgaaaggtgcaccagccccagcttccctgaggacaaggctgagtcacgaagcatggacgaggctgagctgcagtctgcacaggtggagttaaacaggccatagccaactcacccctcacccgaggtctgcacagacctcacctgcagccaaattacatttgagcacgcagtaaaaggatggaaactgatgatcctcctgctccctcccttccatttctttgctctcagtttagtcactgttttttgtttgtttgtttgattgtttgtttgtttttgagacaatgtctcgctctgtcgcccaggctggagggcagtggtgcaatctcagctcactgcaacctccgcctcctgggttcaagcaattctgcctcagcctcctgagtagctgggattacaggcatgcaccaccacgctcggctaatttttgtatttttagtagagacggggtttcaccatgttggccaggctggtctggaactcctgacctcagatgatccacctgcctctgcctcccaaagcactgggattacaggcgtgagctactgcgcctggccaatttagtcacttattttatttttttgaaactaaatctcactttgttgcccaggctggagtgcagtggcgtgatctcgactcacttacaacttccgcctcccaggttcaagcaattcttctgcctcagcctccccagtagctgggattacaggtgcttgccaccatgcccagctaatttttgtatttttacttttttttttgagaccaggtttcactcttgtcacccaggctggagtgcaatggcacgatctcggctgaccgcaacctccacctaccaggttcaagcgattttcctgcctcagccttccaagtagttgggattacaggcatgcaccatcacgcctggctacttttgtattttttgtagagatggggtttctccatgttggtcaggctggtctcgaactcctgacctcaggtgatccgcctgccttggcctcccaaagtgctgggattacaggcgtgagccactgcacccggccaatttttgtattttttagtagagatgggctttcaccatattggccagtctggtctcgaactcctgacctcaagcaatccacctgcctcagcctcccaaagtgttgggattacaggcatgaccaccgcgcctggccacttttatttgtctgcttttatcaggactcttggaagcaagtgataggaacttaaactgattttaaaaagaggcttattagtacaggggttgacttggcttcaggtacagctacattcagaggccccgaaattggcttgggccttgatttctccccctcttggctttgccctcccgtgtgggcactttttcaggagggccctcacctgctgcggggcacagctggcctttgcacagccatggaaataatctctttaaatacgtcctagaaaaaaactccttggctctcattggccggtcttgagtcacgtgcccatgcctgtaccaattgctgcagccagtgacagggctgttctgagtggccacgcccaggtccccacccactcctgtttctggaccccgtgaatgggagtcggggatgggctcgctcccaaggaaaacaggaatgttggacccaggaggcaggaggatggaagcccagccagcaacacagcagatgcccttacaaagccacggactggcgggatcagcggcacctgggagcctgctggcatgagattcttggatctgccttgcacctgccaagtcagaatgtctagaggaagcacaggttgtgttcctttgtgtgttattgttattattattattattatttttgagagacaggatctcgctgtgttgcccaggctggagttaagtggcacaatcccaggtaactgcagcctcaatctcttgggcttaagcaagcctcctgcctcagcctcccgagtagctgggaccacaggcatgcaccaccacgtccagctaattcttttatttttatttttgtagagatgcattctcgttaccctcccaccttggcctatcacggtgctggggttacaggtgtgagccgccgggccgacaggagtctgtgctctaacacactctccaggggatgttggtgcacactggtgtgtgagaactgtttgtcagccccccataaaattagcattttattcactgatgtgaataatatcctcgctaggaccaggtgcggtggggaaggggaggttccagggaaagttgcgaggctgttcctgaggagggtgtgccacacagacaggcacgcaggttgagattcttgaccaaaagcaggctttgacttgtgatcctgggggataattaccatctgcaattgtcttgttttccagcctaaagcctgagcctgggttcccttggggatacagaaacatctagattccaaggcacacatgctgccatgagctgaacagaaaatgacaagtgtgcccttaaagcactgcagggatgtccctgctccaccgccaacagggttggggcgtgggtttgttcttgccctgaggggtgagggacgggcctcccgtgccgacctcaaggcccactggacacagcctccgctgggcttgagccagaggcccgtctgggccctgggccagctgccggctctcctggggaccgactgtgaccttggcctcactcacccagggtgctggtgcttccttctctgcatggaggtcagctcctgatggcctcctgctggattttgtgaatgttggatgcagattctttctctaaacggtgcctgctccccagattcccttctttgcagagcacggagtcccattgggaggcctctgtggcctctggccgaggagttccccaagccttctttttcacatctgtaaaatggggactggtttgtatctcccacgactgttgaaaggaagactgcagtggtgcaagtgaagcccttggtgaggagaagtgagttggtgaagggctacaatctgcagtcggaacggaagccggctccttgtactaggtcactcacccttggcagtcgccccttctctgagccttcatttgttcttacgtaaaatgagggtcccgcaatactctctctagtggcttctgttttgtgccatgctgctattcatagatggcagcgctttttttcccgcgatggagtctcgctctgtcacccaagctggagtgcagtggctcgatctctgctcactgcaaactccacctcccaaattcaagcgattctcctgcctcagtcccccgaggaactggaaccacaggtgtgcgccaccaacctggctaatttttgtatttttagtacagatggggtttcaccatgttggccaggctgaacttgaacttctgacctcaggtgatccacccacctcggcttcccaaagtgctgggattataagcatgagccagctcgcccagcctggcagtgcttttaaagggggtctgtccacataccttcctccttctaggagtagtatcaggattcccctggggccccctgttccccactgcatgaggtcttggtgaggacattagccgggtgcctgatgctccaccagctgagggctgggtgtcagctcagggtcagccaccagaccctttgccttgggaatttattttgtaaaataacaaacaaaagtccaaaataaccttcaaagtttatactttacgacttagaggaaacaaatcagttattaaaatatcagtgagacccacagccacatctaaaaattatccaggaggaatatgaatcccatagcaactcatctgtatccatgacaactattgttctcaaaattactaatacattcacacaaatattaacccaaacaattaaaagttcaggaactatttttggtttttcaatattttgaagtggctgcatgaagaatttttaaataatataaccacattaaaactgaaaagccaatctgagttgcttcttgggcatttgaacttggaacagaccaacaaggggagaaaaaccattggcaactgaataaatgaatgcaaaaatccctgctccctggtccccgaagctggcctggtttgtgcctcccaagatctggttgtcccactttccctcttcttctccgagctggtcttgtccttccaagaagttgcactttgcttacgttggctggagttggggttactgctgctggcactcagcaagccccacacgggaagcatccgcgggggttgcagtggagcctgatgaagcaaccgtgaatggcactgagcatacaggcagcgtggctccttctcaccttcgaaaggagagagagacactggaaggaccaagccgtggtgtttgcgatgcactgtgtagggcctggcacagagaagaagctctcacgccctgcccccaacagcaggtgcattagaggcaggagcaggctcaggctgggcctctactctccatggggtgcctctccccgggctccaggaaggcctgcacatacggctcagcgcactcatccgtgggcaccgtgcctgctcactgaggtcccctgtgttgagaatttctaggcatatgcagatttaagtggctgaaatgcaagcaccatgtcatgacgaagctgggacgcagctgggcagacctccccgtgacagcaggagctggggaagccccggtgagcatgtttagtgtaaggaaggtgaatgctgcctccgcatgcacagcgagagggcatgaaggtgagcgtgggggcagcgtcccgcttgttggtcccgcttggataacgcagaagcgtggaagcaggtccgggcatgctggcagccatgtgggagtttctgggcagatgtggtgctgagtgccggcctggggtggcctcgattctctccctgcagcctttgcagtggccatcccttctctccccaatcacagaggaagaaaaggaggctcatttatgccttcaactctgttcatccgtcaatttgctgagtgcctaggaggcctggcgcataaaatatcaaataagacaaagacctgccccagcggagttacatcctcatgggagcaacagtgagtgagcaagatccccaggcacgtgggacgcacccgggaggaggcagatgggatgcctgccggagaggatgtggagctgtggctgcggctgctttggggcccccaggtttgatgattccccaggaagagtcactgggtccagcacagagccaccctcagagctaagctacattcagcaaaaggacgcagagcgagatcagccacgcgaagaggtgtctgggctgtccggagggccccaggcaggagcttctggagtcctcaccagggaagacggacaggacggacttaattctcccctaaaccagccgcaacactgaaccagtgtgacgtgttctgtaccagaggagctcactagcaactcagtgcccaagggtttattgggagctgttcacataggcacctgatacccagcacgtggcccaattccagactcgcagcaggagggagagcaggcgttccgcatgaaagcagcttacagtgacaccagctggtgctgggaaaacaccaggtaggacctggcagccagtcctgataaaaatgcaaacataataggcatagagagaaccttcccatacctcagagcatctgcctggaacttccgagaatcatggtgaaggtttgaagagatgatccgcagaagcccttggccaagcgctggaacccagtaagggcttggtggctttcaggacctctcaagtcacctcccagcccaccccgtccctccaccaccgtctcccacctgcatctccccggactgcctcctatttaacccctgctcccctccagccgcctgctcagtctgtcctcacagcagctgtgggatgcatttaaaaggtcagcgagggccgggcgcggtggctcacgcctgtaaccccagcactttgggaggccaaggtgggcagatcacctgatgtcaggggttcgagagcagcctggccaacatggcgacatcccatttctgctaaaaatacaaaaattagctgggcatggtggcagacacctgtaatcccagttactcaggctgaggcaggagaatcacttgaaccaggagacagaggttgcagtgagctgagattgcgccatggcactccatcctgaatgacagagcaagactctgtctcaatataaaataaaataaaataaaataaaatgtcggccaggtcactgcctgctgaagcctgcagtggtctcatttccaggctcccaatgcccctgccctgctgtggacccaacttccttgcaggcctctgcctagatgatcaaggccagcgtgggcgtccagccaccgctgccttctgagttcctcttccgacgcgcaaagtgttcgcatttcaatgagcttgtctcttcctcccacccgctgcaaggcgagccccacgggaaggggattttctttgctaggtgcacctgtgtgcatgcaggtgccggcggtattctcatctgtaaagtgagcaccaggctcctgtcccctcgagaaccttcacaccatcccccaggtgtgtcctccctcaagcgagtctctgtccctgccccagcagcacaaggaaagcagcaccttcctgctctcctcccccttctccgcgaagctcttgaccctgctgccagaacaacgggagaggacaaagccctcgagccccagctggcactcacctgatgcctcggtggcatcgtcaaattccacctggaagaggtagccagtgttccagatgtacaggcaggatgccgcttcataggagaccctgagtggcttcagctgggggtcatagacgctgtccctccactggatgttaataggagactgccgggtgccccctggcacggagaccgggaccgtccagagtgggtgcactgcagggagagagacggagaccctgagtgaggcatgagcttcatcctgtgtcttggacggacagggcagaaacccggccgcacgagacccctcacgtcctggctcatgggaaactgacccacgggaaacgggcgcgtgggggcccctgcgcagcgacgcacgcccacagggtactcgcctgctcctctcctttctgcaccactcggggactttctttcccacccggaagcaactccctctgggcccatgccacctgtgttgatgggtttttgacttttgtgttgccctcgtcacagagtagccacaggaagtctggatagaccttggggagggcaggtgggtggaggagggcgctgtggggaaggcaggctgagtgcagtggggctcttgtctctcgggaagggcttgaaacttcccttcccactcccaggtaccccacctagtggtcctgtggaaactggagctgctttggaagcccaactctccaagccctctggcaaggaggaaatgagaccccagtgtggagaaaattaagcagagtggcagcccctctacctacttcctcgaggctcatttcaaactgctttgattgtcatttttaaagtaagagccattaatcgaaaacagttcagaggtcaggaacagtggctcacgcctgtaatcccagcattttcggaagcaaggtgggtggatcacttgaggtcaggagtttgagaccagcctgaccaacatggcaaaaccccatcattattgaaaatataaaaatcagctgggtgtggtggcgggcgcctgtaatcccaggtactcaggaggctgaggcaggagaatggcgtgaacccaggaggcagaggtggtagtgagccgagatcgcgccactgcactccagcctgggggacagagactctgcctcaaaaaaaaaaaaaaaaaaatgcagaaaagcttatgagtgaagaagcagctgtcccatgattgcaccccctggtgtgtgtctgccccacctgttctctgtgcaataacctcatgctaagagaaagctggatcttttatttttatttttccttaagagacaggatcctcgggatatcctgctcttgaaaccttagagcacttccaaatacagagtccccttgcttggggatgtcaccccagaggcctggcgtgtcctgtggctcctgtcctcaccttcacaggcctgagctaaaccagttcttaaaagggattaaatggaatagtgcgtttttgagatcaggtctcactgtgccacccaggctggagtgtagtggtgtcaatcactgcagccttgaacccctaggctgaatcgatcctcccacctcagcctcctgagcagctgggactgcaggtaaacaccaccatgcctggctaactttttcattttttgtagagacgaggtttcactatgttgcccaggctggtctcaaactcctggcctcaagtgattctcctgcctgtcccaaagtgaggcaggcatctcccaaagtgctgagattagaagtgtgtaccaccacacccggccaggattttttattttaatgaacaaggattttactgtgtatattatcttgtaagttgccttttttcatttaacattgtgaactcattttgtgaaaaaaatatatatatacaattctttttaatggtggcacgtttccattgtacagttacgacacaatttttaaaatccattatttggtgatgatatttaggttatttccaacttcttgcaattaaacaaagctgtgatgaagttgctgttctttctctgtattctcatctggattattttcttttctttgttttttttttttttttttttttttttgagacggagtctcactcggtcgcccaggctgcagtgcagtggtgccatctcggctcactgcaccctgtgcctcccaggttcaagtggttctactgcctcagcctcctgagtagctctattacaggcacgcgccgccacacctggctacttttttgtatttttttcatagagacggggtttcactgtgttagccaggatggtctccatctcctgaccttgtgatccacccgcctcggcctcccaaagtgctgggattacaggcgtgagccaccgcgcccagccttggattattttcttcttacaaattcctaaccacagaatcactaggtcaaagggtgcatccaacagaagtctagaaaacaaggataaagatgtatagccctggctgggcgcggtggctcacgcctataatcccagtagtttgggaggccaaggtgggtggatcacctgaggtcaggagtttgagaccagcctggccaacatggtaaaaccctgtctctactaataatgcaaaaattagccaggcgtggtggctcatgcctgtaatcccagctaccggggaggctgaggcaggagaatggcttgaatctgggaggcggagattgcagtgagcagagatggcaccactgcattccagcctagatgacaagagcaaattcggtctcaaaaaaaaaaaaaaaaaaagatatatagtcctgtcagaaatgcgtctccacctaggtcaaatggttagcgcattgctgtgttttgttctttaatcaacttgaaaaaatttttagctgttatttaataagtaaaccatcaggccaggtgcagttgctcacgcctataatcccagcactttgggaggccgaggtgggcggatcacgaggtcaggagatcgagaccatcctggctaacaccgtgaaacccggtctctactaaaaatacaaaaaattagccgggcgtggtggcgggcgcctgtagtcccagctactcgggaggctgaggcagcagaatggcgtgagcccgggaggcggagcttgcagtgagccgagatcgcgccaccgcactccagcctgggcaatacagcgagactccgtctcaaaaaaaaaaaaaaaaaaaaaaaaataagtaaaccatcagaagtcagtagaatgtacaatacatttttaagttaaagattgcaaaatcgcagaatgtttgttctaaaatcgcatcttttctactcgtcagtgttaaaaagccctatgggagataaaggtgatgatagatagtaggatggttgtgtgcctgtttattttaattttctctcttggtttttctctcccccatcaacgtgcatggtaacatctgctaggggtctgctgtctgtctcataaccagaatctcagcagggggttggtcatttttctggcccgtgcattcccgtgctccgacagcatctggcactatgaatgtttgttgaatgaataatccctagtgtggattaactgcccctgccccttacaggtgggaaagcagagggccgggggctggagtcacttttccaagacatccagcaagctcgctgcagtctgaactgagatcctggcctctgggagtctctgctagagcttctggctgctccaggctggtgtccaggtctccagagtgttcctctgttctttgtagaccagtggcaaggacctcccccctccggacccttccccagtggaacctgaggcctgaatcccatcaacatcagacccaggcgcctggcttccctattaaagtggacgtgttgtgagggcagaggatgctgacgagtaaagctgctgtgggcaacgggccctccctgtcaggctgggtggggaggagagagcggtggggactgcggcgtggggacagcacagggtggttctgagaggggctgctgctaccccactgggcaggagagggagccctctgctgccagatctttggatctattttttttttttttttcttttttgagacagagtctccttctgtggcccaggctggagtgcagtgacgcgatctcagctcactgcaagctccaactccctggttcaggcgattctcctgcctcagcctcccaagtagctggggttacaggcatgtgccaccacgcctggggaatttttgtatttttagtagagacggggtttcaccgtgttggctaggatggtctcgatctcctgaccttgtgatctgcctgcctcggcctcccaaagtgctgggattataggcgtgagccactgcgcccagcctggatttttaaagagaagatagaaatacagatgttcaggtagggtgtcccaacgttcaggtgttgtcaagtaattttttttttttttttttgagattgagtctcactctgttgccagggctggagtgcagtggcgtaatctcagttcactgcaacctccgcctcccgggttcaagtgattctcctgcctcagtctcccgagtagctgggattacaggtgcctaccaccacgcccggctactttttgtatttttagtagagacggggtttcaccatgttggccaggctgttctcgaactcctgacttcgggtgatccacctgcctcggcctcccaaagtgctgggattacaggcataaaccactgtgcctgaccttgccaagtaattttttaagttttacacattgtgcagtggggaagacacatctgtgggccaaaaccctggcggctctccccactcactctccgagttacctggcatattatttaccaccttctcccagtctcagtttctatatctgcaggaaggagaataagggagtagaatcacagcagctttgctgagaagataagctcgctggcgctggggaaggcctggagtgccttcccacgcatgatagacggggaggatgcatttccctgcccctgccttacagcccagcacaaccctgcggtcacacacagaactcgctaagtgccggaaagcagtgactaagccggcgctgggaaacagtgggccctgcggcatcctgcagatgcgttctgttctctctcacgcgatagacaactatggacgcgggagccggcggccacaacaggggcctctgtctgtgtgtcctttgtcccagcatctgctttaattcagaacgacaccagcagccctgaacttccattgactgttctctccaaagagcctctctgaggctgggcgtggtcgtgcctgcctgtaatcccagctactcaactacttgggaggctgaggcaggagaatcacttgaactcaggaggtggaggttgcagtgagctgagattgcgctattgcacgccagcctgagcaacaagaggcagactccgtctaagaaaaaaaaaagcccctttgaggcctcacaaatctcccttgcatccaacgggaagcaggattgagtgcactctaccccccctcccacggccgctgcctccagtcctacctgccgggcaaggggcatttaacatggctacacagacctgaatgtagacagaaccctaaagccactgatgccacagaggaggtgctcatctagaccagagacgcaggcttccctggctcacagagacacaggttgtgggaagagcgggtaattttaggttctgtttgctgagctgcaccaacgggcccaccaacaatgaaacacccgcattgaactcagcgtgtgtcacccaacaaaagggctcattgccacctgcacggaggcgacgccacctggatgctgaataggcttccaatctccacacagccgaccctggtgcccagcaacgtaggttctgtgctaattccagtagggctccaatgggaggcaatacaaatgttatcctctttttcaatcagtcaacaaatatttacagagctgctcctatgggtcaagccctggcccaggtgcaggggacatggaatcaaagacgccaagtcccctgccccaggaggccagtatttgcccctaattcacacgggcgcagtctggaaggagaccccatctccccgatgcattctcagtctccaggtttgatggtggttcagcaaatctcaaattccttcccccttgacctccatgggaggagctatcccctcccccattgtcactaggcttggccacctggtgacctgctttgaccactgggacattagcagacatgacgtgagcagtagcttggaatacatgggcaccgctggcctcgccctgtgagtgcctgccctccgccgtgagaagaacaggcctcaggtggctgcgaagggaggatgagagatgcagtgagcaggcctgcacccacccagagtggggagcccagcccaaccacggtcagcccggggggagccaaatgcaagaagactcacacacacctgagcaggaaatagccagtaaaatgtccaaaaatgtgcagcagtgtgctggttgaggtttaataagccgttctcccaggaatttagaatctttgatttctagggtttgccaatgactgtggtgtaaatactttcaccatggccaattttaagttaccaacgtaacgttgctgatcacacacttaggaacagatgggcactgccagtgcacaccctgaaacatgactagaaaacattaaatgatccctaaaattattttttcttagacagggtcctgctgtgtagcccaggctggagtgcagtggcctgatcagggctcactgcagcctgaaattcctggggtcagtgatcctcctgcctcagcctcccaagtagctgggatgataggtgtgtgccaccatgtccagttaattttttaatttttttttttttttagagatgggttcttgctatgttgcccaggctgatcttgaactcctgtgcttgagctgtcctcccacatcagcctcccaaaacagtgctgggattacaggtgtgagcccccatgcctggttctaaaattatcactgagcgttttgtaactctttgacttttctctcaaggccaaaccaccagtgatttttcaataatttttagtaacaatattctttttccaagtgaaataatcttcagaatgcccataaataaaacaccgacatagaaggatgaattccttatgatgttccaatcttctctgcttggcagaatattctgctctttgtggaactctgaaatgatttggcagagccctctgttcactgggaacaggttgaggaccatggtgtaaatggatttaggtgccgatacagaatatgactctctctagcacacgatgtaagaggacatgttgccacagtaagaaatggaatgctacctgctgcccactgacagggaaatgcttaaatagacacagggcacccaccgctgcctgtgttagcaacagcagcagctggcgtctagcaagggcttcctggagccatgtgctgtccccagcctttgcaggccccacctcggacccttctcccaacgacactgtgccgtaagcaccattatcaaccccctgttacagacgacaaaaccaaggctgggggaagttaagaaagtcacagaggggacagctgggcgtggtggctcacgcctgcaatcccagcactttgggaggctgaggcgggcagatcacctgaggctgggagttcaagaccaccctgagcaacatggagaatccctgtatctactaaaaatacaaaattagccggatgtggtggcgcatgcctgtaattccagctactcgggaggctgaggcaggagaattgcttgaacctgggaggtgggggttgcggtgagctggagatcgcaccactgcgctccagcctgggcaacaagacagaaattagtctcaaaaaataaaggaaagtcacagaggggcaacagccatagagcagtggggccaagattccaatctaggcaggctagcgctcttgacggtcgtactaagaataaaaaaggggggtgggtgcagtggctcacgcctgtaatcccagcactttaggaggccgaggcaggtagaccacctgaggtcgggagtttgagaccagcctggccaacatggcgaaatcctatctctactaaaaatacagaaattagttgggcgtggtggcacacgcctgtagtcccagctacttgggaggctgagtcaagaggatcgcttgaacccaggaggcagaggctgcagtgagccgagatcgcaccactgcactccagtccacaggtgtggaccccaacaggaggaatgagtgtagctcactcagagtctggggtgggccaggctttctacacgcatcgtgtcatccttccatggccctggagagaaagtctggccacccccatctcgagataaggacacagaggcttgggggtgaagacctgccgaggctccacctcagcaagcgtcagtcggactgcatgcctggggtctggctcctaagcccatgctctttcaatggcccaaacatggaatgcatggaagatttcagttagaagagaacttggcagctgccaaagcaggctctcattctacggaggaagcacctgagacccagaaagaggaagggcctcgttcaaggtcacaaggcactgaccatgaagccaggaggggctggcacggggcagtttcttggcagagctggctgagtggtttatttgttacaggtttgcttgaaagcgttctctgccgaagagtttaggagcgatcgtgactggttagtgcagcccattccgccgggtctggatggtgagtcgtgccagtgtgtcccgtgcgaacacggactacccgcctgctcccagcatcttgccctccccaggacccctgaaacggaggctaaatgattcacccaaggtcaccaaatacaagagaaacggagtgtggccaggcgcggtggctcacgcctgtaatcctagcactttgggaggccaaggtgggtggatcacctgaggtcaggagttcgagaccagcctggccaacatggtgaaaccccatctctaccaaaatacaaaaaattagctgggtgcagtggcgggtgcctgtagtcccagttactttggaggctgaggcaggagaatcacttgaacctggagggcagaggttgcagtgagccgagatcatgccattgcactctagcctgggcaaaagagcaaaacttcatcaaaaaaagaaaaaagagggccgggcgccgtggctgatgcctgcaatcccagcactttgggaggctgagacaggcggatcgcgaggttaggagttcgagaccaacctggctaacacagtgaaaccctgtctctactaaaaatacgaaaaattagccaggagtggtggcatgcacctatagtcccagctactcaggaagctgaggcaggagaatcgcttgaacccgggaagtggaggttgtggtgagctgagatcacgccactgtactccagcctgggccacagagcgagacgccatcttaaaaaaaaaaaaaaaaaaacggagtggaaatctgaacccatctggctcgggacggtctctcctctctcctctcgaaagaccccatcagctaagacaaggatccagtcgcatcttaggaaatttgaggctctacttacaagtgttattgctggtttgccatgcacaggaacgctgagaacaccatcgccctggcctcatcgaacgactccagagaggggcccacatctgctcaaccaagaaggagaaagctgaggtcttccaagtgttcctccccaacatcttgggtctgttcccactgactccagtctgaagagggtgatgttccctgctgtctgttctcactttgatcaggaccactgtggactggcgtgtacccacctctttttgtagaaactcatcccaacccctgagcctaatggttaaagttcaacccatgcctttcccaacagggtgggtccacagggattagtggcctctgctggggacaggccactcaggtcactgggctttgatctggcaaacaggagcacaagtctgccagggagctagaaaaactgtacggtggggctgcgtgagcaccaggggattacgcgggaggcgggggcgagtggatgagagcagagtccctgtttctttcatggggttgaccgtgtggtttggggctccgggacactcaataccaggcacaaagccatggtgtgcatgtgaggagggactggcaggcaggctcagaagtacaggaatgggactggccaaagcgctgctgggtagacaggccaggggagcagggagcttctgtccacccaccagggctcctgaagtcatggagtccttgcttgccttaaaataggtgcgatttgattcattcatcctccccggaagcaagatgccctgtggcttcggacacttccaggtcatgcctgctgtcttggcataaacattaacagggccacctttctttctttccttttctttttttttttagacagagtttcacttctgttgcccaggctagagtgcaatggcgtgatctcggctcactgctacctctgcctcccaggttcaagcaattctcctgcctcagcctcctgagtagctgggattacaggcgcccaccaccatgcccagctaattttttgtatttttagtagagatggggtttcaccacgttggccaggctggtgttgaactcctgacctcaggtgatctgcctgcctcggcctcccaaagtgctgggattacaagtgtgagccactacgcccagcctcttttcttcgtttcttttcttttctttctttctttttttgagatggagtctcgctctgttgcccaggctggagtgcaatggcgtgatcctgcctcactgcaacctttgcctcccaggtttaagcaattctcctgtctcagcctcctgagtagctgggattataggcacacaccaccacaacggccaattttttgtatttttagtagagacggggtttcactgtgttccccaagctggtctcgaactcctgagctcaggcaatccacccacctcggcctcctaaagtgctaggattacaggcatgagccactgcgtccagcctcttttcttttctttctttctttctttctttctttctttctttttttttttttttttgaggtgaggtcttgctctgtcacccaaggtggagtgcggtggtgccatcatggctcactgcagtctcaatcacccaggctcaagtgatcctccctcctcagcctcccaagtagctgggactataggtgcatgccattatgtccagctaattttaaaaattatttgtagaggcaggttctcgccatgttgcccaggctggtcttgaactcctgggctcaagcaatcctcccagagtggcctcccaaagtgctcggattacaggcatgagccactgcccctggcctggtacctcccttcatgcccagggtccacatgggtatgttagctggtcactctagccaggcagctggtgatatttgcagacgccaacccacaaagaaccttcctttgggtcctttgagcggcacagcagtttattcacccagacaccttttacctgtgaaatggaacccatgggattgggatgcaccagtttgtgacttcttgttgttgtttaaacttacaatcttttagggggcagggctatcataacttttcatagaatcctggaatcttagatctagaaaaccctacagaacacaggtgttgaaatgcgagtccacttgtaggctcctgaaagcccaagaatcccactgaaatcccccacacaatggatagggtctgcggctttcggccactgctctggtgggcccaagagtttgcttgcatttgttttgagcaacaaaaaccaagtctggatgatatgttctctccttcccacacagtcatggtggaaatgcacccactcttgggaagtctgattcattgtcattcattcattgacccactcactcattcattgactcactcactcactcattgactcactcactcattcactcactcactcattcattcactcactcattcattctctcactcagtcaatcattcattcactcattcattcattcattcactcactcattcactcacttattcattcactcactcattcactcattcactcattcattcactcattcactcattcattcattcactcattaattcattggcttttgcctccatttcctcatctgtaaagtagggaagattctaggattccatcatacacgataacactctgtcgagctgttgttgacacaagtgatgtccttagagcggcactttcattgctgcaggccaagctcccaccccaggcattgccagccccatgtgagcaggggcatctcctgagtacactcacctgggcagccgatgatgccccacaggctcctggggcatgtcctctgccatcctcagccgtcctgccctcttcagcctgcccagtttaggttgactgcgttgcagcagtacccgtgggctgggggtctccctgtcttcctcatctccctgctgccccatggcaggactctgctttacttacaaaatatcaccagccccagtgtattaatcagggttctccagagagacagaaccaatgggatagacaaacagatagatagattagagaaagagagagagaaagagatgatagatagatagatagatgatagattagagagagatgatagctagataggtagacagatgacagacaatagataggtagatagataggtagatagatggtagataatggatagatgaagaaagatgattggtaggtagatagatggtaggtagatgagagctagatgatagatgacaggtagacatgttaccagatggaaagtcttaacttcgagttgtccaggttcttggtgtgttaaagaattgagcaaaacacacaaacaaagcaagaaaagaacaagcaagtggctcaagaaccctgattaccatgttcttcagggtttttattaagctaaaagaatttggtaacacccccaggtgccctttagagggctccaattggttacatcctatgaaggattggcccctgaccaatcagaggcagaagtggaggcttctgttctgttaccgcagtagtgagactgtggcccgtgtgccgcccaatcttgcctggaaccggctgctcctgctgctcttttgcttctgccttaaacctgggttaccctcattccctattctcccgcctcaggtaggtgatagatagaaataaagagataaatgataggtagatcgatagatagatagatagatagatagatagatgaatgagaggacattaattaggggaattggcccatatgactatggaggctgagaagttccaggacaggccactgcaagctggagaccctggggtgctggtagcatggctcagtccaagtccgaaggcctcagaaccagggaagctgagggtgtaactctcagtccaaggccaaaggcctgagaaccctggggcagagggtggcattggtgtaagtcctggagtcccatggccggggagctgggcgttgtccaagggaaggagaggaagcgcacgccccagtccggcagatggacagacacattcaccttttctctgtttttgttctctctgggtcccagcagattggatggtgccacccacatccaggtggaacaggaattaaaacaaattaaagaatatgtaagcagaaactcagttgtatgtaagaaaacccaattccccctgagaaagagaaagtgctgaagtcctttaaaattaactgcctgtttttctgtggctagtgagccttctctctccctttcccaggcattgcgaagaccctgtttctctagccgtgcagctgcaaggtcataaacagataaactcaagtcgcaacgcatgtttttccttgaaaagtaagaaatgatgtaacgcatgtctcaattaattgaataactgtctttgtttctcgcttctgcaacgtgcttccccctacacagatctccctccaccccacgaaatgcttaaaaggtaacttaagctctttgttcagggctcagtcctttggatgttaatccgactgggccggtgcacctaaataataaatatctttttttttttttttttttttttttttttgagacggagtctcactctttcgcccaagctggactgcagtggcgctatcccggctcactgcaagctccgcctcttgggttcatgccattctcctgcctcagcctcccgagtagctgggattacaggcgcccgccaccatgctcggctaattttttgtatttttagtagagacggggtttcaccatgtcggccatgatggtctcgatctcctgacctcgtgatccgcccgcctcggcctcccaaagtgctgggattacaggtgtgagccaccgtgcccggccggttagcagtttcttatggttctttttgggaatttccatatcagaaatctcttacatatgtattctctttttaaatacaggaaataattatgtatagaggatatgtacttatagaaacacatatatatgccacctactaatttatccggaataatttttatatcagtgtatatagctcttcccttcttttaaagaaataactacaaaatattccactgacatattaccataatttattaaattacctctcttatagatggtgtacatagctcttcttttaaagaaataactacagaatgttccactaaaataagtaccagctgggtgtggtggctcacgcttgtaatcccagcactttgggaggccaagacgggtggatcacttgaggtcaggtgttcaagaccagcctggccaacatggtgaaacccccgtctctactaaaaatagaagaatgagccgggtgtggtggcgcacgcctgtaatcccagctacttggaaggctgaggcaggagaatcacttgagcctgggaggcagaggttgcagtgaactgagatcgtgccactgcactccagccagggtgacagagcaagactctgtctcaaaaaaataaaaataaaaataaatatatatatatctcataatttattaaattaattatcttacagtgtttttccttttttttttttttttgagacagtcttgttctgtcgcccaggctggagtatagtggtgcgatctaggctcactgcaacctcggcctcccaggctcaagtgattctcctgcctcagtctcccaagtagctgggattacaggcattgcccaccatacctggctcatttttgtatttttggtagagatggggtttcaccatgttgcccaggctggtctcgaacccctagcctcaagtgatctgcccgcctcggcctcccaaagtgctgggattgcaggtgtgagccattgtgccaagctgtttttctagtttttatggtttttttttttttggtcttataattaacattgcacttggccaggtgcagtggctcacgcctgtaatcccagccctttgggaggctgaggcaggcggatcacctgagtttgggagttcgagatcaacctgaccaacacggcgaaaacccgtctctactaaaaatacaaaaattagccgggcgcagtggtggcacctgtaatctcagctactcgggaggttgagacattagaatagcttgaacccgggaggcggaggttgcagtgagccgagattgcaccattgcactctagcctgggcaacagagcaagactccgtctcaaaaaaaaaaaaaaaaccctgaaaaacaaaaatcaaacaaacaaaaaaattaacactgcactgaatatccttgaatagaattcctaggtttgacatacataggtcaaagggtaaatccactgaactgctgatagatgtgccaagttactcaggcaagggattgtgctctcacctgctcaccttgtattctgggccaaaatgtcttatatgtatccaacccaacacttcctaatttcttagtttctacctcccacagaaaacaccgtatagtctgtaattttctgccagagttgaaaatttctcatgcagagtcatgatggtaacttttgtcaacccggctgggccatggtgcccagatatttggtggaccattattctagatgtttccatcagtgtgttttttgaatgtgattaacatttatacctcagtgaacgttgaataaagcagattaccttccacaatgtgggtggctctcacctaatcagttgaaggccttaatagaacaaagactgacctccctccctattcccccaaaccccctctcccaccccccattgagaaggaattctgccagcaggtgccctttggacttgaactgcgactctctcgtcagatttggggcttgtcaagcctccccaattgcatagggcaattcctcaagataaatctgacaaatctccctctctctccccatgtatagatagataggtagctaggtgtaggtttacttacacacacacacactacacacacacacacacatcctgttggtctgtttctgtggagacccttacaggagttaataaaaatccataactaaaggagattttttcattcttttttttttcttgtcgttttgagatggaatctcgctctgtagcccaggctggagtgcagtggcatgatctcggctcactgcaacctctgcctcccgggttccggttcaagcaattctcctgcctcagtctcccgagtagctgggattacaggcacccaccaccatgcccagctaatttttgtatttttagtagagacggggtttcaccatgttggccaggctggtcttgaactcctgacctcgtgacccacccgcctcggtctcccaaagggctgggattacaggcataagccactgcatccggccttcatttcttaaattagaaggtaggagatcaagaaactgctcctctctgcctgtttacaaacattcttcatatttgaacccaaaatgtttaagtcaaaccttctttaactgcttttttctaaaatggaccacgtgtacccagataacccttccacgtgcagaagactgaaatttctattcttatttttttctcacctattaagattttctgtttttcatatgttccgtaaagcacacactacgttagtacctaacacacagatgtaaatttacatgtatacatgttcatggcaagtgtgtgtgagtgagtgagagaggcctagagcccaccattctctgagaaccctcaaatttctctgcatcactttttgaaatagggctttattctcatgtgatagaaatttaaagtcatttctttttttttttttttttgagacagaatttcactcttgttgcccaggatggagtgcagtggtgcaatctcggctcaccgcaacctccttctcccgcgttcaagtgattctcctgcctcagcctcccgagtagctgggatcaacaggcatgagccaccacgcctggctaattttgtattttcagtagagacgaggtttctccatgttgctcaagttgcaaaacatgtttttctttgaaaagtaagaaacgatgtaatgcatgttgcaaactcctgatctcaggtgatctgcccgcctcagcctcccaaagtgctggggttacaggtgtgagccaccgtgcccggccagaagttgaaagtcatttctaaatgcgctgcctgcgctccatagtactctgtgatctcaaaatgatacactgtccatgaagaaatgctattttaggtgaaaaaatcaaataggaaaaacttgcattggacaaaatccttcaaaacacacagaagtttctgcacgagttttggtcacagtaatttcttttgctgagccactggacttttttttttccatggttagtgttttatttttattatttatttattattatttttttttgagatggagtttcgctcttgttgcctaggctggagtgcaatggcgcgatctcggctcatcgcaacctctgccttctgggttcaagccattctcctgcctcagcctccctagtagctgggattacaggcatgtgccaccacgcctggctaattttgtatttttttttagtagagatggggtttctccatgttggtcaggctggtctcgaactcccgacctcaggtgatccacccatctcggcctcccaaagtgctgggattataggcatgatacaccgcgcccggcctagtgttttattctttgaagaatgcttctaaaacatcgcgccaagtcaatctgaaaggtaaagtttaaaatctttttaaaggataagttatatgtaatgactgttcactctacaaaatcttaatcttagggcttatgaggcacccagttggcagtaacatccaggttttccaaatagccagttatcatttttctcgtctgcatagatttctcattaactgcctcctgttttgttgcatgatctcagagtccccctgctttctctgagaggtggtcaagctatcctcttttcttcttcgcttgctaatttcctgggttttcttcatgttttctggcgggcaagttctcgttgatttccacggaccatgccgaccaccgacagagccaggaagaaagcaagtcggaaaagcaacggttccctggcacgctgggctaccgtcactgctgctggattttttatgggtccatttcccgcaggcgttttttactgattgcgtgggtttgtacacctgtttcccccacctgcttcacagcggcaacttctcattaataaggactcaaacgctcagtagcccctgttgagatgctaatcagctgtctggcttgggtggcctggattaattgcaccgtacgcagcctctcctgaggagttcgcatcaacggctgctcccattctcagacaggaggacagagctgccagccggacagaacgtcagtgctgacgtcagcgttcacgtgtgcaggaggagagccctgagggaccccgctggggactggtgctgtttctgcctgcgcacacccagctcttctccctggcagctgctgggtttgctctgggagaccagccctccccacccgccctccacgaggctgggccaggctgacccctcccccagacatgtctcaggactggccactcggagtgggggtcattgccgggtacacagtctggccagtaagcatcgcccccgggagccttgctggaatgatgagaaaagaggccctctctctcccagggaatggttgaactggaaaaacctgttggtagttgcggggaccccttcatgagatcctgctcaggaatggggaaaaaccagccaggtgaggtggttcatgcctgtaatcccagcactttcagatgaagtaggtgggagaatcacttgagcccaggagttcgagaccagcctggccaatatggcgaaactccctctctaccaaaaaaatacaaaaattatagcaaggcttggtggcaggcgcctgtaatcccagctactcgggaggctgaggaaggagaatcacttgaacctgggaggcggagggtgcagtgagccaagatcgcgccattgcacttcagcctgggtgacatagcgagactccgcctaaaaaaaaaaatggggaaaaaccaagcccacagatgggaagggcggggtggagagagagagagacagagttagagacagagatgagagagtctgtgcagtggactcccgggggtttctggagccactgaacctggccccactcctggaggtgcaggctttggtgttttcagagggtctcatatcagcccagattgagaagtgaccacgaaggctgcttggccatatgtttggccaagacaaaggagaaatcagccaaattgctgggcctaagcaatgccactctctctctctcctctctctttcaaatgcatgttactacgcagatagtaagggtctctgtgacctttacaaatggcctggtgcacacacgtgtaagcggcccccatatttgaggccttgctgatccactttacaagtgaggaaggtaaggtacaggaagcgtaggttgtttctccagtttcagagggcaccgtatccacacagcagtgactgggtaggtcctggtctctctcgacagcccagagtgtgtggcctgtccccggagagggtgggatccacgccaggaggggctgagtggtgctgactgccaccccctcccatcacccctggatcatcatcttgttttccagtggggtctcctttcagggctctagttcaccccaaagctgacctcttccagtgagaccttcaaacccttacagtgcccttgcatgaagtggcaaagtcaggggaggggtggagagtggaggatgaattacagaaggagcccccctggggggaacaattgcaaagatgtgttttcagggacagtcctcacgaccgtgggcggtagccatgacgtccggtctcccatctcctggagctgtgcatccaccatccagtacagcacctggacactccctctcccttagcagtccccagcatcgggctcatgggcaagtcctgtggatttcactctgtggaacctctccaatctgtccatttctcttcatcctgtctgcactgcaaccccctgcagcaagcctccgtctctcacttggagcctgtcacagccttctccactgctctcctcaaattcatgcaggataatgtatttcctcctcccattccttttccagcactccagccagatggacttttctttttttttgagacagagtctcgctcttgttgccgaggctggagtgcaatggcgcgatcttggctcaccgcaacctccacctcctgggttcaagcggttctcctgcctcagcctcccgagtagctgggatcacagccatgcgccaccacacccggctaattttgtacttttagtagagacggggtatcaccatgttggttgggctggttgcgaactcccgacctcaggtgagctgcccgtcttgacctcccaaagtgctgggattacaggtgtgagccactgtgccaggccgccagatggacttctcaaaacacaaatctgatcctacccactctggccccaaactttgtaaagtcttccccattgcctcaggagcaagacgacaccccttcctcgctgacaaggacgcagttgtgccttcactacctttgctgccacatctcaccacctgcctcctctcgtctctacccccactgtggctgtgtgaccccaggtgtattgctcaacctctcgtgtcttcctgttcttcacaaagaataggaattacagtgaaatgtgcctggctcatgggcacccagcccatggtaacatgagcacatccggaatcagactctctactaaacgcttcatcacctccatgccatggacccctcccaatatccctgtgagctgtgagatctaaacaccagttcccagagtgggaagcgaggcctgagagcctcagcaacttgcccagggaaggctcagactctagccctggccgggcaaactccaagtcctcgcacttaagaacaaccaggctcagcgttccagcattccactcggcctcctgggcttttcctgggccaccgagtgcatcgtgtttactttctctttctctaccctagtgacattctcagaaagaggaaccgtcggaaggttccagggttttcttgatgtgggcatttcgaggtgttgacaaaaggacctctgtgacctttacttatggcctagtgcacacacttgtaagtggcccccatatctggtgccacacaggccagagtgcacttcccgctcctcttataatgccctcactaatgtgactgtaacttcattaactccaggccagattggatccttgtaccgactggtgagtaagcgaaccttcactacagacagctgtctttgctgatgactagctacttcatttttaaaattacggtgaatcaactatatgccaatattgaacaatgccttccttttttagcttcctgagcagcaaaataaaaactaaatcaaaaccatcaaaaataaaaaagtgtagtagctcatgcctgtaaccctaacactttttgggaggctaaggcggtaggaccgcttgagtccaggagttcaagaccagcttggacaacatattgagacctctgactctacaaaaaataaaaaaaaatcaggcaatggtggtggtgcatgcctgcagtcccagctactctggaggctcaagcgagaagatcacttaagcccgagaggtagaggctgcagtgagctctgattgtaccatcgcactccagcctggatggcagagcaagaccctgatgcaaacaaaacaaaacaaaacaaaacaaaacaaaacaaaacaaaacaaaacaatcactaactgcagcacaatcatagttttgattggcttaatttctgataatgcctagtcagcagtggccttcaacaaacctcactgtagcttgttggatggtcacagatggattcacctttgcccacaagttcctcctcttgtccactcacacctgttcatgacgccgagcccagcattgcacaaggcctggggataggggaagtgcagctccagacacggacttgggaatgttttgaaacaacaggaacgacatcaccctaggtttgtgttttcaagccagatattccggcgtggatgctaagaattcttacatgggcaagtattaatatttgaatgcagccgtgattgaggtggaggtggagacaaaaggcgtgcgtccctagaacatgttttgtccccactgccggagggaatattctgtgtcagctatcgcacgcaccctttccctccatgtgagtggactccacactctaagcaaggcgctctggactgcaaactcagcttgtgcctctctccagccctgtggcctcgctggacaatttttctaatctctttggagctgatcttcatgttgaaaaaggacaagtcccatcttcagatcaacacctgtcccagcgctgccattttgccaaggctcctccttggagtgtttgtaaggcacttttgccacgaagtaacccagccaccagcctcagtggaacctccaagcctaattctggaggagactttaactcggtaaggttgcccaaggtcgcatagcccatgactgcgctgaatcctgtttttattattggcaaaagggagttgggcaggaaattcaaggtaaagcattttgtttttctttctttctttttttttttttttttcttgagacggagtctcgttctgctgcccaggctggagtccagtggcgccatctcggctcactgcaagctccgcctcccgggttcacgccattctcccgcctcagcctcccgagtagctgggactacaggcgcctgccaccgcgccgggctaattttttgtatttttagtagagacggggtttcaccgtgttagccaggatggtctcgatctcctgacctcgtgatccacccgcctcggcctcccaaagtgctgggattacaggcgtgagccgccgcgcccggccagcattttctttttcccagtgaaaatagctgcctcgccctgtgtttgggagctcaaaggcattcttgctcattgcaaataattgaggaaacagaggcgagtataaagaagaaaatgaaaggcaaggtaatcctagattagcagagggagataaccaggaatgacatttctgggaactgcgctatggtttgggaattttttcctgtgattacccacaaacgcacatttgcacatttattctacgtgtgcacattcacgtcatcactttttttttttttgagacagagtctcgctctgtcgccaggctggagtgcagtggcgcgatctcggctcactgcaacctctgactcgcgggctcaagcgattctcctgcctcagcctcccgagtagttgggattacaaggcgcccgccaccacgcccggcataattttgtatttttagtagagacagggtttcgccatgttggccaggctggtcgcgaaccctttacctcaggtgttccgcccgccttggcctcccacagggctgagattacaggcgtgatccaccgtgcccggccgccatcacttatttatattatgtgttacctataggacttatctaagaccataatcactgccgcgtgtgctaagtcccgcgcgcgtgcactcaggcccctctggatagacactggggacccctgaccacttatgtcagggaaaacgccaccaagcgctccggaacctcagggcaggacccgccgcagcagcaggtaggacccgctgggggcgcacagcccacctgagacatcgtaactacaagtcccagcaacccttggtgcggggacaggacgggccaccggagtccggagagactacaagtcccggcaggcatggcccagacgcagggactacgagtccccgaatgcatggctcccagcttgcgcagggcaccctgggaggtgtagtagttgagggagctaatgcgtattcattccgtctcaaagaagatgcaaattcctcagaccgtccactgaggtgattgttctcacgcaggccatgggcgtgggcgaaaaacggggggaaaaaagccctgggaagccggtaccgtcgcggaagaaggccgcctgcgcatgctcaccaggaggccgagcgggaaaagcgcgcgcagctggcctcactgccacaggggtgccccgcccccgggcccgcgcgcccagtgagcctgcgcggagggcgggggccgagcgtcgcggggaggggctcgcggcgcctgcgcagagcggcggcttctctcgcgaggacggacgccattatcgcatctccccgacaaacaccacgagaattccgcagcccacacggtaattgcagctcccgcagccggtcgcgcctccgcctcccccttcccgcggggcgagagcgagagcgagatctccctcctccctcctcctcccgcccgccgggccgcccgcgccgcagccccgccgccgccaaccgcccgggccgggcgatcgccccccgggccccgctccccgtccccggccgcgccccggaagaggggctcccgcttcctcgcttccgcacccccggccccaccgcgcccggcgtccgttgagccgcggctgccgcagcccggcccgggggcctcgcgctcccgacctctgtcccgggcctcgccccgcgggaaggacccggagccacggcggggagactggaaaggcctagaaccgcgcccgggctcctctggggcccgaagtctcccaagggggtcgctcctgccagccaggcgggagcgacaggcatcgtttttgtgcctcctccgtggctgtggaccggagccccatagcccaggacttgcacacgcaaggggcgctctcggggaccgcagacctcggcgacgaccccagcccgtcccccgaggggccccgatgaacgaggacctcggggtgccccctccccagcacgtttgtgcgatttctgtgatctagtccttaaggaaggtggccgttttctttttcccccctaggatgcagaaagtagatgacattccatccacactgtgtgagcaaattggagagattgccttgatagaggactgatgtttttcactgatgagatggtaggggttgtcttgctattggagaaatacatcatccctgaagaactgtgagcaagtggagcgagtgtgggctttgaagggtagcgagcttgcaccctgaccggggagggcccgggtcacacagttgttgatgtggaacaggtaattgccctgtttggagttgcctgttctgcccaggaatgtactccagggcctgatggcgatgctggaactcgcactacagtaaataattgataagaggaggcagttgtagggttcacttttagctggaagttcttaggggacagaaaaataacttggagtagtgagtggttctgagtaagctcaggaaacgtcaaataaaaactggatctggtcatttaacacgcagctcgcagatatccagtgctagaagaaaacaccaaaacgcggtaaaattctgtatgtgggtccacttcccgtgtctggcgattaaaataagaatatattcttgcgatgttggattctgtcatcattggcgttaatatttttatttttttggagatagggtttcactcggtccccgagactggaatgcagtatcgtgatcttggctcactgcagcctcggcctccctggctcaagtgatcctcccaccgcagcctcctgagtagctcggaccacagacgccaccaccccggctaatttttgtatttttcgtagagagggggtttcgccttgttgtccagcctggggctttaatctttttaaaaaagagcttccatttgtgattccacgctgcgtgggggcagctcaacatctcgggtgcttcatcatgacccaggaggcagaggctgcgtccactttatagatgaggtgactaggcccgcagacactaagggacttgctcagatttacagagccagggttcgaattcagtctgtctgaagcctatgttcttaaaaaaaaaagcccatatatttagtattttaatcaatataatgtatacaataggaacgtcaatgaaagacttacaatgaaaagcaatggtcccctgccccacctctcagccccgttcttcaaagaggtttacatcttgagtggtttctttaggtcattctccacagctctgagtaagctgatcctttttatttttttcttgagataggatcccctgatgttgcccaggccgtactcgaactcctgagctcaagtgatcctcagcctccttagtagccgctaatacaggtgtgagtgactgcacctagctctaagctgatattttgtattacacagccttgtctttctattacgatggggtgatggagcccttctgtcatatcccaactcttctatcccctggactgtctgtgttaggcctatgcaaatactgttctcttcacggacaaattgagtgtttcccttcctgtacagcgtggatttttctgttagtcatggcttttctcttggcactttctgttcccatcgactccttacattgttttaaattctcaaggatagtgtcaggtcccctttctccttcagcccctgtccttctcatctggatgggttagcttgcacacgagccagcctgatattttcctttcttctgtagctgggtatgttcaggaatgttttcatcttggctctgttcgtttccacaggaacctctggcaagtgctcttcctccttgtggagacccctctccctccctgaacgctcttggatcttctctttggtgttaatgatgttttacccttgtgtgtgctgaggtgtgtggattcctacgccggggactctgactctggtgctttgtccttcagctctgggaagttcccttgttctgtctgagaagttcttcctctccagctctgctcttctgtcttaggagttcctgtttgtgatggacgttctaggtggagccctggagttgcgtctttatccttccttctgtgtctcgtttattctcattctgggagagggctttaatatgtgttcacaatcaaatttttaatgtccaagcatgtatttgtcttgtttctttttcatagtagcttattgttacacaagtgcctcatctccatgactctaaggaaactaataaggattcttcccagctctcctttgttctgatttcttgtttccactaatgtcacttaaaaaaagtgttggcttcttcctctttatggcaagtcctccatactgatgtttactgttgtctgaggcaggaggaagctggcggagagccccgggtctgtggggtgcttttgaaagagtccagtttcccctcgggtgattgggagcctgtcaccgtgggacctggagcaccaacttgcagatattttctctgggctgttccgcttctttaggaaggcccctttgctggccgtgggggagttagctctcctgtgcgggaccgacttggcaggtgcgggtttggcctgcccgcagggctctgcgaggcttggagccccacgcctgtgcccccggtgctttccctctgccctgatcgggtcctctgcatctgtcaggagtgtgttctttcttgtgggttgataacaccctattaaagatgatgttaatggagtgagaggaggtcacccgtacggccagtcactccccttgagcaggaatttgcaagcctgttctattcactccaccttcctgcttccttgtggccttggtaattgcccacagtcaacggggtgaggtgccaagccgccgttccacagccgcctctgaattgcagcgtgggctggtggctctggccctgtggccttggagggctgccagcgtacctgggcaaggcccggcagacccgtgtggtagcaaagaccctgactttggctcctcgctgggtcagtgtgccaagcgggccgtctgccctgctggggtccaggagggcctgcagtgaagcagtggtgagcgtactgggagcatgatctttctgcatggtggctgactgtcactgggaggttgtgtgtagtgcggtgggctctgtctgccagagccttgccagccgagcgtccaggggccagctgtgtccatcagcatcacttgggtatttgtgagaaacgcacactttcaggccctacccaggttctcgtgcagaatcagactgcagcttggtcagcttttaattttcagatagtttttgactttacagaaaagatgcaaaaaatatttcactgagcttccctgttgtcttcatctgcttcccctgatgttgacgtcttatgtaaccaggcatccatataaacgccagaaagttcacagcattattgcgtaaatgacagaccttattcgaacttcggttttgcaccagtgtcctcttgctgtttcgggatcccctccgggaccccacactggtgcgtgtggccgccctgtctccttaatgtccttctgtctgtgatatttacatagtcacaaagtatctcccccaagatacacgtcacaaagggaaaaataaaactgtagcctctcggtggaaaaacccagcagatactgtgtgaagcaagtgatcggggtaacaccatcagtcataagacgttgacaccaaggacccagtgagacacatcacttctctggcagtgttgccagaaatgcagtctcatcatgagaaaatgctgcacccaaactgagggatgctcaccacagtcctggccagtgcgtctcaagtgtccaggtcttgaaagacagggaggctcagaatttcctgcaggcaggtggccaggtgatgtgtgtgcaccctggtccacacggaaggccttcccacaaccttgagggaggtgagggagtaggggtttgggggctccaggcacaggtgctgggcagtgggcctcagtggtcttgcagctcccccgtcaggattgttagcctttgggttcctcgtctgcagtgatactgtacaaatcccaaaaactccagttacacgattaagtgattgacatgacatggagtcgcaaggctgacttgaaaatgactgtaactcacagcaccagtttagccactgcaatctagagaaactaaacatttcctcattttgaaggaaagacttcttggggaaagtcaatttgagggtttgaatgagaatgagatgaaagctttagaaggtcctccctgtgcctgaggtagataaacatctgtattttctcttcacacgggtgacggtggtgaaagcatgacatcatctgacttggtcagcagaagtgctctgaaccatccggaactttgggggcctgggggccgtggggaggagtttcaggaagttgaaaacagtattgggtggaatcacacacttgcaatttgctctgaaaaagctacacttgttttgttctcagctgcacctggggcccttcagcccctgcaggagaagaatggggcgagtgattggtacgtggccttcccagcctgcagagccgcctgctttggttgtaatcataggcaagctcagcctgctttggttgtagtcgtagacaagctcaggtttccgcctctgcacgtcccggtgggctcgcctgggactccctttgtctgttgtacaagactccactctggccccccctttggaagagacgatgtctccatcctcaggaagtagagaaacactctccgccaccctccatcctgacccccgtgcagaggatgaagtgctgtcccagaagccccctctcaggggtgccgtaagtctcagagagaggagcaccccggggcctccgtggcagaatcctgtgagtgtctttggttaaaatgtgcaggaagtgttaactcctaagctgccagcagatggtgtgccgagatactgtgaagtcacatgaacttgattcctgttggaaagaaccactctgcaatccttcgcgtctacacttcgtcaagaaccgtccaatttgattaaacattctggatcgtcagcgttcacggtggagcagactccacgactcgctgctcccatgggaggtgtctctctggggaaggggtcagtggtggtggaggatggcgcggtgctccattcggaacccacaggtcgccagcttacagcgtgggagctgtggaaggacacatggagcagaggcggctgaggaggtgaaaggctgagaggaggctgcagtgaaacacctgaggaaggctgggcagaatggatcgggggtgtgtattggctgcagtcacctcccctctgctcgtctgtgtccacattctgtcgtggttgagaccggatcctgtgtggaccgggtgggctggtgtggagtcctgtcaggagacctggggcggttttgaggcaagctcacggaggcctgccgcagggccctgcgctgacaaacctttcgctagtgaccagttaccttctgtgtctgagagaaggccgttgtggcctgtagtgattttccttttcccttgagatgaaaagtcatcaaatatctggaagcaaagcttaatctttctgaaagtagaaacgcgtttggatggagccgggagggagaactgggtgcgcgcttggcatttccttgccggtgtgaatgcgcttcccgtaaatatggcagaacgccttcacctttcaccagatgacgcggggggaattgggccacggtccctgctgtcatcatggcatgctgcaagctctgtgggcgctggtggccaggatgcggacaacccctgccgctacgtgtcctcaagtgagctcagctcttgtgtcggtgggagctggcggtgggtccctgagcagagtgctgccgctgccagtctgcgttttctgccgaaatgcgtccctgagattgagaaagttcacaccctaagtgtttttagaaggctgggtgccctgtttcccagccaacagttgtgactgtcagtgggcaaacacagtttgcaataattggcctgttgtcttacaatttctggctctcctctttgtggtgtaggtcatgttaggtggtggtccttggtcgtttgtgccacgttccctcatgttcttgaactctgagtccctagaaactgacattggtcttattttgagtgcattatttttcaaactttgggtctgaacccacatcaattgagtgggccatggccagtgttaagaatactggataaaatggagcatgccttggataaaaggagcatggttcggagtggctaacgggtaggtatcgactcaggaaacttgcagtgatgagtgtatgaacttaccatcgtaggccccagtcgagagcgtggaaaccactcttctgtgatgtgtgtctactagcgggtggttatgcacagcatttgactgaatttgggtaactctggatgtagtgtataaagtactttttaaaaggccatccactgggccaggcatggtggcccaaagctcccagcgctttgggaagcggaaactggaggatcactcgagcccgggaattggaggctgcagggctgcagtgagccatgattgcaccactgcactccagcctgggcggcagagtgagaccctgtctcaagaaaaaacaagcaaaaactattcccgttaagccgcttgcttaggggtgactgtgattgaacatgtggcttctcatccaagttgattttaatctctatggagatcagactaataacctcacagtagaaaatccaccagtgagctcagcggcacaaactcacagcccagcagtgtttgcagaggggaaggcccagaatgcgtggaggcttcgggatccatcctttgcagacatagagaattctcatgggggagggaggaccttgcggcgccttggcagtgaggggagcaacctcagcatgatgttggcacgtacactggggactgggtggtgacaccgtgcatgcccacaggggtggagatctttgtggagttcactgatggatcccagaggcccaggacgggatggcacgcttttctgtgagggtcagagtgtaagtgtttctggccttgtggggcgtgggatgtctcgtgccactgtgaagccgctcgactctgctgttgggctgagaagcaggcaccttgtttgtggacgctgacatttgagttttatgtaattttctcatcatgaaatattgttcttttgttatttttctgttttaaaatgtaaaacccattcctggctcacaggctgcatagaagcaggtggagagctgggctgggttgtgggccctcacgtgccaccccctgacctagagtgtgtttgccctgggaaggaataagacgaggttgtgtagagaggcagtggctggatggggagaggcctgggccctgcacagaggagctgaggtgtgaggctgcttgcgagggaggcggctgaccaggcttggtactagcaggctctccggggaggaggccccctggaggaacagcgctggcgtcagccacagaagggcttagcggccatggtcttcctgctgcagcccgtgtggttttgggagggacacatggagcattggaggacaaagagacggccagatcggagtgtgtgtggcagaggggcgatgccacccttcggagcgatgggtgccagggtactcggtgagagcccaggtcccgggtgagggggtgggctgagggggagtcagagagggaggagcctcgggatgcggaagggcgagagcagggcgatgagggtggggccgcagggaggtggccgggactcctggtagtattcttggggagaaagataacagggaagtgaggagggttcagctgtggaagtgctgggatggctgatccgagtgaccatggcctagacggggtttaaaccctggactgaagaaagtgccggtgagaggtcaaggcaggagatggagacctgggggtgacaggtgtccccggcacctcctacccccaccctgggagacagtcccaaggggcaccttcactgggggctggccctcatgcacaccagccaaacctcctgcccaccttctgggggcttctggagcagagcagaggccccgcggaccgtgaggatggccacagggaggggagatgcgaaacactggccgtggcaggtgcccacgcagtcaggagcttgcttgtggggctcttgtctgacacctgggagatgaatttcagtctgatggtggatctggacccagatggcttgcttgggattcagcagctcttgggaagagccacacttgaggatgggcttgggtgagggtttggaacgtgcttaaagaggttggcaggcaaggatttggtggtagcaggtggggcacatcgtgtattggcagggttttgttatttttatcctaaagacatacttatttgcaaaccttctattttggaacattttgagatgtatacatatgtggcagagatagcatagggagtgcccttgtgcctggtacccagtttctcccgttgctaacaagacgcatgacagcagttcatggcacagtgttgggtgtgccccggccaactcagcagatgagctgtttcacaaaatcagtgattctgctctgataaaatggcaagtccacggaaagcactttcattgtattttgaagttgggtggttgttgagggattatttgagttgtagttgaactagctgctcttttcatggaacactataaaaaaataatttacagattactgacatctcttactaaatgagtgaagttagcctctcacctcaaagaagtcagctaacagtgtttgttgccagtgataaagtttgagctgtcaagtgaagttggagttttggaaagtttgtctttgccaccgtgagcccgagagctcccaataaatcagatgccagtgctaatgctgatgaaccgtatgcttttgatattatagactgaacaacatttgcaagagctgcctaactcggtgaagcaacattttccagatggtcgatgcgggatcacgcctgggtaaaagatccatttagagtacaagtcaagccaatggatcttaaagccataaagtgcagaagctcatggatacagttcacattccatattgcaaacagcctttaaggaaaaataaaacacacttgttgcgtgttggtgtggtgtcaaagaggaatctccataattatctgaagagcctattaagatacttttcccttgtctaactgcatctccttgtaaggctgcattttattttattttttcgtactttttgtagagacagggttttgctgtgttgcccgggttggtctcgaactcctggactcacagaatctgcacccccccgggcctcccaaagtgctgggattacgggcgtgagccacttcccctggtgaggctgcctttttgtcatatgcatcgaccaaaacaacatatcggagcagaccaccggtggaagcagataggaaactctagttgttttcaattaagccgggcattagaaatttgtaaaaatgtaaaacaatattatccctcttctcattaaggttttgttgttctttggaagctatagttatttttcataaaacatgttttgtatgtaccatgaatgtttgtcccctttgaaactcatgttgaaagctggtccccagtgtcacagtattaagaggtgattggatcatgagggctcagccctcaggaatgcgttcagtgcatttatagactaatgggctctcctcgtggtgggttagtgatcatgacagggcgtctgttataaaagccagtttgggtgtctctcatatccccaccagcaggaaggcactcctcagatgggacccctggaccttggacttctcagcctcctgaactataagaaatgcatttcttaggctgggcgcagtggctcattcctgtaatcccagcactttgggaggatgaggtgggtggattacctgagatctggagttcaagaccagcctgccaacatggtgaaacgctgtctctactaaaaatacaaaaaattagcctggtgcagtggcgtgcgcctgtaatcccagctactctggaggctgaggcaggagaatcacttgaacccgggaggtggaggttgcagtgagccgagatcatgccactgcactccagtctgggctacagagcgagacttggtctcaaaaaaaaaaaaaaaaagaaagcacatttttttcctttatgtaataaattaccagtctcagatactcagttatagcaacagaaaacggagtaagacagcgttaatatgtaatgtgttaatttgtatgatttttacatgaattaaaaaatattcaaacattttttgttctaatttcaaatatggtaaatatcgataggtagaatctgtacaggtgcaagctcttcaggaccctcagtagctttagaatggtgaagaggaccctgaggccagaaagtcagaattactgccttagagcctagacgcttcttaagatgtgtccctggaaattatgcatgctcaggtgaaattatgcatgctaatatattcaggtttggaatttgaccacttacttacaaatttgaatttttcctccctttcccccgcaagcacacatttggggggccatcttaaagaaaaagcagtgttgcctgaatgaccccaagagtaagtgggagccgtcgggagaagtgttcttgcttctttctgatttcccgcctatctagcatccgatcagtcatttatagttttctttccagttatttcccatctcattcttgtacgttccacttcagactgatttcgggcaaaagaagtaggctgagacttcttcacatgtctcagtttaataaaagttgacttcttcatgtcagttcatcctgcctttctcattatttcttcctttctagacttacatcccgagaggatttgactaaatggaatgattaatttcttagcagtttcctcgtttcgggagatttagctttttaccaggtaccacttagtctcatctttaagtgggagttcctgtcctaatttttatggctctttggacttgccattccagctcgggtggcctgggagtctccacacagaagccgtctgaggagaagggcgccaggacgatctggggatgggctgggagcttggtggccgtggtcccttcttgtcactttactgtctcaagcgtcttctctccctggtcgcacgcgctgtgagcttattgttctgggcgttccccaccctcagttcccaagtgcagtgcaggccaggccctgtgctaactttttacagcagggaatatactcagttcatatttttgccatctgtaaagtgaggtaggccccttcaagacatgtaaggagtatctatggctgtggaatgcatctttttagactggccgctctgcatggatctgatcacgggtaggtgctgtgattcacaccacgtcagagccccgctctgggaggtgacacatctgggctatattgttccacttcctgtggaaatgactgcgtccaaatcagatgcagccttaggacttttcttaagggttgatggaagaaacagctctatgaagaatgtctgccctaaaaatactgacgggaaaaaacccgttacgttgtgacacccctaatgatgcatgtgatgtggcttaggtagcgacagagaagatcctggtgttgaaggaagccctagtgttaaatacaggaagcctggcttgacttttcttgctgctgtttttcatgtgatgctgataatctatagcagtttgttttttaactttgactgttaaagccaagttttctgcccagttacagtgggtttccttttagtcctcttttaatggctttgtggttttgttttatgggtgtccaatatttttgaaatagtaatagcaaaattaaatacttttgcagctgtccgtttctcctgatgaccagctaccgttagcctttgctgacagtggatgggcactgttcatcagatgtgtcaatcaccctgattccacattcatgaactgagtagttagattagtaacttaattatagcacagtccttattgaaatcaggacatgggcacaacacactttgaaaaccttaatccatggtttttaaatagcatttctgacattcatcattgtgcattggggaatgacgtcagtggtgtgttctcactggactcatcacagacgtattcactggatgcggtgcgggccaggcccggtgccctgctgagaacacagccatgccaattcctgcccttgtgaagctcaccttctagcaggagacactaagcaagagaaacctttcagatgtgtagtaagtcagacagtagagcaggaaaggctgctgtgcacgtcaccgttgccgaggcgtccaggaggcgtgcaggaggcgtgcaggggtggccagctccgtggtaggaccctgagctgagtgtatccctgagaagcatggggaggcccaaatgcaggggccgagtgagcgtggcggggaggagagccccaggggctgcagagggcccgtgagatgggaagccctcggagggcttagagcagatgaggggcatagcctggcacgtgtttttatgtgacgccttgagcgctctttatcgtgatcacagcagaggtgcaggtgacagtgagacggccgtatgtgagcaggtctgaggggcggcctgggtccaggttgggagtgacaggctgggaagacgaggccggatcagggtgaaggagaggagaacccaggaggcctgaggttttggcctgagcatctgggaagtaggtgttgccttaaattgaggtggaaagtgtggaagaagcaggttggtttggggtgggtgacaggggctcagtttggacatgttagaattgagacgaccccttaggggagacacctagtaggtggtgtggtgtgaggcctggagttcatgtgcgaggtctgagctggcagggtgataggcgccattggcgtggagatgtatctgaagccacagactgatgagccgctgggtcagtgctggctgagcaaaggttccagggccgtgccctgggcatgcatcctcaagtcaggaagtggatgtgggaccagcagagagacagaggagtgggggccaggcagggaggacagcgtggggaggagccggaatgagccccatcaggccctgtggtggggagaatgggggcagcatctgggctggagcagttttgggggagtaactgagtgacagcccgatgggtgggatctggaggggatgtgagcactgaaaatggagaccgcaagtacaggcggggcttctgaggaattttatctgaaagggaacagagaaatggggctggggctggaggggcaggagggagggcagcaccgtgggggaagggtgtgcaagggtgatgctgagggaccagggaggggtgctgactgggtgtggggcacatgcccgaggaggcaggagtgggcattcttgggaagtgagagggaggagagcaggatcacccactaagcccgaggcgcagagggtccaggagtaggggagcgttcgcatggctgggcggggctgggcggggctgggcggggcttgcagcatcaggcgcacctgaggttgattggatgtggattctctccccatccctgcccgaatgtgtgggtccccatgccttggtggctgagaagtggatttaaggccaggttaaagatggttctgtaaagtttatcaagatttgatgtagttggccttgcctgtagacacatcacttggttgtagaaacagtttcacaggtaataaataagtaaggcctacggaataaggcctatggaaagctcagcagtccaggagggcggagtggacaggagagtggggctcgtgcagttggagcgtccctgctctgggtagcctgaggtttgctatttgtcatccccaactgtcttggatgtgttggcacacctggacagatgaccacacgtggacaccatgtttaggaagcagaattgggatcatatcatccgcaccgctgtgcagctttccatttgtatgccttccttttgctatcatattctggagatctttccattttggttcatgtaattaaatcagtctcatccatgtgaatgacttggtggtgtctggcaatctggatgggcgtggattcttcaccactcctgttctgctgtacattcagggtgttactctgggctgtaggccctgctttcccatatgcgccctgagccctgcatctcttggtggacttggtagggttctgaatagtcgtcagagtaagaggcttgcttgagcattagtctcagtccagctgttttattgtattaagactggactatccccaggacttctgagaaatggcaaatttaatttgccaaaatagcaaccacaggcattgctgtgttccagttttcttgggcttgttgccctagttttttctattgaaatctttactgttagcagaattttaaatgactcttgatcctggcaacagaggcattttgagtaaacaactcgaataatgtgtggtgtcctcatttggaagaggttaggattcaggattttatggtgagttcagagcattttctgaagccacttgcagagcttttagaaactagcaaaa

SEQ ID NO: 41 - DNA, 152744 bp, Homo sapiens
tttccagccttgttcacatcccccataaaagaaaacctttggccaggcaccgtggctcatggctggaatcccagcacttggggaggctgaggccggcaggtcacttggggccaggagttcaagaccagcctggccaacatagtgaaaccccatctctactaaaaataaaaattaaaaaaagtagccaggcatagtggtaagtgcccgtaatcccagctactctggaggctgaggcaggagaatcactggagcccgggtggcggaggttgcagtgagctgagatcacaccattgcactccagcttgggtgacagagtgagactccatctcaattaaaaaaaaaaaaaaaaaaaaaaggccgggcgcggtggctcacgcctgtaatcccagcactttgggaggcctaggcgggtggatcacgaggtcaatagatcgagaccaccctggctaacacggtgaaaccccatctctactgaaaatacaaaaacaaaattagcctggcgtggtggcaggcacctgtagtcccagctactcgggaggctgaggcaggagaatggcgtgaaccctggaggcggagcttgcagtgagccaagattgcgccactgcactccagcctgggtggcaaagcaagactccatctcaaaaaaaaaaaaaaagtctggattggccaggtgctatggctcacacctgtagtcccagcactttgggaaccccccaggcaggcagatcacttaagcccgggagtttgagaccagcctgcctgggcaacatagcaagaccccatctctacaaaaagttaaaaaaaaattagccaggtgtggcggtgcacacctgtagtctcagctactcaggaggctgaggcaggaggatcacttgaccctgggaggtcgaggctgcagtgagctgagattgcaccactgcactccagcctgggtgacagagtgagaccctgtctcaaagaaaaacaaaaagtctgggtcgggctttgattttgacattcccctacctgtgtccacctccgtcgacagggctggacgttggtccctgcagtggcctggccggtctctgggcacccgtaactgctgcagcccagaagggagcccctcccaccttcccgcagacctgcgccccacccaaggggcccggccgccgctcactcggggcccccgagctgagatggggtgctggcttcattttttttcacctcttccacaaatactgaccaaggcttttgttcaaccagaccctggaactgggggacccagtgggggacagggcagatgacctgtcttcaggaaccttcccggggtgggggtgcacccatgggtgactgcaagaacgctaacaccagcactgcgggtgcagaccgtgctctggggggggacaggggctgggtcagggcaggcgtctgaccatgaagggtggcctggagggagagtgatccaggctaagtggaaggcagtggaaagccccgggacgggggcggatgggggtgcggggcagagcttcggggactccaggggcccagcctgactggaaaagggagattgggcagggccagggctggtggggctgcagctctgtggggcgtctgcatttctcttcaagggcaggaggagcttttctgactggtgttcggcaggggactgagggatgaagaacaaatcagggtttttaaaggagttgacttgaaaaggttgcaggccgagcgcggtggctcacgcttgtcatcctagcagtttgggaggcctgtaatcccagctactcaggaggctgaggcaggagaattgcttgaacctgggaggcaaaggttgcagtgagctgagatcataccactgcactccagcctgggtgagagtgagacttcgtctcaaaaaaaaaaaaaaaggttattgcagcaccgaggactatcgcaatgggggatctctgctcccaccacagggtctacaaggagctccagggttaggcaaaggctttttgttttttttgagacggagtttcgctcttgttgcccaggctggagtgcaatggtgcgatctctgctaactgcaacctccacctcctgggttcaagcgattctcctgccccagtctcccaagtagctgggattacagatgccccccaccatgcctggctaatttttgtatttttagttgagaaggggtttcaccatgttggtcaggctggtctggaactcctgaccttaggtgatctgcctgccttggcctcccaaagtgctgggattacaggtgtgagccactgcacccagcctgggttttttattttatgggggtgtgaacaaggctagaatctgtgtggggagttgggcgcggggcctgaggggcagtagatagaggggttccccgggccagcctggtctcagggagtgggaagtcacaggctggcccaggctgagggggtccaggtcctgggcctaggggagggagagcagccgagctgggtttggtcagcaagcattttgttctgatggatccctgccggtcatcggcgaggtcaaggggactcagggcctgggctgggccttgccctaggtagacccggggtgggggcatctctgagtctccctcaagtcacatgggaagaggtttctctgcacaagcagaacacaggggtcaggggtttcttaaccttcactgtttccaggagcccaaggctctttgagctccatgttggcaccaagcatctcgaaggagccagctgggctgggggccaggcgggctggcagtcactgaaatgccacctgggagggccgccgaggctgaggctgctcaccatgctggtagcagcacctgcagggctggctcacctgtggctcccagccccaccctcggatatcactcagcaggcccccagggagtccccagatgctggtgcaggtgtgttggggcctgtctcaccggtgacctcacatggccagtgtcgggggtggggcagcctgtgagttctctccttcctgtccctcgacaagcccaccctaacggtcaagtccgcaaaggggtacgcacctgccgcagggccatccaaggtccccagctccaaaaattgctttccaaattccagctcccttagagggcagccagttctcaattgtgagggggtgagctattggattaatttgcctttgaacagcactgagaggcctgggcctcaacttcccagtagtgaagacattactacaatgcgcccgaatccttccagaacccatgggaggtgggtgggcccttcctgcctgggtggtcagagtggggggctcacacagatcctgagccagggctctaggtgaccctggttgctgcaaaggttcccagctgcaccccagaatgccctggtccatcactgggcaaggtctccctaaagaaagggctgcggggaggggggtgcccagcctactagggaaaagccgcccaacccccagtcccaggagacctgcagccaggaggcctctttgctaataccctgtggagctgactgctcactccagtgactttgtatttctggagccctcccagctcctcgcgggactcggtggctccaggataagactcagactatggggcccactcagggcctgtcccccacctcccgttcagctgggactgcgtgagtcctgcagataggagcagccttcactggatccaggacggagccctatggttgccttcccaccccgtgctgggaggtggatgaggggctcatgctctgagccccggactcgcccccttaactgagaggctcgggagtgtcctgggaacacagaatcggtgccgcttcctctcctgctctgatcccaggctggagaaaggcttccttcctgacctcccaggagctggagccccgcatcctctcagcgggtgacccccaaacccctcccaacttcacccctgcagctccctgggactggaaccttccccctcctccccggtggtctccacctgaacatccctgcgcaggctgcctgccccccactcccgaggcagatccgatatcttggctcggcacccccaccctcgaggggtgcgtgctcacatgtgtgcaacccgcccatggctcacccccacccagcggcctaagtgggctgtcggtgaatgaatgaatgaatgtgtgaaggtgggaaggaatgaggtggccaagagggggccaggaacgttcctatacacagaacctggcgcagaagaaaagaacacagaacatcagcggtaggatgattgagtgtttctttaaaaataaaaaccccacaaaaaagccagaacaccctacccaacccagcccagtgtaacaggttagccattaacacagaataaagaaggtcccagccacacacgtcattactcggcagagggtgtccagcctggtcggccgacgtcacagtggatggccctgcgtggctgggacacagacagggagcaggcatggcacctgcgccacgcagagcagcaaggctgagcatgaccactggaaataaataaacatggtgccgacagcatctttaaattagtaagacgttagcacaaaacaaaaaagcacaacgactgaaaatgcacttgcttgttgtggtgggttgtgcttgaaaacacctgaagcccacaagtggaaaccgctggggacgtttgtcagtggagtgtggagaaaaagggacggaaaaatcaagtcttctgagacagtcccctgcggtggccctggtccctgtggaattccagcacagcaggagggggagggggaagcaggcctcagtcagcaccgcgggacacggcccctaccttctgaagtggggtccccaggctggagtggggcacacagcaccaaggatcacagactggaccccccaccaaccttctgcggaggagctcccaccccagctcagacgcccagaagagacctgcgcagtgtgaagacggaccccagcggccccagccatttcactagcagctactttccacaacagacgctggcagcccccatgctcgcccacagccgcagcagccaacaggcaagtgcgtgccgtcgagaggccgccggctccctgtatccttgaggcatgtccacgtcccagagcaggaggttggaacagaacggcatcccgaggacccctagccgaggcgggaaggtaagaggctgacgtcgtgcgtgggccccgccggccccagtgggaagcagtggtgcgtgcctccagggagcacttctcctggacccggggccgtggctgcctacgatgtccactgcctcctggattcacacagcaatgcaccaggcaggtggggcaccagctgctgtccttatttgcagccaagagaacaggcccagagggaagaggtcttgcccaacacagtcagtccacctgcctgctggtggtcctcggcctccagaccgtgggctgtcccttggacgagtggaattcgtccccaggaaggatgcaggtcctatgagcagacgctgtgaagtctgtccatgtgcagcgggaagcaacggggcaggggtgaataaaggtcttcattcctcaagcaagagagacggacatctggtcctgagtccccaaactgttcatcaggtttctccgggcccactggatggtgagggggtcccggtgcccaggcgggggcggcaggctccactgggcacttgctgagagcttgcggcttgagcagccgctggtcagtgaagccgtgtccggcttcgttggctcccggcttgggacactcagggctgtgccacaggccagctcctccagccacagctgagcactggagtgacgctggaccacttggctccacctctggctggggagaagggaagcccggggcctgagaaggcagagccccccgagctcaggagggatcctgcggggtcttcttgttctgggggtccctggctgctgccatggaggcagcgacagctcaggaaagtgggccgcattggccaggcctcggctgcctcccatagcgaaaaaaattcacgggaacaacagaaacaaggggtgccctagttccctctctgcaggcgggtggggactgggtgagagcccaggggcctccaaacgcaggcggcagagacgtgagcagtgcttggctctgtctcctagacaacgggcatcaggaccaggacaggacatgagcgtgacagggagagcggggaggtgcctaggccgggagtgggaacccagcaccggccagaaggggctgccgggcggtacagaggccaatgcattggaggctgagggtagctgcgacctctggggcaggggacactgctgtgtggagcccagggtgggcgcccacatgggtgcctggccgcggtgtgtctgcctttcttgtctctgtttctagaagactgaaggacagggctttgtctgcatgaaccagaactcagcctccaaaactggacacagaaatagccaagaggccacactgcccagaggccaggcctggtgagctaggggagatgccggcaccccccaaccctggggctgttccctggctcaggatggtgtctcggggctaggattatggtcaggagtccatcggggcctcaagcacctcctgggaggaatcacccaccttgcccagatcccccaccccctcccagtgccaccctacggctgagtttccactctgcaaaccctaaggcagagacataagcccacagggttggttttcacgaatgtcacaagcccatgtgtctgggcagctgtccggcttcagtgcaagtctgtggtagcaatgaggttccaagtctcagtagctctgtttgcccagggtctgggcccttggggcaggagaaaggaaggctcctgccttcccccagctccttaaaaaatcatcttagtggtgtcaagttgacccaaaatttaagtttaaaaaaaatatatatataagtaaacaaaggagggaagggaaaaagggcccaaggagaccaaaagctgctcctgggcaggagcacaggcacacctgggtccctggccctcagttgagggatgagattcgtaccagagttttcacagcagcctccactgcccgacctgggagggacggcgagggactgggatgggcagctgagctgtgggttgcggggaaccggagtgggttcgaggaggtgatctactttaactggcctctgcgcatgctcctccggcagccactcggcctcctggctatgtctcctgggggaccacctgcatgagcttctgacacaggacggtcgtggagactgtcaggagagaagacagctgtgttagcctgggggctgggtaggcacccgtgggacacgggggcgtgagctggggctcccccagccctgctgtcaccaaacccagcgccgctgcccagcgctgggattttaaggaaccttcccttgtgtacttgcgcatgtgggtgccgggtgcccgaggcgctgtcttcaactgaaatgcggaagtgccacatcccactcggcccacccctcgcctgcttcagaaccctggggaggcagagtgcggcccctggggcacacgaaccaggccctggtgtctcagcaaagtgcaacggggggatgacaggccttcctgcaggtccacacccgggccaccacctggacacatgcctggactgttcacagcaggcagggccggaggggccaatctgctaacgggtcctcggaagacctgtcgcgcctgggactgtctacagagacatcactctgtggagggggactgctttcaggatagagacgggggtttgctttaagctcttggtgtcctgaatgacagttaatgcagatcccactgcaaagcttgaggcaaatgttctaccatgaccctggcggtgatcagagtgtggggtaggggtggggggtctccctgcctgtgttgctgccatcccgggaattctccaagccacccagtgacatggggatcagcatgtaggcccgcaagcaccccggcctttttctacgagcctggccacatttgcaggcgctgaggacggggtcctgagcttggtgacaaagcacccctggggctgccgctgcacacagggccggggggcgggtttctccttctgcctttttttttttttttgagaagagtctcgctctgtcgcccaggctggagtgcaatggtgcgatctcggctcactgcaacctccgtctcccgggttcaagtgattctcctgcctcagcctcctgagtagctgggattacaggtgtgtgccactacacccagctgatctgtgtatttttagtagagacagagtttcaccatgttggccaggctggtcttgaactcctgacctcaagtgatccgcctgcctctgcctctttctgcctttctgggtaagtctgctgtgtccgctggtggcagccagcaggattttgttacttggcagcagtagcctggttttccggaatccctcgtcctgagagattagctggtgctgcgctgtgtgtcttatccctgaaccatgtgggctgcgtgtcactggcggacactgcagtgacctgaaccctcctgccacccaacacgcttcgccccatgtgggtggagacggccgacgcctctcaactcccttcgctgcccagggcagagggtaccacgggctgtgggccagcgagatactcacagatgccctggaggagccacttgggcttgtttttccaccagaccccgaagaagtagacgggcagcccgctgaggatgatggtgaagccgatgccacactccacgggtgtcttccagaaggagacggcgatcaggaagaggcaggccaggatgaagaacacaggcagggccaggttcacctggggcagaggacagggcctgggtgagccctctcctgtccagcctccctcccccatgccccgaggttcctcagccctcctgggccctccacacccacggctgctgacttccaggtcaccaagatgcgatctgcactccatctgcctcacacaccgggctgtcccgccctcgactctgcatacagtgctgggcatgttgccaggggctcaggcggcttatgatgagggatggaaggagacagcttcgtctcccgaggcctcccacgggcagggaaggtcacggctccattcccacatcacaggcctggaaaccctgagccgccaggacgcacaggggcctgatgcttccaggagacagtggccacccactaataagccaggagaccaccctcttggagacgccgctgtggacagcgctgagcaaaagcccatccctgaagctgcagcctaaactgtcaccttcagcagatgagctccacccggcacagaagccaggcagggctgcaaggagcctgcaggccgcaacctgcggctcggcatggctgggggattgactcagctgtcctgaatccatacttggacagggcaccctgggagatgcagggctgaccacaggtcccagcccatcagtgtgggctgcatgactgccctgtccccagggaacagacgccaacccgtgcccaggctcacaacagtgggtagagcctaccccatgcccaggtccccatgggggctgagcccccgctgtgcgcagtgactgccctgtgccctaggcactgccccaggctggcacagcaggcacaagctggtgcccatgtagggcggctcctccctgccctctgcagccttctcttggggcagcatctgggttcttgtgctgactgtattttaaagcccctgttttttttgtttgtttgagacggagtctcactctgtcgtccaggctggagtacagtggcgcgacctcggcctcccaggttcatgccattctcctgcctccacctcccgagtagctgcaactataggcgcccgccaccacgcccagctaatttttttgtatttttagtagagacggggtttcaccgtgttagccaggatggtctctatctcctgactttgtgatctgcccgcctcggcctcccaaagtgctgggattacaggcgtgagccaccgcgcccagcctaaagcccgttcaacagcattcacaggcacccccggggcccccaggcttcgggaacacagagggagagatggtccgggcagggaagcaggggctactgtgacagccataggccagctgagtgacaaaagctgctggctagcagccaccaggggctctggcctcttgttctgtgtcagggccagggcggcgggacttgctgggccccaggcaagagcatggcctctgctggacggccccgtttttggagaaggcagcccacggataacagctacccctctgaatgagccgctggggacggggagagtccaggagagtccagctgggcccaggcgctcctcgggccgggttccctgcattcctcctgccagcacagccccgacggccctttgaatgctgcgccaggcccggctctgccccgcccctgccggggctcaccaccgcccacctatgactgcagtgtccttatctgcttccctccacccaacggagcacaagctctgtgccatctgctgtcctttgaggaaccccggctcctgcagtcacacttggcaccctcgtagctggtggtcaagtcatcaccggaattagtcgacccaggtgcatgcaggcaggggcaggtccagaggctgagctgggatgctggctcccaactcagggtccttaggacccacggaccctgcctctgtgaagggtgcctgggtgagcgggaggccccgggctcaccttgatgggccgctcaagctcaggctttctgtggcgcagccagatcatgccgatgatggccagggccacgcagagccagttgaagaagctgaagaagttgatgacggagaagatgtccttggagaaggcgtagagcagcgtcatcacacactggaagagagaggcggctggctgagccctggggcccacgagcagggctgtggacggccgtggtggccaccggggactgtccagcctggctgggcccagctgagcaccagggaattttgttttaaaggagaaacctcatctgagcaacatgcaaggtcttgaaggaggaaaggagggaaggagggaggagaggaggagggaagaggcggggaggagggaaggagggaggagaggagggaaggagggaggagaggaggaaatggagaccacatttgggttaaggacaggtgaagaacacagtgtacatacacagctgggctctgctggactgtggctctgtgtgcgagggccacaacctgacctaacccagtggtcaccaagaaaacagtttctgtaacccccggcacagccgtgctcccgaggaccgtgcagctgccaaagagtccaggacttgctgcccttcctgactggcttctaactcagggaaggagtagtaagcaagggccaggacctctgaggccagcccacagctgccagaccccagcttcctctgctgtatctcactggctttgggggaagcagcctgttgggggagcccagtgtgctcaggggtggggcctgcagcccacagccctggaggaagccactgtggagtggcctctccagccctggtcacaccctacgatgagaacacagcttcaggcaccagctccctgaattcctgacttacggaaactgtgagataataagtgcttttccttttagaacactacattttggagtgatgtgtgacacagccagagggaacaaaggcagtcacgcgggctggcacggaaagatgcaggagaagcggaaggaaactgtgtgtgatgcaccccgctgagaaacgaacagagtgggcgcccacggaggtgcagtgagccaggcggctggcagagcagcaccccgggtcagcttctgcctcccgcatttccgatggtctgaatcgtttgtggcagccaccatatattatttttggaataaaatctaaagcccctccagcgctctctggcattcagcggagctcggcaggaggccacatttgagctgtcacccagtccacaccccagacagagctgcaagctgtggcagcctccctctgggagcccccggacaacccccagggatgtagggcacagggccgtgcagcaggcttaccgtgaacacgagggacggcacgggggtgaggagctgtgggtggatcatggagaggatggagggcaggtggccttcccgggaccccacgaagaagagcctgtggacagacaagagtggcagagtcagccaccgccccacaactcagcacgtggacaggggacacgcaggctggggagtggcagggcctgtgcctggcttgtctgggcctctctggccacagtgggaaccaggcccctccagccgctggctgtgggcctctcagttcccccaaccaactcggcaaggacagcaacttgggagccactgctcactccagcccggggggtcaagcggcggccacagggcatctaggacaccacagctgtgtcacctccaggcaggagtggggaggcgagggccaaagttcatgcttcctttatttctgtattatttgggcttgctgctgccttttttttttttttttttttgagatggtctcactttgtcacccaggctggagtgcagtggcaccatctcggctcactgcagtctcaatcttctggtctcaagcaatccttcgacctcagccccccaagtagctgggactacgggcacgtgccaccacgcctggctaatttttgtatatttttgtagaaacggggttttgccatattgctcaggctggtctcgaactcctgagctcaagcgatctgctcacctcggcctcctaaagtgctgggattacaggtatgagccaccatgcctggcctatttgagcaattatgcatccccagtatcacagagacaaaccttttacagacatggaacatgttgaacctggccatgaggcctgggcctccctcacctgtggtgggtcgggctgtgctcacctggaggatgtgaacagggacccattgacggagccgaagcaggacaggcccacgaagacggggatgatccaggacatgacgcccaggtgatagttcccgaagtcctaggcaggcacaaccagtgagctgggccccaccgggccggccctcgccctccctgtgctcactgggagccctctgcaccgggccagccctcgccctctgtgctcacaagagccctctgcagaggacctctcaggctggattctggcctctggggggacttcccaggacagggctttccagtgacccctgcccagcctgcttgttggggagcccttgctggtcctgatttgccccctcctctgggactccctggagcaagctacggcctgcaggtggggatcttgccttcccccgtggggtcctccacaggctcagcacggtgccctgccggcagcgggctgggagtcagagcttgttcagtaggaagctggccagagcacccactccctgttcccccagccctgggagggcagtgggagaagcctcgggaactgcgaggccagcctggctgagctgcccggtgacaccgcccgggcctggcctcccgcctgccaagccagcagcagccgtgccttctaacgaaccccactctgtggcagactccaatctttctgtactcagatttaaaatgacctctgccctggactccccaggcattctggcttatagctggttctgggtgtggcttggtatcagattttaaacccttctcccctttgactcccccagcagctgagcttgaggatgatccccagacacttcctctgcggtcgctgtgaggggagaccaccactccacccctccgggtaggggaggcttagagacgcggggccccctctgcgtaggggaggcttagagatgtggggcaccactccggtctggaagggacgggctggccacagcctctcaggcccctggtggaagctggcgggtagcggctcaccacggccacggcctcggacgacagcatctgctcggtggacagggtggtgaagtaggccaggttggtcagcacgtacaccagcgtcacgatgggcagggagatgatgatggccaggggcaggtttctggaaagaacagggacgacatgtcacccaacgcagcccgggctgaaggccaaaccctgtgcccaggagccaggtgggctcctcgcaagcagtagctccagcctctgtgctgggcttctcggggaaggtgggaagcagcaagagaacacaggctggcggcaggaggctgtgcctggagcgggacactgcacagccctggctggtgccttggccgcggcctcagcttccccacctgagaaatggggattcttcggggtgacctcaagggctcaggagagttaagtcaggccacctggtctgaattctaaggctctgcccacgagctgcacagccggggaccagagccgagagcccaggcagctcctctgtaccgtcccgccctgagtggggccctcacttgccacccgttctctggagaaaccgtgctcaaggacacacggccagaagccacccgccccacatcctgctggccccagaggccccaatcacggcccgactgtgaactggcctgagccgaccaacaggcttcgagtggaatgtggctgcttcctgcctcacattaaaataatgaaaaaagacggctccatccattcttgcacgtacctgtaggggttgatcatttcctctgtgacgaaattcaagtaattcctaaaatttagagaacagcgttcaaattatatgatcctcatcagggaaaataaatcaccggggagagagcatcccagggcagctggtgagcctgccccccggtggtctgctcgctgggctggaaagcggacctggagtgggagggagctcagcctcctgcgtgttccggggggtccctgctaccccttccaggccctcccgcacattccctgcctgttcgccctactggggtgattctcaggtccctgtgaggcccgcctgagcgcaggagtcaggctggggacctggaggaaaggggccgcagggctcagccgcctccacctgccaccttcgccaagactgcgacgtggagctagagccagagtagggctgcagcgggcggcctccccacgcttcgtcgggatgtgggtgactctggagggtcacctgccactctttaactgccaaggggcagttaaagggaggggcagtccactccctttaactgccccttgatggctgggagatttgggattcctggacacgtcagggactgtatgtccccagaccaagggacccagacattccagaacctaccatcctccataggcaaagaggccgctgtataatgccagcacaatgttccccacatccagtttggtgccttcaaatgagaagttgggatctagattggacacatcacctggcagggccaaagaaaggaatgctgggttagagagcgctgaacagaggtcatgctaccagttctagaatgttcctggagcaaaatacatagcaaacaaaaatgctggagtgaaggcttttcactgtgacaaatggtatgtacctgctgagccacatggagggtgcagggttccaaccacaaccagggggatgtggccctgccagaggccctgtgcccacctgagagggcacaggcagttctgaccactgcccaggagggctcctcagacgcttgtctacaggaggtcaggatggaggggtcaaccagccccagttgccttcaagaaggttccctgagacctcacgacatgagtgtcaaggcagtataaagccaggagacctcggtttgcatcctggctacggcaacaaggaaggcccagagccactagggccctgcttcttggggtgcgaggagctcggaacagactgccctccctccagggctggcaggacaggcctgggcaagaacataggtttgtcctggaccgtgctgagtgtgtggccagctgcagccggggcaggggcaggagcagggctgccagggccgagaacgatccccgtgctgtgtgcagagctctctcctttgccctctgaggacacgcgtcactggacttcgtgactgctccaccctattccagaaggacctcatttcaaaacttgaacttcagtcacatctgcgaagaccctttttccaaataaggccaccagcattcacaggttccccaggaggacatgtcttttgggggaaggggtgtctccggaaggtcacgtggctgctgggacagcactggccctttctgtggctgttgcctcctctgtgaaatgggcctggtgtgttcgagcccggaatatattgcccagacatcagtctcacagaccactgcgcttcaggaaggagaacttggaaagaagaccaaagacaccaccggaacaaaggagccgggtcccctcctgcctacctgccaggtgcatatacagctggaggcacaagtggaaatcttggtcaggctgtggactgttagttcattagagaaccgtgtgtgacagtatccttcctgctggaaagtcaccagcccgtctcacagggccaggcagggacgggccctggggctgctgtgtcccaacatgtggccttggaccacaggtcaccatgggggcccaagaaggggaaccaccttggtggtccagggaacaccgcagagtgacgaggtgagcaaatttcaaaggggacccgtgaagggaggttcccataagaccttggcaattaccccaaacaaagtgcgcacttcaaaggtggcaccagatttcctacggcagagcccacggtggggtcccttcctgatgggtggacccagttcctgttttgcacctgcttccccgtggcgtgctggatgcctgcggctctgcctccagctctgtctgtcccagatgccaggtgtgctggggcctttgatcttcagcctacactgggggtgctggtgggttccctgagggctgcccgccaccctgccctgctgaggccttgatctcctgagaaggagctccagggcccactgcctgcgtgtgatgtattctggtcaccaggtggtcagcaggcggagcttgactctgcaggcctggagcgggggcagctcagagcagctcaggacagggcactttgcacagcacctcggcacagcccctctggcctctctcccatctgctctctgatggaatgttctggaatgtgcagacccttcacatctgcatagccctactgtgtctcgcccacttacttctgctggggggagcatctgtcctacaagtgggggaatgcagacctgccaggctgcttgagaatcaaggtcctgcctcccccatctggcactcatggtgggagggggtgaaggtgagccctggaggccagaaacacgtgccccattcactgtgaccacccccggactcagcctgagctgatggacaggaggcctcagtccaaggtccccgccagacacatcaatcctcatagctgacctccagcctcatgacagaaaggcggctgatcctacacagagggtggctgcttttgctaaggacaatataccgaggcttgacatggtatgaggtcttcagtcaggagccagatattggcagccctaaggcctgagtaactttttttttttttttttttttttttttttttttttttttgagacagagttccaccacgcttggctaatttttgtatttttagtagagatggggtttcaccatgttggccaggctggtccagctctgcttaagggtggcctggagggctgcaggagggacctgcttgcagcccagggcagctggacacagggaggtcaccacactcatccagtgactccacgctacacacaggggagagacacaccagaggtgggagttagacagcgttcaaaccctgggggcagcacccctgtacctctcagcatgaccagcgggcattctgcacaccgggagacctgggctgtcacgacggcggggtgcggcgctactggcacggagcaggaggccggggatgctgctggatgtcctgcaatgcacgggacacccccacacaacagagagcccacggtggcagaggtgccaggctgaggccctgtgcaagaagaccatgacaaggcatcagccacgagcctctacccctgccgggaggacaggaccagctcctctcagctttctctcccatggaccctagactcgggcgtggtcctggcttcgacatgaagccccaggcactgggcaggactggaaggaatggctgagcggcccactcatccagcagccacccagcctccacacctgacagtctgctatccagtcagcctccacccacaaggaggggacagcgtgacagggaagtgaggaagagaatcaccgtggacagacggtgacatctgccagagcccacagagacgcgagaacagactcagcgcagagcctgagtggggccctccagccccttccttgtccctaagaggcatcttcctcaggggctggtggagctgccatgaaagcaaacgcacagccaaaccccgggtggggggaaggcaaactgcaaacgccgcggcgaccccggcacagcagccctgtcagcaggattcccccgagagcggggtaattgcggtgggaacgagcgctccaaaggccctggggagatgatttcagggaaaagtggccttgatccctgagtcaggcagatgcggccatgggaaccatccaccccgaggctggaggggagactccgccggtggctaaagccatcctgctgacggggcccagggacgcccccagtggccaaacgcacgtgggaacgggatcttccccctcctctgtgatgcggccaaccctccaagcctctggctcctgactcagaggacgatgtctccccatgaacgcagtgtccctggagagaagagcctgcccagcgtggggaacatgggaatgtggagatggagggcatcccggaacctcagggctgacgggcccctgccccagccctggaaacacctcagggacaagagagtcactcctcaagcgcggactttccactgtgctggggccttccgccttccaaccactctggccccttggggctctaggtggagtgtgctgaacagtgtccccaaaattcacgtccagtggagctgcgggatgtgtcctagctgcaaatgcggtctccgcaggtgcaattagcgaaggaccttgagatgagatcatcccggattagagtaggcactaaggccgacgacaagtgtcctcagcgacacagagacagatccaggggagacagagccagagccagcccaggatgcctggagccacgggcagctggaaggggaaggtggcaccttgggtctggacctctggctgccaggaccaggaccgtctgcatgtctgttgctaaagccagtctgtaggcatctgtcaccacacatgaggggccaaccgtgccacccaggggagacctcccggcttctcagtgcatcaggcatggtcaggggcaggacagctgcagctcacaccccacttctcagtcaccagccgagtgcacagccaatggcacctcatctaagagggggctgtgagtcccatgtggtcagcaccctggagctagctgccctgtgggctcagggaagtcgtgcagtgaccgccacatgggttcagtccagagcccaggccagagtccatgcccaccccacagagtccacgcccaccccagagtccatgcccactccaggcagagtccacgcccaccccacagagtccacgcccaccccagagtccatgcccactccaggcagagtccacgcccaccccacggagtccacgcccaccctaggccacggcgccgcttttcagatgcctgtttcgctctggccatctaatgcctgggaaccgtgatggggcaggaatttgggtttgggggttctggcggcaaccagatggcacttttggaccaccagcagtgtctgtcggtcttggaaactcatgaaggagtgggccctttgcttagagctgccaacctcacaccagaagtaaaagctttttccaactccacaggcggggaaagaccctgagaactgtccccagcacagggctgtggctgccctggcctctgtccatgcgtctgacgaagggcaccgggaggtgaaggccgcgggaaaacaagccccgctcccgtcctttgattctgtcccagcacacggcaccggcagagccccagcttccccagcctgtcatcctcccgaggccgacggcacagaagaatggcaggcccaggacacactgagctcccagagcaagcggcgggtcaagcatcctttatcaactgcgaggtcttcgaggcccaaaagaggtgccctgagtcgcgaagtacccacccttggggcagccaacgccgcagccctggctccaggcccaggttgtccggagtggagccacactcgagcctggcaccaatctgggagctcctgagcgcaatgtcctgtctgtccctgcatgaccctgagactgtctgagatgcctcacagagagatgccctggagtcccccacaggcaggccagcctggaagcttctctggaaagtgagctttggcagctcgaggccgagctgtggccgactcctcccttggttaacacagcctgtacccagctgggattcactttgaggccctggggcttgccctatttcctgccaggagagcggggcccgaagctccatcctgtcccccaaaactcagacgtggaagccctaaccccggtgtggctgtacgtggacatggggcctctacagattaagggtaagtggggtcctcagggtggggcctgatctgacaggatccttgtccacacaagaggaggccccagacagctcactctcccacaaggaaacacagcgagggggtgtctaggagccaggaggccgagcaccccgcccagggcatcagggtccctggcctggcggggcctctcaccgactctcccgccggcatccaggtagcagggccctggcaccagaccctctgaagctgagacccacccacccaggcctgctccgctcttgctgtcacccccggagaaagcggcagtcagggcgtgaggtgaggaaaaggggctgttggaccctgcatggcagtggctcccgtgccggggacgcggtgagcctggcctcctccctgcaagggaggacagcccatttcccaggggaagacaccgaggctcagacaccctggccggggggcggcaaaactagaatcccaaggcagctgcacatctagcacctgcccttgccctctctccgggagggcaccctagaagcccacagtcctgatctggggttcggagagcaggctgggctgagctctgctgggagcgcctagaagcccagctatgggtccacgcacacactcaggtgaagccaggcccagaagaaggaacagctctaagccacagcccaggggggcttctcagtccacgaggcgacccctccacaccccagagccacagacagccaaggtgtgggtgaaacgtttttctcaccagaacagcccagcagctgggcatgtgctgtgaccactgagggggcctttgtcagaaacatcgtctgggggctggacgcccccacccacaggaagaggagaccaagacagggccgcacacccccagccagatgagggccagatgagggaggcggcacctcttcctccaggaagctcctcaggagggacatcgggaggggctcagggggctgccttcaaggaagctcagtgaagctcagagaccagtctgaaaaggaatgtcctccagacctccaccctctcaggatggacgtgttactcaggaactgtcccgtcagcttttcccgtaacacatgacaccccacgtgaacctcccaagagcagatgggcccagtgctgtccacccgaacgcaccttgggaacagaggtgtgggcctccccccagcagcgcatgaccctgcacactgcacccagggtcacagtgggggtggggagggacctgcccactgctcacggctgtgggacctggggcagggcaccccacttctctgagtctaaggggccctactagctgaagaaccaaaggaaaaccatcatttcaaaactgtcacgtgacacacaaatgcaggcccctgccccacagcccagtggcacacacgtatttaccgcctgggacacgggaccgtccagaagtgccctactcataggtgtaggtcacatccaggggtctcggccaccgggacccagggcccagcagctcagcaaagccattcagccggggtctgagccctgcccaggggaagcattttcccctcctggggtgaaggacagcaagaggcacgccgccctggcaggctgcggctttctttcctttttgtggacagagtgaaagggcaaatttgctccaggggaatactgacctccaacagtacaatgtgggaggagaaggaaaagaaagtttttatgcaaccttttttttaaatctgcccaactatccaatctgtaactgttcaaggagagattagtttgttctgccgctgacggctgcagcccaagcaaagcacaaagcgccccattgtgtcctccaggagggacgtgctgctgctgctgggctgggacggcagagcctgtgccctcgctcccaccctccgccctgcaggcgaaggcccagccaccctctccttaggcaacagcctgcgagtggactcatgggacggtgggtcagatctgaaccctcatgagtactgtctccctttcgaaaaggctgggactaactgtagaacctcatgtgacacctaagcctgcgtgtccccatgccccagcctaggggcagccatgactcccccaagacgcggaggaggcaagggctcccgaccactcaggcccctgcagagtcgcccctgtcactcagccagctgcccctcccagcccgcatctcaggaaaggcccaacccctcagaagggcttttctggtctgcaccagggccccgcttattccccactgcgactctcccattcacgtgcctatggctctcaggtccccccatgagctctggatgcggggccatgttctcattgggacccggcatagatgcggcacacgggacagaagatggttctgcggatggccaactgggaaggggtgattacaaacttccctgacgaggaggaaacaggtcagccaaggcctacaggaccctagggccagtgcctttccatagcacagggcccacctgggggccaagggcagcaaggaggagccttttcagccccaatggagcagggcacccagggtgcgggacaggcaggaacaggtgcgtgggccaggcctgctctgccagattttcgctgcattctccagacccggaaagggccacttgccagtcgttgcaaaattgaggccggagtctctgccttgaagtatctgggggcgctgctgccaggtgccagcgaggggagggggcagctgcccaagggctttgcgtccactggggggtataaagttggacaactgctttgggagaaaggggtcaacacaatgtatcttctaaaagcaaggcattcatctggtaacaaaataaatctgttgaagccaaacaggagacaggaattctgcagacactgcactgtatcccaaagctcagaagggaattgctggggggagcacggtgggaggacgctttcaacagctaacggaattataaacctattatgtattcaagtcgaacaaaagctctttgctctccctaccgaaatttgtttttacaaaaatcacgttcccctcctaaatctttcctggctatctgatgagcgcagccaagcaaaggccttcacgagcaaagcaccccttccgtgcccacttctgggaggcacaggatggatttgtctcctgcccgtaaaatgtcactcaggcccaaccacctccctgggcaacttctgagtgcccgggagccatggaatgagctcgtcttgccttgagtaaggtgccggaacctgaggtcccaggaaggttcagaattgggacttcctgccagccctgtcctgccagctcttgggtggctctggtaccccgggcgactctgagaatccctggtcagacacatgcatgggggatgggctcgagctcctgaaggattgacctgggcaaccttccagagccacctgggaatcaagtgggacttcccctcgacgatgaggcaggtaactaacacctgctgcagactttgtacagattgatacatttgataaagacagtctggccccagcccctggagctcgcctcgctgtggtgaggtcagtatagcccggcactgcatccccctgcaggcccaggttacctgcttggtgtggagacccctccccagctgcagccagactttgtcctaaggcgaagtgccacgtacagccagcagggggcgccaggagcaaggcggaggctcagctaaagctgcgtgctgggtgctgggtgctgcggggcactgttcagttcacagcccaccagtggcacggtgcacacaggagagcctcccagccctgaggcagggccccacacaggaggaggcagcgtccttgtgtctgcatgttttggcctggccgtgcatgggggcggggcagctcacagcttgctgggtgaggaccttcctgcctctaggagcaaggtccttgccctgtcctctgcagccctggggtcctacctgcctcccctacagccatgtgggaccaggcagcctctctgcagccatcggtgactgcgagtcaccagagcgtgcatccgccgggtgcctgcactcagcgaaagctccacagctccaggactgggatcatctctacctgaggctctgggagagaagagaaggaggccagctcctaactgctctgctcctaggctggctccaacatggatggagacaaactcagaaggaactgcagacagaggcatccctgctggactcaagcaacagggccccccacttcaactgtacccaaccacgggtgggatccagtgccaaggacagtgtgtcccagggtctgtgaccacacaaatgggaactgcttatgaaaccccagcccgacctcaccgcggaatggcagtgtggaaagggtggaggctctgcaggcagacacagaacacagatctatggagtgtgtgttaaagggtccagagacacccagcaaaataccaactgtgtcagtccacgtcaacagagaacacaggtgcaaaggggcgggggctgtttcacactcactctctttattccttctaccagccccaagagaaaaagcagctgggaaaaaggctcagaatcagtgatttccccaagatcacacagcacaagaccaaagtctgggccagccagccttaaaacctgtgcgccagactgctctcacctgttcccgaatgctaacagtggacacgtctgagtgatggggttaccacgtttgttttgttttccatgcttacctcatcttctttaaaaagcagacagaaacacagagacaatcccacacctgcccatggaatgatgaatgaatcacagcatgaccaggagcatggccccgtcgggggtgggtgaggggcgacagcacgtgggactctgacagacccagggtgagatggctcgggtgaggtctgcatggcaggcatagcccctgccaggcctggaatgttccacatcgcccccaggtgaggttacaacgcatcagctgggctctcaagattcacagacatcgcagcgtaaaaaacaagaaaaactgccagagcccctcccagtggtggccacgctgtcccacgggagcactcctgtgtccccctctgggtcggatttcacttgctgggtgattttcccagagggaaatctccacgttgtacagcactgcagagctgcggactgggaggcacccggggacgggacctcatgccctgtgaaggacacacaggcaaagcctcgaggggccgccggtggggcctgggggacgtactcacccttcccgatctggacgaagcccagcaggatgatcagggccagggccaggagcttggcggcggcaaaggcatcctggacccgggtggcggccttcacgctgtagcagttcacggccgtgagcagcactgtggagacagagggcagcggtgagttccacgggcagacagacgccagctcaggggtaggctgggaggtgacgaccccacccccaccccagggccaggtccaccagaaaaacaagctccttaaacagctccagtcccctgccagcccttagggcacgttctgactttctgagacctgttttgataaacttcgcagtcctttcaggtctaagggctggatcccaggtgccccttaagatctgcaagggacctttcctcaccccccaccacaccaggccatggagtcccacctgtagtcaggacttcaagtggggtcactgcctccagagacccaggtgagcaaggtgaccctgccacttggaaggcgcccattacacctttttgtacctactcagcaccctgacctgactgtgagacccacgcacagcccgactgccggactccatgagggcggggccctttcctcaaagaggatcttctgtggattccaacagaagtggggtgtcccgctttcccggaactacctggccagtcacctggggacggcagcctgggaggggccacaggggcctgtggtgagcagagcagaccctgctgccctgctgctttgggggcatacgatgaaacccaaaatagcaccgtgtgcttcagaagcctgagtgaccccacacagatggccagaacgcctgccccaggaggcgctgagatgtggggtcaggcacgctcagacaggtctccagacaccagcacgtcctcctgggccctgtaaggcacccagctctgagcctctgtgtgtgtgtgtgtgtgtgtgtgtgtgtgtgtgtgtgtgtgtgtgtgttgggggttctgttgcaatatataggcacgctgagccactgtgtgtgtgtgcgtgtgtgtgtgtgttttggggggttctgttgcaatatgtgcgcacgctgagccactattcagggatctgtgagctggtggggaaacagccacccccacaacttaaaatgaagtaaaatcatattaatcccgaggcactgactccacgacacccctcactgcctgctgcactacccttcactcctctgctcacgaggttatctgtcgctgtcagcagcttgaaatctgccagtgggaacgtctacaccccagaagtgggcaaaggcccagcacgggccacccacacagctcagatctcacagccctcccggcaccgcaccactaagactgcaggaaggtgagagcatcagaaaggccgtgggctcctcttctctctttccccttgggagtaacgctcagaaaggtctggccagccaaggccttgaggactccagtggcttttccccagctgaacaaatcctgtggaatcttacaatgtaagcaacagaccccgaggaaagacatccatgctaattaactaatgacaccggaaacgtcctgaggtgcgggacgggctgccgcctgcctatctctcagaaattaaccaccccgctacaattctgtggatgccagagcggagacggctactacacaccaggaaagtctggttgaaaaatgtctgaaagtcagtgttttcgctgctattcctaaaataaaatacttgaaattccggaacttccactcctcacccaaactgaagaggtgattcttcacctcttcccagggctcccagggacatggagatgttaccagtccagagctctccagtccaaccctcagggctcagcagggtcaggtcagtgggtctaggcagctccttgtccgctgcacagggcaaggggcaggtcctggcttgccagtcccatttccttatggttggggggagcacgaccataaaagaaactgagcctcggggacctagccggcttctggagagctttctggattcgcaagaggccggctgattgcatcactcgctcattcatgcccggagggaggcggggagtgggtgtggccaagccgcactcgaggctgcctctccccaaaagggagagaggcacgctgccaccactgaactccagacaccagacaggcgctgcggagacactgagcactgccctcgcggctgtcacgtctgcggctgtcacgtctgctagggggttggggggtccaggaagggcagcgagttgcccagaattgcccaaccacgggctgtcctgccacactgacgtggtgctgggtaatgacgccatcagggctgtcactgtgggtgggacagaggccaggacccccccgcccccccccccaccgccagcctgaccctgcctgcccagttccaacccagccgctccccaaccaaaaacagtctggaggggctgacgggtgccaccgggagggttcaccagatcatctcctgacgttggaaataaccacaggacagacaggcgggggccgggtcttgaagtcaggtggggagcaaaatggccatagaacaaaggggaccttatatttattccttttataacaagaacataaattttcatgttcactgactttgggtgatgagtaaacaaaggtttcattattctccacagtgtccttttttttacgttttaagatgagataaaatcttaaacaaatacatgaattcatctgggttcagtacctttcgaccttaaggaggcgaggcagtcacaggataagtctggggtttgaacctcagtccctgctggcacttgccctctcccaagcctcagtgtccacaccatggaggggctgctggctgcccccacagcagggagatcgacagggctgtgccctgagtcagagtgagggggctgagcacacagggccagccacccccagataagtgtggccgcgccagcctgcggggacagctgggccaggagataaaacccgtccggggataccccgtggcgtggcttggcttgattggcagatagccgggcaggctgagctgggggcccctcccagtctggggtgctgtcttccccgtcctcacctggctgcctcccacctggctggctggcaggggctccagaggagctggggtgccttgggggcagtgcattggaggaacccctgccctcctcctcccttcacctgtgtctccaccacccttcagggccatcagccacagaaacatcctcatcttcgggtgggcattgacagcaaggcccacagcccggtgaaggaaggacagccctggccatacccagagccagcgccagggccttggccaggacacctgtcacagtgaggcccaagctgtggtcctggtcctgactcaaaagccacttcagataccctgaggctcacgcaggagggattggggacgcggccagcccatttctcctcaggaccctggggtgggcaccaaggcctcccactgctctcgccacgtgccctgctgctcagagctggggcgtcccggggaggttgccaccacccagcatgaggtgggggacacccccacccccttgtgcctccccatctctggggtggggccggcagtgatactgacctcagagaccatgcaagaaggcacctgaacagggagggcccacagacgggacaggtgcatactgctggctgggcccacagacgggacaggtgcataccgctggctgaccccccaactctgctcaatcacacacgtgcacacacacgcacagcacccccacaacttgtaaaccaggaggctgccttctcctggcccctggccttacccctctcccctcggggggatgactctctgaggtgcctccctgcctgatgcccgtgaacgctcacctctgcggcagccggctctgctcacctcccctgatgctggcatcttggtctcctggccccaactctgtccagctcctgataaaatcccgctacaagcaaagggatgatcccccagggtccagtgttggaggagaggggtgggggaagggccagtaacaggtgtgttcaatatggagagcaggtgggacctgtgggccccggctgggtggggaccccgcaggccccatgaacccaccccacacggactaatgcctgattctttcaggtaataaacatgtaccaggtacaggagcatccgtggatagggttcagggtcagccacaatgaaaatcctctctgttggccacagaggctgctccctgggccgccggtcctcacctgcccccgagccaggcacagcagtgagtcctgcagggctcagcaccttggcctgtctgtaagtgggagtacccagtgaacatgatcctcccgggccccttcgagcccaaacacagccactgtgagtgccccaggcaggcgtccagcccaggcaggcatcctgcagtcccttctgtcattttcagacccaacagaaacagaagtgctcctgccaggcccccgaggactgcctccaggagtcatctgtaatgacaggctgtgttccgcgcacggtttcagagtctgtccagagggccaatgctggggctggggcagagatggtccaaggcctgtgagctgtgcagctttataggcaaatgacgattgtttacccagaactgcctgctggagacagcacagaggaagtggccggcagcttcatcagttccaggaagcccaggcagcctggtcccccagggtgcaccgggcacagcagttcgcacggggccggagagcggcagctgaccacagcaactacagctggcccgacaccgggcacaggtaccagcccagcccagtcccgcccagtgcagcctgtggcccctagcggagccagcacctggcaaacctgacacccagccttggagcttgggcccccctctgcagctggctggggctcctgagacagcttctttgtcggaatccactcggtacgcacagggccccgaacttggtggctgcccagtgcacatggggctttagtagaaccagtaccttcctccctggccccttcaagtctaaatatcccctgctctgagtacaagcctccaccttctccaccgacagacagcccccaccatctcccgtgtcatcccccgggggaacttataaaagcagtggtgggggaggcggatggaaacccagagcttctgatcaggcaggtccgggagatggagacaacacatctgcacagaacaaggtcccagggaggctggtgctgccggcctggggagcgcccccagcacaggcgcgtgcttccctgatggacacgtcaccgccccgggctccagaaaatgaatgtgtctgacccagtgacccctgtcctcacccaaggccaacctcaccccagaatgggctggaatgccaagcctgcccatgccggctccagatccacctgcctccctgccactgctggccagagagagaggtcaaagtggtccggaaaccccaaggaaaatgaagcagttccggggcagggaagcaaaggcagcgttcacattttttttttttttgagacgaagtctcgctcttgtcgcccaggctggagtgcagtggtacgatcttggctcactgcaacctccgcctcctgagttcaagccattctctcacatctacctcccgagtagctgcagcctccgcctctggggatcaagtgattctcctgcctcagcctcctgcctcagtagctgggattactgacacctgccaccacaccggcctaatttttgtatttttagtagagacaagcgttcaccatgttggccgggctggtctcgaactcctgacctcaggcgatccgcccaccttggcctcccaaagtgttgggattacaggcgtgagccaccgcgcctggccgggatggtctgcttataatggctcaattttgatgcccagtctctgcagagcacaaggccccacctttgggccggacatacagatgtccctgggcaaacagagagatgatcccaaggccctggccccacctgtctgctcagtgttgaaacagatttctgtgaaaacaaattactaacaggctggtgtcacattttcaaattctgtcaccagcccttgaacacatgtctttgtacttttttccatttttaaccggggctgagttacgcccaaccacactgtcctggctggcacgggggaggaggtgtcagctgctgtccagaatggggctgacacattcattttaaacaggccaggaagatgcagatttggcaagctctgaaatttgccaacatcccaagtccagggtaagcaggagaactggaaaagggcagcttctcatgtggtcaggttctcctgacacaagcgtcctggtggatttgggtttcccaagggtcctgactccaggagacccccagggctgacaggaagggccaccgctccctctgaaactctgaaaccaggccacccggtgctgaaatgctgtgtgaactccggcaagttcctttgcagggactgagcctccctttcctgtttccaacagactggaacaactgcctcctgctgcatgggcgaaatacctcgcggacgtgtcttacggcgccccatgaaagcatcaccattaatctgaccagtcaccgcagcatgagtatcttcagggcacagatgaagccgtgggcaccagtgataaggagttgccactgctggctaagtgcggagcctcacacatctgtggtccggaaacccacgccccactccaaaccctctacagctccaacagttatgctaacaagaaaaaggagtgaaaacccgctccagtcacggtattgtggaggtggaaggacacttgtggcagccaatccaacacctccattttatagccggggtaaacgtagttcagagaggttgtcccacttggtgaaagtcacacagcagttcctgggcggcaaagtgaggacatccaggtctcctaaatctcaccctcgtgctctggccacttgactgggattttcaatcccggctgtcaaagagaagcaccaagtccacttgggctcctggccagcgtccaagccagtccaactcaacagcaagcggaagcaaataccacacaatgaactcgttgaacagactctgcgctcaggcttaaccagtgcacagcctgtacacccgacaggaggatgcagctgttccaagctaaggccagggcctctccccaatcccgatgggctctgcagatgcagtgatggaagaatccctggtgacggggagcccttagctctgagcaggacctgaagccatctcagggcttgcaccggcccagatgctgctgcacaagtgctccaggggctcctgccctgccctcctcacctgccccctcacctgtcagggatgtttgattcctggctggcccctcccctacctgacccctgccaaagacccacgtcaccccaggcttccagctctgaagcaaacgaccagagaagtcaagcgcctggctccgggccacacagcttgagggactcagagctccagggacagtgcccgggccctgctcaggccttctgcagaggccctgggctcttccagttgactcagctcacaaggcccctacacggtagcaggtgaagacagggccccaagaaccctcaggctctgaagccacacatgagagccgtggacagaatcctgcattggcctccagcagctcgagagcacagggacaaagctggactggccccggggtcaccatggccttggttttgtagcagctgcagtttgagcacgtacaccaaaaataaaattctaagccccgtaactgactaaagggacccctcctattgccaaagggatattccaaagttaacctgaaaaacgagctcaggtcacgatgggaagagggggtcacacaggccttgttataccccctccctctggaattcaggtacagcggaccagcactaacactcaaacacagatcttggcctggctcagtggctcatgcctgtaatcccagcactttgggaggctgaggtgggcagatcacgaggtcaggagttcgagaccagcccgaccaacatggagaaaccccatctctactaaaaatacaaaattagccaggcatggtggcggcaggcacctgcaatcccagctacttgcgaggctgaggcaggagaatcgcttgaaccgggttgcagtgagctgagatcatgccactgcactccagcctgggtgacaaaaacaaaacaaaacaaaacaaaacaaaacacaatattcgtctccacaacctcctgtcttacccagatactcctttctattgataccaggtctttagctaataactctttcaaccaattgtgaatcagaaaatcttttgccaggcacggtggctcacacctgtaatcccagcactttgggaagccaaggtgggcggatcacctgagatcaagagttcgaaaccagcctgaccaacatggtgaaacccccgtctctactaaaaacacaaaattagctgggcatggtggtgcatgcctgtagtcccagctactcgggaagctaaggcaggagaatcacttgaacccaggaggcggaggttgcagtgaactgagatcataccactgcactccagcccgagtaacaaaagcatctcaaaaaaaaaaaaaaatacacacacacacacacacacacacacacacacacacacacacacacacacacacacacatatatatataaagaaaaaggaaatcttcgaacccacctgtgaccaggaagcccatccccgccttggagttgtcccgcctttctcggcagaaccaacaaatacctttcatgtactgactgatgtctgcctgtaacttctgtccttgtaggaggtatgaactccagctgtggcccaccccctggggcacatgtcctcagggcctccaggccttggtcctcacatttgactccggataaatctcttcaaacattttacagagtctggctttctcgttaacaagcagctcacacatacagtgtctcagtagtgacagatgctggcccaccccgaggtcaggatgactcagcagggatcgagtttgcgggcgtcacgctccaaggcccagaataggaggtcggtgctcattcctcacgtagtgggcaaatcctagggcaggggaggggcgggcaatgccagagaacggtccccacctggggtggtctgacggccagggatgcagggagagacgcctcccacactcccggaggcacgcacgtgctgtggccaccccggagggtccgccttccagagggagaattcaggattcggccagtatcagggaaggagacgctgtggggggccctcctgttggaaaagggcagcagcgggaagagggtgctgccacagggcctctggggagcgtgcgggcacacagtaccaatctgcatgcatacacgtgtcctgtccctgcagacgggccaggcaaggcctgcccatggccagctatccaggtgatgctccagggagggccaggcctactggggggcagaaccctgtggctgtccagggtacctggatgtgagtctgggaaggatggagaagggtggaggagcgcaaagggcccctaggggatgctggggaacacagatgagcctctgacccacctgtgtccttacctgggccgactgggccacccagtcttgctgactgacacctccccagacccctggcacccaccagactccccaggcgtggctttgtgctcccctatgcctgatgacaaatggtggcctcagtgtagaggtgggcactgtggcccctggctcctggctcgctcctgcctcagtttccccagctgtaaattggggattatcactggcttcaaaggctggagtgcaaagtggtggccaagaggtggccaagaggtgccaagaggtggtccaagagtgtgccctaccttggacacccctctcctgggggtggctctcaacctggcctgggcccccgggggtctgcgcaacccacccttctgtgtgaaggcggctgatacacatttctgggcaagattctgcacattctgctggattatgaaagaggtctgtgacccaagaaaaaagggtcacaagtgcccgttaggctctcctgtgtggctcaggtcatgtgcttctgtgagctccccctacggccttgccccgaatcccgtgatgcagcgtgacctgcctaggtgccggcggcactttcatgtgcggctgggaaagtcagatttcagcactaatcactggctgccgcctgcaatgagcccacggcttgagctctggggcccacccagctccttaaacacgcagaacctttgccagctgagccaggatcccagctgtggggggttgggggtggaggggtgcagggatcccaaaacccaacccggggccaggttttacacaggcctggactgagaagtggggctacaggctacaggtgcttgataccccaggggggccctggaacaggcctggactgagaagcggggctacaggttacaggtgctggataccccagcggttgggggggtggtgctggacacccagggggcagatagaggcagccaggcagcctgaagaccctggggcaaaacacacacaggccccctctgctctctggtcactgctaactggccaactggcctttgagtccactgaccacagctaagcccacagccatcaaaacccaccccttacacccttcaccctttagggaggggctcagagacagttgtggcgattcctacttccacccatagccccccgaccctgggcctgtgccgagcgtgggtgggtgacatcatctcgcacccagagctccagactaaaggaaaccctggctcctgtctctggctcttccctccctctctttgttcccttgctccttccttcttttgccagaggagaagacagtgaggctgagggctgctccatgtgcacagtgagcaggagatacaggcacgtggagggacggtcacagcccgtgcaactggcaccttcacacgcagaggcctgggattcccagacacctggcgctggggccaatcccattccacagtcagaaacaggctcggcggggccaggtggatttctcaaagccttggttgcttttggcctgatgctagctggacagtgtctcagctcacaggttcctaaacgcatacccgcccacaccaatctgctgaggagtgacagccatggggaggagagccacctcactccagggaccctggcaccgtctcccatgaggccaggtgtcctcagccacccgcagccagagtcccgcgagaccgacggacggcctgcccctgcgtgacggcacgcctgggactgtctcagcagccccccatgcttcacccaactgggacagggaaacaggagggggctacttctgctttcaaggcatggaggagctgtctgcaggccacttcccgaacacctatgcgcttggagaagtgactgagactgagccagggtatcttctccacgatgcagtgagcccatcgggcccttcttctgagagcacctccctggaggtggaagcccctgaggcccacagcatcttctgaacctgtgagttcccacttactgagaactcgcctggatcagtgccgggccacagtggaccgggactttgagtggatgctaccctactcgctatgcagagccagctggggcccagggaggtcagataaactgcccaaaccaaatccaggcccagccagaatctcagctccagcctttgcgccttctgataaaacccagcatcgcttgaatttccagtacacgctgccaagtcttcgttaagcaataaataaccacacaaccctactgtcatgccaagttccatatggccatccagaaagagacacatggagctggttcctctcacctttatgaccagtgaaaagcgcaccaacacgaagacacgcgtgaaaggacctcatctcctacccagactgacaagcaagggatttttttcactcaccgtcagtgggatggttctaagcaccgaggccaacccatttcacacgattatttcacaaaaagaaaccttctgtgggacgtgcctgggcgactgaaaagacagccagcaaaactgagaaccttgttctcaaatctataccctctcccaaggcagcctcagaggcccgagggctgaggatccagacccgaaagccactgtaccttctgtaggatcaggctcaaggaataagggggtaaaaggtgccctttcccttcctaagcagaaaattccagaacccaaccttatgtgtgatcatttaaaaatatatatatatatatatatatcagccgagtaggctgactcacgcctgtaatcccagcactttgggaggccgaggtgggcggatcacctgaggtcaggagttcgagaccagcctggccaacgtggagaaaccctgtctctactaaaaaatacaaaatcagccaggcatggtggtgcatgcctgtaatcccagctactcgggaggctgaggcaggacagtcgcttgaacccaggaggcagaggttgcagtgagccgagatcgtgccattgcactccagcctggacaaaaagagcgaaactccacctcaaaataaataaataaataaataataaataagtaaaataaatcactttctatggcttttcactgctccaggagcaatgtccacagatcaaacgcccggcctctccttcacaccctggagcgcccatcctgcccactggtccgggctccaggctgccccctgcacctgtcagaagcccccctataagggcagggtctcccttcccgggacatccactgcccttctccgagctgaagtcagaatgacctgagaatcagcttggagttctaccagcctcagcaaagcccacctctgcgacagcactccttgcagacccctgacccggtgacagatgaataaagtacagacacacagatattctgctctgccagtccagctgagggtcccagccgcttataggctccctgctgagtcctgtaaacagttgctacttggccctgatcagctagtcagacgtgcatttattcagtatgattaactaacaaaagcttgagtcaacaccattagaatgtaacagacattgtggacttcccaagtaaaaagcacttaaacacccacggtcttaagattatgcgagtaaacaagctagctaggtaaactacgctgcctttcttttatcactatttttatttgtttaattaaaggtaaagggatcaggccgccttcagccagagctaattaccgaagttatgccaacttctcggccttccaagatttgtgtctatttctataactatctctaatatctttcccaccagaatgattgaaccccaacacacctccctctctcagcagggtctgcctgttcagagaacacagcttctctttcttgccttacacacaggggcaagaatagattcactcttgcagagagtacatccctttctgttactgaaaatcactttccaaaaaaaaaagcaacacatacacacatactcaccacacacacaggtgggtcagagaaaaaaaacaagtacaaatggcttagggacatgagaagtgtggccctaactttcgctgaaagggaccctattaacattaaccctcacctctgggtcagagagggttggcactctagggcctgccttgaagctttacctactgggaccaaaaggactgcttggaaagctattttaggccaggtgtggtggctcaagcctgtaatcccagcactttgggaggcagaggcgggtggatcacctgaggtcaggagttcaagacaagcctggccaacatggtgaagccccgtctctgctaaaaatacaaaaaattagctgggcatggtgggcacctgtagtcccagctactcgggaggctgaggcaggagagtcgcttgaacccgggatgcggaggttgtagtgagccaagatcgtgccattgtactccagcctgggtaagagcaaaactccatctcaaagataaaataaaataaaaataaatttaaaaaatactttttaaagccctattaccacaaaataaatccaggaacgcgtgacttggtacagcctctttggaaggcacattagctattacattagaatccacaccccgccgggtgcgatggctcatgcctgtaatcccagcaaattgggaggctgaggcacatgcctgtaatctaagctccggaggttgaggcaggagaatcgtttaaacccaggaagcagaggttgcagtgagcaacgagcctgggcaacagacacagactctgtctcaaaacaaaatcaaaaacaaaaagcaaaaaaccacatacccttttcccatttgcacaaagctgggaaaccccaaatgccctccacagggttctatgggggggcgggggtgcggtgagcacacttgttcctgccgacacagggaagtcttcttagcagctaaagagggcagcctctgcgtactgcctgggaacatggcaaaaccattttaggctttaaaaaaaaggtggagaacaagttgtacattatgatcttttaaataaataggccagcgatatatttgtaacagaagcagctccggaagcatacactgtcagccgcagaaactctgggggtcgggggtggtaaaggaggagaaatgtgtcacccaggcaggagctcagtggcaccatgcttggttcaagcagttctcctgcctcagcctccgagtagctgggactacaggtgtgcgccatgacgcccagctgatttttgctttttttttgagatggagtttcgccttgttgcccaggctggagtgcagtggtgcgatctcagctcactgcaacctccacctcctgggttctagtgattctcctgcctcagcctcccgagtagctgggattacaggcatctgccaccacacccagctaattttttgtatttttagtagagatggggtttcaccatgttggccaggctggtctcgaactcctgacttcaggtgatccgcctgcctcggcctcccaagtgctgggattacaggtgtgagccacagtgcctggctggtttgaatttttaaatgatgatgaattcatgtatgactgatgtgatttttattagaaagagaaaactaggcagcgccccatcctacgtctccttcctggtggccaatgaagcatttcccacgactcactcctggcaccagcaggaagtcagagactcagcacccaggggctgcttttttttttttgagacaggcttgctctgtcacccagactggagtgcagtggcgggatctcaactcactgcaacctccacatcccggagcatgcctcagactcataagcagctgggattacaggcgtgagccactctgcccggctaatttttgtatttttagtagagatggggtttcaccatgttggtcaggctggtctcgaactcctgacctcggtagatccgcccgtctcggcctcccaaagtgctgggattataggcgtgggccatcacacccagccaaccaggggttcattttttaaagataagagtgcaggctgcgtaagctactatccatgtcgttacataccgggccgacatgtacctaggcgggagggagactgaaccagtgaaattctaatgacaaaaaaagaaatcagagtcatcccctacattcacatctccaacgcccagctggaaggcacaggctctccccactgctgtcctgctacgatttttcccggctttgacctgcatggtggtgcggctgctcgactcagagcctcagagaaaccacacagagccctgctgagtcttgccctcggggcattctcacatttatgaagaaatgcctccccctccccctcccccccaaagtacggtgtggcagaaaacagcgccaacaggtcctgccagtcagaagccactcccctgatttcatggctcaagaccccaactataaattagcccttcccaccttgaatgtgtacacacactattgagatgcaggccgatccatgccatgggatgaatctgagaattgccaagacccaccttcccacgccacccaaccaaatcatgtggcatctgctacaagtgattttccccctgaaatcccacaagaaaactattttgaggccgggcacggtggctcacgcctgtaatcccagcactttgggaggccgaggcgggcggatcacaaggtcaggagatcgagaccatcctggctaacacggtgaaacgccgtctctactaaaaatacaaaaaaaattacccgggcgtagtggcgggcacctgtagtcccagctactcgggaggctgagccaggagaatggcatgaacctgggaggcgggcttgcggtgagccgagatcgtgccactgtactccagcctgggcgactgagcgggactcagtgtcaaaaaaaaaaaaaaaaaagaaagaaaaagaaaaagaaaactattttgaaaagcagttatctctggcctggtgaagaacacaccagcaccatgcccaccaaaacaggagccccatggctgtttcccagagaaacctgggacccgcacgtccattcactgcaacacagactgaatctgcagccaagctccgctctctcactactgggaaccctcaggggggatcccttagcctaaatcagcaccagtcactacccgcacacgatgttattactactgttttcttatgagtcagcccgtgtcactgattcctgacgagctggtgtggagagcagaaatgaatgattttttttttaactgcaatttccttctcaccaaccagtcagcaatcggagctctaacagtaaaccgattgctcagttactccacgtgggtgccacgcaagaggctgggagtattgctcagcggggccaacgggagggtggcacttgcctaaaccgcttaagtgggggaatggaatgcccaccgaagggcagggcagggaccctgctgtcccgtcactgaagatattcccagcctgtggggagaagtgtaaaagaatgaatgaaagaaacgcacgtggtttctgggaccaatgaccttagcctagaactgccgggatggtccaggaacgtaaagatgtagagatgtgggagccaggggcgtagtgatgcaaggatgcagggacccagagactacgacctcccaacccccggcccgcgccccgtactcacgcacgcagaggcaggccacgagcttggctgcctcctcgggcaccgggcaggtggggaagagcggcttgagcaggtaggtggcgaagaccagggccacgatgtactgcgatgaaggccggatgatgagcagctcgatccagagcttgaggaaggcgggcagcgagccgtagacctccagcatgtaggcgtagtcgccgcccgatttggagatggtggtgccgagctccgcgtagcagagcgcgcccacgatggagaagacgccgcacgcggcccacaccaccagcgccagccccggcgagcctgcctccttgagcacgcccgtgggcgtcacgaagatgcccgagccgataatggtccccacgatgatggccacgccgttgagcagcgtgatgttccgctgcagggtcacgccctcgccctcgcctgccggcgccgagccgtccgcgctcttggcggccagcatcttctcccgcgcctcttccttctcctcggccgccggcgccgctagcgcgcgccgcttcgggcccgcacccgccatgctctgcgcaccggccgggcctgggacacccgggagccgcggcccagcgagcagtgtgcgcgccgcccgccgcccgcagctgcgtcaggaaccccgcccgcgccgccttttaggccccggcccgccggccccgcccaccgtccgcggctcctccccgccccgtggcccggccccgtccctcagccccgccccctcggcccagctcggagcacgtgcgtcgtccggcccagcctggcgggctattcccaggcccgcgtggtcctcgaaggccccagtcctcctgcgccatggagaccccggcctcgcgacctcccccctcccggcgcccgcgtcatcccagcccgtcctcccggatgcgcctgggcggggcctggcagtcagggcgcgccccttcacccactggcccgcagcctctcgtcaagcctgggagcgggcagtgcaccagggctggcctgaggccaaggatggagtttggggtaccccccgaagggaacctaggctcctgtcccggatgggccgaggggatggaaccgcccccacaaccagctcctggggcacgggggagggatgagaggatgacctgaggggaagctcctgcagcctccttccagcctgggggctgcatcagtggggctggtgagccgcgaactgggacgagggaagaaccgaaccgaggccacccagtaattcccattgtatcccaaaagaatcttgccaaagacggcgatccggtgcccgtagctttgagaagcagtaataacacaggctttgggaagccagcaatctgcctgagctcaatttaatcaacagaaccgggggttcgctgggagccataagacccccacccccaaatctacctggggaattcaaaggcaggcttcagtgtgaaggggctttaaagcttgttattcctagggaatgcgagaggcatcttagctaaaaagggttgagaggtaatttcagttagaggcgagagcaggatgccaaggctcctaggcctggaaatgggaaggaatataaatactgccccgagattgaccagactggtgagcggccaaagacctgttcaaagggtgtgtgtgggtcagggaggaagctcctcagtatcaccccaccccggggttccttggcgtgtgtgcaaacgagtccttggaagctcacagcaggcatgtggggaggcctttgttctgggtgagcgttcagcctcccagggcaaacacgcaaacaccggttgcagagctgggtgttcacagcaagacagtctgctgggcagatgcctctggaatccacagaattctgaacaatagccgtggtggaggggggtcagaatccctgtcgtgctgggacctctagctgcagccaggaatgtccaggccccaccccagggagggggcggctgaggaatgccagggcttgtcattctggaccttgctcgccccccggtatgtcgggcattcctctgcggtgataaaaccgagcgaaatctcagcagcccaggcagccacaggcgggggagtgcggaggtcacacagatactaacttgtaatctgccgtccacattgctggctgtggaaggtgcagagacccctccatctgccctattcttcccgctgtgcctgcagagggaaggagacagtaccaccatggctgggcaaactcaccgagtgctcactgagtcctcccctagacagcttcttatgcaatagggtaggtgccagttagagccattttgcaaataaggaagctgaggcttggtagggttacctcgcttgtccggccagcaagtagcctgggagctgtccttttgactctgaacttatatggtacttttaatcattccaccattcttctttgagtaacaagaaaggcaaccaacagtcataccccaaagcataaaattacaaccatgataagccaaggacatgacagggtgagccagcgacagcgacagggaccaggcaggtccagatagacttttctgaggtggtacctggagctgagagcccagggtgagtgagaattaataagggaggtgcaggggtccccaccggcacagagggggccctgcacagttggtgcaagtcatggttggtgcccccagagccaggctcctggcaagtgctggagcccttaagcaggaagggtgacaacagccatgagcgtgttcaagtcacacagctattacgccacctctgtcggtttttactgggttttcatatgacaacattctagatttatccagcaaatctactcctctcagacgtccctgatgccggccctgaaacgccttcgcctgaaagctatgactctagaatcttagcaaagagtgccatctgttggaaagattcggcagcgttttgatttttacagaggcaggacaatggtcttttcagctccagtcagtaatttatcacatgttgtgtattttcagaggttaaaaaaaagaaagaaagaaaagaaaaaaaagttgtggcactctcgcttgagctggttgggagaatactttcttttcttttttttttttttgaaacggagtctcactctgtcacccaggctggagtgcagtggcacagtctcaactcactgcaacctccgcctcccgggttcaagcaattctcctgcctcagcctccggagtagctgggattacaggcacccgccaccatgctcggctaattttttattttttgtatttttagtagaattggggttagccaggatggtcccaatctcctgatctcgtgatccgcccgcctcagcctcccaaagtgctgggattacaggcgtgagccaccacgcccagcgccctgcaggtcctttttaaggctgtttgcaacataaatgagacgaggcatcttctgcccccctcagagcgccagcgtggagttgagcaggccaccctctctcacaaggcgaacccgtcattattttgtcatttggagcaactgcaggggagcagcaaggccacagggcgaggggagagaacccggtggataatcctttgttttctaattatgagatgagtctcgcagtgcagggattgtggttttcatctcagcaaaatataggagtgaggtccggagcggatccttgctcttcctttcaactcgttctttttcccaggaaaacgacttacctggtaaaccctgtaaaccaaaaataaaattctaagggccaccccagacatctaaacagacttcctcctcagccagggctcttaacatttaacctgaaagactggtttgggccaggaagagaatcgggggttggacggcctctttagacctctccagcactaacaccaacacatacttgaagtctatcagacttaaagattaacattttacagcctgttctctttgaagcctcctagctaaaagcttcatctgcatgatacagctttcatctccacagcctcaccacaacccaaacattccttccttcctttctttctttctttctttctttctttctttctttctttctttctttctttcttccttccttccttccttccttccttccttccttccttccttccttcctttctttctctctctctctctctctctctctctttctctctttctctctttctttctttcttgtctcacttatcgcccaggctagagtgtggtggcgcgatctcggctcactgcaagctccgcctcctgggttcaagtgattctcctgcctcagcctccagagtagctgggactacaggcgcctgccaccacgcccggctaatttttttgtatttttagtacaaacggggtttcaccgtgttagtcaggatggtctccatctcctgacctcgtgatccgcccgccttggcctcccagagtgctgggattacaggtgtgagccactgtgcccggcctccaaacattgctttctactgatcccaggtcttttgtgtttttctttttttttttgagacagagtctcactgtcgccctggctggagtgcaatggcacgatcttggctcactgcaacctctgcctcccgggatcaagtgattctcctgcctcagcctcccgagtagctgggattacaggcacctgccaccacacctggctaatttttgtatttttagtagaggctgggttccaccaggttgaccacgctggtctcgaactcctggtgatctgcccacctcggcctcccaaagtgctgggattacaggcgtgagccaccatgctcggcaacaatcccaggtctttagacaacaaactcaaacaattgtcaaccagaaaatgtttaaattggttgggcgcggtggctcacacttgtaatcccagcgatttgggaactttgggaggccgaggcggggggatctcgaggtcatgagttaaagaccagcctggccaacatggtgaaaccccatctctactaaaaatataaacattggccgagtgcggtggctcatgcctgtaatcccagcactttgggaggccgaagcaggcagatcacttgaggtcaggagtttaagaccagcctggccaacatggtgaaaccccgtctctaccaaaaatacaaaaaaattagctgggcgtggtggtgggcgcctgtagtcccagctactcgggaggctgaggcaggagaatggcatgaacgtgggaggcggaggttgcagtgacgggagatcgcaccactgcactccagcctgggtgacaaagcgagactccgtctcaaaaaaaaaatatatatatatatatatatatatatacacacatatatatacacacatatatacacatatatacacacatatatatacacatatatacacacatatatatacatatatgtatatacacatatatacatatatacgtatatatacacatatatacacatatatatacacacacacacatatatatacacacacatatatatatataaacatcagctgggcgtgttggtgcaccgcctgtaatgggaggctgaggcaagagaatcgcttgaaaccagaaggcagaggttgcagtgaaccaagattgtgccactgcactccagcctgggtggaagagcgaaactcttgtctcaaaaaaaaaaaaaaagaaaatgtttacatttacctctagcctggaagcccccctcctgctttgagttgtcccgcctttctgaaccaaaccaatgtattttttaaatgtacttgattgatgtctcatgtctccttaaaatgtataagaccaagctgcaccccaaccaccttgggcacatgcggtccggacctcccgaggctgtgtcacgggtgcgccctcaaccttagcaaaatacgctttctaaattaaaggaggcctgtctcagatttgctggcttcacaacccttaattgaagtggggcttcctggggccgcctctctcctgtgagtcccctgccgggctggttctcagtcacaggggagaaatgcctgcatcttttaacatagcaagggtccttgcttcttctggaggttgtttttgaaagccatgcttttattatgctcagaggtgagcttttcctatctgcatgcttgacaaggtggggctgccctgagtacgatcagaaattccgttctgtttccaggcagataggtgtgtagggcagccactcagtcagtgttcggccttaaagactcttgccagtcaaggaagacgaccgaggcaagtctccgtcattttagctttaaatgccaacattagggacgcgcacctgagagactggtctatgcctttctccgaagatgattttgagggcttcaatattgaaagggggaagggcaggatattgggcagtacacaattttcatgtgaagggggtaggggaaaattcaagtttttgtctggtttagtgactctgccgtttcacgtaagataccctagacgatagggcagcggaaacaatgagatatgcatttgcttcaggtgggcggagggatgactcagttctgcccctcgtcccagcacctgtgaagataagctaacggttcacattgccagggtgaactttaacagaagcgcttagggtaaagatcttggagcccacaaggaatttccttatgggcaaaatgtgagggaggtgtgtcgcttttcatctttttttttttttttttttgagacggagtctcactctgtcaccaggctggagtgtagtgggtcgatctcagctcactgcaacctctgcctcccgggttcaactgattcttctgcctcagtctcccaagtagctgggattacaggcgcctgccaccatgcccggctaagttttgcagttttagtagggacggggtttcatcatgttggccaggcgggtctggaattcctaacctcaagtgatccacccgccttggcctcccaaagtgctgggattacaggggtgagccaccaagcccagccaaacttttcatctctgtagctgtttgttaaataattaggagccgaaacaggaggctggttcccatgacacggtcaccagcttcacttttccctttcgttagcaagtgtggggtcccaggatttatgttcctttcacactctctatgccatttaatttttgcagcaactatagttagttgtcatttatggttggagaaaaagggcagttcagtaagtggccaagcccagcttcagacccagggcaggcctttaatcctcgtggcaatgctgactgccacgctgatggcgccacttacataggcagccagattcataagcatgcggattctcccagttaaaagagaattttggccgggggcggtggctcacgcctgtaatcccagcactttgggaggctgaggtgggcagatcacaaggtcaagagttcaagaccagcctggccaacatggtgaaactccgtctctaccaaaaatacaaaaattagcctggcgcagtggcaggcacctgtaatcccagctactcgggaggctgaggcaggagaattgcttgaacccagcaggcagaggttgcagtgagccaagattgtgccactgcactccagcctgggcaacacactgagaatccatctaacaacaaaaaaaagagaacttcatttcagctgcccctggtggcaccttgaaagcctcattgcctcttcactggaaacatccaccattcttgttaaagaaaagacactcatgactttccttcaccgaatccttctagcttctgtttgaacacttgggtagtccccccacccgtttcctgaagttcgtatgggggaacggtaaacagtgtccatgcctgcaagtaaaatccgaagccctgcgattgctcagtaacagctaggagcaaggttagggattgtagggccagattttttgcttaggttcaactaggtaaaataaaaatagactttgcatgcatttcaggcactgggctgatgaccggccaccagggaggctccgccccacttcttaactttggccccaacgttagtcttgttgctgctctcagatgtgctctgcgtgtcaaagatgacttggaggctgggcgctgtggctcatgcctgtaatgccagccctttgggagaccaaggtgggagaatttcttgagcccaggagttcaagaccagcctggacaacatagggagaccccgtctctacaaaaaatacaaaaactagcccagcgtggtggtggtgcacctgtagttccagctgccggggaggctgaggtagaaggatcacctgagatcaggaaggttgaggctgctgtgagctgagatcatgccactgcactccagcctaggcgacagagcgagaccggtctttttttttttttgagacggagtctcgctctgtcacccaggctggagtgcagtggcgcgatctcggctcactgcaaactctgcctcccgggttcacgccattctcctgcttcagcctcctgagtagctgggactacaggtgcccgccaccatgcctggctaattttttgtatttttagtagagacggggtttcaccgtgttagccaggatggtcttgatctcctgacctcgtgatccaccctcctcggcctcccaaagtgctgggattacaggcttgagccaccgcgcctggcgagactggtcttgaaaaaaaaaaaaaaaagatgacatggaagcaacagtaggagccggggtcagagttcaggcccgtccatccgtggatgatggataaacccagtgtagtccgccatcccttggagcgtcattcagccgcacacaggaagacacgctgcaacgtgcaggacccctgaaaacactgggctgcgtgaaagggtcagtgaccacgagttgtatgattccgagtgcacgaatgtccaggacaggcggatccagagagatggacgagattcgtggctgcttagggcggggggaaggggtgatggagagtgagggctgagtggatggggtctctctttggggtgataaaatgtcttggaactagatgatggggatggttgcccaacactgggagtgacttaaacaccacggatttgtacgtgtttaaatgactaacggttaatgtgatgttatgtgtgaactatacatccaaaagataaaagcagttcaggcctggaatcgaacggtcctgggttcacatctcacctctaccacttggtggcaccaggcgagtgactcggctcagctttcgaagtctcagtttcctcttctgtgaagcagggagacacctgtgcctgcctcctggggaccagcaggtagaagaccctgagccgctggcattgccatcactgcagaactgtgctcccaagaccagccagtggaggaccctgaggtactgctgtgtccctgtcactgcagaactgtgctcccagggctggcggatggaggaccctgagccgctggtgtcatcctcactgcagaactgtgctcccggggccagcaggtggaggaccctgagctgctggtgttgccatcactgcagaactgtgctcccagggccggccgaatgcctggcttccaccctcagactttctttccaatgtgggcgaagggaacacggagggacagcggtcgcagcagcccacacttgctgtgtcgggcgtggtctcagtggctggagtgtgaagatggaggcggggatgggagtgggcggccctgagtcaagggacacctgtagcccccagaagctggaagaggcaggaggggtcctggagcctcccgagggagcctggccctgccaccaccttgaagttggcctctggcctccaggactgtgagagaacaaaagggctgttgtcttaagcccctgtttgcggacaaagggaataatctcaacattgaaaaaatatggccttaatctttagtgctgtaggtggcaaacttaccttcaggatggcagagacagatctttttttcctgttgacaggcattctaacatttccagagacacgggagccaggttctcctgctgggcctctgcactatgagccaaacctgcctattgttaagtgattgaatgagttgacgctcaccttgaactttcttccactctgccctggattacaagaagaattcattgctcagcccatgtcccagcatgaggctggaagcagctgtgaattttgtagagcctggagggccctgcactctttgcagctgccagcttcagcgctgctctcttcggccactttgccccgcctctgttttgggcagtggctgcagggcagatgccacccaaccaggtcaaatttccctgtgaggatggaagtttgtaggttataattcagttctccatcttggaaaatatccaggtggatattgtttaccaccaaaacaatgacttctatcgcgtgagcccgaaaaccaggctgatgcgtgctacggcatgcgtgcgtggtgcctgctccatgtgtgaactgtgtctgttccatgtgtgaaccgtgtctgttccatgtgtgaactgtgtctgttccatgtgtgatccatgctgctccatatgtgttccatgctgctccatgtgtgaaccatgtctgttccatgtgtgattcatgctgctccgtgtgtgatccatgctgctccatgtgggaaccatgtctgttccatgtgtgaaccatgtctgttccatgtgtgaaccgtgtctgttccatgtgtgaaccgtgtctgttccatgtgtgattcatgctgctccatgtgtgatccatgctgctccatgtgggaaccatgtctgttccatgtgtgaaccatgtctgttccatgtgtgaaccatgtctgttccatgtgtgaaccgtgtctgttccatgtgtgatccatgctgctccacatgtgaaccatgtcttttccatgtgtgaaccatgtctgctccatgtgtgatccatgctcttccatgtgtgaaccgtgtctattccatgtgagatccatgctgctccatgtgtgaaccgtgtctgttccatgtgtgatctgtgtctgttccatgtatggtccatgctgctccatgtgtgaactgtgtctgttccatgtgtgaactgtgtctgttccatgtgtgagccatgtctgttccatgtgtgatccatgtctgctccatgtctgatcacacctgctccctgtcactcattttgtctagacttctcaatgatgacagcccccagttacccagatttaaggtagtttctaaatatttgtagccagatccatctagtatcctgcaattcattcattgactcagcaaacatttcacgatagctagacatacgcctggctttgtgagaatgtgtgtccgtatgacaccccagcctgcgggtgaccctttcatgtgcacccctgtgataacaggggatgtgcaggagcccaggtgcggggggaggggatgctgctgcctggggctggcactgacgaaggtgtggtggagaggaggggctgcgctgggccttggcagagaggagaaagtgcatctagcagagcagggaggacagcccaggagagggagcagcgcctagaggacctgcggcagcgcacagcagtccccgagcttacaagtgggagcactgcagcccatggcgcccgaccacgtttattgtgtgctgtgggcaagcagaacagttgaggatcccgcccctgggggctcacattccagagggggatgcaagcatcatgcagcaacacgtgcctgatgccaacagctggggaggggacacagggagaccgtggttggggcaggtgtctgagaactggttgaggatggaaaggagtgactgtgaagcagccttggggacagcaaccccagccagaggcccacacacacaaggtgacgtggaagagggccaggctgcgaatcttgctgggagaagctcgtgctcattcccaagcctagtggaaagcctcagttttgaacagggcagcagaatggccaagtgtcggtttctcaaaaaaacccactgttaaaagaaaaatggatttgggggaagaggggaagaggctggaaagaaagtggctaaactggaaggccagcttgtcactcaggctgcagcagaagggacagagaaaagtggacagacttggaataggcggcagtttgagggtcctccagcagagcctgctgctgccctgggtgcaaggagtgaggggagaggaggtcccaagggggctcccgagattgcctgtggcgtcgggtggatggaggaaccatttatcaagacggggttggtgggcacagagttggggacgcagcagtgcacggacagcccacctttcagcaggagggacaagtgtcaaaaaatgacacttactgctccgttaacggagtaatggagcagacactccgttactgctgggcaccgctgtgtgccaggtgccatctgggggctcagctcaggccgaggaaacaggaggagcaggtgttgagcaggtggtatggggcgggcggggaagggtgccctcaggtccatcagaacagccacaagagccctggggtgggagggggccgatattctggtcggcacagagtgggctgccaggagagggcgggggcggaggggcaggaatgtggattctgtcccaagggggcaaggctgaggggatgtagctgggcacatggtctgctctgaattgagcttggttctctagagggtcgatgggaaggacgtgctggggatggggaggaagcggaggaggaggaggcggtggcagctgggaacaggcaatgcttctcacacaggcgtatctttattaaacaagaaaataagataaaagcaaagggaggaagccttgaaccttaaaagctgggccagaaattctacaatacaatcagaagccacaatctggtcacagtgagagcccttcccgcagagccgcagacaccggccgctgcccctggggcgggagggaagcctcctgtttgttttttgtcccgttgctttgagggctggaatcaatgtcttttcctctcggcgtgtttgtggtttcatctcagtgtgtccaggctcggatggcttcccgggagtatctccgtgtctcaggattagcaccagtttttaaaaataactgacaaaggccatttttcaggagacaaagatgttggtgggtgcagagggccccctgtgtgttgatacggaaaatgaaggtcagccactccctgcttctcttggtgtcttgttggacacgatgtcaacatggggccggtagaactggagcccagggcccctctggccgcttgggcctttctctgtccccaagcccacctggaaatgggcagcccatggagaatggctgaatagctgctctctgcccccatcccaagccccaggttcagagaccaccccctccattgactgtgtcaccccttccccagcagaggagcgggctgttctcagagcgctgcaggaagcccagacaagtgccttcctctggctgctgcttccatcagcgtgaactgcccggcattgtaggataagttttctcctgggttttaaggttcaggactttctctctttgctgcgctttttccttgactgattgcacaaatcagagaaggcaagagtgaaatgctgcgtatcccttggcctagcgggtcagcgacaactttcttaacttctcaagtgagcctcagtttccttattaaaaaccagggacgattttgtggaacttgtcgcaactcaatgggagtgccgtggcccttacgcccaacgacaccatcctgtcacttcgggagtttttcctaaaacaccattccccagaccaacggcgctgcgagcttctggggcgtgggctgggcccaacatgtcagtgcgacccacagcggggctggagctgctgaatgtgcacaacacacttcacccgggcctggttcaggagcgggcgaggcagccgtacaccctgtccttcagcagactcctcttgatcgatggaatcgaagtcaggcgcagcagcttagagcagaacagaaacgtgcccatttccccgcttggtgctttcccgcttccacttcgactccttcaacccaatcctctttcacccgcatcgccaccaagtgtgatctcctttaaagagccagacgctttattttgggggggcgtggaggggtggagtctcactctgttgcccaggctagagggcagtggcacaatctcagctcactgcgacctccacctcctgggttcaagcgatttctggctagattttgttttgttttgttttgagacggagtctcgctctgtcgcccaggctggagtgcggtggccaccatctcggctcactgcaagctctgcctcccaggttcaagcaattctcctgcctcagcctccacagtagctgggattataggtgcgtgccaacacgcccggctgatttttctttgtatttttagaagagacagggtttcacaatattgcccaggctcgtctcaaactcctgacctcatgatctgcccacctcagccttccaaagtgctgggattacaggcgtgagccaccgcgcctagccttagtttttttttttttttctttttgagatggagtctcactctgttgcccaggctggagtacagtggcacgatctcggctcactgaaacctccacctcctgggttcaagcaattctccctgcctcagtctcccgagtcgctgggactacaggtacacaccagcacacccggctagttttttgtatttttagtagagacggggtttcaccgtgttagccaggatggtcttgatctcctgacctcatgatctacctgcctcagccttccaaagtgctgggattacaggcgtgagccaccgcacccggcctacttttcgtatttttttttttttggaggcggagtctcgctctgttgcccagactggagtgcagtggcacaatcttggctcattgcaacgtctgcatcctgggttcaagcaattctcctgcctcagcctcccaagtagctgggattacaggtgcctgccaccacgcccagcgaattttttgcatttttttttagtagagacggggcttcaccgttttgcccaggctggtctcgaactcctgacctcaggtgatctgcccacctcagcctcccaaagtgctgggattgcaggcgtgagccaccgcgcctgacctaacctacttattctttatctccccggaatgaaatggcctttatcaccttgggaaacagattagcatctgcttatttttctgtgctcatctgactgtaaggtaatgttggaagataatgtaattaggtttattgtaaaactttctctcttctggcgggaatattttttaatgctatgaaaataaaaatactgggccaggcgcggtggctcatgcctgtaatcccagcactttggggggccaaggtaggcagatcacctgaggtcaggagttcgagaccagcctgaccaacatggtgaaaccgaatctctactaaaaatgcaaaaaaaaaaaaaaaaaaaaaaaagactgggcacagtggctcgcgtctgtaatcccagcactttgggaggctgaggcgggcagatcacctgaggttgagagtttgagaccagcctgaccaacatggagaaaccccgtctctcgtaaaaatacaaaattagccaggcgtggtggcccatgcctgtaatctcagctaattgggaggctgaggcaggagaatcacttgaacctgggaggcagaggttgtggtgaaccaagatcgcatcaatgcactccagcctaggcgacaagagcaaaactctgtctcaaaaaaaaaaaaaaaaattcgctgggcgtggtggcgggcacctgtaatcccagctactccggaggctgaggcaggagaattgtttgaacccgggaggcagaggttgcagtgagctgagatcgtgacattgcactctagcctgggcaacagagctacactccatctaaaaaaaaggaaaagaaaaacactgtactgattttggattttttccaagcaagtaataggtaaaaagaaacccaaactggcttacatgaaagggcacctattggcttgtgtaactgatcaggtgcaaccattgctataagcttgatccagacccgactcagtgactcatgccagtaatctcagcagtttgggaggacgaggcaggcggatcacctgaggtcgggagatcgagaccagcctgaccaacatggagaaaccccgtctctactaaaaatacaaaattagccaggcacggtggtgtatgcctgtaatcccagctacttgtgaggctgaggcaggagaatcacctgaacccgggaggtgaaggttgcagtgagccaagattgcgccactgcactccagcctgggtgacaaagcaagactccatctcaaaaacaaaacaaaacaaaacaaaacaaaacaacaacaacaacaaaaaaaagagggtgaaaggcagccccagagtgggagaagagatttgtaaaatggacaaaggccttataattggaatatataaagaactcctaaaaatcaataagaaaaccacagacagcccaagagaaaaatgggcaaatggctcaagcaggtatctggtgaaagaggatatgcagacggccaatgaatctgcacaaagtgctccacgtcatgaatcattagggaagtgcaaattaaatccacaggagacacctgggcacaccctccagaaagcacacaatgacctgctggcaaggacaggaatgaccactttggaaaactctttggcagcacagccgaactgagcctctccacttgaaaatgccctttgctcagaacccagcagcagctccaaagtctccacccagcctgtggggccccagtacccacccttgcctcccatgcctctctcctcacccctgcacttggctgccctcaccctcgggctgcaccttgaacaccagaagggcgctcctgcctccagcctctgcctggaattctctgcccttgggtagccacgtggttcactcctcctttggtctctgcccaaatggcccctgtagaagagacctccccacccagccatgtcctcttcctgtgacttaccactccagactttctgtgtggatgcatcatggtctacctccttccatcagaatgtgagctccgaggcaaaggctcttcagaccttaaacagtctaggctccgtccccagagtctagaatagagcctgccacgtaattggcactcaataaatgttacatgaattaatggaaaccatcctggcacgagtggtagctctctttcctccaaaagaatgagcttgccgagagagacaacatcatgaaagagagacagaaaagccacactcagacccaacattgagttctggatcaagtttttttttttttttttttttttgagacaaagtttcgctcttgtttcccaggctggaatgcaatggcgcgatctcggctcactacaacctccgcctcacgggttcaagcaattctcctgcctcagcctcccgagtagctgggattacaggcatgcaccaccaagctcggctaattttgtatttttagtagagatggggtttctccatgttggtcaggctagtctggaacttggcctccgaaagtgctgggtttacaggcgtgagccacagcgcccagctcctgttattttttaggagctttattgttttacctttcctgtttagatctataatctgtcaggaattaatttttgtgtgtgctgtgaggtaggggtgtgaggtatggtgagaaaaaagattcatggttccccatttggatatcccgttggctcggtggggtggctaatgcctgtaatcccagcactttgggaggtcaaggcaggagaactattggagcccaggagttcaggaccaacctgggcaacatagtgagaccccatggatcgactgatgaattgatcgatcaatcaatagatagatcaatcaatagatatccaaatgatccaaaactattcacagaagagcccatccattccctacagcatgagtcagggatcacaaatgtgtggaaccttctagacacgctattctttttcattggttgatttgtccttctctgacaggtaccacattatcttaattaatatagctttttatttttatttatttatttattttgagatggagtctcgctctgtcaccctggctggagtgcagtggcatgatctcggctcactgcaagctctgcctcccgggttcaagcgattctcctgcctcagtctcctgagtagctgggattacaggcatgagccaccacacctagctcatttttgtatttttagcagagacggggtttcgccatgttggtcaggctggtgtcgaacttctgacctcaggtggtcttcccgcctcggcctcccaaagtgctgggattacaggcatgagccactgcacctggcctactacagcttttgaagtaggtcttgacatcaaattgtgtatgttttctggttttatcctgccagattatttttggttgtatttttggtagagacggggtttcaccatgttggccaggctggtctcaaactcctgacctcaagtgatctgcctgccttggcctcccaaagtgctgggattacaggcgtgaaccacggtgcctggcctcacaagaattcctttttactttgagacagagttttgctcttgttgcccacgctggagtgcaatagtgtgatcttggctcactgcaacctctgcctcccgggttcaagcaattcttctgcctcagcctcccaagtagctgggattacagacatgcagcaccacacccagctaatttttgtgttttttatagagatggggtttcaccgtgttggccaggatggtctcgatctcctgacctcgtgatccgcccgcctcggcctcccaaagtgctgggattaaaggcatgaggcaatgcaccccgccagttcttacaaggaggaggcagaagctggaaaggcaaggaaaaagatcctgccctagagcctcagaaggaagcagccgtgaggacaccttggtgtcgggcttctggctcactgaaccgtaagagaatcaatctccattgttttaatccaccaagtttgtggtacttcgttacagtgaaactaagcaccctgcacttgcgttgggtgccatggcacacccctccatcccagcgttatgttccccacggtacttacacatctttctttcacttgcagctgaaaagtacttcgactaaaacaataacctcatgctctctttttaatttcagaagtcatgtacaatcacattgtgaaacttgggaaacaacgcttccttccttcaaagtcagttctgctattcatgtggacctaatgtctctaggaccttgtgccctcattagtggcctggaaggacgcccagaccttccggttcatcaagggttgaagtgggcgatagttgttcaccatcatcttctcctcttcaccaagtgcagaaaacaggagagtacgaaatgcagagagctggaatagagggcagccagggtgagcttggtatgagtgcagggtgagccagcctctgggtgtccctcaggccttatgtggtcccctcccatgctgaatcaggatggcccgaaatgatcaataaatatggtggaagtgatggtgtgtgcagggccagattataaaaggcattgccgcttccgccttggtctttaggatcacttgctctggggggaagctggtcgccatattgggagggtactcaagcagccccgaggagaggcccatagggagaggaactgaggctcccagcgaactgccagcaccaacttgctagctactcgagagggccaaccttggaatgaatcctctagccctagttgagctttcagattgctacagtcccagctgacactgggctacaattcatgaaagatggtaagccagagccacccaaattcacaacccaaggaaactatgggagataataaatgattggtttttgttgttgttgtttgagacagtgtttcgctcttgtttcccaggctggagtgtcattggcgagatctcagctcgctgcaacctccgcctcccaggttcaagcgattctcctgcctcggcctcctgagtagttggaattacaggcacaagccaccacgcccggctaatttttttttttttttttgagatggagtttcgctcctgttgcccagactggagtgcaatggtgtgatctttgctcaccgcaacttctgcctcctgggttcaagggattctcctgcctcagcctcctgagtagctgggcttacaggcatgcaccaccatgcccagttaattttgtatttttagtagagatggggtttctccatgttggtcaggctgctctcaaactcctgacctcaggttatccacctgcctcggcctcccaaagtactgggattataggcgtttagccactgtgctaggcctaattttgtatttttagtagagacagggtttcaccatgttggtcaggctggtcttgaactcctgacctcaggtgatcgacttgcctaggcccccaaagtgctgggattacaggcatgagctactgcacccggctcaaatgattgttttctaaagccactatgttttggagctatttgttacacagcaatagataactaacacctataatgtaaatgctaaagtaacatttgaatttacttttcactgaaggaactaaaagactactttttatggctggatgtggtgcctcacgcctgtaatcccagcactttgggaggccgaggtgggtgaatcacctgaggtcaggagtttgagaccagcctggccaacatggagaaaccctgtttctactaaaaatacaaaattagccaggtgtggtggctcatgcttgtaatccagctacttgggagggtgaggcaggagaagctctttaacctgggaggcggagcttgtggtgagcgagatcacgccattgcactccagcccgggcaagaagagggaaactccatctcaaaaaaaaataataaaataaaaaataaaaaaagactttttatgtattatctcacttgttcacagaatatacttatgaaccctgtgaggcaactcacgcatttgattacattcagaagtgagattatgtctacatgctgacagcatactggtccagttagccctgcgtgatgatgcagcgccccctagagttgcgcgcatggtgcacgtggcctcctgggccgtgaccacggtgtgctcatccacatttgtggtctgcacatttgttgactgtgcagcctttctcctcccctggaaaactccccgccttccaggacatgtgcctccctggctcccctgctcaggataaggggctcctgccctgcatttttatatgacaccggccaccctggcttaatactattggcttcgtttctactttcctgccatacagcagtgttctgagacgaatgccctgttcctgtaccgcccctccacacctgcccccctcccaccctctcttggtggcacagacccagaatgggcacttgtcacatatatgcttgttgagtggcataagggccttgctgacaaggggccaccttcaacaaaagccttccccgtttgtatataagggaatattttcacaggcccgggagactgaaagaccctctaagagctcacctggagccctcggaaagagatgagccagagatgctaagtcgcgctgcgactgctgagaaacgtctgccgggcgggggcggggcataggcagcacgtctgtggctctgaactgccttggacagacagaattgctacagattcttaagatttccagaaaaaaatgatagtataacttttatttattttttattttatttttttgaggcagagtgtcactctgtcacccaggttggagtgcagtggtgccatctcagctcactgcaacctccgccttccaggttcaagtgattctcctacctcagcctcccaagtagctgggattacaggcaaacgccaccatgcctggctaatttttgtatttttatttatttatttatttgagatggagttttgctcttgttgtccaggctggagtgcagtggcgtgatctcagctcactgcagcctctgcctcccggcttcaagttattctcttgccccagcctcccaagtagctgatattacaggcatgcaccaccacgcctggctaattttgtagatttagtagagacggggtttcaccatgttggtcaggctggtctcgaactcctggcctcaagtgatctggctgccttggcctctttaagtcctaaaattatgggcatgagccatgacgcccagcccaagagtataactttaaaaagtgtatacaaatattattaattaattttcgaaaaaaaaaaaagcaatgaaactatttagataagaaaaaggaggccgggctcggtggcttatgcctggaatcccagcgctttgggaggccaaggtgggcagatcacctgaggtcaagagttcaagaccagcctggccaacatggtgaaactccgtctctactaaaaatacaaaaattagccaggcgtggtgatgggtgcctgtaatcccagctatttgggaggctgaggcaggagaatcgcttgaacccaggaggtggaggttgtagtgagccgagatcgcaccactgcactccagcctgggcgatagaacgagactctgtctcaaaaaaaaaaaaggaaagaaaagaaaaaggaagaaaacaaaaaccatgcagacccatgaccctgggacaactcccatggatgcctcgtgtgtctgtgtgtgatagattagggcgttgctcaggacatgcttgctgtgatcactggaaccgctgtccaatctcaacaagctcctacttcagttggaattttcttcttgtgtaagaatgccccaaatgcatgaaagaatatatataactccacaacgctctcatgcagcatcttagtgacgctgccaagcaagagggacgccttccatgaagcgccatcgtgccagttacgggcacggctcacctggcttggggccacttcaacgggctccttctggatgatccaggtgaccgactcggtcagcggcggggtggtgagcgagcccgcgtaggtccagtaatcccagcaggtgggcagcagagtggaggggtcgaaggggcgcatggccgcccgcgcgtcctgagagaccgagaagcacaggacgtgtcagtcctcaggggagactaggagcttccatcttgtctcagcacgtgaggccttcatggtgcttggaaggaagtgctttcccccagataaggccatgaggccactgctgtcacacttgcaagcagtgatgagaaaatgtgacccttctatacagagcaaggattcctgccaacttacattggtgggaattacgttacattacaccagcttacgttggtgctcacatttttccttttgaagtcatttcttggggcgcagtagctcacccctgtaatctcagcactttgggaggccgaggcgggtgcatcacttgaggtcaggagttcgagaccagcctggtcaacgtggtgaaaccctgtctctactaaaaatacaaaaattatccagatgtggtggtgggcgcctgtagtcccagctactcaggaggctgaggcaggagaatcgcttgagcccaggaggcagaggttgcagtgagccgagatcatgccactgcactccagcctgggcaacagagtgagactctgtctcaaataataataataataataataataataataataataataataataaattaattaataataaaaataaaaataaagccatttcttttagcataccttggctgcaaaaaatattactttttattgtgataaaatatacataacataaaatttaccatcttaaccttttttttttttttttcgagatggagttttgctcttgttgcccaggctggagtgcaatggtgtgatcttggctcaccgcaacctctgcctcccaggttcaagcgattctcctgcctcagcctccagcgcctgccaccacgcccagctaatttttgtatttttagtagagacagggtctcaccatgttagccaggctggtcttgaactcctgacctcggatgatccacccgccttggcctcccaaagtgctggggtgagccactgtgcccggcctatgggctcctttttaaggagggagtcatggtggccaagaaggatgtccacatgcctaagcacccggagatggcagacaagaatgtgcccaaccttcatgtcacgaaggccatgcagtctctcaagccccgaggctgcctgaaggaacagtttgcctagagacatttctttctttcttcctttctttctttctttctttcttttttttttcagacagagtctccaggctggagtgcagtggtgcgatctcagctcactgcagcctctgcttcctgggttccagcgatcctcctgcctcagcctccctagtagctgggactacatcttcacgccatcgcgaccagctaattttttatatttttagtagagacggggtttcaccatattagtcaggatggtctcgatctcctgacctcgtgatctgcccacctcggcctcccaaagtgttgggattacaggcgtgagccaccacgcccggcttgcctggagacatttctactgctaccttaccaatgagggcatccagtatctccgtgattaccttcatctgtccctggaaactgtgcctgccaccctatgctgcagccgtccagggactggcaggcctcggcctaaaggtctggagggtgggcgacctgcaagactcacaagaggggaagctgacagacatacctacagacggagtgctgtgcccctggtgccgacaagatagccgaggctcgggctgggtcagcaaccgaattccagtttaaaggcagatttggtcgtggacatggccagctacctcagtaaaatcagagaggattattttgcattgaatacactcacagccaaaaaacaaaaagagtcagggtcttactttgtcacccaggcaggagtgcaatgatgccatcatagctcactgcaggctctaattcctgggctcaagcgatccccccgcctcagtttcccaagtagctaggacaccacaccagggtttaaaattaattgtttgtagccagggggtcttgccatcttgcccaagctgttctccaactcctgggctcaagcgatcctcctgccttggcttctcaaaatattgggattacaggcataagccactgtgcccagccagctcttttggatatatacccagaagtgtgtgattgctgaatcatagggtagttctatttataactttttattttttttattttttttgaggcagagtctcactctgtcttccaggctggagtgccgtggcatgatctcagctcacggtggttgggcctggccgcaacacagccctcatcagcgtcccatgccaaccaagcatagctctgcacctgcccctggccagcactgtgggacaagagtccagtccaaagtgacagagtccctgtctgcaaggaagatggcctccctgctcagccacatcacatcaccttgactttgctgggccctggccttccaaggtggaagctggcaacccagatgccttgggcttgtctcctaacatcaagcagtgagggtcagggtcaagagaggtggctgagctaccagaaggaagcccgggagtgtccacactggcagacacatgcatcagttctatgcacgcatgttcacgtttataattatccagttaattaaaaaaaaaaaaacagcattataggctgggcacagtggctcatgcctgtaatcgcagcattttgggaggccaaggcaggcagatcacctgaagtcaggagttcaagaccagcctgaccaacatggcgaaaccccatctctactaaaaatacaaaaattagccaggcatggtggcaggtgcctgtcatcgcagctgctcgggagactgagacacaggaactgctttggcacaggatgcagaggttgcagtgagccgagatggcaccattgcactccagcctgggcaacagagagagagactctgtctcaaacaacagcagcagcagcaaaacccacagcattattgtgatagaattcacataccatgcaactctcccatctaaagtgtacagcctggttgggcgcaatggatcatgtctgtaatcccagcactttgggaggccgatgtgggaggactgcttgaggccaggagtttgagaccagcctaagcaacataacgagaccctgactctacaaaaaatacaaaaactagccaggtgcagtggtgcacgcctgtggtcccaggtagttgggaggctgaggtgggaggatggcttgagccccggaggttgaggctgcagtgagctgtgatcataccactgcactctagcctcggtgacggagtgagatcctttcttaaaataagtaaataggctgggcacggtggctcacgcctgtaatcccagcactttgggaggccgaggcggatggatcacctgaggtcaggagttcgagaccagcctgaccaacatggcgaaaccatgtctctactaaaaatacaaaattagccaggcgtggtggcgcatgcctgtaatcccagctactcgggaggctgaggcaggagaatcacttaaacccgggaggcagaggttgcagtgagctgagctcatgccattgcactccagcctgggcaacaagagtgaaactccatctcaaaaagaaaacaaaaaacaaaaaacaaaaaaagtaaataaaaattgaagggtacagttctatggttttgggtatattcacagttgtgcagccatcccaagtcaattttagaacttccacctcaagggggaagcttggtactttttagctatggtccccacccccgccctgctgcttctgtctctgtgggtttcataggaactgagtcatgtaacatgtggaacatttgtgtcttgtgtctctcactcagcacggcgcttttgaggctcacccacaccgcagcatgagttagagctgtgtcctttctgattgccaagtaatatctcactgcatggtctagctgggttgacatcccattgcacgctctagctgggctgtgaaggagcagactgcttgtgcatgtgggtaacaggcgggtgtgcagtgagacatcagtctggtgcacgtgggtaacaggcgggtgtgcagtgagacgtccgtctcctcctgcctgccacacatccccagggcacagatgtgccagtcactttctgagcaactacttcaaatcttcagaacaaccctttgagaagtatttctagtttactgatgaagatagacagacagatataaaaaacttgcccaaagccacgttgccagtcagggccactgaggcctggcccgttccgaggtgcgggctcttccttccctccccaaggctgcaggaatcagtcaggggagtggcaggctccagccatgccactgcgggtaggtttcttgccaattaagctttctgccttgggctgagaagaggatgcctgtgtgttgcctcatcgtccccaggagttcctgtcctgtctctaagatgcatgagggctggagcagccatgtggttacagaaaactgctccccctcagggcccccaaagcaaatcagggcccttcctttatgcatgtggtgatcctcaggcagctagaatgggacaccggtgagcacaccaatgaggctgaagaccatcacatccattatctgagcacggatggcccagctacctgtggaaagcaccacaagcctttgctggtggaagtgggttggtgacttgttccacttttcttttatttatttattgtttttgagacagagtttcactcttgttgctcaggctggagtgcaatggcacgatctcggctcaccacaacctccaccgcccaggttcaagcgattctcctgccttagcctccctagtagctgggattacacgcatgcgccatcacgcctggctacttttctgtttttaatagagatggggtttctctatgttggtcaggctcgtctcaaactcctgacctcaggtgatccgcccgcctcagcctcccacagtgctgggattataggcgtgagccacgctctgttcctggttttgtcttctttctcttaaacaggaccccacattttatgagcgtcaagccccacccagcctaactccgcccttgctttgtcctcttagagtctcagtttccccaggtgtacgacaggcagtgtggtggcggtaatgggcttccatcagtgcctgccacgtgggcgtggggctcagtaggtgctgccgctgctgctgccaaagctagaagagcccccacagggcacagagccgttccctggatcccctggacctggtgggctgtttccacctccacaaggcagccaattccccggtagctctgactgttgcgaaggcagggaggaggggggaccccagcagcctgaggagcttgcggcttgtccaggcatggagggtggggaccctctgtgggcagtttttgccaaaacttctggctatggtgagagggtcaaaggcgaagccttgaggtctccattctggaattgtctgcccggggtcaccaggaccacactggggctgtgcctgcgtgctgggagctgagtgcatagtgacaggtcggcactggtaggggcctgtgcagatgggatggtgctgggggtgggggtgggggtccaggcttccaggcagcgcctgatgtggttttggttacagacactgcctgtgtttccctctaagctgctgaaaagctcagaaatgtgcagcaggggctggagctcagcctgggttctgactgcatgcgggaggtgggcgccaggatgactgggacttcaggctgcgtggacccacttcctgggtttaaaaacgggctcttcacctgccagctgtgtgctcgggcaaggccttctctgcctctctgagctttggttttcctgtgtgtgcaagacagatgaatcacaggccctgccccgtggagtgattggaagattcagtgtgataatttatgtggagggctgtcgcttctttgaaccccttccgccgaggtgtagggtgatgtccccttgccctgagcctgggcaggtgctcctgacgggagtggtaaacaggatgccgcaggagcagtgctttgtgactctggaagccagggcagaaaaggacatcgtgtccatctggctctttctggaaatgcacccttggagccctgagcactgcatagaagccagctgggtccccagggagtgaccgtggcaggcattcctggagggtctctgccgagtcagtcccacagcagggcccggaccagcctggaaccaggagagatgatggggactacgtgactctggtctttcctgccctaattcaggacaacttgttccttaactggaggaaaccaggaaagcagcccagaagctgcaggtgagcccgtccctgggtgagaactgctgagtccgcgggggagtggcagagctgggatttgaagccaaggccatctgcccttgagcctgaggccaccatggccctgtcctgccctgcactgcccaccaatcaggaattagattcaaccacacttctagcattttccatcacaaggccatcattctaaaatttcatgggctcccagaaggtaatagctctctctgggaatcacctgacagaaagcacccgcagcaacaaaaagcgattttaaccttagtgattgggctggtggattttcgtttcgtgacgggcagcagcagcctgtgccttccacagcagacttgagtgtgtgagtgttggccacagctgggccttaaactcaactgcacatttcaccaagaaccagacatgctccttattccattacatggtgagaatgctgctctagtgtggattttttttttttttttttttttggagacggattctcgagctgtcacccagactggagtgcagtggcacgatctcggctcactgcaacctccgtctcctgggttcaagcgattctcctgcctcagcctcctgagtagctgggattacaggagtgtgccacgatacccagctaatttttgtatttttagtagagacggggttttgccatgttggccaggctggtcttgaactcctgacctcaggtgatctattcacctcagtctccctaagtgctggggttacatgtgtgagccaccatacctgggctactgtggatgtttaatatctccatttcacaggcgaggaagctgaggctcagaggtgcgcagctcaggagtggtggatctgggctctgaacccaggagtccaactgtggggctctctgatacactgtgctatgggagaagctcccagaagtcctaggctaggagcctctaggcgagagagttgttcaagtctcttcccattccctggcccatgaagcacagactcttgctcccaaggctgggccttttacctcctaaggtcttttttttttttttttttttttttttgagatgagtctcgctgtgtcactcggcctggagtgtagtggcacaatctgagctcactgcaacctccaccgcccagattcaagcaattctcctgcctcagcctcctgagtagctgggattacaggcacccgccaccacgcctggctaatttttgtatttttagtagagatgaggttttatcatgttggccaggctggttttgaacacctgacctcaagtgataagcccgccttggcctcccaaagtgctaggattacaggcgtgagccaccgcacccagcctcttaaggtcttttaatttctcaaaggtctaactcggccaggtgcggtggttcacgccggtaatcccagcaatttgggaggccaaggtgggcagatcacttgaggtcaggagtttgacaccagcctggccaacatggtgaaatcccgtctctactaaaaatacaaaaattagccaggcatggtggtgggcgccggtacttccagctactcatgaggttgaggcaggagaatcacttgaacctggaaggcggaggttgcagtgagccgaggtcgcaccattgcactccagcctgggcaacagagcgagattttatctcaaaaaaaaaaaaaaaaaaaaaaaaaaaaaaaaagagtctaactctttattttcagctgaggggatgagcccagagatcagcatcaggaccagagctcagtccgcggtggcacttcctcccctgtcccgggcatcattcctcccctgtggtttgcctagaaaattctgacttaccccatggagaagaaatgctccagaaccttccccgggaggaaaacagcccttgggtaaagggtccttcacaatcagctcttttctttcccaccaagaggtgggaccacctggtgtgggaggtggaggctggctgggaaaacaacccctgcccaggtttcctctggctgtggagccgcgtggaggaagaggatggggcgtcagagctctcagaaccgtggccttgtgaagttcctgagcaggcagatggggcggcagggggtgatctggtcccagtcccaggaggccaccccgaagccagcatcaaggcgaaggccacgtacagatcaaacgtctccttgaaccgcgaggaagggctggtcccagctccatctggaccagcctccaccattgttaacacaggttgaagcctcatccgtccgcacatgtgaggcttgcgttgactccttctgccctggaattcttttgtatgctgctgaataaataaactacatttctttggaatttctccttctccctcaaagccttttctcagctgatcttggagaaaggcgacactgttgtccccaccatcttttcgagctgcgctggatacagggaagcctatggatcgctgggcggagagctgcggtttgggcaggtttctctccgcccttgggcttggggtcggacagggacgttcaaggagagtgctgggtggtacatgagtcaacattcttaaatgttattagttagggatttgaggtttttgtttcaatctgttttaaaacaaactttatcattagtgaataccatcacccaggacaaggctaaaaatttttcgagctaatcaatttaaagaaaaatattaactaggctgggcgcggtgattcacgcctgtaatcccagcaccttgggacgccaaggcgggcggatcacctgaagtcagcagtttgagaccagccagcctggccaacatggtgaaaccccgtctctactaaaaatacaaaaattagctgggtatggtggcgcacacctattgtcccagccgcatgggaggctgaggcaagagaattgcttgaacccgggaggcggaggttgcagtgagccaagatcgcgccactgcattccagcctgagtgacagagggagactcctcgaaaaaataaaaaagaaaagaaaagaaaaatattcagtagaaagttgtcccattggcaggcagatatgtcaaacgtcttcaggatctcgcctgcatggctgaattttgggaacttctgttgagctcaacacccttattttatggaggaggaaacagggtcccagagcagtggtgatgcattcgaagtcagagagacctagctgtggacacaccagcatcaaccctgcggaatcccatttccagaactggaaccacagccccttggcggggctctttccactacgccatttctttttccttgcaaatgaatcgctgcactaaacaattttgcttgtcagattatactgatttctttcttttcttttctttttttttttttgagatgggatttcactcttgtcacccaggctggagtgcaatgacacgatctcagctcactgcaacctccacctctgggttcaaacgattctcctgcctcagcctcccgagtagctgggattgcaggcatgtgccaccgcacccagctagttttgtatttttagtggagacggggtttctccatgttggtcaggctggtctcgaactcccaacctcacgtgatccacctgcctcagcctcccaaagtgctgggattacaggcgtgagcctccgcgcccggcctgctgatttcaaatatgcagcttaccttatgttttatttccggcaagatgtccaccagcctctgcagcgtctgatgatgggccccgagctgcatggcagacaaaggaggggttagctgcaaaggcagtggatggggggggaagctcactccactgtaaatacaccacgttttaaaagcaatcctaggccaggtgcggtggctcatgcctgtgatcctagcactgtgggaggccgaggtgggcggatcatctaaggtcaggagttcgaaaccagcctggccaatatggtgaaaccctgtctctactaaaaatacaaaaattagctgggtgtggtggcacactcctatagtcccagctactggggaggctgaggcaggagaatcacttgaacccaggaggtgcaggttgcaatgagccgagactgtgccactgcactccagcctgtgtgacacagcgagtcctgtctcaaaaaaaaaaaagcaatcctaatgatggatcaccactttcttcattagatctacacccgagcaagtgattacctttaaaaacacgcctatcacagccaaaccattctctcccacgacagcttccttgtaattttggtatttcacagaattccagtgaactaaatgcagctgaaacacaatggaaagagaacttaaattgatcagcaagaaataagacagtcacttccccttctgaatggctgacctatgtgtccacttaatcataatgaaatggccaggcgcggtggctcacacctgtaatcccagcactttgggaggcggaggcgggtggatcacgaggtcaggagatcgagaccatgctggctaacatgctgaaatcctgtctctactaaaaatacaaaaaaaaaaaattagctgggcgtggtggcgggagcctgtagtcccaggtactcaggaggctgaggcaggagaatggtgtgaacccaggaggtagagcttgcagtgagctgagattgtgccactgcactccagcctgggtgacagagcgagactccatctcacaaaaaaaaaaaaaaagaactaagttgttgcagccagatgagtaagatcccagcaccagcagcacctctgagctcccaggcccttgacgaagccacaggaaggaacagcctcagtcttcctggtggggggggaaaggagaggatcatgttaacctcatccaatagaaatgggtggtttcattattttctacttcctagttatccttggacaagaattaccagaagaaactcaggcctcggctgggcgcggtggctcacgcctataatctcagcactctgggaggccgaggtgggtggatcacgaggtcaggagttcaagaccagcctggccaagatggtgaaaccccgtccctactaaaactacaaaaactagccaggcgcagtggcaggtgcctgtaatcccagctactcagaaggctgaggcaggagaatcacttgaacctgggcagcagaggttgcagtgagccaagatcgtgagatagcgccactgcactccagcctaggcaacagagtgatactcagtctcaaaaacagataaataaataaataaaatatctgttcatcaaaaacaaagttgcagatagagatactaaaataaaagtcatgttgttaaatgaaaggaagcacacagaagccattgttgtgctcattcttggaacaatttataaatatgtgtatgatgatgacaatagatatcactccctatttataaaatgtccggaggtcacctctgggtgtgagattacaagcaattttcattttttggtttgggtggactctagttccacattaactgcagcattactttcataacaacaacaagttcaaaaaacagaaagagtcctcagcttgaaaaagcatcaaaaagttaggtgagtgggtgagcagaggtgtgataaagtgaatatggcaaaaatgatcatcacaggactgagacatcaaactcgtagattcttctcgttcatttcttttcattttttcgtatgttgcaaaaatttcataatgaaatatttggggaaatctataaggcatcacttatcaccccaaaaaaactacaaaaaccaattcccaacattgatatgcactgattttctctactgactcccactttggaaggttgaaaataagactgctttaagatgatcttagccgggtacggtggctcacgcctgttatcctagcactttgggaggctgaggtgggtggatcacttgaggtcaggagttcgagaccagcctggccaacatggcgaaaccccatctctactaaaaatacaaaaattagcagggcctggtggcacgcacctgtaatcccagctactcgggaggctgaggcaggagaatcgcttgagcctgggagacggaggttgtggtgagccaagattgcaccaatgcactccagtctgggtgacagagtgaaccctgtttcaaaaaaaaaaaaccaaaaaccaaaaaacaaacaaacaaacaaacaaaagaagatgatctctattgcaaagatgttcagcttctcagcagagggccttgtggatttgctagtccctacagctgcaagcacacagctgagtgaagtgcggcaaagagctcaagctctgactttgcatcccggctgtctggctttggcaagttccgtaaccattcagaacctcagtctcttcttccgttaaatgagagagaacttacagcgccttcctcgtaggagaggtgtgactaaacgggtggggcggccgacggttctggtttgagcactgacagtcccaggccccaggaaatccttcacatctgagcggcgcgcatggcttgttcaccccccaccatagagccggagacatggaaagtgtgcagatatgtgctgttaggccacgtctacaaacctctgcggggtacgcgtggccgtccactgtgtgctctgagcccccctcgttcactgctccccagtggaagtgaaattgcttcagtctgtagtggttttccaagggcccaccactaattcctggaaataaaggcagtgagacgtgtgtgtcattttgtctgtttgttgagctgtggtgttacctgaggcattgtctacattagggttatatgagttcactcgcaaggggttgctgtatggttgaagtgacaagccaaaggtgggctccgtgaaaggtgggctctgtctgtcccattcactctgcccccccccagcccagcgcctgcccagaggttcacagtaaatgtggaatgaaggcagggtcccagtgctgccactgggtggtggtgagggcctcaactccctgcaggcagaaatccgtaaagaacgtttctgtgatgcctgcctgtcctataagatttccagactttaattaaaaaaaaaggtgtcttccaaatattttttaaaagcagcttaaatcctatcaccaaataacattataaaataacacacaatgagcaaagtttttgttttgtcttgttttgttttattttaagacagaatcttactctattgcccaggctggagtacaatggcatgatctcagctcactgcaacctccacctctgggttctagtgattctcctgccccagcctcctgagtagctgggattacaggcatgtgccaccaggccaagccaatttttgtattttaagtagagacggggtttcaccatgttagccaggctggtctcaaactcctgatctcaggtgatccacccgcctctgcctcccaaagcgctgggatgacaggtgtgagccaccgctcctgggtgagcaaggtctttaaataagaagaccctgagctgtagcatcagtcctgatctctggcagtccctgcttaatctaggcccaccacagggccagcttttattggaacactccttccttcctaagtcaccctaaacactcaccttggagtcagcactctctacctgcaggcctcggggtgcccctctccatggcacagtgccaggtgcagcctcccaggagcttgcttctcctgacatgtggggctcagccataagcatcgctcgctgaggcctctggctctggcccccagagtcatggctgccattcccacgtccaggtagtgctgggagtctgccttttaacgagctccccaggggttcggatgtgggtggcttctcctgtgtctaagtactttgtcactaacagatttccatcagcagctgctacaaatggggtacccgttccacacgttttcactgaaagcagcacagcgtgctcctgggatggctgggcaaggctggaaggcgccagcagaactggagcactgatcccgaattcagggtggcccgagtgcctcccatagctgtggaggagcctcatgtcacctcccgctgtggcaaaagccaggaaagcactgagcgcgtgatgaatgccttggggagcttgacactgctgactcctggtggtttcccgacaccagaagtacttgggctgggcgtggtggctcacacctgtactcctagcgctttgggaggccgaggcgggcggatcacttgaggtcaggagttagagaccagcctggccaacgtggtgtaacccatctctactgaaaatacaaaaattagctgggtgtggtggcgggtgcctgtaatcccagctactcgggaggctgaggcaggagaattgctcgaacctgggaggcggaggttgcagtgagctgagaacgtgccactgtactccagactgggcgacggagtgagaatcagtctcaaaaaaaaaagtactcatagttggaggcaccaaggtgtaaactggaaaatggaaaatggatttggctttagtccagtcaggggctaggcaagtgctggaccaagccacagagctgctcactgcccctcttcactcaaaatctcagtgttggtctggagcaacctcagagtcatatctagttttaaaattctaccattatgagcaaatcttctattctccttaaacatacacagatgaattacatctcaatttttaaaaatacacagaaagagtccttcccacaataagcacataaaatcactttgttaggccaggcacagtggctcacgcctgtaatcctagcactttgggaggccaaggcgggtgtatcacttgaggtcaggtgtttgaaaccagcctggccaacatgataaaacctcatctctactaaaaatacacaaaattagccaggtgtattggtgggtgcctgtaatcccagctacttgggaggctgaggcaggagaatcgcttgaacctggcgggtggaggttgcagtgagccgagattgcgccaatgcacttcagcctgggcgacagagtgagactctgtctcaaaaacaaaacacaggcgtgagccaccgtgcctggcctccaaaacacaatctaaggaacttacagaaccacaaaatgggagcacggtgagctctgtgctcgcttctgcctcggcctgtgtctgtgggggaaagggggtttgcagccgaccagccccagcagcatcaaagtgcattgatgggtgactgagggtggagcctcccagggggtctgcctctctctcttgggatgggctcactcatgataagtttactgtgtggaaattcacgcatgtctgtatcatctcttctagaatagaaatgcctagaaggcagggatgatggatgcttcatggacaaattagactggacccagcctggtagatgccatttgtaagactgagttaagtcccatccagttgcactcttagagcagaggctgtttctaggctgggtgtggtggctcacgcctgtaatcccagcactttgggaggccaaggtaggcagatcacccaaggtcaggaattcaagaccagcctgaccaacatggtcaaaccccacctctactaaaaatacaaaaaattagccaggtgtggtggcaggtgcctgtaatcccagctacttgggaggctgaggcaggagaattgcttgaacttggcaggcggaggttgcagtgagccgagatagcgccactgcactccagcctgggcaacaagagtgaaactccgtctcaaaaacaaacaaacaaacaaacaaaagcggttgtttccgtctggaccatcactgtatcaacaggacttagtgcaggaaggggtcatcgaaggcacacaacgaaccctcatgggatgaatgaatacaggaacgaatgggattagtcagtccactgatttattcatcgaatcacttggtcggtaagcagctctgtgtgttacagtggaatcgagcctttcccacggcagttggggaaccgcctgggatctctaggaaagtccacagaacacagaaatagttaaagacctggatttgcaactcagctctgcttctaacttgctgtgtgaccctgggcaagtagcttagcctctctgagcctaagcctctctacctgttaaatgagaagggcgggcaggataaatggagacaaggcaggaggcattttgtaaagtgttgtctgatgatggcagtggtggtgattgcgcatcgcacacccttcaggggctccgcagcttcgtctgtgtaaagagagttactacacgtttctcctggtcccagctcaagcaccctagggttctacgtaggcacataaatagggttccaaagagagcgacgccaactgcatgaggcataagtccactgacagccgatgcctgccggatccccacccacaaaacctagtagaaaagtcaccctccagactgtggccaaccaacaagggccaggaacgggagctgctgggaccggaagggacttgtgagccctgagcctctgcagggtaaggtgctgtgctaactctggggctggaagactttcccaagggtttccagcagggctggagcccacaggcatctcttcatccttcccgaccccgagctgtcccagaattcttcttctcctccttcttcttctgctttttcttctttttgagacagagtttcactctgtcgcccaggctggaatgcggtggcgtgatctcagctcactgcaacctccacctcccgggttcaagagattctcctgcctcactgcctcagcctcccaagtagctgggactacaggtgcgcaccaccacacccggctatttttttttttttttgtatttttagtagagacggggtttcaccatgttggccaggatgatctcgatctcctgacctcatgatccgcctgccttggcttcccaaagtgctgggattacagacgtgagccactgtgcccagcctctcacagaattctttactgcagcagcctctgatgggccggatcccccgcctctctactcactggagtaagagacaagtcagccctttccaatctgcctcctgaggggaaccatggggccctcgggacatgcggcccctcctcaggctggctcggggcatctgcacgcctgtacctgaacaagggacttgcttgaaacggcggccaccctgggctggggaccaagcacgctcaggggaaaacccaaaaaggctactgggtctctctggctctatgatacgcaaatgaggagggaagcgaaacgttcgttcttctaagaggataactgcaaaggaaggctgggccgctgcgttttcgggaacagcaggtgcaggggccgatggatcactcgggctgggctggagcggcccctggtggcagttcggtgaagagcaacgtagcccgcgcggggcgcacgcatttcaggaagacacagaggcctttttactggaaatgccagcgggtgtggattccacaggctcctcttcagcatcagtctagtgtgggattcatacaccttgagcctctttcaaggtgaaacagagaatctcactgcaaattttaaatcccactgtaaattccgaaattagacctgcgccgcgaagaccgcccaccagcaaaatgccaagcgtatttctttaaaaactggaaagccgtgtttcgttactcttcctgtagacaacacagcatggggtcaggagtggggtctggagtcggacgcacgttcagaagctggggccaccactcccaaactgtgtgctctaggtccagcttttgcaccccttctagcctcagtttccccatttgtaaagtgcggatgatccttgaacccccaccataggactgctgttacggttaagtcacatgggaaatacgaagtccttagcacaacgcttgacgtaaaggaagcactctaaaacaaacaaacaaacaaaaaacaacgaactggaagccactgaagccttcatggggtgaaacagctgattaaggggcaaaggctctcactggccaggttctgccgtgtcccgggcaccacgcatcctgtccatgagctcacgtcgttgtcgtgatggagaaggcttggtgtgtaccagagtgcagcggaggagctggcgttcgctgggcacctgctacctgctgggcattgcgaggtaactttatgttcctcccaggatgaactcctcacaatggccctacagagcaggtcctgtgagtccaactttgagatgaggaaattgagacgcagagaggttcggtcacctgccccagtttagccggcaacctcacccaggtctgacggtccaggccctcagcttttgtagtagggttcaggccaaactctgctacttgccttgccagtaaagttagggacccaatttaaggctgcagacctggataaaataatctcaaagtgacttctttttttttaggtggagtctcactctgttacccaggctggagcgcggtggggtgctctcggctcacttcaacctctgcctcccaggttccagtgattctcctgcctcagcctcctgagttgctgggactacagacatgtgttaccacaccccactaatttttgtttttgtttttgtttctttgagatggagccttgctgtcacctaggctggagtgcaatggccagatcttggctcactgcaacctccacctcctgagctcaagcgattctctcacctgtgcttcccgagtagctgggattataggcacccaccagcatgcccagctaatttttgtatttttagtagagacggggtttcaccatgttggccaggctggtcttgaactcttgacctcaagggatctgccgcctcagcctccccaagtgctgggattacaagcatgagccactgtgcccagcctaaagtgacttttcataatgacaatacaatgtcagggtattctccttaatcaaaaaaaaaaaaaaaaaaaaaggcaagcccaattcacgaaaaggggtctttaagctgccagcccccatcccccggactctgctatcagcagggctggtccaccgggcagcactggccactgttgcctcagcgttctgtgtaagcaggtgcgtcagaaccggctcatggagatataattgaacgattgcctcagcgcgtgccagactctccaaacataataacagatgacgtttggggccggctccaggctgtgacgtgctggccccagagaatattgtctctgctattacaacagatgctgttaatagccatctatttgtagttcggggcttttaccaagatgagcaggcttttggcaggcacgggttgtttgaaggcttaaaattagtacacgagaagtttgagatgttctaattactggaaatttcaaataacatgatgctgcaaaggaccggcctgcttccggtgccactctgggaggtagtgcacgttcccaagctgtaaagggtgacacggctgagggcttctgtgtgccacctccccaggcaggcaggggccgcagccactgcaagcccctgcccacagaactccgcgacgatggaacctagactgctccctggaagttagcctctgagaccatcacatattggcactggtttgaaagccaggcaaatgtgggctccaatcctggcttcacacggtggggctttgcaagttgttttataggtctgtggcccagactagacgtttataaaaggataatgatgcctacttcaggggcccatggcaaggattgagtacggtgatgcttacaaagtacctccctcacagtccctggcacgcagtgagagctcaaataatggtagccacttactattattatgactggtgttattgttattattaaaattactgtcatcgcccaggcacggtggctcatacctgtaatcccagcactttgggaggctgaggcgggcagatcacttgaggtcagatgtctgagaccagcctgggcaacatggtgaaaccccgtctctactaaaaatacaaaaattagctgggcgtggtggcacgcgactgtagtgccagctacttgggaggcggaggtgagagaatcgcttgaacccgggaggtgcatgttgcagtgagccgaggtcgtgtcactgaactccagcctgggcgacagagggagactccatctcaataaataaataaacaataaaataaactaaaattgctatcctcactgccatcaccatcatctcaccacggcagagatccgcagtcccctgaagcagataccacgattctcaaggtgagacctgcacgtaaagacgtcgaaagataaatatgtcttaagaacacgtccataagaaagggctttgccaaccatgcaagcataaaagaagaaaagtccctcattcatccgaaaacacccactgactttctcccacgtgccgggcaccacgctcagtacaagggacagagggaggaggctctgggctcagacttgccctcgcagagcgtggaatccaggaggggcagacggtggtagagataaaaagctgtgtgtctgagaggtgagagtgtgggctttggggccctaaacttgcttgggacgcccaggagggcccccgtggaagcggcgtttcagtggagccctgaagatgggtttctatttgtcaggtgaagataatggcggctccaggcagaaagggacgaccagcggaaaggaccctggtgacagcagccaccacaacggaacaggcggaagcaccagccggcgaaggcactgtcaggggcagcaggagatgggattacaggggcaacagggtcggcgccggtggtggctaaaggaagtggggccttcgccaacaaaccgcaacatggtttttttttttttgagacagagtctcgctctgtcacccaggctggatgcagtggtacaatcttggctcactgcagcctccgcctcctaggttcaagcaattctgcctcagcctcctgtagctgggattacaggcaggcaccaccacaactggctaatttttgtattattaccagagacagggttccaccatgttggccaggctggtctcaaactcctgacctcaggtgatccacctgcctcggcctcccaaagtgctgggattacaggcgtgagccaccacacctggcccatcaacaggttttgaatgttccagtcttttttttttttttgagtcaggggtctcattctgtcacccaggctggagtgcaatggtgtgatcatgcctcactgcagcctcaacctcctgggcgcaagccatcctcccctctctgcctcctgagtagctgggaccaccatgcccggctaattttttttacaagaccactgttaaaagcccggaagaatcctgcagctcactgtggtgggctgttttgcgtgtgctagagtctattcagcatttcagatggaaaagcctcagcattcctcttccgtgggcctccaccgtagctcctttgaaatctctgctctttcttgcaccttcccatctgagtgtctgtgccgtggcccccccctcctctccaatacgaagagcccacactcagcttccctccctcctcctccaccccacactgcccgagcacctcacctcccagtgactgactcgtccccggtcttgcacacacctggggagcgtagctggcccgtcctgcacaccagccttgcaggctcgctgagtagaccatccttgtctgctcttgctgggtgcagccgtgtgtagtggcccaaggggggtcatctgggagggcataaggaagcttaagtgacgtctaccacgaggaagcgtaagtgatgttcaccacaagaggcgtggggagcggcggcagcgcgttcatccactgtgcttgacgtcgcttatttccccgatgaccttttcccggacttcctagctggatctccgtgagtgccagggctgggtctgggaagggtctgggacccagcacatcacctggcacagtcagtgtttgctcaatatttgctgagagaaaactgcagccatgtcaccgatttacaataggaacttctcgtatggagcagaaatgtgttgttgcctgtggctttgcaggagctccgagcagtggcgagaggaagtcacgggtgaccatggtaggcattaccgcctgatggggttgctggctggtcctgagctcatcaccgtccatctcctgcatccacagtgatttctattaagtgcagcttttcgtcaggcaaccgccagcagcactgaggggtgggatgatggcatattgaccaaaacactcagggggtgctagccacgcggcgggtgcagatgcggacccccagccccacgagcttgcagtgccgttcagccccgctgcacccccgtctgtctccaaggctgaggaactggggtgggaggaggaggaggcacagagccgtctgaacacagctagagccactcactggcccctgcaggggagcaacgcagtggggaagccagcagggagggaaggggcagttgcagtgggtgggcatgggggctcagctactggcacagcaacacgagggaaccacggagagcaggagggaggacgtgggggcgggcgcagggcgggagcaccgggcagtccacaaggtggtcaggacctcagctggcggctgggcttgggaggggctggcatggagtcacgggccaccgtcccctaagtgtttccctaggcaaggttctcattcccctcgtcaggggaggggatgggcacagagaagtgcagccatgagccaggaacagagctgagatgaaacctcggcctcccgtcttcggaacgagagttaatccacagaggagctaaggaaaacgccgggcaccgagttgacgggtgaggggtgtgagcgatggggccagcatggccgccgcaccaccagctccatcctgagcgtttcacggacatggccctcttcatccacacaactgccccaggagccaccgaatgaggctcgatgaaacctcgactcgcgttgcagcgcacgtccgaccacactcgcctttgatcgcatttatcactggggatccagaggtcagggctttgtgtctgcagcggtccctgggaaacaatctacaattcgaagctccaccaaactccctcagagtcacgaaatttctatcactgactgctttcctccaaggcccaaactggatttataaacttccaaaggaaactttatattgaaaaagcgatgtacccacagcattgtagaacgatgtttacaaaggaaaaacaaggccaggcgtggtggagtgagcctgtagtcccagctacttgggaggctaaggtgagagggtggtttgagctcaggagaagcttgcagtgagcccagatgcacttcagcttgggcaacagtaccagatcctgtgtcaaaattttttttttttttttttttttttttgtggctcacacctgtagatgcaactacccaggaggctgaggtgggaggatcaattgagctcaggaggtcgaggctgcagtgggctgtgattgcaccactgcactgcagcctgggcgacagagcaagatcctgtctccaaaaaaaaaaaaaaaaaaaaaaaaaggaaaaactattgtttatgccatcaccacccagtaaacatagttactgatatttttacttgcagtgtaactttctggccccttcccataaccacatgtatttggtaagcttttgttttcaaaataagccaataacatttaataagaaacaacagtgtattagtctgttttcatgctgctgataaagccatacccgagactgggtaatttacaaagaaaaagaggttgaatggactcacagttccacgtggctggggaggcctcgcaatcacggcagaaggcgaaaggcaggtcttgcatgggggcagccaagagacagaatgagaaccaagcaaaaggggttactcgggagcctgcggcaggagaatggcgtgaacccgggaggtggagcttgcagtgagcagagatcgcgccactgcactccagcctgggtgacagagcaagactccgtctcaaaaaaaaaaaaaacaaaaaaccatcggattggctgagtgcagtggctcacgcctataatcccagcactttgggaggctgaggtgggtggatagcttgaggttgggagttcgagaccagcctggcccacatggtgaaaccccatttttacactacactacatttttagtgtagatcccaaatatttagcataagtatggtttgtgtaatatttaggatgctcgtattttaaaacggtgatgctggaatgctcctccccaccgtcatgaagctggcactttcttaccagctgggacttgggtccagtggggtcttttctgaccatgttgtgtaatgctcacaacctccctcagtggagtcaccgctggcctatcacctgctttcattttcatcacagcacttatcactatccaaaaccatcttctttcttatgtacatattcgtttatttttctgtaaacttgtgtagagaagtacctatttattaattaatgtttactaattttcttatcccaccagaaggcaagctccatgggagcaggggtttcactgtcttgattgatccttcctccctacaaaagaccacacagcacacaggggtcgcggtgcacctgggaagcgtctgggaagctggacgatcagaaatgggcttttgggctgggcatggtggctcacgcctgtaatcccagcactttgggaggccgaggcaggaggatcacgaggtcaggagatcgaggccatcctggctaacacagtgaaaccccgtctttactaaaaatacaaacaaaaattagccaggcgtggtggtaggcgcctgtagtcccagttactcgggaggctgaggcaggagaatggtgtgaacccgggaggcggaggttgcagtgagccaagacagctccactgcactccagcctgggtgacagagcgagagtctgtctcaaaaaaaaaaaaaaaaagaaaagaaaagaaagaaaagaaaaaagaaatgggcttctggatccaaatgataacaacagtggctccactgcctgacattttgtccaacatgatcgcacccctggtcacagttgattggacagggatgggcactcaaaccatgctggaccaatcagagcctcttcctcagtcccgctcctaattagtgcagggctgggccaatcagagtcactgctctgggaatttagaattggaagtgagcaagaacaggaacagtggctccccagtggctgaatctctaacaggtaaactttggaagctgtttggtacgttttcatttttcagtcttgaggaccagaaagcagagaaaatatctgtagagagagaggggacactgacttctacctaacttccccaaaaatattcacacccaggcctgagggaagaaacaggagctacatacagaatggagatggaaacacacgtgtgcacacatgcacacaccacacatgtgcacacacaaacacacatgtgcgcacacacatgaacacacgtgcacatagagacacatgcacacagtgcacaatgcacacccgcacacgaacacacacatgaacacgtgcacacacacatgaacacacatgcacacatgtatacacagtgcacatgtgcacacatgcacacatgtatacacagtgcacatgtgcacacatgcacacgaacacacatgcacacacacgtgcacacacatgtagtcgctttaggaactagactgccagtttatgaacttgtgatgataaatcactttcccaggatataagcgtgatgctcacatcgtttcctctcagtccaggggtcgtccttgaaccgcacagccacagtcccagtcccgacactgccaggattcccctccaaggaattcactcttcccctgtctctcatcttggagctgccgatttgtgccccactagaggagccaagaggtccctagagcctcctcctctgatgcggacagcctggcaggcaccccccaattccgggctctcaggcctcgtttggatttattttgaaggaagctattgtctactaaatgcttaattctcccagaatggtgccaagtgcttcacacagccctgcccaatgagctgggccctcccgcacctttagggaatgagctgagctgtctgtggggggcactcaaggtgggacaggcacagtgtggcagcgcgtggatctggctgctgttttcctttgtgactggcacctctcctctcccccttccctcctccccccgctttgctcccccagcctttcctccttggccttcaaggccatacacgctccctggaaagagcccttgccgccacctctgttactcatcgtccttggcccatgcttgctccaagtgctggcacccccagctcctaggaaaactgctggcagtgtccacgccgacggaaatttccttggcctgtccgtttgtttcgctttgtttctggccctgccacggcatggcccaggcctcgggagcctgtccgtgtgcagttctctgcaccttgtccgctcccttccctttctcttatgggcactgcccctccttccatgcagggtttgctgtgttttcatctcattcttctctgtttctctctgaaaacctttctctagccctacctgtccttcatctgaggttctcattccctccatccccagcggctcccgattcccaatccaggtgaacaaagaggacagaaaatctgtgaaggagaggaccgagaacctggaaaaatgggctgcagagacggggaggggaccgggagcacgtgaagctgagtgggagagaaataaaaaggaaactgggttttggagaaaatgacaaagtgaaaccagattggcccgcgtggacgggagccaaaggagggatgacccagctcatttccatggcccgggagacacaccggatccttctttcagtctgtggcagggagggcctagatcctttaagcagatgtgaagccggtggggaagccaaaagtggggtcgggacaaggtcagaggctgacgctgggagacagagacagcagcagtggccttggacctgagagcaaccgagtcagggaggggccgaggtcagctcggggtccatggccagggtgcacgtccagtgaggagggcgccccatccttactctgggaacagcgtcctcggctgtcctgcgggagtgctgcctcccactctccaaacacaccttgctccaggcggggtcaccctcgggctggccagacgagcagccaaagccgggcccctgagaatcagccatgggatggtggctggaactgccgggaaagaggcgacatcgctccactggaagccaagccacagcctcgggcggccaccttcgccccatcagggaacccccgtgagtgtcccctggggaaagcagagtctgggggagcactcacaggaaagcagagcctgggggagcactcagagccctggcagtcgacgacccctgcacccggttgcagcccggactctttaggatcggagccggcaaatctccctctttgcttaagccactttgaggtggggttctgccaggtaaaccaaaaagaagtcttaagacggcttactggaattcctcacttggagagcagcagtgagatcccaggctgcatggacaagagagaggaaggcagggggcagcggcgggtgggagatggctcatgctggctctggagctgactttgcaaatctcttcccaactccactatcggtgactgcaccttcaaaacttgaactcggccgtgcaggagtatttgcaccatggaaagtggcgaacaccacacatcaccgctctcgtccctccacccagccccggaaagccagctgctaggcctgtaccagcattccccatccatggactcaggagggccgggcttacctgggaccacttctgaaaggtgcaccagccccagcttccctgaggacaaggctgagtcacgaagcatggacgaggctgagctgcagtctgcacaggtggagttaaacaggccatagccaactcacccctcacccgaggtctgcacagacctcacctgcagccaaattacatttgagcacgcagtaaaaggatggaaactgatgatcctcctgctccctcccttccatttctttgctctcagtttagtcactgttttttgtttgtttgtttgattgtttgtttgtttttgagacaatgtctcgctctgtcgcccaggctggagggcagtggtgcaatctcagctcactgcaacctccgcctcctgggttcaagcaattctgcctcagcctcctgagtagctgggattacaggcatgcaccaccacgctcggctaatttttgtatttttagtagagacggggtttcaccatgttggccaggctggtctggaactcctgacctcagatgatccacctgcctctgcctcccaaagcactgggattacaggcgtgagctactgcgcctggccaatttagtcacttattttatttttttgaaactaaatctcactttgttgcccaggctggagtgcagtggcgtgatctcgactcacttacaacttccgcctcccaggttcaagcaattcttctgcctcagcctccccagtagctgggattacaggtgcttgccaccatgcccagctaatttttgtatttttacttttttttttgagaccaggtttcactcttgtcacccaggctggagtgcaatggcacgatctcggctgaccgcaacctccacctaccaggttcaagcgattttcctgcctcagccttccaagtagttgggattacaggcatgcaccatcacgcctggctacttttgtattttttgtagagatggggtttctccatgttggtcaggctggtctcgaactcctgacctcaggtgatccgcctgccttggcctcccaaagtgctgggattacaggcgtgagccactgcacccggccaatttttgtattttttagtagagatgggctttcaccatattggccagtctggtctcgaactcctgacctcaagcaatccacctgcctcagcctcccaaagtgttgggattacaggcatgaccaccgcgcctggccacttttatttgtctgcttttatcaggactcttggaagcaagtgataggaacttaaactgattttaaaaagaggcttattagtacaggggttgacttggcttcaggtacagctacattcagaggccccgaaattggcttgggccttgatttctccccctcttggctttgccctcccgtgtgggcactttttcaggagggccctcacctgctgcggggcacagctggcctttgcacagccatggaaataatctctttaaatacgtcctagaaaaaaactccttggctctcattggccggtcttgagtcacgtgcccatgcctgtaccaattgctgcagccagtgacagggctgttctgagtggccacgcccaggtccccacccactcctgtttctggaccccgtgaatgggagtcggggatgggctcgctcccaaggaaaacaggaatgttggacccaggaggcaggaggatggaagcccagccagcaacacagcagatgcccttacaaagccacggactggcgggatcagcggcacctgggagcctgctggcatgagattcttggatctgccttgcacctgccaagtcagaatgtctagaggaagcacaggttgtgttcctttgtgtgttattgttattattattattattatttttgagagacaggatctcgctgtgttgcccaggctggagttaagtggcacaatcccaggtaactgcagcctcaatctcttgggcttaagcaagcctcctgcctcagcctcccgagtagctgggaccacaggcatgcaccaccacgtccagctaattcttttatttttatttttgtagagatgcattctcgttaccctcccaccttggcctatcacggtgctggggttacaggtgtgagccgccgggccgacaggagtctgtgctctaacacactctccaggggatgttggtgcacactggtgtgtgagaactgtttgtcagccccccataaaattagcattttattcactgatgtgaataatatcctcgctaggaccaggtgcggtggggaaggggaggttccagggaaagttgcgaggctgttcctgaggagggtgtgccacacagacaggcacgcaggttgagattcttgaccaaaagcaggctttgacttgtgatcctgggggataattaccatctgcaattgtcttgttttccagcctaaagcctgagcctgggttcccttggggatacagaaacatctagattccaaggcacacatgctgccatgagctgaacagaaaatgacaagtgtgcccttaaagcactgcagggatgtccctgctccaccgccaacagggttggggcgtgggtttgttcttgccctgaggggtgagggacgggcctcccgtgccgacctcaaggcccactggacacagcctccgctgggcttgagccagaggcccgtctgggccctgggccagctgccggctctcctggggaccgactgtgaccttggcctcactcacccagggtgctggtgcttccttctctgcatggaggtcagctcctgatggcctcctgctggattttgtgaatgttggatgcagattctttctctaaacggtgcctgctccccagattcccttctttgcagagcacggagtcccattgggaggcctctgtggcctctggccgaggagttccccaagccttctttttcacatctgtaaaatggggactggtttgtatctcccacgactgttgaaaggaagactgcagtggtgcaagtgaagcccttggtgaggagaagtgagttggtgaagggctacaatctgcagtcggaacggaagccggctccttgtactaggtcactcacccttggcagtcgccccttctctgagccttcatttgttcttacgtaaaatgagggtcccgcaatactctctctagtggcttctgttttgtgccatgctgctattcatagatggcagcgctttttttcccgcgatggagtctcgctctgtcacccaagctggagtgcagtggctcgatctctgctcactgcaaactccacctcccaaattcaagcgattctcctgcctcagtcccccgaggaactggaaccacaggtgtgcgccaccaacctggctaatttttgtatttttagtacagatggggtttcaccatgttggccaggctgaacttgaacttctgacctcaggtgatccacccacctcggcttcccaaagtgctgggattataagcatgagccagctcgcccagcctggcagtgcttttaaagggggtctgtccacataccttcctccttctaggagtagtatcaggattcccctggggccccctgttccccactgcatgaggtcttggtgaggacattagccgggtgcctgatgctccaccagctgagggctgggtgtcagctcagggtcagccaccagaccctttgccttgggaatttattttgtaaaataacaaacaaaagtccaaaataaccttcaaagtttatactttacgacttagaggaaacaaatcagttattaaaatatcagtgagacccacagccacatctaaaaattatccaggaggaatatgaatcccatagcaactcatctgtatccatgacaactattgttctcaaaattactaatacattcacacaaatattaacccaaacaattaaaagttcaggaactatttttggtttttcaatattttgaagtggctgcatgaagaatttttaaataatataaccacattaaaactgaaaagccaatctgagttgcttcttgggcatttgaacttggaacagaccaacaaggggagaaaaaccattggcaactgaataaatgaatgcaaaaatccctgctccctggtccccgaagctggcctggtttgtgcctcccaagatctggttgtcccactttccctcttcttctccgagctggtcttgtccttccaagaagttgcactttgcttacgttggctggagttggggttactgctgctggcactcagcaagccccacacgggaagcatccgcgggggttgcagtggagcctgatgaagcaaccgtgaatggcactgagcatacaggcagcgtggctccttctcaccttcgaaaggagagagagacactggaaggaccaagccgtggtgtttgcgatgcactgtgtagggcctggcacagagaagaagctctcacgccctgcccccaacagcaggtgcattagaggcaggagcaggctcaggctgggcctctactctccatggggtgcctctccccgggctccaggaaggcctgcacatacggctcagcgcactcatccgtgggcaccgtgcctgctcactgaggtcccctgtgttgagaatttctaggcatatgcagatttaagtggctgaaatgcaagcaccatgtcatgacgaagctgggacgcagctgggcagacctccccgtgacagcaggagctggggaagccccggtgagcatgtttagtgtaaggaaggtgaatgctgcctccgcatgcacagcgagagggcatgaaggtgagcgtgggggcagcgtcccgcttgttggtcccgcttggataacgcagaagcgtggaagcaggtccgggcatgctggcagccatgtgggagtttctgggcagatgtggtgctgagtgccggcctggggtggcctcgattctctccctgcagcctttgcagtggccatcccttctctccccaatcacagaggaagaaaaggaggctcatttatgccttcaactctgttcatccgtcaatttgctgagtgcctaggaggcctggcgcataaaatatcaaataagacaaagacctgccccagcggagttacatcctcatgggagcaacagtgagtgagcaagatccccaggcacgtgggacgcacccgggaggaggcagatgggatgcctgccggagaggatgtggagctgtggctgcggctgctttggggcccccaggtttgatgattccccaggaagagtcactgggtccagcacagagccaccctcagagctaagctacattcagcaaaaggacgcagagcgagatcagccacgcgaagaggtgtctgggctgtccggagggccccaggcaggagcttctggagtcctcaccagggaagacggacaggacggacttaattctcccctaaaccagccgcaacactgaaccagtgtgacgtgttctgtaccagaggagctcactagcaactcagtgcccaagggtttattgggagctgttcacataggcacctgatacccagcacgtggcccaattccagactcgcagcaggagggagagcaggcgttccgcatgaaagcagcttacagtgacaccagctggtgctgggaaaacaccaggtaggacctggcagccagtcctgataaaaatgcaaacataataggcatagagagaaccttcccatacctcagagcatctgcctggaacttccgagaatcatggtgaaggtttgaagagatgatccgcagaagcccttggccaagcgctggaacccagtaagggcttggtggctttcaggacctctcaagtcacctcccagcccaccccgtccctccaccaccgtctcccacctgcatctccccggactgcctcctatttaacccctgctcccctccagccgcctgctcagtctgtcctcacagcagctgtgggatgcatttaaaaggtcagcgagggccgggcgcggtggctcacgcctgtaaccccagcactttgggaggccaaggtgggcagatcacctgatgtcaggggttcgagagcagcctggccaacatggcgacatcccatttctgctaaaaatacaaaaattagctgggcatggtggcagacacctgtaatcccagttactcaggctgaggcaggagaatcacttgaaccaggagacagaggttgcagtgagctgagattgcgccatggcactccatcctgaatgacagagcaagactctgtctcaatataaaataaaataaaataaaataaaatgtcggccaggtcactgcctgctgaagcctgcagtggtctcatttccaggctcccaatgcccctgccctgctgtggacccaacttccttgcaggcctctgcctagatgatcaaggccagcgtgggcgtccagccaccgctgccttctgagttcctcttccgacgcgcaaagtgttcgcatttcaatgagcttgtctcttcctcccacccgctgcaaggcgagccccacgggaaggggattttctttgctaggtgcacctgtgtgcatgcaggtgccggcggtattctcatctgtaaagtgagcaccaggctcctgtcccctcgagaaccttcacaccatcccccaggtgtgtcctccctcaagcgagtctctgtccctgccccagcagcacaaggaaagcagcaccttcctgctctcctcccccttctccgcgaagctcttgaccctgctgccagaacaacgggagaggacaaagccctcgagccccagctggcactcacctgatgcctcggtggcatcgtcaaattccacctggaagaggtagccagtgttccagatgtacaggcaggatgccgcttcataggagaccctgagtggcttcagctgggggtcatagacgctgtccctccactggatgttaataggagactgccgggtgccccctggcacggagaccgggaccgtccagagtgggtgcactgcagggagagagacggagaccctgagtgaggcatgagcttcatcctgtgtcttggacggacagggcagaaacccggccgcacgagacccctcacgtcctggctcatgggaaactgacccacgggaaacgggcgcgtgggggcccctgcgcagcgacgcacgcccacagggtactcgcctgctcctctcctttctgcaccactcggggactttctttcccacccggaagcaactccctctgggcccatgccacctgtgttgatgggtttttgacttttgtgttgccctcgtcacagagtagccacaggaagtctggatagaccttggggagggcaggtgggtggaggagggcgctgtggggaaggcaggctgagtgcagtggggctcttgtctctcgggaagggcttgaaacttcccttcccactcccaggtaccccacctagtggtcctgtggaaactggagctgctttggaagcccaactctccaagccctctggcaaggaggaaatgagaccccagtgtggagaaaattaagcagagtggcagcccctctacctacttcctcgaggctcatttcaaactgctttgattgtcatttttaaagtaagagccattaatcgaaaacagttcagaggtcaggaacagtggctcacgcctgtaatcccagcattttcggaagcaaggtgggtggatcacttgaggtcaggagtttgagaccagcctgaccaacatggcaaaaccccatcattattgaaaatataaaaatcagctgggtgtggtggcgggcgcctgtaatcccaggtactcaggaggctgaggcaggagaatggcgtgaacccaggaggcagaggtggtagtgagccgagatcgcgccactgcactccagcctgggggacagagactctgcctcaaaaaaaaaaaaaaaaaaatgcagaaaagcttatgagtgaagaagcagctgtcccatgattgcaccccctggtgtgtgtctgccccacctgttctctgtgcaataacctcatgctaagagaaagctggatcttttatttttatttttccttaagagacaggatcctcgggatatcctgctcttgaaaccttagagcacttccaaatacagagtccccttgcttggggatgtcaccccagaggcctggcgtgtcctgtggctcctgtcctcaccttcacaggcctgagctaaaccagttcttaaaagggattaaatggaatagtgcgtttttgagatcaggtctcactgtgccacccaggctggagtgtagtggtgtcaatcactgcagccttgaacccctaggctgaatcgatcctcccacctcagcctcctgagcagctgggactgcaggtaaacaccaccatgcctggctaactttttcattttttgtagagacgaggtttcactatgttgcccaggctggtctcaaactcctggcctcaagtgattctcctgcctgtcccaaagtgaggcaggcatctcccaaagtgctgagattagaagtgtgtaccaccacacccggccaggattttttattttaatgaacaaggattttactgtgtatattatcttgtaagttgccttttttcatttaacattgtgaactcattttgtgaaaaaaatatatatatacaattctttttaatggtggcacgtttccattgtacagttacgacacaatttttaaaatccattatttggtgatgatatttaggttatttccaacttcttgcaattaaacaaagctgtgatgaagttgctgttctttctctgtattctcatctggattattttcttttctttgttttttttttttttttttttttttttgagacggagtctcactcggtcgcccaggctgcagtgcagtggtgccatctcggctcactgcaccctgtgcctcccaggttcaagtggttctactgcctcagcctcctgagtagctctattacaggcacgcgccgccacacctggctacttttttgtatttttttcatagagacggggtttcactgtgttagccaggatggtctccatctcctgaccttgtgatccacccgcctcggcctcccaaagtgctgggattacaggcgtgagccaccgcgcccagccttggattattttcttcttacaaattcctaaccacagaatcactaggtcaaagggtgcatccaacagaagtctagaaaacaaggataaagatgtatagccctggctgggcgcggtggctcacgcctataatcccagtagtttgggaggccaaggtgggtggatcacctgaggtcaggagtttgagaccagcctggccaacatggtaaaaccctgtctctactaataatgcaaaaattagccaggcgtggtggctcatgcctgtaatcccagctaccggggaggctgaggcaggagaatggcttgaatctgggaggcggagattgcagtgagcagagatggcaccactgcattccagcctagatgacaagagcaaattcggtctcaaaaaaaaaaaaaaaaaaagatatatagtcctgtcagaaatgcgtctccacctaggtcaaatggttagcgcattgctgtgttttgttctttaatcaacttgaaaaaatttttagctgttatttaataagtaaaccatcaggccaggtgcagttgctcacgcctataatcccagcactttgggaggccgaggtgggcggatcacgaggtcaggagatcgagaccatcctggctaacaccgtgaaacccggtctctactaaaaatacaaaaaattagccgggcgtggtggcgggcgcctgtagtcccagctactcgggaggctgaggcagcagaatggcgtgagcccgggaggcggagcttgcagtgagccgagatcgcgccaccgcactccagcctgggcaatacagcgagactccgtctcaaaaaaaaaaaaaaaaaaaaaaaaataagtaaaccatcagaagtcagtagaatgtacaatacatttttaagttaaagattgcaaaatcgcagaatgtttgttctaaaatcgcatcttttctactcgtcagtgttaaaaagccctatgggagataaaggtgatgatagatagtaggatggttgtgtgcctgtttattttaattttctctcttggtttttctctcccccatcaacgtgcatggtaacatctgctaggggtctgctgtctgtctcataaccagaatctcagcagggggttggtcatttttctggcccgtgcattcccgtgctccgacagcatctggcactatgaatgtttgttgaatgaataatccctagtgtggattaactgcccctgccccttacaggtgggaaagcagagggccgggggctggagtcacttttccaagacatccagcaagctcgctgcagtctgaactgagatcctggcctctgggagtctctgctagagcttctggctgctccaggctggtgtccaggtctccagagtgttcctctgttctttgtagaccagtggcaaggacctcccccctccggacccttccccagtggaacctgaggcctgaatcccatcaacatcagacccaggcgcctggcttccctattaaagtggacgtgttgtgagggcagaggatgctgacgagtaaagctgctgtgggcaacgggccctccctgtcaggctgggtggggaggagagagcggtggggactgcggcgtggggacagcacagggtggttctgagaggggctgctgctaccccactgggcaggagagggagccctctgctgccagatctttggatctattttttttttttttttcttttttgagacagagtctccttctgtggcccaggctggagtgcagtgacgcgatctcagctcactgcaagctccaactccctggttcaggcgattctcctgcctcagcctcccaagtagctggggttacaggcatgtgccaccacgcctggggaatttttgtatttttagtagagacggggtttcaccgtgttggctaggatggtctcgatctcctgaccttgtgatctgcctgcctcggcctcccaaagtgctgggattataggcgtgagccactgcgcccagcctggatttttaaagagaagatagaaatacagatgttcaggtagggtgtcccaacgttcaggtgttgtcaagtaattttttttttttttttttgagattgagtctcactctgttgccagggctggagtgcagtggcgtaatctcagttcactgcaacctccgcctcccgggttcaagtgattctcctgcctcagtctcccgagtagctgggattacaggtgcctaccaccacgcccggctactttttgtatttttagtagagacggggtttcaccatgttggccaggctgttctcgaactcctgacttcgggtgatccacctgcctcggcctcccaaagtgctgggattacaggcataaaccactgtgcctgaccttgccaagtaattttttaagttttacacattgtgcagtggggaagacacatctgtgggccaaaaccctggcggctctccccactcactctccgagttacctggcatattatttaccaccttctcccagtctcagtttctatatctgcaggaaggagaataagggagtagaatcacagcagctttgctgagaagataagctcgctggcgctggggaaggcctggagtgccttcccacgcatgatagacggggaggatgcatttccctgcccctgccttacagcccagcacaaccctgcggtcacacacagaactcgctaagtgccggaaagcagtgactaagccggcgctgggaaacagtgggccctgcggcatcctgcagatgcgttctgttctctctcacgcgatagacaactatggacgcgggagccggcggccacaacaggggcctctgtctgtgtgtcctttgtcccagcatctgctttaattcagaacgacaccagcagccctgaacttccattgactgttctctccaaagagcctctctgaggctgggcgtggtcgtgcctgcctgtaatcccagctactcaactacttgggaggctgaggcaggagaatcacttgaactcaggaggtggaggttgcagtgagctgagattgcgctattgcacgccagcctgagcaacaagaggcagactccgtctaagaaaaaaaaaagcccctttgaggcctcacaaatctcccttgcatccaacgggaagcaggattgagtgcactctaccccccctcccacggccgctgcctccagtcctacctgccgggcaaggggcatttaacatggctacacagacctgaatgtagacagaaccctaaagccactgatgccacagaggaggtgctcatctagaccagagacgcaggcttccctggctcacagagacacaggttgtgggaagagcgggtaattttaggttctgtttgctgagctgcaccaacgggcccaccaacaatgaaacacccgcattgaactcagcgtgtgtcacccaacaaaagggctcattgccacctgcacggaggcgacgccacctggatgctgaataggcttccaatctccacacagccgaccctggtgcccagcaacgtaggttctgtgctaattccagtagggctccaatgggaggcaatacaaatgttatcctctttttcaatcagtcaacaaatatttacagagctgctcctatgggtcaagccctggcccaggtgcaggggacatggaatcaaagacgccaagtcccctgccccaggaggccagtatttgcccctaattcacacgggcgcagtctggaaggagaccccatctccccgatgcattctcagtctccaggtttgatggtggttcagcaaatctcaaattccttcccccttgacctccatgggaggagctatcccctcccccattgtcactaggcttggccacctggtgacctgctttgaccactgggacattagcagacatgacgtgagcagtagcttggaatacatgggcaccgctggcctcgccctgtgagtgcctgccctccgccgtgagaagaacaggcctcaggtggctgcgaagggaggatgagagatgcagtgagcaggcctgcacccacccagagtggggagcccagcccaaccacggtcagcccggggggagccaaatgcaagaagactcacacacacctgagcaggaaatagccagtaaaatgtccaaaaatgtgcagcagtgtgctggttgaggtttaataagccgttctcccaggaatttagaatctttgatttctagggtttgccaatgactgtggtgtaaatactttcaccatggccaattttaagttaccaacgtaacgttgctgatcacacacttaggaacagatgggcactgccagtgcacaccctgaaacatgactagaaaacattaaatgatccctaaaattattttttcttagacagggtcctgctgtgtagcccaggctggagtgcagtggcctgatcagggctcactgcagcctgaaattcctggggtcagtgatcctcctgcctcagcctcccaagtagctgggatgataggtgtgtgccaccatgtccagttaattttttaatttttttttttttttagagatgggttcttgctatgttgcccaggctgatcttgaactcctgtgcttgagctgtcctcccacatcagcctcccaaaacagtgctgggattacaggtgtgagcccccatgcctggttctaaaattatcactgagcgttttgtaactctttgacttttctctcaaggccaaaccaccagtgatttttcaataatttttagtaacaatattctttttccaagtgaaataatcttcagaatgcccataaataaaacaccgacatagaaggatgaattccttatgatgttccaatcttctctgcttggcagaatattctgctctttgtggaactctgaaatgatttggcagagccctctgttcactgggaacaggttgaggaccatggtgtaaatggatttaggtgccgatacagaatatgactctctctagcacacgatgtaagaggacatgttgccacagtaagaaatggaatgctacctgctgcccactgacagggaaatgcttaaatagacacagggcacccaccgctgcctgtgttagcaacagcagcagctggcgtctagcaagggcttcctggagccatgtgctgtccccagcctttgcaggccccacctcggacccttctcccaacgacactgtgccgtaagcaccattatcaaccccctgttacagacgacaaaaccaaggctgggggaagttaagaaagtcacagaggggacagctgggcgtggtggctcacgcctgcaatcccagcactttgggaggctgaggcgggcagatcacctgaggctgggagttcaagaccaccctgagcaacatggagaatccctgtatctactaaaaatacaaaattagccggatgtggtggcgcatgcctgtaattccagctactcgggaggctgaggcaggagaattgcttgaacctgggaggtgggggttgcggtgagctggagatcgcaccactgcgctccagcctgggcaacaagacagaaattagtctcaaaaaataaaggaaagtcacagaggggcaacagccatagagcagtggggccaagattccaatctaggcaggctagcgctcttgacggtcgtactaagaataaaaaaggggggtgggtgcagtggctcacgcctgtaatcccagcactttaggaggccgaggcaggtagaccacctgaggtcgggagtttgagaccagcctggccaacatggcgaaatcctatctctactaaaaatacagaaattagttgggcgtggtggcacacgcctgtagtcccagctacttgggaggctgagtcaagaggatcgcttgaacccaggaggcagaggctgcagtgagccgagatcgcaccactgcactccagtccacaggtgtggaccccaacaggaggaatgagtgtagctcactcagagtctggggtgggccaggctttctacacgcatcgtgtcatccttccatggccctggagagaaagtctggccacccccatctcgagataaggacacagaggcttgggggtgaagacctgccgaggctccacctcagcaagcgtcagtcggactgcatgcctggggtctggctcctaagcccatgctctttcaatggcccaaacatggaatgcatggaagatttcagttagaagagaacttggcagctgccaaagcaggctctcattctacggaggaagcacctgagacccagaaagaggaagggcctcgttcaaggtcacaaggcactgaccatgaagccaggaggggctggcacggggcagtttcttggcagagctggctgagtggtttatttgttacaggtttgcttgaaagcgttctctgccgaagagtttaggagcgatcgtgactggttagtgcagcccattccgccgggtctggatggtgagtcgtgccagtgtgtcccgtgcgaacacggactacccgcctgctcccagcatcttgccctccccaggacccctgaaacggaggctaaatgattcacccaaggtcaccaaatacaagagaaacggagtgtggccaggcgcggtggctcacgcctgtaatcctagcactttgggaggccaaggtgggtggatcacctgaggtcaggagttcgagaccagcctggccaacatggtgaaaccccatctctaccaaaatacaaaaaattagctgggtgcagtggcgggtgcctgtagtcccagttactttggaggctgaggcaggagaatcacttgaacctggagggcagaggttgcagtgagccgagatcatgccattgcactctagcctgggcaaaagagcaaaacttcatcaaaaaaagaaaaaagagggccgggcgccgtggctgatgcctgcaatcccagcactttgggaggctgagacaggcggatcgcgaggttaggagttcgagaccaacctggctaacacagtgaaaccctgtctctactaaaaatacgaaaaattagccaggagtggtggcatgcacctatagtcccagctactcaggaagctgaggcaggagaatcgcttgaacccgggaagtggaggttgtggtgagctgagatcacgccactgtactccagcctgggccacagagcgagacgccatcttaaaaaaaaaaaaaaaaaaacggagtggaaatctgaacccatctggctcgggacggtctctcctctctcctctcgaaagaccccatcagctaagacaaggatccagtcgcatcttaggaaatttgaggctctacttacaagtgttattgctggtttgccatgcacaggaacgctgagaacaccatcgccctggcctcatcgaacgactccagagaggggcccacatctgctcaaccaagaaggagaaagctgaggtcttccaagtgttcctccccaacatcttgggtctgttcccactgactccagtctgaagagggtgatgttccctgctgtctgttctcactttgatcaggaccactgtggactggcgtgtacccacctctttttgtagaaactcatcccaacccctgagcctaatggttaaagttcaacccatgcctttcccaacagggtgggtccacagggattagtggcctctgctggggacaggccactcaggtcactgggctttgatctggcaaacaggagcacaagtctgccagggagctagaaaaactgtacggtggggctgcgtgagcaccaggggattacgcgggaggcgggggcgagtggatgagagcagagtccctgtttctttcatggggttgaccgtgtggtttggggctccgggacactcaataccaggcacaaagccatggtgtgcatgtgaggagggactggcaggcaggctcagaagtacaggaatgggactggccaaagcgctgctgggtagacaggccaggggagcagggagcttctgtccacccaccagggctcctgaagtcatggagtccttgcttgccttaaaataggtgcgatttgattcattcatcctccccggaagcaagatgccctgtggcttcggacacttccaggtcatgcctgctgtcttggcataaacattaacagggccacctttctttctttccttttctttttttttttagacagagtttcacttctgttgcccaggctagagtgcaatggcgtgatctcggctcactgctacctctgcctcccaggttcaagcaattctcctgcctcagcctcctgagtagctgggattacaggcgcccaccaccatgcccagctaattttttgtatttttagtagagatggggtttcaccacgttggccaggctggtgttgaactcctgacctcaggtgatctgcctgcctcggcctcccaaagtgctgggattacaagtgtgagccactacgcccagcctcttttcttcgtttcttttcttttctttctttctttttttgagatggagtctcgctctgttgcccaggctggagtgcaatggcgtgatcctgcctcactgcaacctttgcctcccaggtttaagcaattctcctgtctcagcctcctgagtagctgggattataggcacacaccaccacaacggccaattttttgtatttttagtagagacggggtttcactgtgttccccaagctggtctcgaactcctgagctcaggcaatccacccacctcggcctcctaaagtgctaggattacaggcatgagccactgcgtccagcctcttttcttttctttctttctttctttctttctttctttctttttttttttttttttgaggtgaggtcttgctctgtcacccaaggtggagtgcggtggtgccatcatggctcactgcagtctcaatcacccaggctcaagtgatcctccctcctcagcctcccaagtagctgggactataggtgcatgccattatgtccagctaattttaaaaattatttgtagaggcaggttctcgccatgttgcccaggctggtcttgaactcctgggctcaagcaatcctcccagagtggcctcccaaagtgctcggattacaggcatgagccactgcccctggcctggtacctcccttcatgcccagggtccacatgggtatgttagctggtcactctagccaggcagctggtgatatttgcagacgccaacccacaaagaaccttcctttgggtcctttgagcggcacagcagtttattcacccagacaccttttacctgtgaaatggaacccatgggattgggatgcaccagtttgtgacttcttgttgttgtttaaacttacaatcttttagggggcagggctatcataacttttcatagaatcctggaatcttagatctagaaaaccctacagaacacaggtgttgaaatgcgagtccacttgtaggctcctgaaagcccaagaatcccactgaaatcccccacacaatggatagggtctgcggctttcggccactgctctggtgggcccaagagtttgcttgcatttgttttgagcaacaaaaaccaagtctggatgatatgttctctccttcccacacagtcatggtggaaatgcacccactcttgggaagtctgattcattgtcattcattcattgacccactcactcattcattgactcactcactcactcattgactcactcactcattcactcactcactcattcattcactcactcattcattctctcactcagtcaatcattcattcactcattcattcattcattcactcactcattcactcacttattcattcactcactcattcactcattcactcattcattcactcattcactcattcattcattcactcattaattcattggcttttgcctccatttcctcatctgtaaagtagggaagattctaggattccatcatacacgataacactctgtcgagctgttgttgacacaagtgatgtccttagagcggcactttcattgctgcaggccaagctcccaccccaggcattgccagccccatgtgagcaggggcatctcctgagtacactcacctgggcagccgatgatgccccacaggctcctggggcatgtcctctgccatcctcagccgtcctgccctcttcagcctgcccagtttaggttgactgcgttgcagcagtacccgtgggctgggggtctccctgtcttcctcatctccctgctgccccatggcaggactctgctttacttacaaaatatcaccagccccagtgtattaatcagggttctccagagagacagaaccaatgggatagacaaacagatagatagattagagaaagagagagagaaagagatgatagatagatagatagatgatagattagagagagatgatagctagataggtagacagatgacagacaatagataggtagatagataggtagatagatggtagataatggatagatgaagaaagatgattggtaggtagatagatggtaggtagatgagagctagatgatagatgacaggtagacatgttaccagatggaaagtcttaacttcgagttgtccaggttcttggtgtgttaaagaattgagcaaaacacacaaacaaagcaagaaaagaacaagcaagtggctcaagaaccctgattaccatgttcttcagggtttttattaagctaaaagaatttggtaacacccccaggtgccctttagagggctccaattggttacatcctatgaaggattggcccctgaccaatcagaggcagaagtggaggcttctgttctgttaccgcagtagtgagactgtggcccgtgtgccgcccaatcttgcctggaaccggctgctcctgctgctcttttgcttctgccttaaacctgggttaccctcattccctattctcccgcctcaggtaggtgatagatagaaataaagagataaatgataggtagatcgatagatagatagatagatagatagatagatgaatgagaggacattaattaggggaattggcccatatgactatggaggctgagaagttccaggacaggccactgcaagctggagaccctggggtgctggtagcatggctcagtccaagtccgaaggcctcagaaccagggaagctgagggtgtaactctcagtccaaggccaaaggcctgagaaccctggggcagagggtggcattggtgtaagtcctggagtcccatggccggggagctgggcgttgtccaagggaaggagaggaagcgcacgccccagtccggcagatggacagacacattcaccttttctctgtttttgttctctctgggtcccagcagattggatggtgccacccacatccaggtggaacaggaattaaaacaaattaaagaatatgtaagcagaaactcagttgtatgtaagaaaacccaattccccctgagaaagagaaagtgctgaagtcctttaaaattaactgcctgtttttctgtggctagtgagccttctctctccctttcccaggcattgcgaagaccctgtttctctagccgtgcagctgcaaggtcataaacagataaactcaagtcgcaacgcatgtttttccttgaaaagtaagaaatgatgtaacgcatgtctcaattaattgaataactgtctttgtttctcgcttctgcaacgtgcttccccctacacagatctccctccaccccacgaaatgcttaaaaggtaacttaagctctttgttcagggctcagtcctttggatgttaatccgactgggccggtgcacctaaataataaatatctttttttttttttttttttttttttttttgagacggagtctcactctttcgcccaagctggactgcagtggcgctatcccggctcactgcaagctccgcctcttgggttcatgccattctcctgcctcagcctcccgagtagctgggattacaggcgcccgccaccatgctcggctaattttttgtatttttagtagagacggggtttcaccatgtcggccatgatggtctcgatctcctgacctcgtgatccgcccgcctcggcctcccaaagtgctgggattacaggtgtgagccaccgtgcccggccggttagcagtttcttatggttctttttgggaatttccatatcagaaatctcttacatatgtattctctttttaaatacaggaaataattatgtatagaggatatgtacttatagaaacacatatatatgccacctactaatttatccggaataatttttatatcagtgtatatagctcttcccttcttttaaagaaataactacaaaatattccactgacatattaccataatttattaaattacctctcttatagatggtgtacatagctcttcttttaaagaaataactacagaatgttccactaaaataagtaccagctgggtgtggtggctcacgcttgtaatcccagcactttgggaggccaagacgggtggatcacttgaggtcaggtgttcaagaccagcctggccaacatggtgaaacccccgtctctactaaaaatagaagaatgagccgggtgtggtggcgcacgcctgtaatcccagctacttggaaggctgaggcaggagaatcacttgagcctgggaggcagaggttgcagtgaactgagatcgtgccactgcactccagccagggtgacagagcaagactctgtctcaaaaaaataaaaataaaaataaatatatatatatctcataatttattaaattaattatcttacagtgtttttccttttttttttttttttgagacagtcttgttctgtcgcccaggctggagtatagtggtgcgatctaggctcactgcaacctcggcctcccaggctcaagtgattctcctgcctcagtctcccaagtagctgggattacaggcattgcccaccatacctggctcatttttgtatttttggtagagatggggtttcaccatgttgcccaggctggtctcgaacccctagcctcaagtgatctgcccgcctcggcctcccaaagtgctgggattgcaggtgtgagccattgtgccaagctgtttttctagtttttatggtttttttttttttggtcttataattaacattgcacttggccaggtgcagtggctcacgcctgtaatcccagccctttgggaggctgaggcaggcggatcacctgagtttgggagttcgagatcaacctgaccaacacggcgaaaacccgtctctactaaaaatacaaaaattagccgggcgcagtggtggcacctgtaatctcagctactcgggaggttgagacattagaatagcttgaacccgggaggcggaggttgcagtgagccgagattgcaccattgcactctagcctgggcaacagagcaagactccgtctcaaaaaaaaaaaaaaaaccctgaaaaacaaaaatcaaacaaacaaaaaaattaacactgcactgaatatccttgaatagaattcctaggtttgacatacataggtcaaagggtaaatccactgaactgctgatagatgtgccaagttactcaggcaagggattgtgctctcacctgctcaccttgtattctgggccaaaatgtcttatatgtatccaacccaacacttcctaatttcttagtttctacctcccacagaaaacaccgtatagtctgtaattttctgccagagttgaaaatttctcatgcagagtcatgatggtaacttttgtcaacccggctgggccatggtgcccagatatttggtggaccattattctagatgtttccatcagtgtgttttttgaatgtgattaacatttatacctcagtgaacgttgaataaagcagattaccttccacaatgtgggtggctctcacctaatcagttgaaggccttaatagaacaaagactgacctccctccctattcccccaaaccccctctcccaccccccattgagaaggaattctgccagcaggtgccctttggacttgaactgcgactctctcgtcagatttggggcttgtcaagcctccccaattgcatagggcaattcctcaagataaatctgacaaatctccctctctctccccatgtatagatagataggtagctaggtgtaggtttacttacacacacacacactacacacacacacacacatcctgttggtctgtttctgtggagacccttacaggagttaataaaaatccataactaaaggagattttttcattcttttttttttcttgtcgttttgagatggaatctcgctctgtagcccaggctggagtgcagtggcatgatctcggctcactgcaacctctgcctcccgggttccggttcaagcaattctcctgcctcagtctcccgagtagctgggattacaggcacccaccaccatgcccagctaatttttgtatttttagtagagacggggtttcaccatgttggccaggctggtcttgaactcctgacctcgtgacccacccgcctcggtctcccaaagggctgggattacaggcataagccactgcatccggccttcatttcttaaattagaaggtaggagatcaagaaactgctcctctctgcctgtttacaaacattcttcatatttgaacccaaaatgtttaagtcaaaccttctttaactgcttttttctaaaatggaccacgtgtacccagataacccttccacgtgcagaagactgaaatttctattcttatttttttctcacctattaagattttctgtttttcatatgttccgtaaagcacacactacgttagtacctaacacacagatgtaaatttacatgtatacatgttcatggcaagtgtgtgtgagtgagtgagagaggcctagagcccaccattctctgagaaccctcaaatttctctgcatcactttttgaaatagggctttattctcatgtgatagaaatttaaagtcatttctttttttttttttttttgagacagaatttcactcttgttgcccaggatggagtgcagtggtgcaatctcggctcaccgcaacctccttctcccgcgttcaagtgattctcctgcctcagcctcccgagtagctgggatcaacaggcatgagccaccacgcctggctaattttgtattttcagtagagacgaggtttctccatgttgctcaagttgcaaaacatgtttttctttgaaaagtaagaaacgatgtaatgcatgttgcaaactcctgatctcaggtgatctgcccgcctcagcctcccaaagtgctggggttacaggtgtgagccaccgtgcccggccagaagttgaaagtcatttctaaatgcgctgcctgcgctccatagtactctgtgatctcaaaatgatacactgtccatgaagaaatgctattttaggtgaaaaaatcaaataggaaaaacttgcattggacaaaatccttcaaaacacacagaagtttctgcacgagttttggtcacagtaatttcttttgctgagccactggacttttttttttccatggttagtgttttatttttattatttatttattattatttttttttgagatggagtttcgctcttgttgcctaggctggagtgcaatggcgcgatctcggctcatcgcaacctctgccttctgggttcaagccattctcctgcctcagcctccctagtagctgggattacaggcatgtgccaccacgcctggctaattttgtatttttttttagtagagatggggtttctccatgttggtcaggctggtctcgaactcccgacctcaggtgatccacccatctcggcctcccaaagtgctgggattataggcatgatacaccgcgcccggcctagtgttttattctttgaagaatgcttctaaaacatcgcgccaagtcaatctgaaaggtaaagtttaaaatctttttaaaggataagttatatgtaatgactgttcactctacaaaatcttaatcttagggcttatgaggcacccagttggcagtaacatccaggttttccaaatagccagttatcatttttctcgtctgcatagatttctcattaactgcctcctgttttgttgcatgatctcagagtccccctgctttctctgagaggtggtcaagctatcctcttttcttcttcgcttgctaatttcctgggttttcttcatgttttctggcgggcaagttctcgttgatttccacggaccatgccgaccaccgacagagccaggaagaaagcaagtcggaaaagcaacggttccctggcacgctgggctaccgtcactgctgctggattttttatgggtccatttcccgcaggcgttttttactgattgcgtgggtttgtacacctgtttcccccacctgcttcacagcggcaacttctcattaataaggactcaaacgctcagtagcccctgttgagatgctaatcagctgtctggcttgggtggcctggattaattgcaccgtacgcagcctctcctgaggagttcgcatcaacggctgctcccattctcagacaggaggacagagctgccagccggacagaacgtcagtgctgacgtcagcgttcacgtgtgcaggaggagagccctgagggaccccgctggggactggtgctgtttctgcctgcgcacacccagctcttctccctggcagctgctgggtttgctctgggagaccagccctccccacccgccctccacgaggctgggccaggctgacccctcccccagacatgtctcaggactggccactcggagtgggggtcattgccgggtacacagtctggccagtaagcatcgcccccgggagccttgctggaatgatgagaaaagaggccctctctctcccagggaatggttgaactggaaaaacctgttggtagttgcggggaccccttcatgagatcctgctcaggaatggggaaaaaccagccaggtgaggtggttcatgcctgtaatcccagcactttcagatgaagtaggtgggagaatcacttgagcccaggagttcgagaccagcctggccaatatggcgaaactccctctctaccaaaaaaatacaaaaattatagcaaggcttggtggcaggcgcctgtaatcccagctactcgggaggctgaggaaggagaatcacttgaacctgggaggcggagggtgcagtgagccaagatcgcgccattgcacttcagcctgggtgacatagcgagactccgcctaaaaaaaaaaatggggaaaaaccaagcccacagatgggaagggcggggtggagagagagagagacagagttagagacagagatgagagagtctgtgcagtggactcccgggggtttctggagccactgaacctggccccactcctggaggtgcaggctttggtgttttcagagggtctcatatcagcccagattgagaagtgaccacgaaggctgcttggccatatgtttggccaagacaaaggagaaatcagccaaattgctgggcctaagcaatgccactctctctctctcctctctctttcaaatgcatgttactacgcagatagtaagggtctctgtgacctttacaaatggcctggtgcacacacgtgtaagcggcccccatatttgaggccttgctgatccactttacaagtgaggaaggtaaggtacaggaagcgtaggttgtttctccagtttcagagggcaccgtatccacacagcagtgactgggtaggtcctggtctctctcgacagcccagagtgtgtggcctgtccccggagagggtgggatccacgccaggaggggctgagtggtgctgactgccaccccctcccatcacccctggatcatcatcttgttttccagtggggtctcctttcagggctctagttcaccccaaagctgacctcttccagtgagaccttcaaacccttacagtgcccttgcatgaagtggcaaagtcaggggaggggtggagagtggaggatgaattacagaaggagcccccctggggggaacaattgcaaagatgtgttttcagggacagtcctcacgaccgtgggcggtagccatgacgtccggtctcccatctcctggagctgtgcatccaccatccagtacagcacctggacactccctctcccttagcagtccccagcatcgggctcatgggcaagtcctgtggatttcactctgtggaacctctccaatctgtccatttctcttcatcctgtctgcactgcaaccccctgcagcaagcctccgtctctcacttggagcctgtcacagccttctccactgctctcctcaaattcatgcaggataatgtatttcctcctcccattccttttccagcactccagccagatggacttttctttttttttgagacagagtctcgctcttgttgccgaggctggagtgcaatggcgcgatcttggctcaccgcaacctccacctcctgggttcaagcggttctcctgcctcagcctcccgagtagctgggatcacagccatgcgccaccacacccggctaattttgtacttttagtagagacggggtatcaccatgttggttgggctggttgcgaactcccgacctcaggtgagctgcccgtcttgacctcccaaagtgctgggattacaggtgtgagccactgtgccaggccgccagatggacttctcaaaacacaaatctgatcctacccactctggccccaaactttgtaaagtcttccccattgcctcaggagcaagacgacaccccttcctcgctgacaaggacgcagttgtgccttcactacctttgctgccacatctcaccacctgcctcctctcgtctctacccccactgtggctgtgtgaccccaggtgtattgctcaacctctcgtgtcttcctgttcttcacaaagaataggaattacagtgaaatgtgcctggctcatgggcacccagcccatggtaacatgagcacatccggaatcagactctctactaaacgcttcatcacctccatgccatggacccctcccaatatccctgtgagctgtgagatctaaacaccagttcccagagtgggaagcgaggcctgagagcctcagcaacttgcccagggaaggctcagactctagccctggccgggcaaactccaagtcctcgcacttaagaacaaccaggctcagcgttccagcattccactcggcctcctgggcttttcctgggccaccgagtgcatcgtgtttactttctctttctctaccctagtgacattctcagaaagaggaaccgtcggaaggttccagggttttcttgatgtgggcatttcgaggtgttgacaaaaggacctctgtgacctttacttatggcctagtgcacacacttgtaagtggcccccatatctggtgccacacaggccagagtgcacttcccgctcctcttataatgccctcactaatgtgactgtaacttcattaactccaggccagattggatccttgtaccgactggtgagtaagcgaaccttcactacagacagctgtctttgctgatgactagctacttcatttttaaaattacggtgaatcaactatatgccaatattgaacaatgccttccttttttagcttcctgagcagcaaaataaaaactaaatcaaaaccatcaaaaataaaaaagtgtagtagctcatgcctgtaaccctaacactttttgggaggctaaggcggtaggaccgcttgagtccaggagttcaagaccagcttggacaacatattgagacctctgactctacaaaaaataaaaaaaaatcaggcaatggtggtggtgcatgcctgcagtcccagctactctggaggctcaagcgagaagatcacttaagcccgagaggtagaggctgcagtgagctctgattgtaccatcgcactccagcctggatggcagagcaagaccctgatgcaaacaaaacaaaacaaaacaaaacaaaacaaaacaaaacaaaacaaaacaatcactaactgcagcacaatcatagttttgattggcttaatttctgataatgcctagtcagcagtggccttcaacaaacctcactgtagcttgttggatggtcacagatggattcacctttgcccacaagttcctcctcttgtccactcacacctgttcatgacgccgagcccagcattgcacaaggcctggggataggggaagtgcagctccagacacggacttgggaatgttttgaaacaacaggaacgacatcaccctaggtttgtgttttcaagccagatattccggcgtggatgctaagaattcttacatgggcaagtattaatatttgaatgcagccgtgattgaggtggaggtggagacaaaaggcgtgcgtccctagaacatgttttgtccccactgccggagggaatattctgtgtcagctatcgcacgcaccctttccctccatgtgagtggactccacactctaagcaaggcgctctggactgcaaactcagcttgtgcctctctccagccctgtggcctcgctggacaatttttctaatctctttggagctgatcttcatgttgaaaaaggacaagtcccatcttcagatcaacacctgtcccagcgctgccattttgccaaggctcctccttggagtgtttgtaaggcacttttgccacgaagtaacccagccaccagcctcagtggaacctccaagcctaattctggaggagactttaactcggtaaggttgcccaaggtcgcatagcccatgactgcgctgaatcctgtttttattattggcaaaagggagttgggcaggaaattcaaggtaaagcattttgtttttctttctttctttttttttttttttttcttgagacggagtctcgttctgctgcccaggctggagtccagtggcgccatctcggctcactgcaagctccgcctcccgggttcacgccattctcccgcctcagcctcccgagtagctgggactacaggcgcctgccaccgcgccgggctaattttttgtatttttagtagagacggggtttcaccgtgttagccaggatggtctcgatctcctgacctcgtgatccacccgcctcggcctcccaaagtgctgggattacaggcgtgagccgccgcgcccggccagcattttctttttcccagtgaaaatagctgcctcgccctgtgtttgggagctcaaaggcattcttgctcattgcaaataattgaggaaacagaggcgagtataaagaagaaaatgaaaggcaaggtaatcctagattagcagagggagataaccaggaatgacatttctgggaactgcgctatggtttgggaattttttcctgtgattacccacaaacgcacatttgcacatttattctacgtgtgcacattcacgtcatcactttttttttttttgagacagagtctcgctctgtcgccaggctggagtgcagtggcgcgatctcggctcactgcaacctctgactcgcgggctcaagcgattctcctgcctcagcctcccgagtagttgggattacaaggcgcccgccaccacgcccggcataattttgtatttttagtagagacagggtttcgccatgttggccaggctggtcgcgaaccctttacctcaggtgttccgcccgccttggcctcccacagggctgagattacaggcgtgatccaccgtgcccggccgccatcacttatttatattatgtgttacctataggacttatctaagaccataatcactgccgcgtgtgctaagtcccgcgcgcgtgcactcaggcccctctggatagacactggggacccctgaccacttatgtcagggaaaacgccaccaagcgctccggaacctcagggcaggacccgccgcagcagcaggtaggacccgctgggggcgcacagcccacctgagacatcgtaactacaagtcccagcaacccttggtgcggggacaggacgggccaccggagtccggagagactacaagtcccggcaggcatggcccagacgcagggactacgagtccccgaatgcatggctcccagcttgcgcagggcaccctgggaggtgtagtagttgagggagctaatgcgtattcattccgtctcaaagaagatgcaaattcctcagaccgtccactgaggtgattgttctcacgcaggccatgggcgtgggcgaaaaacggggggaaaaaagccctgggaagccggtaccgtcgcggaagaaggccgcctgcgcatgctcaccaggaggccgagcgggaaaagcgcgcgcagctggcctcactgccacaggggtgccccgcccccgggcccgcgcgcccagtgagcctgcgcggagggcgggggccgagcgtcgcggggaggggctcgcggcgcctgcgcagagcggcggcttctctcgcgaggacggacgccattatcgcatctccccgacaaacaccacgagaattccgcagcccacacggtaattgcagctcccgcagccggtcgcgcctccgcctcccccttcccgcggggcgagagcgagagcgagatctccctcctccctcctcctcccgcccgccgggccgcccgcgccgcagccccgccgccgccaaccgcccgggccgggcgatcgccccccgggccccgctccccgtccccggccgcgccccggaagaggggctcccgcttcctcgcttccgcacccccggccccaccgcgcccggcgtccgttgagccgcggctgccgcagcccggcccgggggcctcgcgctcccgacctctgtcccgggcctcgccccgcgggaaggacccggagccacggcggggagactggaaaggcctagaaccgcgcccgggctcctctggggcccgaagtctcccaagggggtcgctcctgccagccaggcgggagcgacaggcatcgtttttgtgcctcctccgtggctgtggaccggagccccatagcccaggacttgcacacgcaaggggcgctctcggggaccgcagacctcggcgacgaccccagcccgtcccccgaggggccccgatgaacgaggacctcggggtgccccctccccagcacgtttgtgcgatttctgtgatctagtccttaaggaaggtggccgttttctttttcccccctaggatgcagaaagtagatgacattccatccacactgtgtgagcaaattggagagattgccttgatagaggactgatgtttttcactgatgagatggtaggggttgtcttgctattggagaaatacatcatccctgaagaactgtgagcaagtggagcgagtgtgggctttgaagggtagcgagcttgcaccctgaccggggagggcccgggtcacacagttgttgatgtggaacaggtaattgccctgtttggagttgcctgttctgcccaggaatgtactccagggcctgatggcgatgctggaactcgcactacagtaaataattgataagaggaggcagttgtagggttcacttttagctggaagttcttaggggacagaaaaataacttggagtagtgagtggttctgagtaagctcaggaaacgtcaaataaaaactggatctggtcatttaacacgcagctcgcagatatccagtgctagaagaaaacaccaaaacgcggtaaaattctgtatgtgggtccacttcccgtgtctggcgattaaaataagaatatattcttgcgatgttggattctgtcatcattggcgttaatatttttatttttttggagatagggtttcactcggtccccgagactggaatgcagtatcgtgatcttggctcactgcagcctcggcctccctggctcaagtgatcctcccaccgcagcctcctgagtagctcggaccacagacgccaccaccccggctaatttttgtatttttcgtagagagggggtttcgccttgttgtccagcctggggctttaatctttttaaaaaagagcttccatttgtgattccacgctgcgtgggggcagctcaacatctcgggtgcttcatcatgacccaggaggcagaggctgcgtccactttatagatgaggtgactaggcccgcagacactaagggacttgctcagatttacagagccagggttcgaattcagtctgtctgaagcctatgttcttaaaaaaaaaagcccatatatttagtattttaatcaatataatgtatacaataggaacgtcaatgaaagacttacaatgaaaagcaatggtcccctgccccacctctcagccccgttcttcaaagaggtttacatcttgagtggtttctttaggtcattctccacagctctgagtaagctgatcctttttatttttttcttgagataggatcccctgatgttgcccaggccgtactcgaactcctgagctcaagtgatcctcagcctccttagtagccgctaatacaggtgtgagtgactgcacctagctctaagctgatattttgtattacacagccttgtctttctattacgatggggtgatggagcccttctgtcatatcccaactcttctatcccctggactgtctgtgttaggcctatgcaaatactgttctcttcacggacaaattgagtgtttcccttcctgtacagcgtggatttttctgttagtcatggcttttctcttggcactttctgttcccatcgactccttacattgttttaaattctcaaggatagtgtcaggtcccctttctccttcagcccctgtccttctcatctggatgggttagcttgcacacgagccagcctgatattttcctttcttctgtagctgggtatgttcaggaatgttttcatcttggctctgttcgtttccacaggaacctctggcaagtgctcttcctccttgtggagacccctctccctccctgaacgctcttggatcttctctttggtgttaatgatgttttacccttgtgtgtgctgaggtgtgtggattcctacgccggggactctgactctggtgctttgtccttcagctctgggaagttcccttgttctgtctgagaagttcttcctctccagctctgctcttctgtcttaggagttcctgtttgtgatggacgttctaggtggagccctggagttgcgtctttatccttccttctgtgtctcgtttattctcattctgggagagggctttaatatgtgttcacaatcaaatttttaatgtccaagcatgtatttgtcttgtttctttttcatagtagcttattgttacacaagtgcctcatctccatgactctaaggaaactaataaggattcttcccagctctcctttgttctgatttcttgtttccactaatgtcacttaaaaaaagtgttggcttcttcctctttatggcaagtcctccatactgatgtttactgttgtctgaggcaggaggaagctggcggagagccccgggtctgtggggtgcttttgaaagagtccagtttcccctcgggtgattgggagcctgtcaccgtgggacctggagcaccaacttgcagatattttctctgggctgttccgcttctttaggaaggcccctttgctggccgtgggggagttagctctcctgtgcgggaccgacttggcaggtgcgggtttggcctgcccgcagggctctgcgaggcttggagccccacgcctgtgcccccggtgctttccctctgccctgatcgggtcctctgcatctgtcaggagtgtgttctttcttgtgggttgataacaccctattaaagatgatgttaatggagtgagaggaggtcacccgtacggccagtcactccccttgagcaggaatttgcaagcctgttctattcactccaccttcctgcttccttgtggccttggtaattgcccacagtcaacggggtgaggtgccaagccgccgttccacagccgcctctgaattgcagcgtgggctggtggctctggccctgtggccttggagggctgccagcgtacctgggcaaggcccggcagacccgtgtggtagcaaagaccctgactttggctcctcgctgggtcagtgtgccaagcgggccgtctgccctgctggggtccaggagggcctgcagtgaagcagtggtgagcgtactgggagcatgatctttctgcatggtggctgactgtcactgggaggttgtgtgtagtgcggtgggctctgtctgccagagccttgccagccgagcgtccaggggccagctgtgtccatcagcatcacttgggtatttgtgagaaacgcacactttcaggccctacccaggttctcgtgcagaatcagactgcagcttggtcagcttttaattttcagatagtttttgactttacagaaaagatgcaaaaaatatttcactgagcttccctgttgtcttcatctgcttcccctgatgttgacgtcttatgtaaccaggcatccatataaacgccagaaagttcacagcattattgcgtaaatgacagaccttattcgaacttcggttttgcaccagtgtcctcttgctgtttcgggatcccctccgggaccccacactggtgcgtgtggccgccctgtctccttaatgtccttctgtctgtgatatttacatagtcacaaagtatctcccccaagatacacgtcacaaagggaaaaataaaactgtagcctctcggtggaaaaacccagcagatactgtgtgaagcaagtgatcggggtaacaccatcagtcataagacgttgacaccaaggacccagtgagacacatcacttctctggcagtgttgccagaaatgcagtctcatcatgagaaaatgctgcacccaaactgagggatgctcaccacagtcctggccagtgcgtctcaagtgtccaggtcttgaaagacagggaggctcagaatttcctgcaggcaggtggccaggtgatgtgtgtgcaccctggtccacacggaaggccttcccacaaccttgagggaggtgagggagtaggggtttgggggctccaggcacaggtgctgggcagtgggcctcagtggtcttgcagctcccccgtcaggattgttagcctttgggttcctcgtctgcagtgatactgtacaaatcccaaaaactccagttacacgattaagtgattgacatgacatggagtcgcaaggctgacttgaaaatgactgtaactcacagcaccagtttagccactgcaatctagagaaactaaacatttcctcattttgaaggaaagacttcttggggaaagtcaatttgagggtttgaatgagaatgagatgaaagctttagaaggtcctccctgtgcctgaggtagataaacatctgtattttctcttcacacgggtgacggtggtgaaagcatgacatcatctgacttggtcagcagaagtgctctgaaccatccggaactttgggggcctgggggccgtggggaggagtttcaggaagttgaaaacagtattgggtggaatcacacacttgcaatttgctctgaaaaagctacacttgttttgttctcagctgcacctggggcccttcagcccctgcaggagaagaatggggcgagtgattggtacgtggccttcccagcctgcagagccgcctgctttggttgtaatcataggcaagctcagcctgctttggttgtagtcgtagacaagctcaggtttccgcctctgcacgtcccggtgggctcgcctgggactccctttgtctgttgtacaagactccactctggccccccctttggaagagacgatgtctccatcctcaggaagtagagaaacactctccgccaccctccatcctgacccccgtgcagaggatgaagtgctgtcccagaagccccctctcaggggtgccgtaagtctcagagagaggagcaccccggggcctccgtggcagaatcctgtgagtgtctttggttaaaatgtgcaggaagtgttaactcctaagctgccagcagatggtgtgccgagatactgtgaagtcacatgaacttgattcctgttggaaagaaccactctgcaatccttcgcgtctacacttcgtcaagaaccgtccaatttgattaaacattctggatcgtcagcgttcacggtggagcagactccacgactcgctgctcccatgggaggtgtctctctggggaaggggtcagtggtggtggaggatggcgcggtgctccattcggaacccacaggtcgccagcttacagcgtgggagctgtggaaggacacatggagcagaggcggctgaggaggtgaaaggctgagaggaggctgcagtgaaacacctgaggaaggctgggcagaatggatcgggggtgtgtattggctgcagtcacctcccctctgctcgtctgtgtccacattctgtcgtggttgagaccggatcctgtgtggaccgggtgggctggtgtggagtcctgtcaggagacctggggcggttttgaggcaagctcacggaggcctgccgcagggccctgcgctgacaaacctttcgctagtgaccagttaccttctgtgtctgagagaaggccgttgtggcctgtagtgattttccttttcccttgagatgaaaagtcatcaaatatctggaagcaaagcttaatctttctgaaagtagaaacgcgtttggatggagccgggagggagaactgggtgcgcgcttggcatttccttgccggtgtgaatgcgcttcccgtaaatatggcagaacgccttcacctttcaccagatgacgcggggggaattgggccacggtccctgctgtcatcatggcatgctgcaagctctgtgggcgctggtggccaggatgcggacaacccctgccgctacgtgtcctcaagtgagctcagctcttgtgtcggtgggagctggcggtgggtccctgagcagagtgctgccgctgccagtctgcgttttctgccgaaatgcgtccctgagattgagaaagttcacaccctaagtgtttttagaaggctgggtgccctgtttcccagccaacagttgtgactgtcagtgggcaaacacagtttgcaataattggcctgttgtcttacaatttctggctctcctctttgtggtgtaggtcatgttaggtggtggtccttggtcgtttgtgccacgttccctcatgttcttgaactctgagtccctagaaactgacattggtcttattttgagtgcattatttttcaaactttgggtctgaacccacatcaattgagtgggccatggccagtgttaagaatactggataaaatggagcatgccttggataaaaggagcatggttcggagtggctaacgggtaggtatcgactcaggaaacttgcagtgatgagtgtatgaacttaccatcgtaggccccagtcgagagcgtggaaaccactcttctgtgatgtgtgtctactagcgggtggttatgcacagcatttgactgaatttgggtaactctggatgtagtgtataaagtactttttaaaaggccatccactgggccaggcatggtggcccaaagctcccagcgctttgggaagcggaaactggaggatcactcgagcccgggaattggaggctgcagggctgcagtgagccatgattgcaccactgcactccagcctgggcggcagagtgagaccctgtctcaagaaaaaacaagcaaaaactattcccgttaagccgcttgcttaggggtgactgtgattgaacatgtggcttctcatccaagttgattttaatctctatggagatcagactaataacctcacagtagaaaatccaccagtgagctcagcggcacaaactcacagcccagcagtgtttgcagaggggaaggcccagaatgcgtggaggcttcgggatccatcctttgcagacatagagaattctcatgggggagggaggaccttgcggcgccttggcagtgaggggagcaacctcagcatgatgttggcacgtacactggggactgggtggtgacaccgtgcatgcccacaggggtggagatctttgtggagttcactgatggatcccagaggcccaggacgggatggcacgcttttctgtgagggtcagagtgtaagtgtttctggccttgtggggcgtgggatgtctcgtgccactgtgaagccgctcgactctgctgttgggctgagaagcaggcaccttgtttgtggacgctgacatttgagttttatgtaattttctcatcatgaaatattgttcttttgttatttttctgttttaaaatgtaaaacccattcctggctcacaggctgcatagaagcaggtggagagctgggctgggttgtgggccctcacgtgccaccccctgacctagagtgtgtttgccctgggaaggaataagacgaggttgtgtagagaggcagtggctggatggggagaggcctgggccctgcacagaggagctgaggtgtgaggctgcttgcgagggaggcggctgaccaggcttggtactagcaggctctccggggaggaggccccctggaggaacagcgctggcgtcagccacagaagggcttagcggccatggtcttcctgctgcagcccgtgtggttttgggagggacacatggagcattggaggacaaagagacggccagatcggagtgtgtgtggcagaggggcgatgccacccttcggagcgatgggtgccagggtactcggtgagagcccaggtcccgggtgagggggtgggctgagggggagtcagagagggaggagcctcgggatgcggaagggcgagagcagggcgatgagggtggggccgcagggaggtggccgggactcctggtagtattcttggggagaaagataacagggaagtgaggagggttcagctgtggaagtgctgggatggctgatccgagtgaccatggcctagacggggtttaaaccctggactgaagaaagtgccggtgagaggtcaaggcaggagatggagacctgggggtgacaggtgtccccggcacctcctacccccaccctgggagacagtcccaaggggcaccttcactgggggctggccctcatgcacaccagccaaacctcctgcccaccttctgggggcttctggagcagagcagaggccccgcggaccgtgaggatggccacagggaggggagatgcgaaacactggccgtggcaggtgcccacgcagtcaggagcttgcttgtggggctcttgtctgacacctgggagatgaatttcagtctgatggtggatctggacccagatggcttgcttgggattcagcagctcttgggaagagccacacttgaggatgggcttgggtgagggtttggaacgtgcttaaagaggttggcaggcaaggatttggtggtagcaggtggggcacatcgtgtattggcagggttttgttatttttatcctaaagacatacttatttgcaaaccttctattttggaacattttgagatgtatacatatgtggcagagatagcatagggagtgcccttgtgcctggtacccagtttctcccgttgctaacaagacgcatgacagcagttcatggcacagtgttgggtgtgccccggccaactcagcagatgagctgtttcacaaaatcagtgattctgctctgataaaatggcaagtccacggaaagcactttcattgtattttgaagttgggtggttgttgagggattatttgagttgtagttgaactagctgctcttttcatggaacactataaaaaaataatttacagattactgacatctcttactaaatgagtgaagttagcctctcacctcaaagaagtcagctaacagtgtttgttgccagtgataaagtttgagctgtcaagtgaagttggagttttggaaagtttgtctttgccaccgtgagcccgagagctcccaataaatcagatgccagtgctaatgctgatgaaccgtatgcttttgatattatagactgaacaacatttgcaagagctgcctaactcggtgaagcaacattttccagatggtcgatgcgggatcacgcctgggtaaaagatccatttagagtacaagtcaagccaatggatcttaaagccataaagtgcagaagctcatggatacagttcacattccatattgcaaacagcctttaaggaaaaataaaacacacttgttgcgtgttggtgtggtgtcaaagaggaatctccataattatctgaagagcctattaagatacttttcccttgtctaactgcatctccttgtaaggctgcattttattttattttttcgtactttttgtagagacagggttttgctgtgttgcccgggttggtctcgaactcctggactcacagaatctgcacccccccgggcctcccaaagtgctgggattacgggcgtgagccacttcccctggtgaggctgcctttttgtcatatgcatcgaccaaaacaacatatcggagcagaccaccggtggaagcagataggaaactctagttgttttcaattaagccgggcattagaaatttgtaaaaatgtaaaacaatattatccctcttctcattaaggttttgttgttctttggaagctatagttatttttcataaaacatgttttgtatgtaccatgaatgtttgtcccctttgaaactcatgttgaaagctggtccccagtgtcacagtattaagaggtgattggatcatgagggctcagccctcaggaatgcgttcagtgcatttatagactaatgggctctcctcgtggtgggttagtgatcatgacagggcgtctgttataaaagccagtttgggtgtctctcatatccccaccagcaggaaggcactcctcagatgggacccctggaccttggacttctcagcctcctgaactataagaaatgcatttcttaggctgggcgcagtggctcattcctgtaatcccagcactttgggaggatgaggtgggtggattacctgagatctggagttcaagaccagcctgccaacatggtgaaacgctgtctctactaaaaatacaaaaaattagcctggtgcagtggcgtgcgcctgtaatcccagctactctggaggctgaggcaggagaatcacttgaacccgggaggtggaggttgcagtgagccgagatcatgccactgcactccagtctgggctacagagcgagacttggtctcaaaaaaaaaaaaaaaaagaaagcacatttttttcctttatgtaataaattaccagtctcagatactcagttatagcaacagaaaacggagtaagacagcgttaatatgtaatgtgttaatttgtatgatttttacatgaattaaaaaatattcaaacattttttgttctaatttcaaatatggtaaatatcgataggtagaatctgtacaggtgcaagctcttcaggaccctcagtagctttagaatggtgaagaggaccctgaggccagaaagtcagaattactgccttagagcctagacgcttcttaagatgtgtccctggaaattatgcatgctcaggtgaaattatgcatgctaatatattcaggtttggaatttgaccacttacttacaaatttgaatttttcctccctttcccccgcaagcacacatttggggggccatcttaaagaaaaagcagtgttgcctgaatgaccccaagagtaagtgggagccgtcgggagaagtgttcttgcttctttctgatttcccgcctatctagcatccgatcagtcatttatagttttctttccagttatttcccatctcattcttgtacgttccacttcagactgatttcgggcaaaagaagtaggctgagacttcttcacatgtctcagtttaataaaagttgacttcttcatgtcagttcatcctgcctttctcattatttcttcctttctagacttacatcccgagaggatttgactaaatggaatgattaatttcttagcagtttcctcgtttcgggagatttagctttttaccaggtaccacttagtctcatctttaagtgggagttcctgtcctaatttttatggctctttggacttgccattccagctcgggtggcctgggagtctccacacagaagccgtctgaggagaagggcgccaggacgatctggggatgggctgggagcttggtggccgtggtcccttcttgtcactttactgtctcaagcgtcttctctccctggtcgcacgcgctgtgagcttattgttctgggcgttccccaccctcagttcccaagtgcagtgcaggccaggccctgtgctaactttttacagcagggaatatactcagttcatatttttgccatctgtaaagtgaggtaggccccttcaagacatgtaaggagtatctatggctgtggaatgcatctttttagactggccgctctgcatggatctgatcacgggtaggtgctgtgattcacaccacgtcagagccccgctctgggaggtgacacatctgggctatattgttccacttcctgtggaaatgactgcgtccaaatcagatgcagccttaggacttttcttaagggttgatggaagaaacagctctatgaagaatgtctgccctaaaaatactgacgggaaaaaacccgttacgttgtgacacccctaatgatgcatgtgatgtggcttaggtagcgacagagaagatcctggtgttgaaggaagccctagtgttaaatacaggaagcctggcttgacttttcttgctgctgtttttcatgtgatgctgataatctatagcagtttgttttttaactttgactgttaaagccaagttttctgcccagttacagtgggtttccttttagtcctcttttaatggctttgtggttttgttttatgggtgtccaatatttttgaaatagtaatagcaaaattaaatacttttgcagctgtccgtttctcctgatgaccagctaccgttagcctttgctgacagtggatgggcactgttcatcagatgtgtcaatcaccctgattccacattcatgaactgagtagttagattagtaacttaattatagcacagtccttattgaaatcaggacatgggcacaacacactttgaaaaccttaatccatggtttttaaatagcatttctgacattcatcattgtgcattggggaatgacgtcagtggtgtgttctcactggactcatcacagacgtattcactggatgcggtgcgggccaggcccggtgccctgctgagaacacagccatgccaattcctgcccttgtgaagctcaccttctagcaggagacactaagcaagagaaacctttcagatgtgtagtaagtcagacagtagagcaggaaaggctgctgtgcacgtcaccgttgccgaggcgtccaggaggcgtgcaggaggcgtgcaggggtggccagctccgtggtaggaccctgagctgagtgtatccctgagaagcatggggaggcccaaatgcaggggccgagtgagcgtggcggggaggagagccccaggggctgcagagggcccgtgagatgggaagccctcggagggcttagagcagatgaggggcatagcctggcacgtgtttttatgtgacgccttgagcgctctttatcgtgatcacagcagaggtgcaggtgacagtgagacggccgtatgtgagcaggtctgaggggcggcctgggtccaggttgggagtgacaggctgggaagacgaggccggatcagggtgaaggagaggagaacccaggaggcctgaggttttggcctgagcatctgggaagtaggtgttgccttaaattgaggtggaaagtgtggaagaagcaggttggtttggggtgggtgacaggggctcagtttggacatgttagaattgagacgaccccttaggggagacacctagtaggtggtgtggtgtgaggcctggagttcatgtgcgaggtctgagctggcagggtgataggcgccattggcgtggagatgtatctgaagccacagactgatgagccgctgggtcagtgctggctgagcaaaggttccagggccgtgccctgggcatgcatcctcaagtcaggaagtggatgtgggaccagcagagagacagaggagtgggggccaggcagggaggacagcgtggggaggagccggaatgagccccatcaggccctgtggtggggagaatgggggcagcatctgggctggagcagttttgggggagtaactgagtgacagcccgatgggtgggatctggaggggatgtgagcactgaaaatggagaccgcaagtacaggcggggcttctgaggaattttatctgaaagggaacagagaaatggggctggggctggaggggcaggagggagggcagcaccgtgggggaagggtgtgcaagggtgatgctgagggaccagggaggggtgctgactgggtgtggggcacatgcccgaggaggcaggagtgggcattcttgggaagtgagagggaggagagcaggatcacccactaagcccgaggcgcagagggtccaggagtaggggagcgttcgcatggctgggcggggctgggcggggctgggcggggcttgcagcatcaggcgcacctgaggttgattggatgtggattctctccccatccctgcccgaatgtgtgggtccccatgccttggtggctgagaagtggatttaaggccaggttaaagatggttctgtaaagtttatcaagatttgatgtagttggccttgcctgtagacacatcacttggttgtagaaacagtttcacaggtaataaataagtaaggcctacggaataaggcctatggaaagctcagcagtccaggagggcggagtggacaggagagtggggctcgtgcagttggagcgtccctgctctgggtagcctgaggtttgctatttgtcatccccaactgtcttggatgtgttggcacacctggacagatgaccacacgtggacaccatgtttaggaagcagaattgggatcatatcatccgcaccgctgtgcagctttccatttgtatgccttccttttgctatcatattctggagatctttccattttggttcatgtaattaaatcagtctcatccatgtgaatgacttggtggtgtctggcaatctggatgggcgtggattcttcaccactcctgttctgctgtacattcagggtgttactctgggctgtaggccctgctttcccatatgcgccctgagccctgcatctcttggtggacttggtagggttctgaatagtcgtcagagtaagaggcttgcttgagcattagtctcagtccagctgttttattgtattaagactggactatccccaggacttctgagaaatggcaaatttaatttgccaaaatagcaaccacaggcattgctgtgttccagttttcttgggcttgttgccctagttttttctattgaaatctttactgttagcagaattttaaatgactcttgatcctggcaacagaggcattttgagtaaacaactcgaataatgtgtggtgtcctcatttggaagaggttaggattcaggattttatggtgagttcagagcattttctgaagccacttgcagagcttttagaaactagcaaaaagcttgaattgggcatttaaaactatttccactggccccttaagagaggcaggagtttaacctggactctctggacccggggctgtttgtggaagggcctcggcatgtccttgggtttagtctggctgcacgtggtgggctccagaataccctgttttgaaccaggtagttgtttattttcctttgctttgaggaagtctgaggcaggcagcctgggctggtgtggcagctccctggacgggaggggcctgggctccttccttccagggctttgctcctccgcgccagctccttctgcctccttccacgcctggcaccagcgggaggaggagcacggaagaagggacaaggccagaggccagggcccctgaaggaggtttcccagggggctgctgtgggacaggctgggaagggaagtccgtgtctgatgccccgcacccacagctgtcgtgggctcttccgtgagctctggggagagcaggtactggcaccggcagctaggactctctgggattaggggagcctcagaaactttgcaaagttttgtctgtctgtactttttcctggaaaaggttcttttttttttttttttttttttttttgtatttttagtagagacggggtttcaccctgttagccaggccgctctccaactctgacctcaggtgatccacccaccttctcctcccgaagtgctgggattacaaatgtgagccaccacactcggccgtcaataataatttaattgtacattttattttattttattgttttttggtttttgatttgtttttttgagacggatctcgctctgtcactgaggctggagtgtagtggcactatctcagctcaccgcaaactctgcctcctgggtgcaagtgattctactgccttggcctcccaagtagctgggattacaggcatgccccaccacacccagttaatttttttttttttttttgagatggagtctcactctgtcgcccaggctggagtgcagtggcgcagtcttggctcattgcagcctccgcctcctgggttcaagtgattctgctgcctcagcctcccgagtagctgggaatacagggcgtgtgccaccacgccctgctaatttttgtatttttagtagagacggcgtttcaccatgttggttaggctggtctcgaactctcgacctcatgatctgcccgccttggccccccaaagtgctgggattacaggtgtgagccaccgtgcctggcctttttttggtatttttagtaagacaggttcaccgtgttggtcaggctggtctcgaactcccgacctcaggtgatccacccgccttggcctcccaaagtgctgggattacaggcgtgagccaccacgcctggccagaaaaggttctacaggtttttttgcctttttttttttaaaggttctgaaagcaatctgtgaccccaaaacgttttaaatgcaccaatgccaaggttggctgggtggcttttgactgaagactactggtttcattaggaaatttagttggctgggtgcagtggctcacccctataatcccagcactttgggagaccgaggtgggtggatcacctgaggccgggagttcgagaccagcctgacccaacatggtgaaaccccatctctactaaaaatacaaaattagccgggcatggtggtgtgcacctgtagtcttagctactcaggagactgaggcaggaggatcacttgaacccaggaggcagaggttgcggtgagctgagatcgtgccattgcactccagcctgggcaacaagagtgaaactctgtctcaaaaaaaaaaaaaataagtttagtttatccctttaataatctttgcttctggttcttactctggaaaaaagaaggctgtattgatgacatgtagctttgatcttcaagctgactactgacgactctgagctgaaagatcctcttcagaggacgcaggtttagtgtcaccacataagtttcatgctagttgcgcctgacagggcccctcagtcaggctatgtggtttctgcttccctggagcagctccgaaggctgagcaagatcccagtgttgatcctagcaccagtgtttgaagaacatgagcgtgcgtaggtggagttggaatggaccctccccccacagcttagatctgcatattttcctgtccgatcattttttaaaagtatacttctttttctttttgaaaaagtgataaatgcacaggataaaaatggaaatattattagaggatgaaaagtgaaaaataatttccttttcacccatgccccaggctgttgtaggtcttctgtatcttaacctggaaatattctgtgcatatctgacatacttcttaaaaataaagcatgtcgtctgcactgccctcgtccacactgccctgcccagttgatattcacgggatcctgcaccttgggagccgcttttcgggggctcttgttgactcctgaagctgcgtggtatattccattcttagctatgcaatgctgacatccattcttttgctgctaaaaacaatgccttacgttgttttgttgttgttgttgttgttgttgttgtttgtatgtaggtctttgcacacatatgtgaatgtctgtgctggctgaatgttgtgtggggcatggccaggttaagggctgtggccatttagcattttgatagctattgcccttcaaagaggttgtacccatttacacccccagcaaaagcgcaacagccatgttttctgatatcttctggcgaagtgtgtcatattttgtgatttttgccaatctgattggtgaaaaatgttgtcttgtttaaattgttttaaaaagattacacatcgagattgacttttttttttttttttgagacagagtctccccctgtcacccagtgtggagtgcaatggcgtgatctcagctcactgcaacctctgcctccccatttcaagcgattctcctgcctcagcctcctcagtagctgggattacaggcacgcgccgccatccccgtctaattttttgtatctttagtagagacgggctttcaccatgttggctaggctggtctcgaacacctgacctcttgatccacccaccttagcctcccaaagtgctggattacaggcatgagccaccacgcctggcctgactatctttacataacttgtttttctgtgaattcattttcatttccttatgctcatttttgattaggttgattggtcttttttttttttttttttgacagagtcttgctctgtcactcaggctggagtgcagtggcacggtctcagttcactgcaacctccgcctcccgggtttaagcgattctcctttctcagcctccttagtagctgggattacaggcatgtgccaccataccctgctaattttcgtatttttagtagagatggggttttgccacattggccaggctgacaggtgatccacccgccttggccttccaaagtgctgggatgacagatgtgagtttcctagtcttgattttgattttcctatttgcatttctgtggtatagtttagcatgttcttctggcctctgtatatcctgtcacttaggaaatgttaggattctagaagcttaattagattcagcatttttgtttgttcggtaggggagcctcccacatagatggtgctgaattcttcattaatgaggcagatagtgtgtgtttttctttttctgatggtaactctgttacctagattcttaattcatcagggattgcaaaacgatgactgttcttttgttagaatgcttttatacagagaaacattctattgcttatgatgtggtttttcagtgacgtgatttgtatagaaaggcagaataaatgcttgattttttctttttattaccattaaacaaattaaaggcttaataatattattaactcatgaatttaaaaatatttccctttcaacccagtgaagttgttaccgttgttgatagtctgcttttcttgttcacaagggcatcagggatgacagaattgcacacaaggcaaggcgtcctcagacagaactctaccggccgggcgcggtggctcggcctgtcatcccagcactttgggaggctgaggtgggcgaatcacctgaggtcgggagtttgagaccagcctggccacagagggaaaccccgtctctactaaaatacaaaaagtagccaggtgtgctggtgggcacctataatcacagctactcgggaggctgaggctggagaatcgcttgaacccaggaggcggaggtttcagtgagccgagatcctgccactgcactctggcctgggcaacagagtgagactgcatctcaaaaaaaaaaaaaagaactctaccacttcttaccgccactgaatgaacattgtaacatttgtttttgttagtttttgaaaattgctcagaaagaactctaccactccttatagccattgaacattgtgaacattgtaacattggtttttgtttttgaaagttgttacatttgttttttatatgtactcccaattcctcccagtttcaagcagttacattgtgtctgcgtttagcacatagccttcatctcctctgtctcagtcctgcgtggagatagggtgctccgctagccgctcttcccaatgcctctccagtggtttggttttccgaagcttgtttgttgccagtgccttcaggagggaatttttgggaatactgttctctgaggactggatgctgcctttatacttgaaagtaattttgtctggatataaaattcttggctcacatatctttccttgtgtgtcttaaatacgttaatccttttttttttctgttggagtttgatagttaattttctttccgttataagtcacctagtcttttgcttggatggctaaaaaatttttctttaaatagtgtttttattgggctgtatcttggtgttctgtcttggtgttgtatcttggtgttgtgtcttggtgttggtggttttgtttttgtttttttccccctaggttgtagtgtattattttaacgagtagtttcaagcaccctccgtcctgttttctggagagctttcttgaattacagtttttggtattccatttcattgctttagttttccttttttcgagacagggtctcgttctgttgtccagggtggagtgtagtggtgcgatcacagcttgccacagccttgccctcccagactcaagtgattttcccacctcagcctcctgagtagcagggaccacaggcaggtgccactgtacccagttaatttaaaaaatattttatggagtcggggtctcggtacatgcccaggctgctcttgagctatcaacctcaaatggtcctcctgccttagcctcccaaagtattgggattacaggcatgagccactgtgcctggccagttttcatctttagcatctcctattatacatatgttgggtcttcttttcctgtcttatgtgctactttttcttgagcttttttcatctctttcatttcttttttattcttgaaaattttgtcattttatttttcttaaggcaccattgtgtttatttgttctaaggttcttctagtttaatcttcatttctgaagttactttttcttttgtttctaatatattctgagttctagcaccttgtttctgagtttttctaatgctggtttctggttaatgtgtgttatgtgtttaatgtatttcagtttgttttgaattatcagggtatagttttttttttctttttagttttcgtctttttgggggatatatgtttctagaatgttttcattgtctgcagtgatgttattttgcttcttattcttttaagaaatacatgatttttgcatgatatttggcctcagtagtttctgttgctcatttttatatgatttttgcttttctgaatgctcagaagggaggcttggtttagaatcgtttctctaatttcagtgttttgggttctttcctgtgttgtttataggaagttttaaaaatacagcagcttcttttctcagctctctaggctctgttctcccctcccacctttaatgagctttcatgttcctttgtctctagtttccgtgccctgcacattttgtgttcagttccaagccgtttcttttcaatgtatttggcctaaaagggagctttggataatgcgttttgagagggcttggggtccagaacactctggcctctgggtcagccctgcaggcccctgtgtggttctcctggtggatcctgcagctgctgctctcggcctggctcctgcttccctttgcttcctccatcctatgcccgtgtgccatgctgaccttgtggcttccagtgtccccatctgcttgtgtttggggttcttgaggaatatgctgtcacctcgttctgttgtcggtgttgacttggattttggttttgctatccttggaggtctgtgtgtctgtatgggaggatttagggagattaaacatctgtctcattccgtctttcccagctggactttttagaggttcagcgctggtgcctctgaggctttgtgtctccccctccagttatttgtcatcagctcttttttttttgttagggacagttgattgatgtttcctcagttcatctaatcttgtgtaaagttataatgtgggaataaaaacacctttgctattttattgatcgtatatttgatcacacatttatgaaaaatattgcctttactctataaaggaagatttaagacagcacttggctccttcttccacaaattgttatccccaagaaattctagagctgaggccgggcgcggtggctcacgcctgtaatcccagcaccttgggaggccgaggcatgcggatcacctgaggtcgggagttcaagaccaacccgaccaacgtggagaaaccccgtcttactaaaaatagaaaattagctgggtgtggtggcgcatgcctgtaatcccagctactcaggaagctgaggcaggaaaattgcttgaacccaggaggtggaggtaagccgagattgcgccattgcattccagcctgggcaacaggagcaaaactccatcacaaaaaaaaaaaaaaaaaaaaagaaaaaagaaaaaaattctagagttgccatttaagctgtaaaatttaaatctagacaaaggagaggaggaactgcattatttattggattgaaggacacgggtgaggcctgcttatgtaatttcattcctgttgggacttatccatgaatagaagttgtgaatagactcaagagttgaaaccatgtgacctgaaaaccttacttttccttctgcgatgggggttgtggttagggacagtgaacggactcttcctgatgaagggctgtgctgtacagagctgggcacagggtttctgtcctcaggaagtgtgtagtgtagttcagggaagacagtttactttataccatttatgtgtcaataattaaaatataaagtataatctgataaaaacatgatggtcacattcattcctcatttctacggcatcctattttgcagtactatatttggatctgtgtgtccatagaccatagtttgaatgatgcagccttatttttactttggaaaataagttctcttgaagcccaatcagagtgtcacaggagctggaggaaagcccctgactgtgtttcagacactgtgcgaggctcggggacagccccgccctggacagcacagttgtggacaggacagatggttcctccttggtcatggtggcaggatgctgctcgggctcaggacagaacctgagagcagaaagaaagcagaacagaggtgctgccactccgccgggcctgtggggtagcagaaacggagtatgggttgtagtctagatggatgcgtgcagctgggagaaacttgggaggagaggtggcgtatcaccacggagaccagtggtatgggtgggaagggatgcttctttctggggtgtggtgagtgtagcagggctgaggccccttgggagcaggaagcgacagagcgtttgctgtagtcagtcaggccccactggagacttgggctgagggagaggacgtttccaagccagtgttgggaaggtggctttggaagggcatgaggaacacagtggaaacggagaggccccgggtggctcgtccagtggttaaggaaagaggcagcgggtggcgttttcaactatttgttaattttcaaagaaactaaccttttgggggtttgaggcaagaagaaccctgcatgtaaaactccacagacgttcgcggcctcttgcatacacgtgctcggctcgtggttttcataatttcacgtgtagcgatggttaatgtcctctcctcctcctttgcttctgtttggtaggtgaccaaaagccagccccactgtgagttgaactctttcgtgttgaccggccactctccgtgctctggatgatgtcggaacacgacctggccgatgtggttcagattgcagtggaagacctgagccctgaccacccaggtacagagctgtgggacagtaggtgaaatattattctctttattcttcaaaaaccaaaagctgctccagttattttctttcctttaagcagaagaaaaagtaatgcatgctgcgtatgaaaagtttgaatcctagagatgtgaacactgtcggcccctcccttccctcgcccctgcagcctcagccccacgtcccttctggagggggcccctgtgacactttgtctcgagggccatccctgctcccactccttgggggtatgcgtgtgttctacactctctcccctgccgcgtccctgtgtgcggcgtcgtggatctttaccatgttgtatgtgtaatcccctgtgtgcggcgtcatggaaccttaccatgttgtgtgtgtaatcccatgtgcggcgtcatggaaccttaccatgttgtgtgtgtaatcccctgtgtgcggcgtccaggatccttaccatgttgtgtgtgtaatcccctgtgtgtggcgtcatggaaccttaccatgtggtgtgtgtaatcccctgtgcgtggcgtcatggaaccttcccatgttgtgtgtgtaatcccctgtgcgtggtgtcatggaaccttaccatgttgtgtgtgtaatcccctgtgtgcggcgtcatggaaccttatcatgttgtgtgtgtaatcccctgtgtgtggcgtcatggaaccttaccatgtggtgtgtgtaatcccctgtgtgtggtgtcatggaaccttaccatgtggtgtgtgtaatcccctgtgtgtggtgtcatggaaccttaccatgtggtgtgtgtaatcccctgtgtgtggtgtcatggaaccttaccatgttgtgtgtgtaagtctgctctgttagcagctctgcaggattcattcacaggtgccccctccacagttgactcttctctttcagagggctcctggcatagtctgtctgatttttcctttatacacaaccctatagagaagatccttgcatatatatcttggcaaatagataagttcctagaagtagaattgctacatgtgtttaaatttttttaagacggtgacaggttttctagaaatgttttactaattcttccacggacagtgcttgagaacaagttttttctacacctttgctaaggctggtatcttttaaaaatggtgttaaaggcacatgtctactttgaaatcataactgtttgtttgtttaaaggagacccttgagaaatgaaaccctaaatttcaggaacttcatctcttcatctgtgataacactttgtccacacttattgttttaaaaagtttttttttttttttggccataaagtagtatatgttttattgttctgttaagtttgaagtgaccagcccaccacagttaagtcactgagtgtttcagttgcctggttattctttcaggaatgtttgaattgaaatgctcacaatttattcccccagaagagagaattttcagaaatctcctaagaaagtctgatgtccgttcatatgatctgtttgctttgttagtcgagaaaactacctttggagactagttgtatcatggaaggggagggcagtagaaatagttttggggtgaggtgagcagtcccaggggaacacgaaggcagcatttcaggagtgctgctggttagttttccacaccatcattgcatattattttacaaatccctgtttctagttcagaaggcaaatgacagtttctttagaaaacataacactgtaatcttgtaaaatgaaagtgttccagttacatcatttttggtgatttcagaaccattaaagttctgacagcctacttccccagtaaatctctctttgtagactgtggtccaaagaaggcttagagaaataattttgaatcttgattttgttccaactctgttccttaaatgcctaagaactgcgatttcttgagtatttgttaaaagcctactgtgtcagccaggcatggtggctcatgcctgtaatcccagcaccttgggaggctgaggcgggcggatcacgatgtcaggagattgagaccatcctggcaaacacggtgaagtctctacttaaaatacaaaaaaatacaaaaaattagccgggcgtggtggcgggcgcctgtagtcccagctgctcaggaggctgaggcaggagaatggcgtgaacccgggaggcggagcttgcagtgagctgagatcgcgccactgcactccaggctgggcgacagagcgagactccgtctcaaaaaaaaaaacaaaacctactgtgcacagagctccgaggcctgccccagtacaaagcctgcagtctctgacccaggagaaggtgtgcgcagctgcaggtaccttgatgtgtcaagcacatttgcattcatagtgggtttaaagtactttccttgtcttgaacgtaggcatctaataaagtttaacaggatagtcaagaaagtagaagaaataaaaatttcccataattctactggttgtagcagcttttaaattgttgacgtgtatgtctttccaatttttccttatttttatttaaaagaaagacttctaggatcatctgacttggcgtgtaccaactatggcttgcgcttactctacctgtctgaatgcaaaaattgtgacttgcatcaggcctgtcactgcagttgattgattgtgatatctttatttatttaagacagaggtttgctctgttgccaggctggagtgcagtggcgtgatctcagctcactgcaacctttgtctcctggattcaagcgattctcctgcctcagcctcccaagtagctgggattacaggtgcccgccaccatgcccggctaatttttgtattttcagtagagacggggtttcaccatgttggccaggctggtctcgaactcctgacctcaggtgatccactcacctcggcctcccaaagtgctgggattataggcgtgagccaccgcatccagcctgattgtgatatctttaaaatgaacaaggagttcttttgtcgaattctaaaagtaatgcatacagaattatagaaaggaacacatacaaaaagcagcaaagtacaaagaagaaaataaatgtcacttgctgtcccactacctgtggagtcattactggagttactgcacgcctctcttctgctgttatgacgaaactagctctgtgaccccagagaagtcccataaccttcctggacttgttttcttctcagcaaactaaaaggttagagtaatgagtacgagggtctctctctgttcttccaggccttgtgtgatgaccggtttccagtgagagtagagcctttgactgaggtcctgagaacctttgactaaccacaggcacttgtaggcatggagttttaaaagtttcatta

SEQ ID NO: 42 - DNA, 187397 bp, Homo sapiens
ggagccctatttgtgccacatctaatgctggaaattatgtgtattctaccccttctcaccatccttcctggtttccaactgccctgttccataccagcctgacccacatgcatgttggagcttgaagctcagtggatacagaagtgtcttgggacagttgtctcagcattgctggccgtggtgataataagcagatgtgactgtgatggtgatcccgacagtgtcagagctctccctagacagtcttcatccatgcatccattgttcattccttcagtagccatgcgtctggcactggccagggctgagcagacagtgctgggagtggtctgcagaaggggcagggcgggggttcatgtggtaaggattaagctagaaaactggaaaggcctttaaagaggggtaagagtttatgactcagggccagtgtgacaacagaaatcttctgattgttgggaccccttcttaatgtggacattgtttaatgcctttaccctttttcacagttggtcagaagtcttgactctcaccagcctggtctgcttcctctgaatgtgcctgaagtcatcagtattccttggatatttagtctgagggctgtccataaagtggagagctcttgagaacacccatgtttgatagccacataaccttgggaaagctcattaactttcttattaaccagtttcttcatcttcaaagtggagctagcactaacacttgcatagctttgactacagctgatgtcaggaggcaggggttattgggaggattcagtgtggcagtgtccatgaagcccttagcacagtgcctgcacctgaagggattcaacagaggctgccgctactctgttctcccaggcccagctctcgctactgtggcgtggctaagtgacaatgggcagtgtgggctgtgggccttttttctttttgtctctacctgaaatccagatgagagtctgagagagtggacagagtctcaggatggcagcttgaggggcctgttctccttagcctgcttgtcttcaacgtgcaccaattttaggcttgattcacactgaaaattcctcagctgccggctgctgggccagaagcaggcctttgtctcagagagacccagagaccatgatgaaggctgagcatacctgccctcctgctggcctctcagactgcagcagagcctctactgagcccgactctgagagggaacagctgggctctccacagggtctgccacccctacagccaagtatgtgctttggctttggcatccagaacacactgccccacccaaacatccctagagaggggatcgatgtggaagcccacaaagtgatctttgtggactctttttttgggggcatgacccgctatcatggttattaatgaggaacttccatatgcttgagaaggcctggagtgggaagcctgggagccgcggcggggctatttaaatccaccacacagagagtggcatcctttctgggccacgtctaccaccagaaaaggaagactggctgggctgggttttgctgtgtctctctgtgaatgtatttctctggcaagacatgctgtcacctggaattctcccctactcttgttcaaaggcccaacaaaggggtggcgcagagggaaccagaaggatgtggctcacgtccatgtagtcagagatgtttggggacctgacccaatgcagacatagccatctttgtccagcaaaagttggcgtggcaactgaccactgccgtttcatttgaggagacatgagttaccctggagaggaatgtgcattcagacttgcttttggcagactttaccataagcagtcctctcagaggacatgagaaatcatgatttccctgaggagcccccatttggggtgatctgtaccttttgccttgaactctcctaggcagggagctgagaagggcgtcttttgtctgtttcagaacactcacctaaaatggtccaccatctggggcaacgcttaggaggctctgtggcaaatctcaaaggcacgtgtgccaagcagcctgcactggagaatgagggattctgtccatgcccctttgtctcttcaggttgctggtggtgtattggtgtccttctctgcccaatcacatggcaaggagaagaaaaacaagtcttcatttaaaaagaacaggaagggaaaaatcaagagcctatgaaaagcattttccaggctggctaggtctgtaatgtagaagagacacaagggagtgaaattcctcatgttttggggttaggtggagtcgggggaggagtggacagtcctttgggatcagctgatccccgaaatgcccaaaagagaaaatgacctccagtatggcttgcttggctcagccgctgcaaaatgggatgggggcagctgctgtcctatggtggtgtaaccctcagagccctcagaacctgttcagtaaccaggcaccccctttcagatcagcaagtctgtgtgaccgtccgatgccctgctgccatctttccaaacaaacgtccaagggctatgcagcttcaatgccgtcaagactcctgactgctaagaacagaaacctgccctagagtgactgaaacgtgttgtctcatgtcactgactagcctaggggtacactagcttcaggcatggctggatccacatgtgtgtgatactaactgacaggtgtggatcaggaactcactcagccctgggacttaggctagaagtggggagaatcctcaaagtgtgagaaaggatggttcccccaaggaaagttgagctcctatctctcaaggaagggaggagttgcacaggcagccagcagatgtccactacagccctcatttgccatttgcagagctcaggctccctcaggtatattctgcagtgagtcaccaccgcgccccacagcaagtcgcaagggagccaggaggaacccagataggagccctcccacaggctgtcagagccccacctggtctgtttggatgacagagccttttggacttgcctggtgtcagaaaggacaatgtcttaggtaacctgggtttgtaaaagccttgtctgtgagctgtcagccaaagacagcagcttttgtggtcttttctctttcctgtggttcatgagaacacatctaggcgctaatgagcaggaacataaataatgaacaaacataccgtcaacaggaaggcaggaagtttttttttttccccaaagactgaacaagatgagcaaagctctgcagccgtacttgcgcattctccacaaaatataattaaaaagctatgcagactgctcccaatgtacagtattgtttatatactaaacataatgtactaataggaatacctcacttcattatgtcagcagaatacgaaagggagatctagcagctgcccttatcaggcagatgggagaccagaaatgttacttagatctaggcagtaaaattgacattgaaccaatttgcctcactcgtgccgcttttactgtgtttaacaaaagctcatgtctgcacataaggcattgtgaggaggactcagcagccataaagctctctgtcatgtctctgcaacataaccagtgaatttaaccgttgggtttcaaagaacagttttggattttcctggaaataagcctacagaggacagcataaggcagctgtgtgtcctgacccttagaaacctgtgagaaccaagacatcagggttgaaggaggggaacccatgccagtgaatgagggagcgagtctagttacaatcacaaggaaagggccacagactccgggcccaagggggaagactattcagtccgcaaggtggagatgggattggcagccagggctatgagtgggggatggtggagagagatatgtccatctggggccactgtttacaggctacccaccttcacagaaaggagttatatgtggagccctcattttagagccagaggtcccaagcaatcacctgtttcattcagccattcatccagcattgattgatcattcgccatgtaccaagctctgccctgggcactacagtctgtgaactcagtcctcatggagctcacgtcgatatgtggggaaacagatggtatacaaataaaaatatacataccaggtggtgatacatgtgatgaaggaaaataaggaagaataaaggcacagaataatgtagggaaggggccgtagtcagactggtctgaggaggtgacatccgagcagagccctgaatgcaatgaggtatgcaggtctctatttcagagctcctcaatcttttgtccaacaagaacccctttgattatttgccccccatgagtcactatgttttgtgagctggtgtatcccagaaaggatgcatttggcaaagatgtagacgtagacatagacatagatatgaccgtgacccttggtcaacctgagaaacggggcaaccacaggaagttgatgcaacccagccccaaagccaacacctgacctgtccaagaggctgggcaatatacatagaaaatgagtccagagtcccagtggcttgtccaagcttatgccagctggtcagcagcagagctaagacttagaccccgggtctcctgagtgatgaaattggggtggaagctgccacagtcagtggcagtatttcccaaacacacaggcatgaaaaaggcagtggctggaatctgagggtgggtcaggaggcctgaggtcttcccaagaggaggccgacagagctgccttgaaggacttcctccaccaccaagggggagccccaggccagggccgatgatgcaggcctgagaaggattcttctgccctcatcacctggggttgcagtgttgatggccaatctgcataagaatctgagtcttatatctccaaagttcaagtcacgatatctgtaatctagggccaggggccccagaccagcaatgctacccagaaggcgagaaggaacagagctctagcaggcagttctctgagcattacgctgccgctgccgtggactgacagctggcctgtgcagcccccacctccacccaccccagcactgtgagctgagggaaagggcagggttcatgttgtttttcagataatgacagcagaggctctgcactggaatcacaagtcctggccttgcccctggctctgtctggtgacaattggcagctgacatctttgcttctggccagagctaccccttattaaaaatggcatctttataatagatttctgcaagtcattgtcaacaggacatccttcttgttttgtaccaatcattcctctgggggactgattttgcctgttactattattttagaactctttagaatacccttttattctatattattctgatattagaatatcaagttttaatatagtattaaaaatatagtattaaatatagtattttaatatagtattattactaattaatatatttttatcgtatagtatatagtattaatatagtatatagtatagtatactaattatatagtattaattaataattaataattactaaagtggtcataattattttttaaataaatgttcgcataccatacagcttcaccccacaattaaacagctggatttttagctgagtcttctcttctttccaaatagccaagggatccatttgtgcccaagttattcatcctcactttgtaaggcctaggtgtcacccagcctctatcttgtcccatctaggttttgtggttttctgcctcccttgggagaagcaccctcgtggtcagacaagccccccagcccgagcagctgaatctgaagctggaaagagctctcattcgtgagcagcccaaatgtccaccgtgaggggtttggttgaatagctcatggcccattcagatgatgagactaagcagctaatagaaccccagggtcacatggagccacatcaatgacttcttcctgaagtcatctctggccatgctggatggagcctggtgcccctcttatgcatgtccacagctcctgggctagacagcagctccagaaggcaggcctggccatgcaggtcgggctcactgccctgtatccagtgcctggaatgaagaaagcacttcataaacagctgttaaaatgaatatacagttcagtgtagaaaacaacatgtacagtgggattccattttagggaaaataatactcgtgcggactcccaggtaaaaggactgaaatataccccaacatgtggacggtggttccctccagctggtgggttgatggctgaaatttttttcttcttttttgcttagctgtgtgggctataatctataagtgttccaagaacaggcctttcagtcagggctggagaagtcagggaaagaggagggaaagctgccatttaaaagtgatccacaattagagcagaaccactggtgggaggcaagatggtttggggacgaatgtgtttttttttaacaggtgagcatttgttttaatgtgtagctgagaaaaaattttgagtagtacattagccatagtactggtccctgctgctcctctggcctcatcccccactttccctatcactcactaggttcaagccctgctggttcctcatcattagaacactaaaggtgccccggggcctttgctcttgctgctccctctgcctgttgcgttcttcctcaccaatatgcaaggcccacttcttatcactgaggcctcagcttcatgccacctcatggctcttaactctacccttccccactaactactagttttgtgtttattactctgtaatatttgtttacttctttatgctttcccctattgagctgtgagtcctttgaaggcagggcctctgtctgtcctgttcgccagtctcctgggtgctgtgtgaactgcacctggtacatagcagtcagttctgttagatgagaagaggaggatgccgtcagtggggggattgaaggaggccataatctcagggatggctgagctctgccagtcaaggaagcagcctttatgcctggtaaagagcaaagcttctgacttcccatcaggggcctctacactcttggaattctgggaaatcagaaattaagacccagaataattgctttgcaaaacatacacatcttacttctgcccaaccagtggtccctctgagccagtcattcaaaacatggatactgtctggccccccagcaccacattcagttgagtcaaggcactgctgcaccagatggaaggagggcccgtggcttgggaaacaagactagtggtctagccctgctttggcactgaattgcctgagacttttaaataatattagcagctgacatttattgggccctactgagtgccagaccctccccacacattaatactgccagtgaccctgtgaaggacaagatcattgtccccattttacaggggagagacctagactcagggaggttgagaacttgcccacagtccaactgtcagtgaataggagactcagggtgtgccccactcttaacacgtgctcagtatatatatattcatggagggaatgaataaacaaaggaaagagtggtgttctctaggggatttgggctgctgcagttcctagaaagccctcccagtccccagccgccaccgtgtccacatcgtgtgccctctggaccactgcagaccactctgcttagtcctcagtcttgatggtatcccctgagtcaggaagccaggtccctcctgcagatccagcaccactggccacaagaccacattccagggaaaggaaatacaagagcagagttagtgggagctccaacaggtagaagaagagggaggagggtccaggcggggctctctctccccgttcccctggggtgcctgccctctgctgagcccacctccaagtaggtatgctgccagtgcctgccagtgcctctcaaccaggcggtgttggtgacatttcccccattgagtcagcttgctgttcatgccttctccttgagtcaatggaagcctccctcaggagggaacggcagacccgtgccagtgccagctccagggaagcctgctgactggggtctctggcttccggtcccaccggccagcacgtgagctgccttcatgcatttcacacacatttcccgagcactctgtgggacaaggggggctctgggaggtgcgaagggaccacacagcgttgtctccaggcaccggtgctgttctcttgtctggattgtcctaccttgtctgtccagccagcacctgctccgtggtcactgctgtttcctgagaggccggtcccaccctccaccatgcacctgtactgtaggtgctccttcaggtcgtattttccccttattcccattatgatttatagaaccatttgtgacattacttctttcatattgttcttccctattagaatgcaagctccacaagggcagggattgtgtctgtcgcttttatcccagcccatgatatggtggctggcacctagtaggtatgcaaataatatatgaaaaatgaattagggaatcaatgaatagagatgcttacagaatatacccctgccccccacccctacaggaacacctctaaattattgggagctggatcttttaagacagaaggtaaaaacatctttccattttgcatttgattagatgtttttctcacctggtgtcacccatcacctcccctctcccaggggagcatcaagggaggtaagacgcctgtagcacaatggaaaggcctctgggggttttgtccctgctctgccacaaactaaatgtgcctgtaggcacatctcttcctctccatatcacagttttccatctggaaaatgactatttctgtgtgggctctaagcagaaccatttatttggccagtcttcgtggcaaaggaggcagggaaaggaactcttcatgagaagggagtggctttcaggtggcagccagcacatccttcaactggcccttggcagatgccacttttttgttgttaattttcatttcttggcactagccttatcttaccatctagattgagaagctctggaagggagggaccaggcctcataggctttaagtcggaagagaccttccagcaggctgaacccaaatgtgtcactccaggagattcgtattgatcaatgactctaccccttttactcaagtattctctctaggtcaaaatggtccctagtaggttaaacacgaagtgtctgtctcccattggaaatgacttgttgttcttccagataacaagtatacatttttaaacatgaaacaaaacatacaaagaagaaagtttaaaaaaatcactgaatgccaccacccaaaagtgattattaatacatcttgttacacatcctcacataataactccctctccctccttctccctccataccacaccctacctcctgcccccacccacaaacagttttatgaaaacagctgcacaggacacacactgtaaccagcattttcactttaccgtcctgtccagatcctggtctcgtaggttctgtggagcccccaattcctggcatgtggcttcttccctcactgacatctgacagttgtttgattaaaaatgtgtcatatgaggccaggcaggtctgtccctacctccactggggaggcagatggcttcaggggccacgtcccattactgccgagatctccctgacggctggaaaccattggtgctgtgcatgggagtgaagcactgggccctgaccctaacccaggcagccacagcacagctctccgtcagtgttcagaaacatatttcatgacacgttaagacagcctcaaatcaggaaatccaccttctcatcccacaaccactcccaacgtgttcatttggtaaatggtaaatgagcagattctctgctttggtccggagaaaccccctctgccgctcttcttttctccactgtggcttgttaacccttgctgctgttgttgctgctcctcctcctcctcctcctcctgacaagcagtggtcctcccagccttccctccccgtggacccagttcacatcctcttcctcaagaggacagacgcgggacgcctgactgactgcacgttctcccccgtccctcgtaccaagtatggcaacaataataatagctagcactgattgactgccgactgtgctgggcactctacatggattcattcttttgatcctaaccatgaaccagctctgttaccacgcccatctcccaggaacagatgcggaaacaagcacccggtctcagctagagtctggctctagaagcccccgcttcctgtggatcattaaagggattgtgatggaggaggagcggcagtccagtcccagggcaggagccagggcgctgataaagggagcagacgaggggcatttaatctagctggagatgtagtgaaaaaccatgtatcccaacagcctagggcctctgagtttgtgaccctccagaagttgggggggaaactgtatgtgttggtacattgtcacactgtcagaggagtctatgattcagagaaggagaatggctgctgggccagatgagcctccaaggtcccttccagctcccaagcctgtggttctgtgaccatataaggccagcatgcctggggagtctcactgcagctaagtgcagtcctacactgcaagggggaagcagagagcaaagggagcccaagtccaggcctcctgcagggtccctaaggcagcagagagagaaatggaggtgcggggagaaccagggtttctccttggttgcctcttcccagaaagctcagacctgtgcaggcgggcttggttgccaccctctgtctctccccatacccacgtgagatctcctctcagcagcgttgccaggtttccagagtccagctggcggtttctgtccaaagtcaaacactccacagtcagtccttggttgttcagacctcctgttccttatggtgcttctggtttggtggcctggaacacccctgagcgtccctgagttttgggtggacatgaattcagaatctagcttgatctccctttgataccctggctttgcagtcataagaaatctagtaggtccccaccctgacacacacacacacacacacacacacataacacacacagggacacacacgtctgcctcctttagtgagtgctctggagagggacaggtctggtgcatctgtgtactcctgactcatgtagttatgtcccactttatccaagcactgtctggagctcaaccctatgccaggagatatgggaagaaagcagagataggtgagatgtggtgctttaattttaaaaattaaaaattagtaaacaagtcttctgggagatgatctctgattattattgttatcagggtacaaaatatgtaccttttagtcatgtctctgttggttctaagtggcagaagcccaaatcaaattagcttattcaaaattgagagggaattatttggctcatatcactcaaaagtatggggtgggcttcaggcatggttggacccaggggctcaaatgatgtttctgggacttgattctgcactcaatcgctcagctatgtagatgaacagcccacctggggctgctgcaatgtgagatgccactgactgttgctaaggtatctcgtggagcctcgctcctgatttccaaatcctggccttgtcacctccacaactcagacctgggctgtcacatgagactgaactctccagagctgtatctccaactccaacccagaggcctcctttccttgccagaacattgggcagatacaacagggtgagttccaatgcttgttttgtgggtgaaatctctggattctcctggatatagggactcagggcagaaggagaagccctgcctttcagcatttgccatttaccagctgtatgtcgagtaagtggcctaacctatctgagcctcagtttcctcatctgtaaagaggagataatttatctcctagaattgttttgaaggttaaatgaaatgacacatgtaaagcacttagcacagagggtaaaccctcaaacatgagctgcaattattctgcttatcttatactgcaaatgaaagaaattatgtttgcaggattttaactttagaatgaaaatgctattattttttttggttgagacagagtctcgctctgtcgcccaggctggagtgcagtggcgtgatcttggttcactgccacgtcctcctcctgggttgcagtgattctcctgcctcagcctcccaagtagctgggactacaggtgcatgccaccacaccaggctaatttttgtatttttcagtagagacggggtttcaccatgttagccaggctggtctcaaactcctgacctcgtgatctgcctgcctcagcctccgaaagtgctgggattacaggcatgagccactgcgtccggtggaaaatattaatagctaccatttgttttatacttactatatggtaggcactttacatttattcctcccaactcttttgcttatgaggaaaccgaggctcaggagattaaattgtttaccagggacacacagctcatcctgtccaatgcccaacctctaaccactgctctactcggcctttctaaaatggtgtggggaaatagaaaataaagagggtctttattgatacatttaaggatatttgcctcaaatcaatgctagcaagaaaaaaagaagaggaatgtggcatttaaaaaagccagagggatgacttaacatttaaaaattcagtgttcttctgagttttgggagtatgaataatatttcctgttgtcggtgaaaccccgtctctactaaaaatacaaaaaattagccaggcatggtggcgggcgcctgtagtcccagctacttgggaggctgaggcaggagaatggcatgaaccaaggaggcagagcttgcagtgagccgagattgcgccgctgcactccagcctgggcgacagacagagcgagactccatctgaaaaaaaaaaggatatttcttgttgttctgtatggaccaaattttctagtcttaagtatttattacattgtagtagaaggggatataaaattctacccagaaacaggaagcctatttttaacctaatataagccagtttgaacaacttatagggctaatcatgatttgagcaatttcccccaaattgcaacatttctgcaaactgcaaatgaagcttctttatcttgggacaccccaggcaacagattgagacctgccaggcagtattttcagcccatgaattgaagtgtgatagaaagtactgtgagcttggagacctgtatcctgttcttggcccaggctcttacctgctgagagatattggggcaattacttattctctctcagcctcagttttctcttctgtcaaatgggtataataaaatcccaccctttccacctgatcaagtgcatataaagattaatgatatcaataggtgtgaaataggttgaaggaagtcccagagccagccataggtctagagaacattcccaggagagtggtagggtctgctggtcccaaatgaagcatgagaaactcaatgcactggcttctggggaagcatatcatagcatggggaccagcaaatcctgcctgcaccactcaggtcacccaaagggtcccaccctcttaggggaatctaggtaccagttgcctttcttttctgttttttagtatttacgctagagtttacaatgtgtatcttgacttattacactttactttcaaataatattatattaatactacttttttcacatacaagaatctttctacagtatagagtatactttcattttatccctcccatcctttgtgctatggttgaagttttatttctatgtatgttataaacataatacatttttcagcttcttccctctctttgtttcaatttagatagtttttattgccatgttttcaagttcactcatcttctgtatgtctaatctgctgttaatcccatccagtgaaatttttattttagatattatattttcatcagttgatattcccttttgttctttttaatgtcttccatttctttcctcattatgttcataattcccttcaatttcttagaaatatttaaaatagatgttttaaaattcttattaattccatgatctctgtcactgctgggtctgtttctgttgactgcattttatcatagttatgggtcatgcttttctgcttctttgcatattcaggaattatttgtgtgatgctgatactatgaatattatattgttgaatgtctagattttgttgttctcatgtaaagactgttggactttattctccaggtagttaagttacttgtagatcagcttgatttttttttaactttgtttttaagcttcatgagggcaggtctaaagcagcctttactctggagctagctcagccccgttgctatggcatgagccttctggcgtctctgctgagtgccccaggcgttcaacaaggactcttcactctggctgtttggaacttgaatatctcccagccttgaatgagctctgggaagcgttcaactgataagctccctgatgcttgttctttctttagtaattgttccttgaccagctgtggaatcttaccctatccagccacagactccaaggagacccctgtgcactctctgaagcatctgaagtgctctctcttcgcagttttctcccctctggtacgctgcccttccagctacctcagctttcctgaactcactttttctcttcagctcagtgaaatggctgtgttctgcctgggttccctcctgcactgtggtctagtaaacacctaaaggcggacgcccaggccatcaccggactctcctccttggtctcccttctctcagggatcacagtcctgcactgtctattctccagtgtttgaagatgcttgtttcacatattttgtctggttttctagttgtttacagtgggagctagcaaagatccctttgagatctctctggggtggtgcaccagtggcctgtactggttatgtactccctcaagatacttttacaaaactggacttaggaataatgaaagtcgacagaaagttaatagggtcattctgatctgctttttagagaaattcagggtgaagacccgcaaaccagcaccaagtggaatttgcagcaggaatcattattgtacgtcaactgatgactggataaataaaatgtggtacatccatacagtggaatactattcagtaataaaaaggaatgagctactgatacatgctacaacatgaatgaatcttgaaaacattgtgctaagtgaaagaaaccagtcacaaaagaccatacattgtatggttccatttatatgaactgtccagaatagccgaatttatagaaacaaaatgtagatcagtggttgcttagggtaggggcagggcatggacagtaactgctaatggatacaaagttccttttggggagattgaaatgttctaaaattagattgtggtgatgattgaccaaccttgtgaatatactaaaaaccattgaattgtatactttaagtaggtagagtctatatatgaactatatctcaataaaactgttgtttttaaaaaaagaagaagaatctttagccattttctcctgcatgaaagtaatgaaggaattggaaggagccttggtatggtagaaaggaggtctcagttattatattggtgcgtgaacgtgtcacaagtagtgttctatctgggactgaaaatatgaccacagaagagtttacatagttcattgagggaggacaaatgtaggatgttaatcttaaaattcatttgctctttctggattactttagttataagaggattcttgtggttttggcgtgagcccctccttctagctttctctcctgcccggatccttgtcagcagtgagcacatgttgagtggctagcaggcagtgccacgtggcctctgaaagttgtgatgtcccctttatgtcttctttgtccctgttcagatccaccagaacgagggtggtatgtggttaaatcctagccaaggatgaaaaagtaggcaaacccttttattgacttttctgttgtcaaagataaagatggttatttgtttgtcttaagtgaatcattttaccttcattaaaagcggtgagttttctgtgaaagaaaaatgcatcatccatttgcagactttttacagggattttcaacaatatgcctctgggtgtacacctaagttgggaccccgaactttgcttaaaatactcatgactaacatacattgagtgcttaatgtatgcccttcctgttctaagtactttcaagtattatcacacctcattgacggatttttctttcattatgtagggaatgtgaaaagactgcatttcttttttccaagattctgttttccagtaatttaggtagctttttcctttagattttatgacattaatgtagcaactcagtaactcagcatctcggctggacctggcccacagtcagccagtgcgtctcatgcctgtgctctctgtgttgatgaggacaatgctctcatcaggtgtggtgtgtgtggtttttctctaggatcatccatgaagatggcttctccggagaagacgtgaaacagtacaagcctgttgtctacagcaacactatccagtccctggcagccatcgtccgggccatggacactttgggcatcgaatatggtgataaggagagaaaggtaggcccctgagcccataagcacagcaacaagaggttctgtctgtgttaccccactgcctcctctttatagtgctgggctgccttaaatgaacgagaagagactccgctatgtttgaaagatatatggtggcacagtcaccaacctaagccattgcatccacccctctggcaaactcccagcaaactcaccaactttgcaagttgcaggggctacaaaactcccggatttattttgcagatgaggaagagttggtgacagttctaaattggagctgccacaacactgtctaagtacctgtccttgggcaattaacttgtacagaaaaaaatatgtattaaacaaaacaagccttgtctggccaccatctcccctccttagaagaactttccttgccttgttgtggagtgaggatagccatttgaattgactgcctttcctcttttacaccaagggctatgttttctgcctcccctgggtaagtatgaggacctacagggctctccttcctgtagaaagtcagtgtcctagaacagggactgtttgggggtaacatttccagtcttctattaagtggtgaatggaataagtactatataaaagcctctaatttgcaaacatttatattaactgttaagactgaactatatacagctacactggcaaggctaaataaaaggagggagggagagagggagaggagaaaatagcctcagaattctttccagaagcagctctttgtccctgtttgggactgaatctcagtgatcctccctctgggacctggagattggagaagggggcggagggcaggtacagcctccaagcacctgggctctgcatctgagcctctggatggagagcattcatctctgattgctgtgtgatttgattgtctattatacacatgtcctgtctttgctaaaaatcatcttcctcacagaggaaaactgtcctggttgtctctgtgtctgataaatcatccatgatagacagctttaaatgtaaaatttgatatgtaatgcacaaaatcctaattccatggggcagagtcatccagcccaggcattggctcctccaggtactggggaattgggtgactgagggtatgtccgaggccagcctgcggtggagaagctgggcactagcagggggacctgggcccatctgccgctcctcctggaggccaagttgggaagtggattctgcaaaggaagcacttcttcctggaaggccggctttgggtttggtcacggagccagggcctgtggaaagagggaatgggggagtggatgggtccattcactgcaggcttatgatgtgcaaggctttgagctaggtgctgtggatacaggaatgagcacagcagggaatggtgtctggttgcagaaaacacctattcagatcgttagaactaacccagatgagtacagtgcttcattcttcttaataacaatagtaggaataaaaacagctaccatctgttgagcacctactggctgccaggcacatactaagcactttacacataatgactcgttttatttaactcattttattacagcccagagcaaggagtgcctcatcttcaggcatggcacaagccacaggcctctggtctgtctgtctccctttgactaagtggggagcgtgatatctgaatctcagccagatagcagacacagtacaaaaggcacaccccctacacacacacacacacacacacacacacacacacacacacacacacacacacacacacacacacacggtgtgtgagatcttccaggagcaaatgtattcatctcccagccagctcttcctaaaaatctcctatactgattataacccagcaaagtcagtgtggctttggaatacttttctccttccattttggaaaacattcattgttcccatgggatttttttttccattttattatcctgaatggagagatgattgcttgggaatcgctaggactatgatacgttaaggactgtactgcaggcccctgggaaacagggtcccttctctggctatttctcctccatggaatttcccagtcaagtcagccttcaagtaggaaggaggggaaggctccaatggaaggagagactgagagctaagcgggactccctggagagtccactggacacagtcgagtccaagcacagttccgttatggcaggtggcaccatggccagcacctggcccatccctagggcaacacagccttgtctggtgtgagcttcctggtgggcaaaggcctccctggcactcaggcacccccttcctgtattcttacacctgtgaggagcaggaaaggagtgaacccgagacccaggccacagcaagccagacaactggaaaaggcgttcccgggagtgggctggtgtggattcgcagcctgtggagctgggcagaagagagtggaagccaccacttggcatgaggagacatgccaggccagaaagggctgcagtacctgctggtgtgggggcagctcagagccaacatccttccctttccatgttctcatggagcttcctatctagcagtacaggcagcaaacaagcccacaagtaggtgactgcataatgtcagataatgctaagggctgcaaggaaaacaaaataaggtgatgtgagagcctgatctgggggtaggaggagcagataattcagagtgggaggacgaggggacagaaagttccagacaagcacccaggccctgagggaggaatgagcctggcgcagaggaatataaagctctgttcagctggagctacctgcagccaggcagctcctgatgtccagatgccctgagcccagtgctgggtccccatatttttctgtctctagggtccccagccactctccacctaggggatctgccatttggatgctggggaaaccaccttatgctgcaggagtccagatccgtgttttggtctctgaagaagagacctccttccctctcatgtttttttcacctctgccacccaccaccactcatcaggggatgtctggaggaagacaaccccactcccagcacctgccggggccagccagccttgcactctccacacagaaaagcgcctaagagcttccttgctgtacctcagtgtcagcccctagaacaggtaggtgtccctgagttcccccggcagctgactcaccacctgtcctgtctgtttcccccagaggaaagaggactggctggtttttccttcagcctctctggtgtggagtcacttggggccccgtgactgtgcgtgagcctgaacctgaaagagcctccgtgcagagcaaacagcagggacctccttacatccgtctgtggtttccacaccccaggccccagcctcagactacagacctctcccaggggccccatgtactctcactcctctgggccttcgctggggtgtgctctctgcctctagtgccgtcctcttttcttcccctcttccacgtggaactgccccactcagtaagggcccactatgcttcatcttgtccatgaagcctccttcccttttccttccctgaggaagaaactcagctcagggctttctccatgaagctcttatctcacacactggcatgaagatgaattgtttatgcttctttccatagagcagtgggccctaaagtgtagtcagagtcctttgagcagctcatgaaagccgcgagccttccctccagaacaggggacacagcacacatctaggagattctgcatgcaatttcaagggggcctggcccaccaatggagtccagcctaagaaccccttcatcatttaaggtcttctgatcaaggcgtatgtcgtttatctttgggtcacctcctcactccagcagccaacacagtgctcagcacttagtaggacttcaagacccatcccattaatggaatgacatttctaactttcccagttttcagagaaaaaaaggcaaagtgcctgtaactttgtcactacatcaacagctgttgattgagtacctaccatgtgtcgggctggtactaagccacgtgtgaagattcaaaggcatgtgagttggagcctttaaggagctggtcatcttcttgggaagatggagctcacaggcagagtgagcacagcccttgcacatggtgggcaggaagagctgcttagtgggagtgaagatggaactgtccctgaagcacaggtacagtttgacaggtgcagtataggtgagcaaaggcccttgaagccaggaaaaaaacatggttggtaatgagggaaaggagagttaattggcagaggaggccagtgggcagaacagaggactggggtctgagcaagatgtgggaaaactagaaggtccagttgggtccagatttggtgggccctggaaggtaggccatggagtttgggttttatcctgttagcagtaggcagccgtggagagattttgagctgggatgggatgaaagtgaaattttaggaaattatgatgatggcatgtgcagagtggacagggcagggagggggatggcagggggagactaaagatgggaggcaggtgaagaagctgcagcaacagaccacgaataaggtgcaaggggctaggtgaggggtcagaaaggcagtagagtgatgcgtagcaacaaaggaaatacaggggcctggtgattaattggctgttggaaaaggatgggcacaaggtagaacctcagccagaaagccaggaggccgggtggggccggaccacagagggtgagtccccttccaaacctaaggggtttccaggtgggggaggtccgcacatatcagatggatggattcagagaactgaagctctgggaattactgactccaggataataacggctttctatttttatgtttcagagcctttattggaaaagggtgggcctaatttgtcctgttatttaaaaaatattccttaatgcttaaattatttaatcctaacagctacctgtgctgtgggtgctattgttgtcctcattttataggttaaaaaaaaatgaggcatggagaggctaagtgacttgcccagggtcatgcaatacaaattatatatgtatacagtgtagacatggaagcctaacaagactagaacctgtgtggcctgggtccagagcagagtcccatttagataggcacagtatgatgaggtaaaacaaatcattcaaagaatcccatccttcatcctaagtctctctaagaatatgaaaagggaccagagacagctccccctgctgttctcaaacatcctctcctgcctcccacatctgtcccaccccactcccttgagctgccttacccccctgggttctccatggaccctcttctccaccccagcgagcaaggctggtcctctctttcccactaaaggggttcctgctctgcctctccttcactcctccctttttcttcatctccctttcccctccccttctatctctccctttcccgccttccctttttcccttttcctctgtcctcctccctccttctcagtccccttttcctcctccccttccctctctccctcccttcctcctcactccagctcattattatgtaaattgtcttcaccttctgagccaagctctccccctcctccttcctctagccttagcccagggcctacatctgcatcacaaaagcagagggccttgttctggctgagctggcctaaactctgacactggaagaaagggttgaggagaaactgaacaattacaggattagaagattcactggaccagtgggggggatggggaaagctttgaacaagcctgtattaatatagttcatcatacacacacatgtgtctatataaacatatgtaaaatatacgtgtgtatgtatgtacatccttgcatatgtaaaatatattgtaaacaaatggactagtagcagtcatgcattgaacttgtatgaggctttattcagttgaaaatactccagttttcattttttcactatttgtgcctatgcctgtttctctcaactataaactccttaagggcagagtgtagatcctgttcctctagcacaatgcctaatacaggaagtattgaatactaagtttaaaccccaattctaccaccagctatatggccctgggtaaattatgtaacctctctaagcctcagcattttggactgtaaaatagtaatgatcctgatacctccctcattcatatctgccgtaagagtaaatgagataatgcctgtagcgtgcataggatagtgcctgtcacatagcaacttctcaacatgtgttggcaattattctcatttatttgtctaaaatcattatttttgataaagtgttgatgaattctactcacagcaatctagtgaggaatgggcaaggttttatctgcacttttcaggttagaaacagaagcacaaggttcttaactggccacccaaggtcatattaccaagcctgggtctgctgaacctgtgccataaagccaaacaccaacactgaagtttacaacaagacaaaagactgcgtttatctgcaggaggctgagcaaggagagtcaggcagctcatgcttaacatctcacttcctcaatggccctacaagcaagggcttttaaaggcaagggtacattttaggaaagcagaagctacaggcaaaaccgtaaacctatacatggaggttatacattggtttggcccaaaaaagcaggatatcttgtggggcaggctttgaggtcatacgtagatccagagattctgtgatatgcagttgattaaggagcaagcctttgtctaaaaccttggggacagccaaaatgaatgttaaggtctggcctgtaggtatgagtctctccaggcccctcaggaagaaattgagaagaaagaccggcgatcagtgttctgtccttagttaccactcttctgaggtctacttgactgcaatgggcattttccatctggtgggggtccaggtttctgaaaaacaactcagggacatatgttaagatgttatctttagtttccatagggaaccaaacatcttgtggctctgacttacttgtgtggctattattttaagctattacaacctccttgcttctcaagttgctcatttacttctcaaggctacctaggtgcctggaatttcccttgaagagactcaagatttttctgtttccatgctttttcagggtgtggggggcagcacgaccctaacagggggctccctgctctatctcagtcacctacctaagcaggaggaaagatgggtgccagctgggcttgccgcccatgctcttgttccaccaggggccttcactggagctgtatcccctagagataatggtagctctttgggaggcagaatcagatttcacatttagttttcagaatgtcattggatctcctctggtaaaagaaatcttgacatttaagtcacacaatggagctcaggacactatgttttttaataatcatggaaatattgtggtgccacctctacagtgcagtgcggttcaccttgtggtttgcatgaattctgaaacagataaaaacaaggatgctatctggcctgtgtctccctgagtcccctggggcttagagatactttagtggtagttgttagatctgacgagggctggaggatgtaatagatgaaggcttcatactcccatagcccaaacacgaggccaggaagaggatgtagatgtgtcccatgctgggtgctgaggctctccacctacaacagccccagagcctgccctgaccctttgccagccaggtgaatagagcttgaaactgctccattcaagcccatctcattctgctgctccattttgcagatggaacataggtttcatctggtccaaactggaaagagacttacccaggggaatatgtggcagatccaggactagagcattcagcttcctgcatcacagctcagtcctctttccatctcagcaggctgcttccagttacccagccaatttggggactcattttctttcattcagttggtcaatcaatcattccacaaatacttatcactcaattacttattacttacaaatgcttacttcctggggaagtgcacaagatggcagaggtgggtacaaagatgcaaagatcaagaggctcccggtcttgggcagagatgccagccccagaatgagaaggtaaacgccttggtttccagggcttctcccagctctgaaattctagctctccagggctcagtgcagcatcagcacagctccctgatccaaggctggatcgggccgcaagctcctggtttgagggaaggcatccaccatctaagccctgccacaaggagcctgagacccggctactggtactttggcccaggatggcagcatcagtggctttccttgaccatcatctaaaaggaagaaccaacccaaaggaactgcagttttcagtatgggaaagaaagaaggactaaagtgtcagatttttgaaatgtctcttagctgctcctcctcattagagtcttgggtttccttagctaaaagtggtgccctcccccaagcccctcccagctgccccccagcagcacactctacttcatggttgtcttacccttggggccagacagcaggtctggaagaacaggtcagtcttgttcatcatgcccagtgctagcaggggtcagtgaatcctgtgcctgagtgattccattcatccaatgggtgtgtgcttctgggtcaagtgctggcttggtactagggatatgcatggcctgaacagatgtgtccagggaagaaaggatgaaagatgcagaatatgcttctttccatgccttcctgatccctccacagcgtttgccatgcgtgcttccattcatgtgttcccacagcggtggctcagcctggagcaggcactcagcctccagggctccagcacattggcccctgcagaggccccagccagcacctagccttcatctggcctggcctgccttctcttccgtggcgtgcagagttgagtggatgctcaaggctgggctgccatcagtctctacatgttcattgcctgtagaaaagggcatggaattttaaaaaggaaatttaaatgaaagacttcaacaaacagtaaacgaaaactgcaagcggtgatgccttgcgcttgtgtgctctctttctgtctttcacactccaaccccgccccccaccgccaccataagccctaatgactctgctctgatggtgggaaaatgttataaccacgtaaataaatattcctcggcatcaggactgaagtggcccccaccaatcttggatgtccaagagccaccccattgcagcccctcttctacccccaccaaacccccacctggcagctacacagggggaactgaccgcctcccctctggagaggggccattgtgtgagcatcctttgggcttgtggtacctgtttcaaggtggcaaaccagctgccaagcagacttcagccttagaagccataggccacagcagagaggggcctgcctggccagtgccctgtattttgggactcctggaatattgaaaattgaagaattcccaaaacaaggtcacaaaatcgtgttgtattttaaatgcatctacttaacaaatcagtactttgggcctaccacaaatgcaatggaatataattgtgctccctaaaaagacaattataggatttacaaaaatattaattgacagtgcagtgctggccctgtggtcctgtagtgggacacaagtcagagccctgtgctgagcactgtagctttcactgtgagagatctctctcccgactatgtctgggacctcatttggtccaagccccagaattgagccctttgtggatgtataatccctttctggccaccagatataccgtggagtagcctaggaaaccaggaaggtagattttagtttgctgaaggaagaggcgccagggactgagaaagggttaggtttgaggcagcagcaccacgtggggaaggctgtgtggggtggggacagccaaggtggtatctgcccctgccctgctgggagtgtagtgggggtcacagtcccacacatgtgagatggagatggcttccctaggaaaaccagagccactttccatcctcccgctacacacatctgcacacacgctcatcagcttctgctttactcagctccgttccctcttctttctttgccgggcaaccaacagtggtcttatgtcactgctgaagcccccactctgagtaagttaggacatgttggttgcaagtgatggaagatacaaccacactggcaaactggcttattcaaacaaaataaaacacaaaacagccacaggcccagagagtcagaaattcagacacacatgtggggagtgggggcttgatcagcagctcaggggacgtccctggcttcccccatctctccactctgccgcactgtgtggttttcaccctcgactccacagcatcactcctgcaccaaggaggaaaatggctccagcagctaagtcatcacttgtaaccttgtgtgcatcctaggacatcaccaagcacaaggtgcatctgagcaaccaccaagtcctgcaagtctctctctctctctcagtctctttctgtctctgtcgcctctgtgtgtgtgtgtgtgtgtgtgtgtgtgtgtgtgtgtatgtgtgtatctgtctgtctgtctgtctctctctctcattgcccctccttgacccaatcaccatgaccaagggggctgaggggttcctgggataagagtgaatcccccagaggaaaaccagaagctcctgaaaaaggaaatagaataggaggaaatgggtgctggggaggccaccagccgcccacagatctctccttgccattggggctaccagctgtgctgccccgtgcaggagatgactcatgtcgtagggtggagggccggccaggctgagtccactgcagcaggaccatgagatggctgagctcggcagcaagccagcactgctgctcccatggcagcctctcccctgaggtcccaggtggcaggacacatgggtgcacagcccccagcccaccactgaccaatggtctcgcctttccactgtggccgcagcagggggccagggaagagtgggaggtgaagaggggagataggctggtaacagaagaggcctccactagaagtcaggtcccttggagcctgccccagccagcaacagccttagagctagtcaacacctcgcttcaaagctggggaggcactgccccagagggcgggcagcaggagtcagagatgtgactttgaatcctggccctgccctctgccaggcagtggacttagcactagtcacctgactgactgaccctcaggttcctcatctgaaaactggagatcataataatacctactcacagggttgttgtggctaaaagaaatgatgcatgttaacagctaagcaaggtgcctggcaccaagtaagtgctcaggaaacagctactgccatctccctcctcttgcccatacctcactgcctgttagtgaagggccaggacaggagcctgggtgtgacaattgtttcagaaccagagcaaagggttggtgtcaaggcctcttagctattacaggtcaaagaggtggtgtcatcccctcccagaatcagctgtcccttctgatttcaggctggaagacagtatgcctcagcacctgccctcttgctggctttgcaggagtggagctgaggagagctgcttctgactcagggcccagcatggcctgagagagaaacccaaagagatagagacaaggagagagcaggagagatcacagagagggaggagagtggcagacactgtgtgactgagaaacactgagatggcgcgctgcatagaccgtgcaccagtgtccagtgtcgatggtgcactcagcatagcatctgcgcagagtaaatgctgctgaaatggctactgctccattccttttcattagggccgcctatgactctgtgaatgtcattccacagcccctccagccagacgtgtcttctttctccccctggatgccctcagcacctggctgtctcattcactcactggtttatttacttgagaaatatggacgtggccttctctgtgccagcagcatgctgagtgctttgtgcaccatggtgaactaatgcaagcaggtgtactgctgctcagagctcagctggcgagcaggtggacagcctcagtgattccagagagcagagtgtcctgacagtcggcctgtcctagcctgtgctgaggacggggtatctgacaaagagctgaagggattggcaccggtggggtctcaccagccaccaggataggagggtaaaaagactgctcccaagtgtccccatatggggcacgccaggaagtaagaccagagcacatacttgggctcctggctgtagaagttcccaagctatataaggagaggagaatcaggcctggcctctaaaaggaggctgcttcctcttggggaaaagtcagggaggtgggaaaatgcagccttcacagccctgtgtcttaagtcactcagctctgatagcaagagtggccagcgtgggggccggtcttccctttgcgttactttctggcctctggagagtcaggagctcaggtagcctggagtcccctggaactcagcagcaggggtggaggcgggtagggtctttgtcatgaaccggaagcataccaggccttcacttagaacactgacccctcacagaaagaccagcccctaggccctgcctcggctggcagggtgacctcaggcccatcccttaccctacagggtctccattttttcatccattagatctgaggaacgacaccgaagatcgcccctcccccaccctacctcctttttagttctataaattcccctggcagaacttaattgctaagtttaggtgattgccaagcacaaggttcttcctttgtatccaaaaaagggggggggagcggaaaaaagagaaaaaaacacagtttcaaagttagggcacctgtgttcaattgaagactgactttctcttaaggagggagttgatgttcccacagccgctgggctgttagcagcaaaagcagcctagcaggaggggcagccttggtgagcccccagtgcaggccacttgggccacttgccccacagtatccagcgcactggggggcagatcagcctgtcactgagaatgacacactcaagtttggagccgggacctcttttttgccatccatcaatgagagtggttcagggttgtcagtctaagacgggagtatagcccagggctggggactgtagaaatgggcatggtccccacccggtggggatggggacaccggtgtggactggcacacatgggccacggagccatcggggtgaagacactaaatcaggcagaaaaacactgtcaagtgttaacactgcagcatctgtgtcaagggtaaccatgtctcagggacgcaggagatgagcggccccatgcaaagctgtcagttttagtctgatcagtccaaaaggctcccggtgtggggagaggaaggatggatttcagtagcagcttgctagatgaggatgagatggcagagcatacggcgcaggcttgaggagggggtacggaggccagggaggcctttgggcagctggctgacagcactgttacaaacattttgcacacattttattgattggcccactcctcaaacccagagcacataaacaagtgtcccatggtaccattggggtacctggaacccagagcagtggggaatgtccctgccccagtcccccaaacaattgcaccagcctctccagcttcccactgcctctcttgcctcccaccccgtaatctgtgctccacacaacagccaaagtgagcttttaaaaatgcatatctaatcccctgcttaaaagcgctcagtggcatctttgctctcaggataaagccagccttatctcctgtagctcctgccacaggctctgctgctgactctttaaatgccacgacctcctggcctcagggctttttagtgagttatctcctccataggggacttctccaccactgcttccctcccccaggcctgggttccaccatcacttcccctcccttggaagcctttcctgactctccgaataggctgggcctcttgtcctgactctcagacccctggtatgtgtgctcacctgagtatttgatcaatgtttgtgccccctgacccaacaaggctgtaagggacagggacagggcctatatgacttcagttggagtcagtctccagcacccagcacagtgcctggcccagaattggtgggtgctctattgaagtctgcagctagtccgtggtagagctgttcttgatcccagatgtttgaacacctggcccattgctttctgtatggccccttgtaaaatcagagcaggtagttaaaatcagatcctggagacccagaatgagtttggaacctgagttctagaacccacttgttcataggccctcttgcaggcctcaattttttcacctgctgaattgaaaccacacctgcccacgcactgtgcaggaagcaaggagtaggggtcacacacgtgaggcatgtgagagggggtgcctcctgaaagctggctctgtgcatccactcctggaacccggcccctctccaggcaaggcacagaggcaagcacctccaaaagaaaccctatacccgttagcattccctccctacccctctgcctgcagcccctggcaaccactaatctgctctctgtctctatggatttgtctattctggacattttatataaatggaatcatacactatgtactcttttgcatcttgcttctttcacttggcataatgttttcaaggtttttccgtgttgtagctgaatcacatttcattgtatggatataccaaatttcattcatctattcatcatttgatggacattgaggttgtttccaccttttggctactatgaataatgctgctgtgaacattcatgtacaagttttgtacagactcatgttttcatttctcttgggtacataactaggggcaaaactgatggttcataaggtagttccatgtttgactttctgaggaaccatcaaactgttttccaaagtggctacaccgtcttacattcccattttccgcatatggaggttccagtgtctccccgttctcactaatacatgttattgttcatcgtttttattatagccatcctcgtggctataactcattgtggttttcatttgcatttccccagtgattaatgatattgagcatcttttcatgtgcttttggccattggtgtattttcttcagagaaatgtctattcagaattagcccatctctaaatggggttatttgtcttacggttaagttgtaagagtcctttattctggatacgagtcctttattagatatgcgatttgcaaatattttctccccttctgtgcattatctttcgaattttgtgatggtgccctttgaagtctcacctcattctgcccttgcctctgcccccttgccagagttcctcactcccccagacctactcatctgtctctgttcctttatgctgctgcaacaaaataccttagaatgggtaatttagaaacaacagaaatgaattgcccacatttctggaggatgagaagtccaacatcaagataccagcagatttgctgtctggtaagggtttcttctctgctccatagatggtgccctatcactgcatcctcaggtggcagaagggacaaaaggctccctcaagcctgtttataagggcactgatctcattcgagatggcaacactcttatgatctaattgcttcccaaaggccccacctcttaatatcattgccttggggattaggttttgagcacgcgaattgtggacggacacagatattctgaccatagcaccattgcctgccctgccttcgggacttacactcttttggagctgaaggaactggctctttcttgctccacattgctccacattccccatcagcgttccccagcaggctctttcctagcagacaatctgaactgcacccaggctgcagtcatccctgagtttgggggcttctaaggctgtgtgctgagttgtgcctgaagcaggaggagcctacaattcactgagcatctccctgtgcccacgtgctggatgcctcgcaggcatggatatatcccactgcatccccagaacaatctcaaaagatactggtatttttctaccctgtggataaaatggagtcagaatttaaatttggatttttttttaagacaaggtctagctttatcacccaggttggagtataatggcatgatcttggctcactgcaacctctgcctcccaggctcaaaccatcctcccacctcagtctcctaagtagctgggactacaggcacatatcaccatacccagctaatttttgtattttttgtagagatagggttacattatgttgcccaggctggtctcaaactcgtgagctcaagtgatccacccacctcagcctcccaaagtgctgggattacaagcatgagccactatgcctggccaaatttagaatttaaaatggagctgttcgctgtcttcctacacagcatgttcatggcttatgagctgcacgttcagctctgctgtcctgtttgataattgcctactctgaaaagtatttaaaaatactggagaaagtattaatacctccctaggtataagccctagtatggtagcaacagaagtttcttgacactctggaaaatgcccaactccacctgctgtaaccagcagccccgaaatctcagggcctcaacatagtgaacgttagttccttgctcccaccacagtctaatgtggaagtgctgggggttgccctgtcccacgtaggcccgagccaactcccctgtggtcagtggttcagcctcagctgagggtcttctgctggactcctggtatcaggccagtggactggggaaggtcacaaggggagtttttggggccgggccagaacttggtccctggtcacacctaactgcagggaagtctatgaaatgcctagctgtgaccttggaagaagagatgaaatacttttgtcaatagggagccagtctctggcatagtgctcaggtgtgaattttagccaaactgctgccaactggaagcagcacctctgctggggtgacaggtccattttcttggctctgttggctgttttctgctcctcacttgggcccagctgagcagttcaacagctttgcttctctgtgacatgacagagcccacctgaaaattcatttcttggtggctatggtggtggcttctcaccctgtctcctgtcccagctctaaaaatggattgcccttctgatatgaacatgcatgacatctctggaacatgagtcccatgttctgtgtgcagacagtgtgccagcagcttctcctgtgtgatgtcagtgtttccctggcatggcacacatactttggtggaatatgagattaaatggtacgtggataaaccttttattcctacttttgtagttgcatatcggttttaatatgtacttgaaaaaagatcacataacatatcaaacccataatttcatatctatgactgaagatgaggctaatttcagagctgtcctgatatcaggttggggaaagcgatgaatgaatgactgggtttgggaacgttgcctggggtgaaaaggctcagatgcccagccgcctcaccggacttgctagtgtgtgacctctctgcacctttcctcctctgtagcatgttcccacatgaacatagggtataggaaggttggtgtgtcaagtgattaacagcagtacctggcacatatttcatgcttagtaggtgatagctcctaatgttcttaggaaacaccaagtcatatcacttaactgtgccaacagtgttgagacagggttattactatactttatagatgagctgagaaaggttaagtcgcttgcccaactggcagcagagccatgtgctgacccccagtgtgcctgactcctacctaggccaggctctgcgaggggagtttacttgcaatcctggctctggcactaacttagcaggacactgcaggcaggccccgtcgctctctgggcttcaagcttcccataggcgggatgggggaccagcataactctttgtgcaggataagtctcacagaatgtgggggctgctctctttgctccaaccacagcagaaggctttgctttaaaaaaaaaaaaaaaaaaaagtggactgggtgtgagctaggtgtctgcatgcaatgcccctcccagatcctctgcttgtctctggattctttctgctgcctctcttgtcacacttctttatgaccaagcttccaacctaccccaagtgtaaacatcatttgtttgtccgtcatctggtgatggacatttcacttgtttccattctgggactcttatgaataatgctgccagaacattgatgtacaagtttttgtggggacatatgttttcatttcttgtggtaactacccaggaatagaattgctgggtcacgttgggagggtatgttaactgcataagaaacttccaaactacttccccaagtggtagtactgttgaaaattccaccagcaacatataaggattcctgttgtcctgcacactcactgacatttggattgccagcccttttcattagctgctcaagtttgtgcacagtggtatttcactgtggttttaatctgcctttccatggtgactaataatatttggcaccttttaacatacttttgggccatgcgtatatcttctcttgtaaagtaactgttcaggtcttttattcttcccttttattgggttgtttgtcttcttattaatgagttttaagatttttttaatatccctgatacaagttccttgtcagttatatgtactatttcatattttctcccagtctttggcttgcctttacaattagcatttttaaatggtaaatggtttgtttaatgaatgttgatttgtccaccagcttccacgtctagtccatacctccctttccagcattgggagccctttgctagttatttctatttggctgtgagaggttttcgtctgcagataaagaagtgatcatggtatcagaggttgaacttgtggactctggggtcagacagtcctgggtccaagtcccagctccgtggctcgcagatgggcaggtccttctcgtctgttctctgagccttgcttttctggtgtgtaatatgaggataataagtcacctacctccttgtgctgctgggaagattaaatgagatgatgatctcaggggcctagcacctatcaagggcacacaaaggctgggctgtacctgttaccactcctgttgctaaggcacgctagcaccccagggccagcccatgtgaaaccactctgcacaaagcaggcttcttctcccttccacctttaaatcgaaagcaccacctttctcccagttatccaagcagagaccctggactcctccttcccctccatgtctcgcttcctgttccagaatggctcttgaatcagcccttcctctcgctgcccaggccactgccccagtgaggcagccttccctcttcccagtgttcgtacggtgctcctcaccaaggtggtctccctgcctcttcctcccaatattccaccctgtttgccgctgacactgttgtcaaaggcttcctttctgaatcagaaacctggggctcctgggtagttgtttgggggagaccaccttgcacaggcaaggctcggctgtcactggcgtcttccttggttataaataacaggctctattcttagccaaacagcagttaattctcttcccgtaccttccagagcctctattagggaccttggccgtccttactggagacaggccattccttggcctttggcaggacccattcctttgatacgtgatcagaaaattcaattataaagccaattactgatttcctgagctttacaagggagactggaaagtttgattaagtttgaatttgtgtttggctgattgccagccaaaaccgaatgggcttgtgggagagttctgttgttgctgattctgttcctgttttgtggcagctctcttggggtgggggcaggcacactggtgttgtgttgtgggttttttttagacccccttacttgctgaatggctattcctctgttgtgatgcatgagatgtaaatcccccaaagactggttgccagagcgacgggctggaattgagctcagctaaacaaagtccttcagctttgaagggagaagcgcttgtttcccatgtggagttgagttatagtggccctcaacaaggctgcattcaaggatgcctgcatgaacaggcatgcagagggggtcgctgagcctgctggaggatcttaagcggcgtgtctgggctctaactgcctctaggacctacccagggggacacacagatgctgagcctgaggatcaaggctattcagggtgcctctgcccagctggtcaccctcaccctagaacctgcaggactggccttcaaacagtgacagcctgctgggctccagctagagcccagcacaggtggggattgaaaagcaaccctttgtctctagccaaagtacttgcttttttagatacttctgggaaaccaaacagagcccgtgatgggaccaggttggagttccaggtcagaatctgagttgtttctggagacccaagttccttccctagcaataaaatgagggaatcccagttctctggaagctgtagccatcccacaactcttcctacaaggtatacattattcaggagagatggtggggccccacttcaaagcgtctccctcatgcctaaaatctcccagttagagccctttgggtgttaaaggtttttaggtctctaagaatcctggttaaagtactaatactcctggaaggagaagcgtctaccagtagggattagccatcagctaactgagaaaaccgccctttgggagtaggacacgggattccctgtacccagggtggggtcagataaactccacctgcctcccagcttgcttgaggcaagatccaaatgtgacctcttgcaccagaaacattaatatctctaacattcgtatctggtgtgatgtaccagagctcacagaacactcacgccctgccctgtaccctcatccatacagcaagctcatgagccggcaccaccttgacccccggttgcagacaaggaagccaaggctcagggaggccaaccaccttgcccagcatcacacagctgggagtacagattttggactcagacctgggatttctaaatccaaacccaaacctgttttctgtgcgcacagccacccacccggtggatgacatggacactgcgcacctgttttgtctaactggtgtgtgtgtgtgtgtgtgtgtgtgtgtgtgtgtgtgtgtgtgtgtgtgtatgcatgtgtttaaaaggtgggaattttttgttaagtttgaatttcagttcttttcttttcttttttaaatgaaagtgttatagcatcctggtggagttgtaattaggaaattctgggttagtcagctaggcagaattgaaaaataacccggcagtgctggttggagtactttttcccctccttagaaattcaggttttgtcaaactagggaggagggagttgtgaagatggaaaaatgtgtgcagctgggctgggtcagggagtgtgtattctcttctttatgtagaactagacgattaaaaaaatagttatcgagtgggagtgctggctcacgcccataatcccagcactctgggaggcaaaggtgggcggatcacttgagcccaggagtttgagaccagcctgggaaacacagcaagaccctgtctctacaaaataaaaataaaaaattagccagccatggtggtgcgtgcctgtggtcccagctactggggaggccgaggtgggaggatcacttgagcccaggaggtcgaggctacggtaagccatgttcacgccactgcactccagcctgggcaacagggcgagaccctgtctcaaaaaataaaataaaatagttatctttgtgtaggatgatcttccgtatgtgcagacatgaggcagcctgtgaaagatggtaaggaaacaggtgaagaggaaccctggctgggtcccaggctttggcaggaagaggatgcgagccccagatgtgggttaagggctctcaaaccaggcgcatgcagagagactccattgtcacctcccttccagcttgcccttattgatcagcgacagtgatgatgacaagggcagtaacaacttcccccacacgtggggcatatatgccaggctctgagacactccgtcatttctgtgttaccctgacagtcttcattttaatagtgatatgcttattttaataagaatccaaaacatagcccatctagctcatgactgcccagatattagaatggggccaaagtatgggtttaactttttttaaaaaatgagttaattaggctgggcacgatggctcacacctgtaatcccagcactttaggaggccgaagcgggcagatcacgagatcaggagatcaagaccatcctggctaacacggtgaaaccccatgtctactaaaaaatacaaaaaaaattaactgggcatggtggcgggcacctgtagtcccagctacttaggaggctgaggcaggagaatggtgtgaacccggtaggcggagcttgcagtgagctgagatcatgccactgcactccagcctgggcgagagagtgagactctgtctcaaaaaaaaaaaaaaaagggttaattaaataaaacatatgaatataaggacggggtgtcatgtggattgggcagaaattgtgaaaacaagacagaaagatctggagtttgggaaggcttgcctcatccatatgagcaggtaaaatgattaacctcattttacagatcaggaaaccgaggctcagaaaggttgagtaacttgcctacagtcacacagctgacagatggcagagccagcaacaagacccaggcttgcctaactccaaaggcaaggcttggggctgccatccaggtgaacattcctaccttcactctccagatgaagccctcagcgctgggttagctagccttcctggggctgtccaaccctggagagagaaggcctttctcactgctttctgaagcatgaacagaggcggatcccactctagggaggtagggccctggggcctgcttcctccgatctgctgcgtctaactctctcaaataaaagccttttcagaaagggcctggcatgaggctgcatgtgactggcagggctgtgactgccaaggcttcactgtgcttcctcacccttgccccagccccacccagcccgaggcagcccccaccttcctttcttccctgatctctcttagctcttcctttctttcttttttgtctctgaatcattttttccaataagctgttgattgtctgttgaataattctctgaatgatttctaaaagcctcctgatcactgaaacctcagagttggaaacacatttatatttatgtggaactgagcttttagaacattattaaatttgcatggggaactagcagagtagccacttccacacaatccagatgatgaggaagcatcatcttcaggaggatggaaatagttccacaagccactctgcctggcttattactctgctgggagaaatcagcacagtctacctgggggtccagaggcagcattgacccagacaatctgagcaaatgctgtggcttagaaaccactcagatgcctgtgttttataattggccagcttcctaacctgggattctggagctgccacctcagaaatggaaggcagattggggttcgtgtgtgtgtgtgtgtgtgtgtgtgtgtgcgcgcgcgcgcgcgcacgcacatgtgcttgtgagtgtgtctgtgtccacgtgtagctggatgtgtagttcctgtgggtggtttagtgtgtgcatgactacatgccttctctctctaaggagagaggctgtagcttttgtcccatgtcaaaagggccacttgcactaatgacctactatgtaccagctgtgtaagctgctagctgaggcctctgagcaggataattctcatagaatttagagttgagaaaagagaaacaaacaggaaaggctgtagatagtggtcaggcggtacagagaatttaaataaatgagtggcttctctcagtcaaagtggtaccagctggcccctggctgcagctcaccacggccaactgtgtgacatagtaacagttaacctccactgactggtcaccgtgctccaggcactgtcttaagtggcttgtattcattcctttaatcctcataacaccctgagaagttgggactatttaaacagattagaatgctaaggttttgtgaggtcacacagagagcgagtgacagagtccagactgaatctggggttactcacctccaaatgcttccctgggtaaaatactggcctctccagactttatttttctcatctttaaaatgggttgattcttatttggcctatccctgaccaaaaaaaataatattttttaaaatataaacttttacacaaatcgatctgaaaatcagcatcctgctcccacttggctctggtgcccttgatggagctgaagtctgtctgggtggttcctgagttttctcagattccttcagggctgccagttgaaccaccaatgtgtggagttttacttaagcctcattttataaatcagaccatttgacttgtctcccactaacttgtcaaagttccagcgagcaagttttagttccagaagccagatgcttgccactgccagctccctgaggtgggcgttctcaccagccccattccctgctgagcagccacgggcccatctcccagcccagggcaaggccacatttcctcagacctctgagagctctgaagtcagcctgtgtggctggggtggatacaggccagctgaagtggacagaggataccggtgaacaataaaaataacagatagctatggcagtcaggtaaacagagtttgggcttacgctaacaatacgattgatggggtgggtttgacctttttttgtttcaagccataccaagaataccagtggaccgtgtcacatacctcagtcaaaacaaaagtgacttggatttgcttttgagggtcaaagaaaggccttacagaagggatgtgggggagccggaagcacagacttcgggggtcagaaagatctagactcaaaccccagctcttgcttccagctctgagccctgggccccctttttcctctgacttgctgtcagtgatttcttcagggcatgaagaggctgcaagaagggctttctctgtttgccctctaagcgcttaccacagaagcttggcatttttccattatttttatgtatgtgcatgtgtgtggagggagattgggtttttttaatttttcagttgcattttttttgttttgttttggtgagttcttctttaccaaaaccctgacgtgtgcttgttttattgtgcttctcttcccagtggaacacagctaaaccattctgcccggcggagtggctcagtcagagtgccagatgtgggtgattcataagcgtagtggccatcatgttgaattgttactattgtcactgagtgtgctgagcacctgactgcactaacttgtttagaactcagccgtctgtgaggtgcacactgtcaccacccccaatttacagacgaagatactgagaccctaataggcctgctcccaaatgactgctcacagcgttactcccttgatgtggaggtgtgggcagaaagtcctggggctctgaacgcccccgcccaggggtcctgcctgtgggtcatccagcagcagcacctctgtccagtcccacactgatgtgaacagtcttctctgatctacagctcacaatctacttcagccccactgtcaccctctccccacttgtgtgccgtgttcagtcctcagggaccccagaaccagcccaagcagactaaggttccctgggttctagaatcttgatagctcaaaccactggcctctccctgaagggtttcgacacacccccccaccacccacctcctctctagcctctgcttcccagccagccctacctccttcccaggatccaccagctaagccaccagtgaccctggaacagtgaactagccccgcctctctgtgcctcagtttcccaacttgtatgatgagggagcatagacagaagcagttctatgggcccctccagctcagacattctccaaacccccatcatctctcatttgacaactgcagtggcctccttggagtgctccctggagccactcttccaggcctcccagccccatctggctatacacagcagccagcatgagcttttgaaacaatattatttcattcccacctttaaaaccctccgtgacttcctaccacacatagaataaaagccaaactccttcccatggccaacagtaccctacatgactgggggtcacgcccgggctccctcttctcagaaggtgctttgaacacagccagcccgccagcccctggctgctaggagctgctgccgtgttgccaataccatcactgtgtgtattgatttctcacccaactggtgtccttaacttcatatttatggcttgccctgacatttcccttctcttacatgttccaaattattaaaaacagctgctttataattaattgagcaaatcacagaaaaacactttttttctgtctataaataattccaccttaacttttctgggaggataaaatgctgtgacaaggaaccagcacacacctggtatctactatctcctccccagcctggacttgaattcatctgaaccatctctggttctctccccggcctgaaacgggacctccacgcgcagccgaagtggggtcggtggagaagggtcgcaggattcctgagcagcttttgactgctcgttctgcctgcctgtggactgcttcccatgatttcaccactgccttttgtatgctgagctctgtgccctgtcccatgctggggtggggtgtgccaggggaagacatcactcctgccccagaggaatcacagtcttgttttccagatggacacttggagacccaagcaaccaagtggtgtgatgctgagctcagggtggggtcagaggagagccccatgtggaggctggcgggcagccttcccatagcaagacccccaccagcgaggcttgccacacaaaacgggtgaccagctgccccaagagtcagctctctgtgttccctgcaaggggctctgctgaggccagcattttctgtgtggacagaccctgacatgggagaggctgggaagcaccagagcatgagctggcatcttgggtgggcagtgacttcaccctctggagcagtagagcccctcgtgactgtcagacagtttatggacttacacccttgacaaagcatcacaaagcatgatggctgacagcgacctcagagatgatcacatctaaagggtgacacggatttgtcttgtgtgcttgctatcattgacccccagctcttgtccccggcagtcactgtatttcattcatggcactgaatctgccctcagagttctctcaggatagccattgccccaggcagccactaccggttggttgcagtcagccctcaagttgaagccagtttcccacctctgatctacccaatgcgacaccctcattttatagacgctggcaagggaaagggcactgaagagccacagcagaacacctatcttgcaccccgagctttctaaccccctacttcattgctttttagatctttccctaccaagccctaccaagttcattcacttggcaaatgtttactgagcacctactgtttgcccagtttgttggtacatcctggatacaagagggcgcctggtataggagcccagcatccagtggagagacttgtaaacacagaacacagaggctggtgggagccacactcactgccaccctcaccggggagagcagagaccctgctgccccagacttcagggagccccctgcgtctgcttttcttgatcctcagggctttgcccatggtactgagggcctgtgttctctttaatccttcctgccatcccaggcaggcagattgcaggtccctcttcaagctggtgctcttgaaatattgttcatcatttattcagcaggtccaggaagatgccattaatgaaacttgtttctttattgttcaaaatacgggatatattagatgtgctggacttaacataacactttaacattgttgggagctggctttcatgtccattgttcctaacaagagaagactggtgcctcacagcccctgaaaggacaagagcccataattacacaattaggctcaaacatcagtttacaactttttttttaatgtgggcaaacttcacttttctgtctagttcatgttttttcttgttttcattcacaacattccaaaccaggtaacttcttaggaggaatattagtgggtttgaaatttacataataaacaaatgcctccaccccagaagacagccctgtatcatccatgactcagtttcagagtttcaccgaccaaccacttcggctggctgagagctggtggcctggcccatgcctacacgtgcagtctgcacaggtggggttgtgttgatactcagctgaataggtgggtgacaaggaaggacactgtccacctccactggagtgcatcagcactcgtttctccagttgctctggaagcatccaggacaggtagggttagccggccccttattctgctccccctgtgacattgcagctaccctcatggctggtatgccccacagcctggctctcttggatctcctgttgaggtaagcagagaccttgagaacaggctctgggccatttctcctctgcttcctgaccccactttcagctcaccccgccagaccttgcaaggatgaggagatggtacctagtgcccatctcaacgtatagcctggagtccatttattccatgagcagcatcttgtaactgaacacaatagttaatgaagcagatgtaggccctgccctcacagagcttacaattcccctaggaagagaaacagtcatcaaggaaacaaacctgtctaattacaccttgcaataagtgctgttaaagaaaagaaaatcatgttaggatgagaaaaacttttgctttagattgggagatgggggtgatcagggaaagccttatcttgggggttaaagtgagactggaaaaataagaaggagacaatctggcaaagactcgagtccaggaggagccagtgcagaggcccctagtggaaatgaggctggtgtgtgtgcaaagcctagaaagggatgggcggagggcagtgggtgaggctcaggggaggaacgaccttgaccccacatggccttgtagatagagtttggaatgatggagagagaaccccaactcccagccccagggagagctccacctcaggggctgtatttgtttcccagggccgtcataacaaagcataatcacagttctgaaggctgggagtctgagatcagggtgctggcagggttggtttcttctgaggcctctgctccttggcttgtagatggctgttttctccccatcttcacatggccttccctccgtgtgagtctgtgtcttaatctctataaggacgccagtcctattggattagaacccatctaatcattttaacagaattgcctttttaaagaccctgtctctaaatacagtcacattctgaggtcctgggggttagaacttcaacctgtgagttttgggggaacacagttcagctcctaacagggagcttccctgccgtcctctgagatgaagctcgtggatcagcatattttgaatgctgcagcaggctgaggagcccagttccactgcttgctccctgctccctctttgttgaaaggaatgattcacaggtgttgatgggtgtcaaagataaaagggcaccaagcagcctttcttaccgaaggtcagtcagaagccttcctagcgtgagttagtggtgttaatgcagggtcccagaacaacctggaatcttcagcggcccacactctgggaaatccccttcatcgttgtggcggaatctgcagagtttaggcagggaagtgagttgactggccagggcgcaggagagctggccaagctgcccccgctccttcagggtttcctcccaacccctagcagaaccctttgctggagagaggcccagaaagggtagtgctgaattcagtgaggtggacttatgaccagctgtccccaagacccctgagatcagtgtttcttcagcctccagggctaacctgctgagggctgaggtgcctgcagacacacagaccagcctccagtcactgcctccaccttatgttaaagataaaaataactacaaggcgggaaatgtcctagagaaactaccttgaaattcagaaaacatgaagccaggcttcatctaattaagatgacattttaaaaggggggacggggggaggcttgggtggcattttaaattgcaagctgattgtgcagcctaattttggttctgagcaaagattccagttggaccagaaaacaggacttcaaaggcactgcctactgctggccaggcaaagggagtgaaaagggcagcgtggggcctcgggcacaatgtggccgggaactctgggcaaaggctgggggccgcggggggctgcagcccttgggagcctgctgtgcctctgaggagatcagtggagccgctcctgggaggagagctaattgaggtagcgacttctccttggagagtgagctttggtccaccccagcccatcttgggggcagtcactggacagaactctggcctggtggtcccaggcatgcccccacccaagtctcccccaggagctacagaaacaggcctggttcttatgcagagcgcccagtgccctccccaggagggggctgctcccttccggggacttctcctgccagcctctaagattcaccaggcgaagaaggccagctccctccttcccagaatcccgggaggggcagccccagtccctttcagattggagggcagcggctgggcctccgcgttggtagggagatatggcagccagctagcctgggaggtggagcatctgcccccagaggctcctgcatgtctctcctttttgtgcaccatagcttatctcacaaagccagcttcactcagcagattttgtagttattgttattattactcattctactgacatagatctgggcacatgcacacaccccacgatttaagtgctccacagtcagaaagcccattccccagactctgggttctctcacaggagccctgggaggagagcatggcatgaagaacaccatttacggttgaggaaactgagtcacaaggtgtcacatgactaacccagatcctctgaggccacaccctgacacttcccacaagtgttgtgaccttggtggagtcactgcttcccacttgacatttcctggtggagacaccatggtgtctgtcttccattccctctggccactgtctcactctctctcagcagaggtctttccccagctcctccataggaaggatggtgagatgagcatgagctaacagatgggaagagtcgaaggagctggtgggcaagggaccttggttcttccatggctgccagtggggagcacggagggttccactgtggcgccattgaaagactcagcggtggatgagagggagattaggaggccagtctggagtcgctgccctcatccatgcagggaggcaggggtgtccttggaaggtaagaagaagggacagattcacaccttcctgagggtaaatgaccttgggaatcagccagctgcaggaaaggaggaagagtggagccaactttggggtccccagcctgtgtcatgggaagcacagaaatgccattggaaagaggctgtgtgtccccaaagagtggtgtgcgctttcctggggcacacaaatgacctggcagtttttacagaccaacagctttggttttagtagttttattattttagtgtatattagaaaaattagcacacaaacctctggttctgtggatattgtggcctagggtaagctggcttttttaaatgagtccaatttaataacattttcaaaaatattgagtcagcagtgacggtgacttgctgatagggcagaaagctggagaatgaggcaggaaggaatgcgatgctggagccttggatgggaaaccaggaggggagtctaactggggacacattgagttgagtctgaaaggccagtgacccagaggttaggtaggggtaatccagttgttccctgcacagaggaaaatcaggcaggatctggctcagggagaaggtggctcgggaaagcaagaaggggtttgaggactgagtccttgggaacattggcacctaaatgttgggtggaggaacaggaccacagttggagacagaggagggatcacagtggactgaggtgaaccggcacccacggggctgggcgcccagagaagaggagaagtgggcgtgatggagagggcactgcgagccctcatggagtggagagggaggcagcaagacagaaggaggaggaaggggaggacagtggcttcacggggaggccagctcagaggacgggttaggatggaggggccagagacccccacccccaccttttcatcaggtcaagtctaacttggggtgaagggtacagactttccttttggggtttccctgaagttcatgtagctggatggggctttagaggcttgggaggaagcagccctggacttggtttctatggctccccgcaggccctctcccagtcacaggagacagcccccttcccacctgcttcactcaagctcaagtgctctcctagctgctgtggggacagacaggcagggtgggctccctcttgctccttcccagctcccttctacgaggacagtggccactaggagaccagaagttaccatgacaacaaagctccttcacagaacagagcccctgggctccctgcaactgtgtccgggatatttgaggtgatcttctctcaaaaaggatgaggccccaagttggcttttagagatggggagagatgataggaggaggtagggacagattcatgttgccagctctcccacccagccaaggaacgtgtgggtgccccttcccttcccataggatgccacacactccttggggagcccaccagtgggctcattccaccttgaaaccaagaccaaggaaccaagggtggggacaaggacagagaagggagcaggaggtctgcgggcttggaagcctggactcagtggcatgaccagatcactgccgcctgcctgcaagcactgtacattcccagccaatcagggttgttctcaggcctcacaggaccagaagccaaggcccttctgctaggagaagagggaggtgaagtgacctgtttccagtcccaccacccaggggccagacccggacccactgctcctgtgcgtgccgctctgctccctcatagctgaggaatgtgcagcagtgcctgctgtgctgggtgctggggcagtcctccccagagtggagaaaggacatcagttttagctggcatgatggattaacatgttgatttttatctcaatatttatgaattcattttcatggatattagaaaaagataaaagctagcatattaaatacatcctttcccagacattgttggtactaaatttccttttgcttgaaataaatttaagtagaaaaagtctgaaggaaaatattaggtcagatgcagtggcttatacctataatccaagtgctttgggaggccaaggcaggaggatcacttgaggccaagaagaccagcgtgggcaacatagtgagaccccatttctaaaaaacaaaaaaaagaaagaaaaaaaaaagaaaaaatcagcaggacattgtggtgtgctcccgtagtcctaggtactcgcaggaggctgaggcaggaggattgcttgagcctggggggttcgaggttgcagtgagctatgattttgccactgcactgcagcttgagtaacagagcaagaccccatctaagaaaaatattaagtaaattaaagtacaagttttatacaaacagcagaaatttaatgatcatttattgagcacctattatgtgctatagtgttctgtggatacagtggtgaacaaaaattatgcgagtaactgaggcttgggagatgctgctgtggagcatgacttttacccttcttagggggagtattggcacagcacagatctctaagactccagaaaactcacctgtgctctttcaccagcttacagtcttattgagagggcactctattgctcactgaagcattagaagagggaccgtactcagtaatccacaatgcaggataaacagaggtcagatgtcaaatagggaacaaaagccaggagaagaaggacaatggcagaatgtgttagtaagggtgccctagctgctataacaaatacacccaaaatgtttcgtggttcagatgcaataggttatttcttgctcatctactagtctggggcaggtgttcttggtgggtgggtggctctcctccacacagtgactcatggaccaacaccttccatcttatggcaccaccaccccctaggattttgtcatcatgtgcatacaggagacacactcacatcttaagagccttgacccagaagtggtatgcttcattttcacatttcattgatttcaacttagttacatggcaggttgtggcctacagaaaagttcccgactagcagaccatgagagggctgaaatccagtgcaccttcccttttctaagccttacaacctgcagaaaggaactccttttttctaattgtaccggctggcttctatctaccctggccagggtgtggggcttgggggtggagatgggggagagaggcatggaagggggtaagaggagtgacagggatgaaggaaagcaagaaatgccttggaggggagtggaacctgagcccaggtggcatttggtggccctgtagtttcagagagtgagtgccaacctgagctggttccccctgcccccactgggttaggagctgcagtgccaacctctcacccagtgagccctgtgcagctcttccccagcagagggcagagttgatacccttccccacccgggcctgaccccatacccagagtcacccagtgtctgtcagggaagatgaggatggcaggggctaagtagaggccatgcaccctgatcccagacctcagagaaaaactgttggggtgatggcgccttggctggagcaggccacccacctggccctgcgctgaactgagaacccgaggagcgcgtcccctccctcctccctccctgctgacatagcttggcagatgagtccccggaggcttggctcagcccctgaccccctgtaccccaggggccaggctctgggagtcagaggagctggcatccagccctggctccactgggctgtccacctcctgccccgcccagcacggcccgctgggacctccttgcctggcccagctgctgcatggccatgggtgccactctgcctcacctgtgttttagttgacaggagtatttgtcacccttgtttttacacctgtcaccatcccacctgccgcatgtaaacactaccagcatcaacacggtaatgccggttcccctgggtgggcaccagccaagccctctgggagctgagaagagcaggtgatagcagctggagaggtcccaggggccagccttccctgaccctgccctcggggagacagggctgccgggctctgggccagctctgcccctggcttgctgatggccccacctcctactcacgggcctccatttcctctcggaagaccaggccactaaatcacagggaagcagggctgcacggggctggcgatgtgggctccggagtcaggcggctggcgttcaatcccagctctaccacctactggctgagggaccgtcagcaagtctcataacccatctgatcttcggtttgtctgagtataaaatgggggaaacgataatacttgtgaacatcaaatggagtaagcctcctggtaagtgctcgacagatactggctgctgtcatgatctcttggggcctctctttgacaccaggcccctgagtgcatgtgtgggtgtttgtctgtctatctgagtcccaaggctcacagcaaacactgaggcggccacagcctgggcttgctgtatccttctggactggttggctcagccagctctgacccctgaacccagaggtccctcctcgaccccaactctgacaaccttcctgccaccactgactttttgcaaagactcataattctggatttcctacctgaggtggtggctgtggccgaaaggcccattctcacccatgagaaggtctcctgagaatgagccgcacctctgcaggtggaggccttgccatccagccctgggatgtgctgcatgggacggtctgcccagggccttccaagtggggcacgtgccaccgctctgtgagatgagatggctcagtgggacaaggctcacacatttaatagcatgggctcaccgagtcagaaagtggttccttctctctcagcttgtctgagagcctcaaaaagaaagtctcaggctggtgcttggaccttcataacacctctgaacctatctcctaggtcaacaaagagagcaaggcctcaagcccagagccttctacaggcaggggatccagagaatttagcatcctattctgctctcattgtagttattcttatgggtgttttctatttaaaatactttatacaagttcttcacttatcatagggatatgatgtttataaggtaaaaagatgtgtctaggaaaaatagtaagtattactcattcggtgatgcaggactttggcagaacttatgaagatattagggtatgatgcttgggaaagaatgctcttgtccagcagctcttaaacattttggtttatactcctaaaaattatcaaggaccccagtaagcattttgtttatgtaggttatatctatcaatttttattgtattagaaattaaaattaaggaaaatttaaaatatatatttatttgaaaataactataagtccattacacattaatataaataaaatttttatggaaaagtactgtatttttcaaaaatattttagtaaggagaatgtcattgttttacatttttgcaaatgtctttcatgtccagcctgatagaaaatggctcggttctcacacgtctctgccttctctctgttgtgatgtgttgtttggttgaagaaaaatttggccccacacgaacagggaaggagtattttactagccttttcagataattattctttgaaactcccaggacttggcaaatggtagtttattaaaggagagttgcaatgtggaatctgaaagtatatcaatgacccttctttttttactttttttgagacggtatctgtctcgcccaggctggagtgcagtggcacgatgacaactcactccagcctcaacctctgggctcaagcaatcctcccacctcagcctccccagtagctgggactacaagtacacaccactcccagggggccaccatgcctggctaattttttttaatttttatagagacggggtctcactgtgttgcctgtgctggtcaatgaccctttcctgttctgttacattaaaattcactggcctaccttgcactttgaatggatctcttactatgaatgatttttaacaccattttggtcatttggaaaatattggttcatgagttacacagatctgaatgttgacacatttcagcatattatatcaaaaactcacatttgttaatatcaacactgatctttgagaaaagctttaggtattgggaagttaccaagtttacagtggtaaacacaagtcttccacaattctgcattttcacttgaaagccagaattttataattttggtaacaaatatgtcagtggttttctttgaaatcgtggctcactggttcatttttgggagaacttctgccagagaccccagtctgaaatcctactgcttgccgctcaggcttttcaaggaaaagcagtgtcccatgaaggaagggatgagtccggcttgcaactcagcctttccccagtacagccgccacccttacatttgcagcacgtgttttgtgcttacttcccatgtcatcatctcacagaattctcagacgggtactcgagtggagttttttataagtcgtaatttttacttcttcaccaacgacattcttcagtccagccagcatttgctttcttggcatgcatggtggtagggagtgcaatggcagctctgcagcccggcgccgagtccagcgccggcgcctggcttctggctaaggagaccacgattgtatctgctgctgctacttttgcaccatccgtgcaaatgttaacactgttaggaaggcaagtgacatcttagttttgttatgaaaatagttttgatttcatggacccccttgaaaggatctcagagacccctcggggtccactgaccaccctttgagaaccgctgatctagccaatcccttccttatgcactagggacactaagaccccacaaggagaagagacttgcccagggtcccaaagccagtcagaggcagagtgacctgaagcccaaagctctgagatcctggaagcaacgtgatctgcaccttttctaacaaaacagtatgtgcccactctgatgaatggcacaggagccagtgtccccggggaaaggatgaggaggcaagagggatgaaccagcctggggataggcaccagttggccaaccctgtcaacttcaggacttgcctattcccaccctgcaccttatgtgtagcgctgcatcttccatcttttctcttccatagctgtgttgctaatgtctcccagccgaggcggctgtaattaaactattcaccatcgtcacttcgtgttctgaagagatgaggtcggccattatcatttttccttccctttgactgagctctgtgtgggtaatttcattctgccttgttcatttcttagaaattttgtctatccaattttagttcttttttcctcttagaacactgggctcaggggaaaggaggtggaggatgagggcatcatggatttggaaatttctgtcccattcaccttaaagcttttttgggacaggatagtgcctgcttggtggtgcagctatccagagagcccccatccaggagagatacccaggaggtgtagaacaggggtctggacccactgaggggagaagggcaccaagacaaagaggcaccacgtaaggctgtcccagaggggcagtggttggagctttggacagacagcgtccccacccctttcctggtggtcagaagccttgctgacataaaaacccccctgcctctgggggcccaggacaggcttctgttgctaatgaaagtgagcaggggccaggcacagtggatcacacctgtaatcccagcactttgagaggccaaggcgggcagatcacgaggtcaggagttcgagaccagcctggccaagagaccagcctggccaacatggagaaaccccatctctactaaaaatacaaaaattagccgggcatggtggcgggcacctgtaatcccagctactcgggaggctgaggcaggagaattgcttgaacccgggaggcggaggttgcagtaggccaaagatcttgccactgcactccagcctgggcaacaaagtgagactctgactcaaaaaaaaaaagagtgagcagggcctccatcctgcgtttcctctccccggcgtgccctgccaggcctccactagctcccctagggcccccatgcccactctacacagatgctggcagggctgacagctcccctgctcctgcaggaagaggccaggagcccacgccacacagaaaacgtgaatgtcccaggccccaacacatggaaggcctggcatttcctctgccaggctctatggggaagcattttctctccatcagggctgccccaggatggacactggcctgcccaccaggggtagggcaccccctcataggcatgaccagcaacctggccgagaggctgtctgtgcttgagcccctgagccatctgtgtgcccacaggtggctgtcctaagtttaaccttctagggctgcatgaccccactgctgtcctcaggccctgctgatggctgccagagcatctggtgcctccaggacccactcttgcccgtcaaggccctcagtgttgcctgggtctcgcctcacctctctttaattccctcctcacctcccgagaagccccatgtctcccaccatccacaaacctgttcctcctgaggcccagaccctgcctccctggggtggcctccccactccccagctggtgctgatggatctgacgcccctagtggactgcaggcacgggcagggcagggtccagttcctgctggcagttctgtccccagcactcagccctgggcttcacacagagacgtcctccaatctgtggggaaggaagattcttaggtctcgccctggctcctgcttaactgtggccagggccaggagtgggaaactgcaccagccactgacaggtggtttctgggtgaaaactttcaggtgtgcgggaaccagtgacagggcctcagaggacttgggccacagtcgccttcccaccccctggcccctggttctggaaggaacatagtaagcagtttctgtctaggaaaaacctgcttctcagtcattggaagatccctgagttctgaggctgaaaaggaaagaaagttaggatcaaaaaacccaagccttctttactccacaggagacatcctgggtccaggcagggaaggttctcagaaaggcttaggacaaatcctggggcatccagaaggtttgaactgctttctgaacccaggtggggacttcaggaacgccttgcttaacacagtcacagacccctgacacagaagggaccatgggacagaggcagggaaaacctcaggggctgctctccctccaccccgatgtgttcaaggcaccaactactgagctggggagattccctttgtcaaatgttaaagtccttaaggcccagaccccactcagtgtctgccacctagcaggtgtaaatggatacatagtagatgggtgaatggatgagtggatcaaggagagaatgaatgggtgggaggcgagttggatcaaacaggagtggatgagtaactaagggatagatagatgccagggaagagtggaggggatggtggtgggttggaagggatgtgagtggatggatgaactggggtggctgatgggtagatgatgtatagatgggtaggtgcacaaggtttgataggtaggtatcctgggtaggtggtgcaggatgtgtggctggctggctggagaagggatgatgggtggatttgaaagaagagagtgggaggatcatcatcctaaatggagaaggaaagcaagattagagatggcactgaatccttggttctgctgcaggatctttttgaggaaccaggaaggttcccttccctaaagcaatggtgagcccatgaggtcccctacctcctcaagagaccctgtgagctgaggacgttctgtaggcgcaggccttgctcagaatcctaagcccaagcgaggaaagagccccagccgccaaatgcctgcagcaccccagttgttgccactaccaaagactggtcacaaatgtctaacgtgcgcccggggtggcaatttggtaccacttccactgagagtcacaggcagagagccatctgccagcccaaggccaggaaagcagacccccgccccggaagggagtgctccccactgttctgacgcccagctgcagagagggaggggcggggggctctctcctgtgccggagagaacggagagaacgtgacggtgtttcctcagatgtgcaggcctgggtgggagcgctagttactaagtacccagaattcttcgccagctggaattgtagtggccaggctgggcccccccagcggctggggtctctctgccccttcgcgttgaagagcaagtcggcagcccaaggaaggcgcgatggccgccgggcccggccctgcaatgcctggtctctggctcggcgggtccagctcacgctccctctcccattggcctgtgcactcctgccccctggtgggtacagggacaactacagtacatggggcagggtggggccagatggaggtttttccctgcaactggaggactgggtttgtgtgtgtgtgtgcgtgcgcgtgcatgtctgcagactcacacttcacttggcctaaaagattagagatggaggaaagctctgaatgatccaaagcagctcctcaaatggaaggggttattattataattactatgattattgttatcaagattatcatgcttgcctagaaagtcttgtacaaagcaggcttattttgtgtcagcttgttgtttgtgtctgaggcatttcatctttgcttataataactaacattggcaggcttctttcatgttgcaaagctgtgtcacatcctcaccccgttttatctgcacaaacagccctgtgcagtggggagtagtgagagaacagaggctcagaggttcagtgttctgtccaaggtcacatggctaaaaagatgcagaagccaggatttgaacttgggtcacacaatgaaaatccctgttcatttccccatcatatccttggcacctcatcccttgagagggaagaggccttttattaagctttagctccaagcctctttgccactgatatttgctgaaaagcttacattgccatgaagagaagggaagggttttgaagactcaagtgttaaaagtgcagtttaccatcccagtttcacacaaagaatatacctgggcttttccaagtccctgcagtacctggggtgtgagtggagaatgaggtcttctatccttttcgctcaggttctcttggtcaccaccaccacccctggggtgtggcacaggacagacaggcatctgctacatctctgagaagcgcggaagaaggtgctatgacaggagaagctggtgcagggggactgtctgtgtcctggtgggtaggagctgggtacacagggggcagggccctgactgggctctgggagcctacgcccctccttggagcatgggttctatctccagggaccagctggctgactggagagagctttctggaagcagcacccctacctgctgcgcaccatgggctgttatactgattgtcaccagggtgctgcttccccagcacactcgtgaccagccgccagcagcacatgtcctcgtggcaggacacagggcctgtgtgccaggataagggaccccctgtgtaatgccagttccggagcatcactaccctaccacctcccaggcatcctgctccccagcaacagcccaaagcaacccacttctggggggtacctgtaccatgctccccacccctctcaatgctggaatgtcccctgggccctgtctccacaggcctcttcctctccttgcccacccctttctccagctgctgacaggtgccatgcaaaggtttacatagggggttctctggagccttgagcttccccaaaagtgcctcatctccactgtggcagctttgagccatttatttgtcaacattaagagtgagatatcatttaaccagaaagattgtactggttactatgataaaaatatgttcatgctgtctttaaatcattgatgtggaaaagagtcctgtaggtggccttgagaaatgacaacctctcctggcctcctgatcctaaacccataagaatggcatctcgcttactgttagcattcagaaatatacagtcccagccatgccccatagaagagtcccatcctcctcccgtgtgcccaatcatcatgagggtgggcgggttgctcttatctctatgtggcagccctgggcagcctatgacgtggagccgtgtatactcgtccactgggtggacagcagcgcagcccacccctcagggccatccctgtgctaagtgccctccgtttgctcacacaacagccttgcagagaaaatgatggtgctgtcatccccattttgcaggtgagaacactgagcctcagaaagatgataccccttgctcaagctggaagctaaagctggagctcaggtctgggtagctcctgaatttacagtctgaagcccgcagaaagctgcatggagcagcactaaaagtccaaggagggagtgagcaaaggaagctggcagaggaggctcctcgaagggtgtggggtggcaagagaatcagatgttggattccatggtgggttccagcaggtgcggaatgatgaggtgggggcattctgggcccttaatgattacaaaacccatcccacctgcacctatacatccgaggaaatgcagtcaggttttccctcacacacacagcagagagccccctcccttcctctctgtagctgggccttagaaccactgtaactgggacagtggtgggaagagggacccactccttcatgcctcaggcagacatgcatgtccatgaactccttacaggactgcctgctactgaatcccccagactgcctttagtgtgcagcatgtatgtggccagtgctcacaacacagctagtgccataccagtcccatgggagagagaggggccacccacacaggaaacaccacacggcatgtgggcactgtgcacggggtgtggtcagatagtaagagaggagcgggctcagaagccaggaaagccagtggcgctgcaggaatgggagggggtcttcctgcaggaggtaggccacacattagccttggccgactagggggcataataggactatttggggtacaagtgcaaaaataaaccaaccaaacaaacaaacaacatatcctccaatggatttttaaaagcaggggattgattgactcaagtaactagaaagcccagaggtctctgtggctgcaggcgcagctggatccaggcgttgacatattatgactcaggtgcctccctctcagctctgctttcctcagtgttggctgcacactcagagggggcctccctttgagagcctctctttcctaatagctgctacaagtgtcctggggctggctgggactagagactgattgttagtctcatttgacaaatagggattctttgtccaccccagactcttcacaggccagtgagatgggttggccaagcccagagcatgtgtccacccctagaatcaggggagatttagctcaacgcagaccactcagactgggctggagaagggtgcttcacttctgggaactggggctctgctgccgtaaaacaagagaaaaaagccacaaaggcagagagggcagctgcccaggagaacaggactgggcagagaggagcgggcaggccttcactgccacctggtagcggtcactgctgtctctcctgcagaactgcctgggcgggagcacgcagtgagttttctaaagaagtcagctctagccgtctgccccgcgtaaaatactcacaggccagacctggtatcttcatccattcaggctaccatagcagaataccataagctgggtggcttatacacaacagaaatttatttctcacagttctggaagctgggaagttcaagatgaaggtgctggcagatcactatcaggtgggggctactttctcttagacggccccttcttgctgcgtcctcacgtggtggaaggggtgtgggtctttggggcctctcttataagggcactaacccccttcctgagagctccacctttaagacctaatcacctcccaaaggccccatctccgaacgccagcatcttgggggttaggatttcagcataggaatcttagggggacataaacaatcagactacagcacctggtgagtctgcccagagaacatgcatgtgttttgtcacatctcatatggcctgggcacccaggcacgctctgaccagcaagaaacagcagtgtgatggggccgtagcagaaagaatggtgctagaaaatacccaccacacacaacccataggcccaggaggagccttggatgggaaattcaggctcagcctgagccccgtcccccagacccctaaaagcaggcagacaaaggagcagggtctcccctggctctagtaattgcttgtgaagcccaccatccttttttttgtgctggcaaagcccttccttcccctcaggcctggcccttctatcttatgcatctcccttccctctgcttgggggctgggctgggtacccgttagttctcagcttgggcctcaggtggccaggccttgtctgagatgtgaagtccagagctgctggctgtggcacaagaggaggtcgactttgagtccaggctctccttactggcgatgtgatctttagcaagctccctcgcctaagcaggatacccacctgccgtaatcattaaatgagacacaaactgacaagagctggaggatagataggattgagtgagaaactggggccaagcctcatattaaaatgccaaggatccatacatcctgcagacgtggctgagcaccaactctctaccaagcacggtgtgaggcccaggtaccatgagaaatcaggaaacgatccctgccctgaggaccaggctcatacagcaccagctgtaccatggtgttgctgtgcgctgtgggagcagggaggtgggcttccctaaggaggtgacatttgagatagggtgggactgagaccagagtgatctggacagatggagcacccagcttatttggggaacaggagtaaggctgtatggctggagccccgtgagagggggcaagttggaggatgtcaggacagagaggcagtcaggggctttgtaggccccaaggagtctggaatgcgggaatgatgggcagctgttgaaaggaagagctatacccattatgattaagtttaactgaataccagaaactctggaaattatgccttaaataagatagaaattgatttaagtattaagaaaacacacactgaagatagtgtgaggatgacttcagatagtgtggagtctgatccttgacctaggctgtttttggatcactattccactatccctagggtgttgaccttgtcttcatgatcccatttagttgctagagctccagccatcacatccaagttccaggcattaggaaagagggaatgagagaaaaagggtgccccttacctttaaaacaacctttcctgaggccttacttcacttcagcttacctttctttgtgcagaatttgtcacatggtcacaactagctgtaagcaaaaaaaaaaaaaaaatccagccttttagttggatatcagtgtgcccaaccaaaaatttctggattctttttgtaaagaagaaggggagaattgatgttaataggaaactaatggtctccttctgtgtggggagcaggctgaagaggagaaggaccgaggcagggagcccatgggagggaaccatggaggcctggacttagaagtcggggaggagatgaggaggagcagacagctgaaagcagatctgaaagaagaactgcagggcactgggcatgggaaggactcagtgaaatcaagcaggtctcctggtctttgaatttgagcagttgagccaatgtggaagacaggagagagcgggaagggcggggggccagggggtgttgctgccagcacaggacccctccccgtcccacaacaggaaggcctagacccctgggctatctgctggagaatcccaggaaatcatttatcccagatgtccccaaactgtagaatgcatcctactggagtgggacccattaaattccaggccacacatggaagctcaaacatgggagcacagtagctttgtggcctcggtttgtaaatcacaccgtcttgagtgtcctcctacaaagcctgttgtggctccagggcccccacattagcgtgtgatcctcaggtccagggaaggtcttgcctcgcaggcgtccccaaccctgctctcaggtcctgacttgttctgactcaggtgctccacagatctacagaaaccatgaaggtagggcccaaagaaggaagagttggaaaactcttgccaggtccaccacccgcattcctcagatgggaaagtaccccaagattgcccgaggtcagccaggcgtgaggagcaggatcgctgcaggtccctgactcataggccttgcactgtttttagccccaggtggaggcgccacccctgctcacccacctgctgctgccctgagtcatccctgcctgcctggggcacccaaagcccaggccccagggctggctttccaggtcactgctgccaggggggcccggacagccttcatgcccagtgagggcgaagtcagaccccacgggctgggttgttggcgatactgacccttggatgctgggtcaggtcagcatggggacttggccttccagcctctgcaccattgtagcttccttcccaggacaggcaatgggaggggcacagcttccagaactttctcactgcccttctgcagtggacaggctctgacatgtaaatagcactttagctggacagctcaattctggaagagctttggcctcacacttcttttgtacagacctttcgttggcgacaaaacttccagatgctgacctcattttctttgtgtctctcccatccccaaggatgcctgcagactttcagtacctcccactcacttctagagccacgtgccatgggctgggcagtcagtctctctcctccggcctaatcagagggttgggagttgaaggggtttgcggcagaaaaattatctaataataatactgcatgcagctgggcgctgtggctcacgcctgtaatcccaacactttgggaggccaaggcgggtggatcacctgaggttgggagttcgagaccagcctgaccaacatggagaaaccccatctctactaaaagtacaaaattagccgggcgtggtggcacatgcctgtaatcccagctactcaggaggttaagccaggagaatctcttgaacccaggaggcggaggttgtggtgagctgagatcatgccactgcattccagcctgggcaacaagagcaaaactccatctcaaattaataataataataataatgcacacatgaataaaatatcccaattctggagagcccgtgaaatcggggagatggtaggcctggtgtatgcgactctcagaccccagtggggtctcagtctctgttgggctccaggactcgtgcggtctgaaaccagggggaaggcggctggaggaaggaccccagctccctgcctccacctcctccagtgctgagcatcttgtcttgggcctggtagtagtcagggtctctgtgagtgcaagtggcagaaactaacgggatagggctcacaggacaggtcacatgaagggtaaagggacccagccttggggacctaaataccatgacacttccctgcttctttctggtagctttattctgagagtcttcttcatgggttgggggacgcttgtctcagtgatactagcgactctggggccacattctcctaagcttcccactttgaaaaatcccagggaaagactacaggtggcccagcatggtcacatgctcaccagccacctcctccactcatcgaccctcttccttgccttggcatcccacacctggttcccagggcctggcatggactggaagctggcctgggctccacaggactcagggtccagcacactcctgtcctggccctgtgttcccagccatgcctcttcctgtcgctgggacatctcgcagtgccactctgctggtgcacaccctgaggcgtggtgccccaggcgggcagtagtcactaggcaggggtgttctcaggacctgctaggattcagccaggaatagaggggccactcggatggtggttaccttgcattttggttaggagagtggtctgagcaaagtcctgtcagccacagagacatgtgaagagcaagaagacagggtatgtctggtgcctgggctgagacaggggcttgctgtcctcaagacagcttctagaggtttaggttcctttagaagcttatctgagaaaaggatttgggtgagacaaggagtttatttgggaggtcatttcaggaagcaccgaggaagtggggaagccacacaggaagggagggaagccatgaaggggagctcatgggtggcctgccacgttggctgctggggctccatcccatggggatcctgtctgaatgtgtagcttgtctcagaattgcctccctgggagggcaaggaagccgggttatttgcccattcctgtctgtccggggcaccgactcaaactgcagccagctatacacctgaggcagtgagctccatgggcagaggcaggagggcggcccggggcagcacctgctctgctctcacctactctgcgttggacattaaaggctgtggctgcctcagacggagcacatatcttcctgggcaaggccacttcagctgtggtctagacccctctaccaggccctgtcagccgtccagggagctctcggcacaggtgggtctgatcatagaggctgggcctggagtccgaaggcacctcatcttgagtcccacccctgccactcaccatcgggttgttaagtgagtgccttcctctctgtggccctcaatttccccactatgaagtggagatggtaatactacagcaactgctgtattagctgtgccacagcaatgctgtctactgagcctctcctaaacccagccacttagttctgcagatcagagacccagggcaggctccactctgtaccaggctccccgagtcctcttcccaggatgaatgacagagcccgggcgtattcatggcgatggcagggcccacgaggaccagcagaaacacggcctctcaaggagctggcacagtgccactgctgcaccattctgtgggccacggcgagtcctgtgccatactcaacatcaagcagacaggacatatactcagcctttagcaggaggagctgaagaggcgcagggcaaagggtgtgggcagaggaggggtgaaaggcccaacgacacagctcttgccactcgctcctgaggtgggggaggttctgaggacggagtgtgttcaccaaatcctttgtacgctaagtactactcccgtgtgcaaggtggcggtgacggtgcagtcctgggatgtctgcaggagccttcttatcttcaaagaccaccacactcctggttgtgatgttacatgcatgtgattgtagtctttgaaaaggcgaccccactttggtatccaggatgaggggaaggggaagaaacctgttaattatgcagtactttttctgtaatttcaagaaggctcagcctacacgtgtgcaccttaagcaaattcatctacacccactcagacaaggaggaagggaggaggcagaggaggagagtgctccaagctcattacctgtcctttcccatttccatgtttcacctgacctaggagcttcccctgcccccagagaaaggtaggccccaggtcacaaacaaatcaagaaaaattaataaaatggacttttggctttgagcagtccaagggccaaagttcttgagatttagtgttggcatgagatatttttgccatctgcactaacttggcaaccagcccctcccctcccccagtcctgaggcacagccccgctgtggcccatccctcagctaaccggaattctctaccgaaacgtctgctcctctacatagcccagttctagggactgcattccaccctgtgtaagaagtatagaaaattacagctcagccaagaacattgatttttttctcccccgaacaaaataaccgagttttcaggatgaaagcagagctgctggttgagttggagggtggagagcagagccaggcccactctgccttcctgctggttgagttggagagtggagaacagagccgggcccactctcccttcctgccccagaaaactctggggccccatgggctgcagcttggagctcctgctttaggacatccatgtggtagaaggccccacgggccccaggaaccccaactgtgcatgctcaggtcgtggccctccctggagcaggctgtgggctgagctgcggtcctgctgcactggctgggctctcatcacagtccccgctaggggagagcccttggctggcagaggtcttctgtccccaccaaagcgtcaaagcccaccatccacctctcctcacaggctgacgccaagatggtgtgtgatgtggtgagtcggatggaagacaccgagcccttctctgcagagctgctttctgccatgatgcggctctggggcgactcaggaatccaagagtgcttcaaccggtcccgggagtatcagctcaacgactctgccaaatagtgagtgtcccagcgggcgcatggcctggagccgggcagtgatgcgggagtggaagggactggtgatggggattggcagagcaaggaggattctcggctgaggtcacgcctgccgggagatgttctcccataggtagagggtgtcaggaaggaatgagaaggggcctctcttcctgcaccccaggaggagaaagaggccagaggaggcagaggacgcaagagacaaccaaacagtggaaattcccagagggccgggaccttgtcactggcttgtcctggagagtgcctggcactgcaaaaagacagctttcaagtgtagcagctttgtttttttatagggagcccctgaccgcataaatacaaaccaaaacaacagccatataggcagaaaagaaatggtgccattttgttttattttagaaaaaataataagctttccattccccatctttaaaattaagaataaggaatatgtaagtctaattaatataataaatgtatactttaatactatttataactaaataagggggatgacaggagggcaggaggacggaaggaagaaaggaaggggagagagggagaaagaagaggacagaagagaagacggagaggtgggaagtggtaaaagctggagctggttagaaggtgctcccggctcttcccatcacagcaggtcacaggtccactggctgcagctttatcactctaggcatctccaaggacatcctcactgcttccgtgcccttggcctctagattggaggctccagagccctgggatggtcagcgttggtcagggacatgtcttctgtcatggagatactgggattgcccccttggctttcgggaaatgcaccccacctttgcaattgcaatctggtacccatacattcagtgggggctttctgcaaggagcccttgagctttatcccactagctgggaagattctgacatgatccagtccagccattttcaccaggtctcagctggggcctttttgcctccaggggacattcagcaacatcgggagacatttttgatggctgcagctagagtggtgctcccggcagctagcaggtagaggccagagatgctgttaaacaccccatagtgtgcaggacggcccccacaacaaagagttacgtggccccaaacatccatagtgccaagattaagaaaccctgatctacgcaatgccaatggacagaggctgaggccaatgttcactcctggacatttccacgggccacatggcagccaacagactagggacttgagcaaggccgggagcggcttcccatttctgcacacctagattgtccagagggcaaatgccgaagtcctgtgagtcccaggtgatgactacctaggcccccgggcctgatgagctcccagggacaccctggtggtcagggcagtgagcccagaagctcagtgtccaccattccgtatgcacaaatcacagaccagagctaggcaggagagagtgactttcagctgccctcctcccttcttccactccctgtccctgccctggagtccagggcctcctccccgagggccagcaagaccctcaagggcctttagggccagctggcccaaatctgtcttctagtggctcagcaaattctgctctccacttacatttttacccatttcactaattataacatgaatccattaccaaaaaaaaattaaacaaatgcagagggatgtaaaatgagaagtaatcttcctactccccccaccagccctgcccctcccacttttacccacttccatttatttgtcccagtggcatccagaaaaacttgatcctctgactcaaaatagtatttactgccacccactctggaatcgagggagctcagctcaccttccttccttccatcgctctccaccttcacctccggctttttgctagttacaggattatttttagttcttccggtgcttacctttataactttaaataagaaacttgagtcagtatttgtcaactccccaccaagtaagctgaggaaattctcctccctgcagcctcatctctgccttctttcaaattttccacttcccaggttgatgatgttaccattctcttctgtcactgtggctgggccttccgtgtctcccctctgggagagggcaggaaagacaggggacacacaggtggccagggccggaagggcctggcacatttcctgtcttagcagttagacctcagcttctgacaaagtcttgggcccagtatagaaagcagatcagagtaggtttgttgtgctggaaaggagagggaggactcacagggctgccacagcacgtgcttccagggggtgccattgacaccctaatgccccaaccaccaaagcacttctctgcccagccctttacaggggagggaccagggcacaggctcctgagcaggctcttggtgcaccccggcctctgtgaacagggctggctctcccttctggataactacctagaggcaggtcccagaaaccctgggcacatccaaccaggggctgtgaaaggtgctctggggcctggttggcattggctttcctcaaatccagttccccactgagttgtccatgctggcgtccgacgtttcctctcctcaccttctctcttgaccccactcctatcgagctcttgctcctccgcctgctgagatggctcatagcccagtcctatcctgggggctgctccatcagcctcctcccactcagggttcagggttcagtcccctagtacctggtacctcctttcactcccagcccccgcctcctctcgggccgccctttccagactccctcgatgcctcctgcccacccacccaggcaactggtgatgggggaggtctgctgggggctgctgtatcccgtccccaagctccatcccagaagcacctcctctcaaggcctggtgcctggtgaccttctcctgtctcgttttaaacaccttgtacacttggacaactctcaaattcatatcgccagcccagccctccctcctgacttctgcctactcagtgcctgtttggacatcaaatgagtctcaagttaacatgagcccgtggaacccctggctcccatcctcccactagaagctgctctgtgtgctcctccctccctctaaatgtgtctcattccaccacgtggaggtatctctacttctgctcgtcctcctgtatcccacaccgaggccaccagcagatgcagctcccctggcaggtacatcagattctgaccactcacaccctccacagccacccccactgtgccagtgccatctggtgacgacagcagctctgcaggccccacccgctgacctgctctcatggcagcaacagggccgttgtcaacatgcttctggccagaaccctcgaggggctcccatctcactcagagcaaaagctcaagccctgacaatgacctcaagggcctgcttgccccagccggactctggccaccctcacctccaccaccttccccagcctcacccaccacctggcccctccacgtgtgcttcctgccgccatgcctgccagtgtttccactgggccactcgaggcccacttgctccctcattcccctcagtctcccctatccagacgccttccccaaccaccctgcatcaaatagcagcccccagcagctctcccccatcactaatagcctgattcgttctctcacactacctcctgacatatcatctctctgactcttctgtttaccacctcacacacgtgtgcacactcacttggaacacaggccctgggaaggtggggctgtgtcgactgccccatccccagctcctggaacagtggctaggtgggatggacagcaggtgcacagtcagccttcccgactgggttgttaagcagttctcccacaccttgcccaccctccacagccgtctccttgcatgaggctcggccagcacagagaggccagagggccaggttgcccatctaaaggaggtttgccctggctgggaaaggaagagcaggaccaaacgcttccaggctggtgtccagctgcagatgacagcagagggcgtcctcacagcttggaagcagaggtcatgggcgccagggcggggcaggcacagaggcttgggagaggctccttctggctgagaccagagcctgcccagatgccactggctggcgaggaggctgtgaggccgggggcgtgtacaggtctgctctgcagcctcggctctctcaccccatccccacaccgttcctgtccacggagggcagtcaggctcaggagaggaggccaggagtcctgtttaaattttttttctggatttttaaaatgctgatgatgtccagtttaagagcgtggggtctggagccagtcagaactgggctggaatcccagccaagtgcattttctttttttcttttttttttttttctccccgagacagagtcttgctctgtcacccaggctggagtacagtggcacgatctcaactcactgcaacctccgcctcctgggttgaagcgattctcctgcctcagcctcctgagtgctgggattataggcacctgccaccaggcccagctaatttttgcatttttagtagagatggggtttcaccatgttggccaggatggtctcaaaatcctgacctcatgatccgcccaccttggcctcccaaagtgctgggattacaggcgtgagccaccgcacccggctgccaagttcattttctcgcagtgtgacttcaagcttacctccctgagccttggaagccacccttctgttttcttttcttaggggcattctcacaaggattgtcactgggttctatcagtgaacaccctagctggcgaagtcatctgccctttccagccctgtggacatccatgagctggtcagcatgcccatctctcatgcagtggtaactgcaggtccagccagcaagctggcccccagcaggtcctggagcagatgcagcctgggaccccacatcgttctgtggttcagacacttggggctcctccctgtgggctgcttgtggtttgccccggcagcagggatgggtggcctggcaggctccatggatcactgagtcttccttcaggcctggcccagctccccacttcctgatttcccagatcctaccctggctttaggttcaaacttaacccacaatgaaccccaaagcccttgcaggcagcgtcctctgagtgcttggcctgaggcctgggcaggtgacttgcaaaagcctggtctgtccccacagcaggaggtagcaggggtaaagagccctgattccaaagaccgggtcccagggaggcccagccgctgtatggctgtgcagccctgagcctccaagagcatcaaattggaaggggcacacagaccccttggtaagtgagaaggaagtgtggagaaggcagggaactgctcaggggccgctgaagccccagacagtaataaaattatggcctctggagccaagggtccgggtcacagcctcaggcaaggtacttaccttcgatgagccccagttttagtacatttaactcagggaaattacacatgaaacatggttacacatgcaaagaatagaacctatctgttggccattattatcttttaaatgaaaaaatgacaaaacagtattataataaacatggtagtctcatataaaagcttgatcttgtctgagtgtcccgggagctgcatgcgtagcccttttggctgtgaatgagtgcgtgaggccaagacccctaagacccacttcctcagtcgcccccactccctatggcctggaatggaggtgatgtcttttccacagtgacctggaggggccctgaccgagactggactctgaagatgggtggcctggccagtcccgaacagtgtccaggcatttggtccatagtcccctgtttgttgccatcctcagctacctggacagcctggatcggattggggccgccgactaccagcccaccgagcaggacatcctccgaaccagggtcaaaaccactggcatcgtagaaacccacttcacattcaagaacctccacttcaggtgaggcccagagaggcccccaggccctggcgagggctaagatgggacatgcccagcctctcagcgcattgcgtttacagcgcccaaacatcatcctgccccagggaacctgcgggctggggcaggcagctagatactagaaggaacctgtctgtgtttctgccaaggttaggggctggagtgagcagggaggctttctggaagaagattcccagagtggggctgtgaggaacagggaggatttggacaaggaggggcagcctgtccctgaggtgacttccaaggaggaggaggaggtgggctaccagggggcccttccaaggtcaccttggggggaggagccaagagtggggctgggtaagcccaagctacctctgtgagaccctgaggacccaagtaatcccagagctggaaggagcagagagagctgacccaccctctcctagtacgcttgggaagctgaggcctgacaagagcagggcttttcccaggcacagagcacagctagaacccaggggctctggggcctcagagcaggggcctgacgggtgagctggttcccagggtcctgctgcagcgctgtgtccccacctgcagtaacatgcgtgcactgaggcctgctccgtcctgtggggaagagaggccagcagagaaggggagggcagggacccctgctgggagagctggattctaatattccctgcctcccatgtccccaactcctgcccgctcctgttcagactgaggggccgaggctctgggcccaggaacccctaggcctccgcagatctggggagcaaaaccttgggcagagcagccctgaggggcctctcttgccttcccaggctccttggtctctcctgctcccccactgggagcacaggatggggatctcagctcaacccagcccagcaaggcggggtctgagaataagcattctggaggggccacagaggccatctgccaacgcccctgcatttcagatggggaggtgggatccaggggaggatcccctgattgatggaatgagaaccagacccattccttgctctgagcccacactaatctctgcctgcagtcactccgttgtgtccggtgggaccagagatccttccctgtccccctctggcaggctgtgtgtcagcaggcatcccagatctaggaggctacaggactcctcgctctggggattggggtgggagactgaccttttacttccaggacgtaagtcccacctgcccacagtctcttccagaatttttgtgccccctcgggagtagagtctgagagggggaagaggccaggctctgatctgccagaaaggggccgtactgggcagaggtgagagcgccagctttgtccacagccagacccagctccaccacagctggactctcgccagcttgggcatgtcctaagcccatgggtggctcacttctgccatccacataacaggtgacatctcctgcctgcctccctcccaggctggtttggagtttgcccagagcaaacccaggaaggaatagactgagaggagggtcctcatgcgaggaggactctcagaggcacttcctgggggtggctcaggtgcgccctcttagtaaaatgctcctcagatgcaagggcaggtctttgagtcatgatctgtgagcacagccagtcccaggacagactccaggggtagtgcctggggatggcagtgatccagctgtctgtcatcacctggagtgacaaggtcttctagtgagggcttttagcaaggctctgagcaccatggcccccatcctctgcctctcagcgtgctcacagcttaatccccaggcagccctcacctgcctggaccctgcgcctaccagctccctgcctcctacaggctgtttgacgtcggaggccagcgatctgaacgcaagaagtggatccattgcttcgaggacgtcacggccatcattttctgtgtcgcgctcagcggctatgaccaggtgctccacgaagacgaaaccacggtgagtggcctgggccccccgggcagggggcagcgctgaggagacggccgcaggataggccagccctctgagcactgggcctcgggtgcccacaatggctctggggtccagccagctgttgtggttagaggtttccatcatggacaggccgtgccggcactccaccaattctgtattgccaaggcaaatgcctcatgatgccagtgtggcagagcctgtgtatgcaacctgatcacacagagccgtgcagaatgtgcctcttccataaacttggtggagtcacagaggccatcaggccatagcaaatttaagcaaaccctaaaaaaaccaggaggcagccaagcaagaatgtacaggcaacagaaatagcagtcttagcctgacagccatccctggggcactggcgtcagatgctgctgaagcagcatggggccggggatgctgagggagaggtggggagggcccaggatgctgcaggagagttgcgtggggttgggggtgctggggagcagtgtgtggggctgatgggccaggaagggcaatggggatgaggcatgctggtgagtgacagtcgtggctctgggctcctttgccaaatgccagaccaggctcctaccttctgtcttgcgtcacattcagcctagggcctcagtgaggggacattcccctgggagagtgcagccttcctctgggtctagtcctggctctgctactcactggcttgctgctgaatttaggcagcaccctttctggctcagttactattttccataaaagggagataataatagtacctgcctgtggggggctgttggcagtggggtgggtgatgcgtgtgcagcgctctggagctgtttctgggacagcagcgccaagctggtggttgtacagttgctggtgattgccctgagcctgcaggtccactgcgtggtccccttctgggctgcagcccgccaggcaccgagcatggcccacagggtcactggagacaagccccaacactcctgacagcggggcccataggctatggggtcacagcctggcgtctgtcatctccttctgtctggaacacatgcaaatcccccaccccacgcctctgaaggctggcaccgagggtttgaggttggaggtggggcttgttgtcatgctgggccttgagcgaggcctgtcctctctctgggtctgtttcctcgtcatttctggcccagctggtccactgggctttgtgaggatgggatcaactttggggtgtgggctacggggcacagtgctatagggaggaggagccgccgccctgaggggcttacacagagtgatggggctttgggctggtggtgtgggtagtctggacccgttccgtgtacaggcttacccacctgactcttcctatttcaggcccacctgtacccctgacttgggtttctgctgtaattgttctcaatggcatctgcaggcagtgatgtcagtcaccagcccagtcttgatgctgagtggggcaagggtggatgcgcttcctgggccgtgcttggacccagactcactgaccacccaaagcccaggtcagcttcctggccatgtgcccctcacagtgactacccagacatttcccactccccactgctagactctatgctattacggccactgctccaactcctggggtctgagctccacttggctcatcttttttcccccatgtccaccacggtttcaaagagagcaaaggagctagaagcaggaagccaggagggcccttccccctggaatccagcctctccctggacctgccctgccaggcctgtggatggcttcaacccaagtcccaggcccaccggccatggggctgggctctcgctcacctctggaagatggaagcaagggacgtctgggtgagcctagcagccacaggccctgagctctgcagcccatgggtccccagtgagcatgagcctggtgctgggcctggcactgggtgaccttccagcctgcgggccttgctgcctggagcacttgccctccggtcttctccaccttctctcacctccctttttccccatttcccccacccttccacacaagggctggagcagaggaccttggagaagccaaagcaaatggagccaaggtcacaggcaggctcttcctgtgtccttccttccccaaggctggccacctttgcagcccggggaagagtagcagctcgtgcagggaatggggatgactttgcaacctgacagcagccacaaaggcagctcattgccgtggtggcagcaagaacaatactggcgctgtagaactaagcagtcatcgccgtgcgctgggggcgcatgcagaggtggacagcttgggagtcagacagatctggtccagggtctagcatcacccctgccgcctgtgtgatcatgggcaaccgccccaccctgcccgggcctgcacctcctcctctgtagatggtgacaatggtagaatggaccaccgggctaaaagctgtaaaagtgcctgtacacaggaatcatcactcagtgaatagctcctgtggctacaacattcagatgccatggctagaggtcaggttctaggatgtgggagctctgtctgcctcagggaggcaagagccaggccccaggaactcaggccttggtcctcagccatcctctctggtcagcgctgtgcatccctctctggcctggggtgagagcctgcaacaaaggtgtctggaagcagcttctggagccaggccaggagagccctggggctagtggctgccactggccatccagccgccctgtccgctgcatcccgggagcccgagagcctggtcctggcctcgtacctgctctcagcaccgcccagccgggcctgcggctgccacagcttctccactaccacggtcgcctccactgcctgcagggccttatcttgccaaaccaaggccaaaaccagttctgagagaccctccaagcccggaaggtatgaagcacctccctccaactgaatccatcagctaagagttgaaagcagcaggttctcagggcaccgctgggtgactttgctgtgatgcctgcccagcccgcccctgcgcccacactcctctccagccacttggcctgggctcatcccacccatcctgcatctcttgccctgcaatccacaggcccaggatggccatggcccctgtgagcccgcaccgggctctctgcaggagctagccaggatgccctggccctgagactggttgaaccaatttttcagtatttttctctctttctcttgttgggtttttatcttctctgttttcatctgttttgctgtgtttcatcttggggttcctctggcccctctactgagaaaccagccccaacaaccagttctcccagagcctcccccgctccagcccaccaacgagaccaccaaccacaccaaggccacagcaagctcacccccgagacgctattccctggtgtctgcttccaactcgggattaattcgaggatctcttagtcctcagttaatgtttcccaactgaatgcgtgcacccttccaaccttgctgtcaaaaccgaatgagaccctggtagagaaatctgcatgagcagggttccgcgcagatgcgttcggtggtggttgcggcccctgcgctgtacgtgcatggtgcatgtcctctccgtgagctggagcctctccagtgacctcactgcccccacctggggccagctctctttggaagggggcagcatcccccaaccctgcccggccctgctccgccccgccctgcctgcgtgtggaatgaaacaggaccacgtcccgtctgtccttgtgggtcctcccgtctccgtcctggtggtctccgtcccggtggtgcatccagccacattggtggaccttccctttgcttgtcccgctgtgtcattggccgcggtgggtcagggccctggatgctgccgcccctcactcacccctccactctgttgcagaaccgcatgcacgaatccctgaagctttttgacagcatctgcaacaacaaatggttcacagacacgtccatcatcctgtttcttaacaagaaggacatatttgaagagaagatcaagaagtccccgctcaccatctgctttcctgaatatacaggtagagacccctccagggacagcaggcccccgagggagcgggccccgttcccaaagcccagtccacccttcctgtgctctgtggatgcccctgactctgccacagagaatccacacaaacggtcccccaccctgcccccagattgtgctctagagaggaggggcagctagccggggcttcctcatcagggaaagccggtagagccctggctctgccacttacgagctgtgtgaccatggcggcctctgggagcctgagctccactgtctgcgcacaggggctctctgtgacgagacgagcaaacgccgagaagatgaggggcggggcacagaggcttggagttaggcagcccaaggtttatgccccagctccgccactcacaagcagctcaggcaggtcatgcagcctctctgaacctcagtctctgggtctgtgagatggggtgatggctgtgattgccctcgcctccctcaccaggtgctatgaagagggaatgagctgatgggcacgcagagcttcgcgtggtgccgcacataggaagcgctccctgcctgtctgctcttgcctttagggttatgcctgtaactcacacggggctgctgcaagactcaaatcacagagctttgcaagcagcagagccctggccccctatatagggtgctggggatgagaggccagccctgccagtgctgtggtgggtttacctgaccatggggtgggcgggcagccaggagggcagcatgaccagggcccctgaggagctgcaggttggcagctctggtcagtgacaccagagcggttacagggccccagcatagctcgggtgcccatcagctcttctgagatggccagaccctgtccagagaagtgagtgggaggagaagtggggcaccctcagcccgacctgccctgaggccttggagggcacagagcaggggcagacagagtcccagtggggcatcccgggggcttggggccaggcaagcagcacagctctcctacctcctgcctccgcccatccccccatatcaggctgagtgcctggcaggccaggacccaggcatgtccagctggagttgagtagggctcagcctccctggaagctcccagccagcttcctctctagccatagttgagggcctgtggatcctgccctagtgacccgggcttgtggcctgtggggcagtggaaacaggtggggtcggtcagttaccaaggccagtgtgggcctggagtggggaaggaggaggggacaagggaggctgagtagtcagctgcagtcctaggacactccccaacctccagcccagattgagcaaagagctgaggtctggcaggccctccaggctttctgcacagcagcccactccagcttagagctgcggctctgaactccagctcccctccctgctgccccctccacagccctgcttgcacctggcatggattcctggaggctgagggccttcagtgcaaagctggggtcctgttcttctgccccttcccaaactagaagcttctctcctagactctcctctccctgagcctacctgagaaccagctcagtgtgttgccccctgaggaaggcagcatgtgagccaggcggttgttaatcccctgtgagtggacagcagaaacaagaagtttataggcttcttctcccatctggcccagcagtggccacaggaggtgatatcaaggcctgctctgtggactcccaaaggaaaaggcccacccacagggtgtgcatcgaccagggctacctgcatgagcccagtgccctcaaacttccttgctcatgacccatgataagatataacatttgccttaggagtccataaatggctgggcatggtggctcacacctgtaatcccagcactttgggaggccgaggagggtgggtcgcctgaggtcaggagttcgagaacagcctggccaacatggcgaaaacccatctctactaaaaatgcaaaaattagtggggcgtggcagcacgcacctataatcccagctacttgagaatcacttgaacctgggagtcggaggttgcggtgagctgagatcacaccactgcactccagcctgggcgacagaacaagactccatctccaaaaaaaaaaacaaacaaaaaagaaaaacaaaaagaggagtccataaatgcatgtataaaaggaaaatggaagtttcacaaaacgtgctccttttaatacaggtgattggccgggcacaatggctcacgcctataatcccagcactttgggaggctgagatgagaggatcacttgagcttaggaattcaggaccagcctggccaacatagtgagatcccatctgtattaaaaataataataataataataataagccaggtgtggtttccagctactcaggaggctgagaagagagtattagtcacttgagcccaggaggtagaggctgcagtgagccctgatcgtaccaccacactccagcttgagcaacagagcaagaccctatctcaaaaaaaaaaaaaaaagataaatacaagtgatatactgggagacctgatattttgtatctttcatgacttttacactggatctgtcccactgactggatccaggaccccctattaactttgctgacccctcaggtcccctccatcaggttttccctgtgcagttgtctctgagaggcccaaggccggatggccacacaggccaggctggggtcgtccatgccaagcagtcccatgggcctctcgcctcaccacaccttgcctgtttgctctgcaggccccagcgccttcacagaagccgtggcttacatccaggcccagtacgagagcaagaacaagtcagcccacaaagagatctacacccacgtcacctgcgccacggacaccaacaacatccagtttgtctttgatgctgtgacggacgtcatcatcgccaaaaacctgcggggctgtggactctactgagcccagccgccctgcccggcacccttgccctgcctggcctgccgccccccctcccctggaaccaggctccaccactctcagaccactctttgcacttgaggaagaagacctcagaggctggcaccaagggagggaggagggagcatcctccacccgcaccccccaacagaacttgtggtaacgcaggggcggggcggggctgctgagtgcatgctgcaaggccaggagactccacgctcacagcctctgtgtcatctctgagtgcttgatcgggaagctggggggacagggcagggcccagatgggcacaccctgcacctgatgactcactggaagcctcggagtgtcctcctgtcatcttgggtggtgcaggggcgcagatggccctgcagcagggtgctggcagggtggggtcataggagccatccttcagctttgcctggggtctctggtggagggcagttccgtcaacaaaagccagggtgggatcaggccaacttggtgtgggttggaggactcaggccttggcgatggcctccgtctccctgctccctcccctgggtctcagcccttccttctctgggtcatcctcccttgcctttgctctcccagagaactcccatccctgactcctccgagttctggaaatgcttcttgagactgatttatggctcagatagatggtggcgtggagcggggggagggagagatgggaggtgcggggaagggaggtggaagctcctgtgtcacctgggctggggcctcccgcccagtcctcgcaggccaaagggtgacccatttcttttttccagtcaccaggagctcggatggtcactctgaggtgtgaatagatatgtttttccttcagtccacactgaattcaactcaaaccagcaaaggcctttgggctggggattctgtggttgcagaggtctagagggggtggacttttgcagccagtgcctccgcctcaccgtcttggtgaagaaatcagcgagtttgttcacagccgttggtgtcttcccagcccctggggacagaggacagcagggggatggagctgacaccctggagtatttggacccaggccagcacaaacacacccccctgtccccaactctaaagggagagtcctaggactccttagaggaggcttcactgcggagatccctgagcagaagggggcggggtagcttctcccggtgacggtgacgcaggtctggctggccttgggcaaccaacacacctctcccactccaagatgcctccaggtggctgaggccaacgcccacacccaggccagtcgtgtgcttgtacagcaggctgtgcctggggacctagatgtgccatgggagggaggagggtacccactgacaggcctctgcctccctcctcaagccctctgttctccctgcccccactctggacactgcttagtccccagccaggcagggcccctgggtttccacttgcagcccccggactgccccagagccgggaagcaccagtgccaacagctctggacttgttggacccacaggcacagagctctgagtggtgcccaggagacccaggaaccttccctagtgccaaatgcctgcagggaccggtgcctggggagcctctggcagccggactgcaggagccaccccatcagcccaagtccacctctgttttgttcacctcggtcatgttttggaccttgcaccaggtgctgggacgtggcagaggacaggccctgggaaccaacagtgtcctaccatggacagccagggccagctaagctaagccatcccgcccaacacagaagacatggcagttatttctcagcagcaccacgctgggtgaggccagttgttccgcttactctgctccgaactgtaaccccaggctcagaagcagccggcaaaagggggatgctggccacgccccacctctaaggccatcaccctggaggtggaagtcactgggctggagggctctccatgtcccccagcagccgccctcagaacacagtggccagagcaccaggctgggtccaggcctccaatccaggccttccctgtccctagaactggggctggaggagtgggtgctcagcccttcctgccctccatccccagcctgcctttctcttcctttggatgctccatcctccttggtttcttgcactgctctcaatcctcccaccctagcctgggggtggtccttggtcctcaggggtatccggggagaaattctctccctgtgcatgacacctgtcatccatgtcgtaaccagcggctccatcttgtggggtggtgactgagggtgacaaatgagatttggctccgtcgtggatgtggatgtgggaggaatgttgcgagtgacacgtgtgggtttctaatccacagtggtcctgcgtgtgccctgaggggccatggtaacctctccgatggctcggatttagcaggccaagcagaaactgatttctacgaagagcgtctttgccaaactcatgaaaattgtgcctgccactttcatgcctatgggccagttttgtgacctgcgccgctgaccatcctaagaaccaggtcttggccttccctctgagcactgatagaggtccccaaggctctctggcctgaggagggtgtggggtctgcccagccccaagcagagagcacagtctgggcccctgaccaacagctttggcattctgggttccatggggaccctagagctcaggcacaagaacaacaccatacctgctgccaggacgcagctgtctcccaggccctccccacagcccagctcccactggcaggaactggacacatccctgccctccatggtctgcactggtcttctctgagtattcttaggagcagaggcagccccaagttccaacttgcaagccctgtaactaagctgtctataaaccccagcagggaaggccaagggatggtctcacccatgcccttccctttggccaacatgagtcctgcagtggggagcttagcccctgctcccacctaacactctacagttagcacccaggggttgattcaggaagttcttcctttttctagcctgcatccttcctggccaccccctttatttctcagtctgacctggtgcactcttggcaagtgagtccattgcagtcccaggtggatatttaatgagcactcggactgtttcctccaagtcagctagtggcctgccctcctccttttcaagaagtctggggcacagagcctcctctggctgcctcttctcttctctgagcctctgggagccttcaggcaaaacctggcagttctcaggaacccagacctgaggctccagctccgcggccaccagagattcagtgtgcagtgccgaaggcagtcacccccaggcagttcctgctgtcaggccgcaagcctagagcgcaggatcccagcagcccagggaacagggccggcgtgtgagctgctgccgtggggtctgtggtagggctccccatctcccacccctcagcaagaagagtcctgacccctgaccccaccctgcccagagaggagctggggcctccagacagaccccactgcagccagatgaaggcccctgtcaaagaaggggcaggctgggggaaaagcagaaagaatggcccccagtccaaactcctggatcccctccatgagagaggggctccccctggaacagaagctctcatccccaggcccagtgcacaagaccaccagcagagacccaccgcccttcctggcagagcaccacttcctggcagtgcagctccgaggcaccactactgtcctccccttccctccccacccctcccctccctttccctcctctcccctcccctccacacctgccctgttactcccacagctctgggcagccaggccctcccctcctgcctcctggtcttctctactccgctggttctgacccatcccctggctctgcccgccgtcccccaccctgcccctgctgagtatcttcttcctccccacgcacccccctcccccatctaggcgaggtgggctcgggcgtcccaggccctccttagaaaagccgtctctctcgagtgcagtggtcccacctcccaaccccatcactgctgcccaccccatattaactgtaattttgtaagaagagtgacttgttggtttaataaatctctagttattgtaataatttattggctgccataatgtatttattagtcgcctaccgttaataaaaagtgcccgctttcctagcgtgagtgtgatgtgttgtcagggcccagggagctcctgccaggtgcacttgcacgatgtgtgtcctcgggccctgccccatcctggtcccaggactgctggcagcctggcagagtgggcacactcctgctggggacagaggatcagggcgactgggcgccctgcccccctgtcaggatcgccatctggtgggaagttgctccgttctgcgccgagccaccttcctgtcctggagagcttggtggccacctggacactgctgtgggtgacgtggcagtggccatggttgcgctggcactgcttcctgctgctcctgggcctccactgcagcctggggcaggtggaggtctagggggttggctgtcagccatctatgatctctgacttctttctcttttctcaaatggtggtatctcttctttgaatgtaccccggcgtctgcttcctctggggagcttgtaaggatgagctgtgctctcagctccttggcaatgggttccaggcagcgtgccgagggagggcagtcaggcctggggggctggcaggggtctcagtgccggcgcctcccctgccctgcaggatctcccctcctcactgccctccccgagtctccaggatcagccgccttttggggctccctccaaggccctctccccataaaaccaggtttggttatgcctgtcctctgctccccaagtcctcccctgcactgccactcctgggaccacagactgtgatcatctttctccagctggactctgagctctcggagagcaggagcctgatgtggtcattcttacatcctcggggcagcccagcagagagccctgcacacagatgccaggcagtactgactggaggagcgagtgtggtgtgagtcgtgctctgtggccctgagatgtaggggctgtggcgggggctcagccttaaccagtggaactgtggagcctaaatgagccggacttgatttctcctccacacctaagctcagtggccaagggggcacagtccccactcccagctcaggtcactctagtggctgctcctggcagtgcctgggaagatgtgcagtggaggagggagcttggctctggctgtgggtttccagctctctgttaggcagctgcaggccaaggtggctctgtggagtggggagcatgttcctgtggaatccttggggtctcagagcctcaccactctggcctcataatgtggctcaatgagcttgagtgtggacagcccgaggccctggacacaggttcactgggcctcccagaagcctccggctgcccttttctgaacagatcccagtgaggtggctcagggcaagcgagacctgctcctccccggagggatcacacagatgacagggaaatgctcctggggaatcagaatgaaatttactgattgaggataggagagtgatgagatcatatgagtttactgaatctgtttagcagaatgaaagggcagtgccgtgtactacagctcctggggggtggggaataacgccatgccagctgtccaggtgcccctgagaggcagctgagaacgctgccctccgccgaccaacttcagctaataggaaccaggggctggggctggccgcctctacaggtcatggtagaatgatgtaggcacgggggagatactgaagggaggactggccgtaagacgcacggagcccgccatgctgctgttagtatcgattcctcgaaagccccacagcctgctgatatggactggagagacccattgcataagttctggatctggcccagctgtgtcaccgcggtgtcccctcaggccagatgaggttaagtgacatgggcagggagagcgctggcacagtgtgggcctcagtgactggtgtggtcacttcatcttcattgccctccttctgctcagaggggggcggtgtggcagtgggaccagcaattcctcagcacccacggtgtgctcacccctgggggaggaggtcatctccccgtagatgcccagtggcatctacaccagctgtcttctttttcttgttacttgtgtcactcttcttatttcagaggtagagtttagcctggttcacctctgggctttagatccagagagctgggtttacagtgagcaagttcccagggctaggacagggttcttggggaaaataagggaaactgtcccttcctcccactccctgtgcagaaatggattcgttcacagagaaagatgccctctgtgctgctgagagacagactctgcccaagtgaatgagctcagcgccccaaagcagagtttttgcccagggcaagaggctgcccccgttcggcatctgtggggcgcccatcacgttcatccatttgctaaacaggctcctgtgtgcagggcagccctccacatctgccttgcttagaacatcatgcagtgtcagatgcagctgagtaggacccagccagaggaggtgtggccagtcccccaggtgctcctggaggtggccctgccaggagcctctcccctgagtggtggcacccaggatgctggcaggacctggcatgccttcccctgagaccataggaagggcccggagtctctcaccactcccagagaacatccccctacccaggatgggcccaggaggagaggtctaggcaggaagggccaaagcccagctctccggctccggtccagactcccccaacgcccacacacacaggcacacacacaggcacgcacacacactcaagcacatggatgcacacaggcatgcacacacaggtgcacacacataggcacacatgcacacgaacacacacaggcacacataacaggtgcatgcacacacacacaggcacatgcacacagccacacacacgtgtgctgggagaccctcacatagctgggaactctgcagtggggagagcccgggtcaccctgtcctcagcctccccagagagccatggctggtgtccagtccagtctctgcctctggccccgacatgacgggttctccggaagcagggaatgagatgtgctgtgaggtgtaactgactcaggttccatctggcagcctctcggaggagctgccgagtagcccagtccctctctgtcaagcctaattctctccttctctttccctgtctctgtgtctccctcccgctgtctgtcctctctcctcccttcctgcggccgcagaaccgcatgcacgagtctctcatgctcttcgactccatctgtaacaacaagttcttcatcgatacctccatcattctcttcctcaacaagaaagatctctttggcgagaagatcaagaagtcacctttgaccatctgctttcctgaatacacaggtgggtgccaggcagtcctgtgcagggggaagcctgcccctgacagggacccatggctcagagaacaggctgctcggccagcactgctggggctagctggcgagcgggacccattgcaggagactggtggggcgcaaaagaaaaacagtgctgtgccaccaggtttgggcttcccaggacacagccctcagcgtggtggaaatggcccctcctaagatatatgtgttaggaccaagtgactcaggagtggtggggagcagggggcaggacaggatcacaggcttcccccttcctcctggtcaccctctagaagaggtctcaggacagcctcctgtaatctcagcagtggcctcccctcacccctgcccagagccccacagcacctttgcatgaaaccgaaaagtggacacgtggcctgtgaacagggcctggactgcctcttggccccacctgctttccctgctccctgctttggtgcccggaacatgcttcatctctgtgcagccgcccagccagaccactccacccatcccacatcgtgcctgccctccctccccaaccccagccccattgcgcctcctctctccccttcttccttcgtccctggtctttgccccaaatccaaccactccagctatctgcaagcctcctgtatcactgcctccctttcttctgccttctctggggctttcttcttgctctcaggggaatgtgtcacagaccttcccccccacccggctcaatgacgctctttccaaatggatggatgagggatggtggcttccgtggaatgggccaactctgggctactgctaatgcctaaaagcagcactgatgggatgccagagcccagccctggtccctctaggggctgggaagcttctaggggtccctggggtaggagttgcctttgcagactacagagtgcacagggccagcaccctgccatggaggaggaggtgtcctgtcatccgccaggtcagggcacaggttggctcggccaggaacccatgttctgacagccctggagtaaggctttgggcatgggctcagtctcagggccacacgggtccccaagctcagccacagggtgcctacatccagcataggtcgatgctggtctccccacccttccccacagctgggagcagtgtgtgaagaagggctgtcagcttgttctgagcacaaaccgtgtcctcactgatggtccgtgctaatgtgaatttgcaaggttcttgcccttcccaaggtgcagagcaggaggtggggccaggaactgtgccctgcactcgaggctctccagcaaagtcccaatagggcagagagcccaggtagcctctggagccagaccacctgcagctcagcaagttgctcagtcatctgtgcctcattctaatctggtcaacacaatgggtaatcatgcccaccccaagggtgactggaaggacagctgcttggtgccaggtctactgaagtgctggctgtggctgccattggtattattcagaggatggaaactaggggagggggaactggccacggagaaggtgccctctgcaggatggagtgagggcaggagggcacaggacaagccctgaaaggccagccccaggtggcccttgggcagagccaggctgtagcccactctggcagccactcctgacctctcccagccacaacgatggagtccagtaggccccctcaggccagggctaccctcagagacaggcccaaccctacggctctttcttgcccagtgtcccactggggcctgacttgggagtggccagtctcactgctgtggagtgcaagcactagatgccccagcgaagggcagttggaacctgagaaacaagttctccagggccttcagaggaatccagtttgaattcaggtatcatggatgacagatggtcaccagtgcagtggccccatggagtgcaaacctgtgagggcacaaaacaagcagcaggggtgggacgggaggtggccggctgtctaagggacgtgtgggccagcatggctgggtggcagcagggctgtgtgaggacgctgggctcggcagacacagcgaaggcacgaggcgctcctcccacctggacggcttcctgtggccaccttccaccctgggctgtgcccagttcggctctctccagacaggaagctcctgggcagggtccacacgggctgctttgtccaatccttaacagctgtgctgtgggcttggcatctctgcaccagtggatcaaggatgaggctttgcactgtgggtccaggcactcctgctgggctgcccagagctggtctcagccatgacaacccacccaaggctgtcccaaccccctgccccttgccccttgtacacccaaggaattggtggggacagagggcccccagttggcatcatacatgctgatgtccccttaaacttcccaccttggggacatcaatgccccaatgtcctggccactcgcttaagaaccacgcctactaatgatatgctgccagccctgccaagtggcctcttcttaaaggaaaccaatgaggaaggagtgcaggtccctctgagtgcccaccaccctcttgggcaggcccctctccagactttgttttcatggtttactggaatcagcaggattggtttagaccatggggcggtgcctcaatttgctcatctaggaagcaaaagcgttcatctgtggccactgctgtcccaggcggggcttccgggtggatctggtgtgaaaacagtaagagatcttgcaaagtccaaagccaggcaaatgctcagcctgtgtatggttggtgcaaaagtaattgcagtaattgcagttttgctatcaaaagtaatggcaaggccaggcgtggtggctcacgtctgtaatcccagcactttgggaggccgaggcaggtggatcacctgaggtcaggagttcgagaccaacctggccaacatggtgaaaccccgtctctactaaaaatacaaaaattagctgggcgtggtggcacgcgcctgtattaccagctactcaggaggctgaggcaggagaatcgcttgaacctgggaggcagaggttgcagtgagctgagatcgtgccattgcactccagcctgggcaataagagcaaaactctgtctcaaaaaaatagttctttaatttaaaatgcaactatggcttggaactgcccagcagttcctactgctcccttcctgtctcatcccacttcctgggacacgccacaacccacttcttgtcttcatgtccccagccctgtccacccacagcgctcatcagggcctctccccgttcttctgtgtcttgttacaggccccaatacctatgaagacgcagccgcctacatccaagcacaatttgaaagcaaaaaccgctcacccaacaaagaaatatattgtcacatgacttgtgccacagacacgaataacatccaggtggtgttcgacgccgtcaccgacatcatcattgccaacaacctccggggctgcggcttgtactgacctcttgtcctgtatagcaacctatttggtaatgattccagcacccacagaacagcttgcgtgcgcgcgcatacacacacacacacacacacacacacacaccactaacaaatgcaagttggtaaataaactttaaagaggcataacaaaaccttatatatatatatatatatacaaatatatatttaaaaaatctttttagtttgtactagaaagagctgcggacagaactgaccaccatcccatagctcatggaggttttcctgggacggcacgtgagcatgcacgtgtgtgtgtgtacacacactcacacatgtccagatgggagcttggtttgggagtccctccttttgaggatagccccggggtgttcctctcagccccatttctgagaacaggtgaatggcagaacagccctggccttggcccagccagctctctgtgttgcgcccttagagcctctgcgccctcagttccgtcctgctcttggcaaattccagaccctttcagaaatggccgaagccctaagcctctcctcactctgcactcccaaaaacagaacaatttaaggatgcttctctttcgggtggtggtggttgttaatttcaggaatttagaagaatcattgctccgaccaatccactgtctcctgagttttctttattcatgttaagatggcaagaatcagagaacagggagacttggtctgctttctaaaagcagctgacaggaggggactcaagttcacctgcagagttgaaaccagccccgctccaagagggcatgtgggaaggtggggagcgaggggaacaggcgtggcggggagggccggacttgtgggcctgacccgagtcagggtctcaggggggggccaggcttccccaggtgcccgggatgggcttcaatggggttcctgacccctcgtgctgctgccccatctcgcccaaccccagcagtagtcaaaatgttctagggttttttggttggttggttggtttttaaaatcaaagaaaatggtcagactggaccccttatctctctctctacagactgcttcacggactctttgctgttgacgttgatctcctggtagcatgaccttttggcctttgtaagacacacagcctttctgtatcaagcccctgtctaacctacgaccccagagtgactgacggctgtgtatttctgtagaatgctgtagaatccggttttagttgagtcttcacatttagaatttgaaaggaaaaacagaacatttctcatgtgctttgtagcttaaaaaaaggaaaactcaccatttcatccatatttctttttcttgcaaaacaaacatacccatctgcaccgacgcctgcccccgtcccacctcgcggcgcagcccctggagctcctgctggggggcagggcccatctgccgcctggggctccggtgcggtgcactggtccgaggagtgtgctcaggccgggctttccagaaggccacaggccactgcaaaccctgctgcctgccggccgcccagacaccacagacgccacctggcggccctaagccactcccgccacacgctcactccaggttcgtatagaaaaagcacagctctcactggccagtagctgccaaaaagaacacccatcgtataaggaaatccagccccatagaaaacaatctgcccaccgaccccctttctaaggatagcctttgtaggggttttttggttccttttttttttttttcagtttttgtttttacttttgtcccgccgagtactatgtattaccagccccccaccccacagatcagttttcctagtctttgggaaacgggttgtgttttttttcctttgccgtgttggatttccggtcccggctgacacctcccttcgtgtgtgcgcccctccccacccctgcctttgtttcggtgccctgtgtccgctctctcatgtggggatgtttgtgctgcagacaaaaagaacaaaaaaaaatttttaaataccacaagatggaaaaaaaaaacaaaaaaatttaaaaagatggaatgtagtgtttacattaaagccgccgttttcatgaccaatcctatgtcatttctactttgactaatacccaaaccctaaacctcttcacggtttcacttttaagacttaatctttgctgaagaagaccagtcacagccatttcaaataaagaggaggcaaaaagacaaaacacacaaaaaattaaaaaaaaaaacttaaaaaaaaaaggaaaaaagaaaaaaaagcccacgggtctttgtaagcctttctattcccaatcggtgaggtttctgtgatatcttacacactgccagtctacttctctgactaatggaaaattcctgtgtagctcaataaaagagaatgtttgtctgtactcctgagtctcaccctgtgccttccaacgatggttatttggggtgggcttcattctggcaggagagggaaggagggactcggccacacacgctggtaggccggtggttaggagtcccccacaggaccttcccatcccctcagtgccgtcactggagccccagctcagagcacagttgacgcgaccactgcccagtgctgcctgggaatgagggcaggggagccgccactttctcctgcgatgccctctcctcccggctcccggtgcctcctcaccctcagtaggttttgtttgcttttgagaaatgaggtggaagtggggattaggaaggaagaaatgcaagaagggcaggcaagccccctctcctatcatgcaggatcctctttcttctgtagccggcggttcccccacagtgggaggatgggtggtcccaagaatgaggccaattgcctgagcccatctgcacccaagagttcccagccactcacatgcccaggacgagcttgggcccagcctgaccaggaaggctgccttcgatttgctccctgactgcacctggatgccaggaagccccctgcaggccgaacacgcaggaggtaacccagcagtgcagtggggcacacggagtctgatccctgttcctcccctagactgtaggtctcacccgtcccctacattggcccgcttttgctgtaataattagcaaatgggttgcaacggggacctggaggcaacggcagcccactgaacttgcatcatgtccacacgccacttcctgtacaagcggccaagagcatcatgtatcatgctgtcttcagtgagatgggggagctgccaagaggtcagttacctggaatcctctccacatctcaacaaatgggaattagaggctcagaagggcctctctcgggcaagttccagcagtcttttgaatcaagggggtggaggcaggggatattgtttcagagactatggaagaacaagaggcactgtgataaatacccaaccaatacaggcaccccttaaacctcttctgctttccccctggttccccaaaccccaacttatctgcagagaggggcacatgacctaccctctccattgaggggaaggtttgcaatccaggccacagtttgactttgtaacaaaccaagatccacatggaaggctgaaggaaaccatgacattttctatatatggcacatttgaatttttctgaaaaccaagccatattctaatagggttcttcccaactttcaaatgagttttgcaataaaaccaacagaagtttatttgcctcatttttcttagaagggaggtcatagcattttttggaaaggatgcagcaaaaaggccaattaaatcggaacaaggagagtgggggcagaacctatctgatatatatatttttaaagatcctttttcccccctagtttatctgtgcacacaattgtaaaaagctagttctaattagaaccaaatcaaataggagatttacttccaatggcacctaaatagcttctaaaagaaattctgagaaaattgcctctattcaggaggtaaacaaaaggtatccatcatcaccacctgtggaatccctccaggtctttgatctctgccctgaaactctactgagaaagtctcagagtcgctgtgaacctcttctggctctgggggctgccagattcctgaaccattctttgcccagttagaccacccaatgaagaggggctccaaaatgcacttttgttgcctagctggcagttgcttaaggcaataagacaggtaattaaaagagtaattctctaaaggggggaaatgcacacaaaactactgagattataaaaatgcagatccaaccctttttttttttctaaaccaggactaataaccgacactgatgttggaatgctaacatccagagaatgatccgagcaatattccggctgagatcagatcagatctgaaaccagttaaaatcctttaaacgctcaatccgcctgcttcggatcccaggcaagatttaaaaaaaaaaaaaaaaaaaagtggtcctttcactgctacagccaattccattcccagagaattagttcctttggtttgatattcatgtgacttttgatgtttggggataaggctttgccacttaggagagtatctttggttaaaaagactcaaaagccagaaatatcagctgtttgtcccagctaaaattgggtaatatgagatttcaaaggattttaagagctctacggttagaagtcagcttaattaaaaactgatattcaggatatatgtttatcttggtaaggccttcctgctttttctcttttgggatcctgtttttggtaattttttttctagttgactggaaccccctctctaaaaaaaaatgatgtgcttgtttcctctgtgcacttcagttcctaaaaatcatcctcccgcttacttcctctcttccctctttcttctctgccatcttggctaccacatgaaaagacctagaggggacctctaatgactcagagctcttaaggaaaatagaaaaggcaccacagactcctctcttggggagaaatctgtgtttcccccacagaactggaaccccaagagttgcaagtggacagatacctctcaagtcaactctgccctcttttgtatttcatgactggatctccttggtcccagagactgctctgtcctgcgctgtgagagcctgaccttgcgtgtgtgatggctgccagaggcggctcactgcagttgtttacagtaaatgactctatctaaaagctccacaagtgattctaacatgcagccaaggttggaaccatgtctaacctaacagatgagcagcagccctgcaagatggaggctccaaatgacggagggccttcgagggcaggcaggcggccgctgctccttgccagggcttgtcggcaaggccatggcttccttttccatgtgtgtccagctccagcaggactgaaagtccccacagacaggatcaagttggctggctacagataaaaggacacattgtctacttagcccaagtggaaaatcaggcccaagaggccgcctgggcacctggattcacatcaatacaagtgaaacagccacatggcccaccatcctctatggtacagaagagcctcaaaattcaaaacaaaacaaaaactgaggagaacctaggaagtcaaaacagggccactaagaaaatggagagggcaacacagcctcattccaaaagagcccacagaggccaggggcagcccaaccaccattcaccagagcacccggatgctccttctgctgcgcttacaaacctggacccacagccctgagtgctgcttctccaggggctgggcgtgaggaccatctgcctgaccctgcagctggcagggcagcaaaagtggtcctgggaggggaagcccccagcataactgccactgccctcagcacctgtcccggacgcccccaggaagtggtgaaatcctcaagtatccaggtgtaaaatggaagggcggactgagaacttcacttcttgcatcattttaagctacttaataagctcctgctctaaacactgtgatatggctgttttgtaatgtgtcaagaccctctaaaattgatccaagtaattttctcttttcacacatcagaaacctgtgaacatgtggaattagtggcacctacaatgggtgcaacgtgtgaagtataatgtaattcgaggacagtaaaataatctttcgctacacacttacctgaaaaaaaaaaagatataaatacaaggggaagaaaaatgtagttctgccttccccaaatacactactaggaaaaacaaaagttcccaattcaaaaacatgggaaaaaaccctccaaccaaaatagtatacacaaaatccaaatcaaaatggggtttaacgttggcacctctggaaaaagatgccttagcttccagccacacaaaaacatgccttagcttccagccacacacaacacaccaatagagtttgctttttattattattattgttttacaataaaaacaaatagctatgctctcagcaaaacaaattaaaaaaaaaaatcacagaaatttactaacagcatttcaaggtaaggcttttgaaagatttattgaaataaattatctttgcctaaaaatttacctatcacctttttcaattacttttcaacattctaaaaactttccgttatgtaaaatacatttaaactttgccaataattgtggataatactggattcttcccaaaaggactaccacaaaacaaagctttcaaagagtaaaaaaaaaaaaaaaaaaaaaaaaaaaaaaagtaatccaatggggcataaaactgaggtctgtaacctatgacttcatggttcaaatccttaaagttaaacatgtgaagaatttgaagagatttgggacctgggccctctccaaggcaggtaggttcacaccttaccttctctgctgaattaaaccaggaataacacagctaggaaaacgcagtgctcccaggataaaagatacaaaagttcttttttatttctttaataaagcccttcaaggtttactctcccatcttgcaaggcccacatcttgttcaaggaccaaacccacaggctttagcactgcctaatttacttcaccaatgaatgaaaaccataaaccaaagcttgctgcctaaccactccccaggtccagacgggacaaggaaatgctgagaggggaggggacccatggggcacactcatgagatgcaggagcaccagagttcacggaaatcaagccggctttggactggaggctcggaaagtcagtcccagatgtagtgggacagaaaggggtgacttcatcacaccctatagccctggactttcccctcctctgctccaggtatcgaaccaagagttccttttccaagatgccctgctggctcaggggtgcatgagcccgtgggtctggcctctggcacagtctacatgcttccacaacaacgacagcagtttgataacagatgttaccccacgacgtgggggcgggctcacactgtgcgcctcccccacactcttcccactgggtgtggtgctcaggacacctgcatttgtgggacgtacgcatgaggcaggagtagaagctgcctgctgcaggcaggcgactgctcacttcctcctgatcgtcccccaccccaagcagtccagtcaacaccagaagagatcatacctacagttaaaatttgcagtgtttctaaggggaagagaaatgtcacatagaaagtattacaaagaaggattaaatttatcagctgtccaaacactataagaccacatgctttatacagcggcaatgcagtcaagcccgcttttccatggagcgggcagaattgggacaggcctcctccagtcagtcgggcacagggcgcaggaggcagctgaggaaggcaagggagcgctaggaggtctgctgcttctgaagcctccgttccgcggcggcagccagcatccttcgacgcagggtcacggggtcagaggacgcaccttccgaggggaggaagctctctgaggccgcatcatcttcagaacttttgttcaagaaacgtctagaaaaaacagaagactttttctctctcataggagagatggggagctgtggaacacagccagaaggttgatttcacatctccccatgtccaggcaccttcatgaagctgtcactcagcaccacccaatgaccaagacatccagcccccaacagatgggcgcaaattctctctgcaccagggaggaacccttcagtgctgttccctgctgtctcttcctgcccatcccctccacccacagacacagcacagaactcccacaatcacagggtctgccagggcccaaacccacttgaggaacacagtgctggccctgtccttaagagctggaacaaaaccccctctatccacaggacacacctgctgtagctgccaccaaccatgggtgtgtgacgcacagatgcgctgagtgtgtgtacaatgctcagctgaaaggcagagtggtcaacagggaggacctgggagacagacgccagggccaggccagtgctaacctctccagcctccatttcttcagctgtatgtcagctgaatgggttaacagtgctccctcttagagctgttaaagtaattcatataaagggcttagatcaggttagcacacaagtgctctctcggcaagcgtggccaaaggggtccatgggagatgactgacagtaccagcatcagaggtagaccagtggggcccagtgttaccagatgctctggttttttcaagagaggcttgaaatctgagttttggggtggcatgtaatgccgtttcactgttggcatctgtttaaaaagagaagacggcctgacaacggccttcagccactagtttttgatctggattatgccaggtggtctggagaagcgactcacttgcgagcttgctggaggagttcgtccttacgctgcaccagcatgcgctgtctctcatcagcagacttggagaagcggctcccacgagcctcgaagtcttccacctcactgggctccacttccacctcgccgaagtccagcgtctcctccaggcgaggactgaggtccagtggcacacgctcggtctggacacggggcaggaagcaaggaggcagctgtgagcacaggcctccctcctaagcaggttcctcacctacagggcaccccagacacggctgttctggacgcaaagagaaggctgctgccaagcagggaggcagaaactaggaaccacaagctacggataatggagcagcagcttccctgagggcaggcctgctgcctatggcttgagtagtactaagaacaggacctgactcacacagaatgttcggcatcagagggtaagtaaatgattaccagcatgaaaaacgtaagcaccttcaagctgcactcttagaatacgctaccaacacgacaaccgtgagtttacatcctgggaattttctgttcacttctactaattgctcaaacatttaaaccagtcttatccaatcttctgcacaaattttatatcctcaattgactctgaaaacagaggtaaaaaggaaaactgctaggcatctatttatttatttatttacagacagggtctcactctgtcacccaggctggagtgcagtggcacaatctctgctcaccacagcctcaacctccccaggctcaggggatcctcccaacttagcctcccaagtagctgtgaccacaggctcgtgccaccacatctggctaatttttgtattttttgtagagacagggttttgctttgttgcccaggctggtctcaaactactggactcaagcaatctacccacctcagcctcccaaagtgctgggactacaggcatgagccactgtgcccagccctaaggatcttttgaaaagacacaggatggattatatggttccttggctttggttgaagctccaaagtccacgacaatgcccaggcacccccaggtcctagcaggtgcctgaccatctgcgctgctcatgctcccagatgcagacctgcgctggccagggtcagcccattgcccgcttctaggctgtgacagaatggaggtgggtgcagctgagaggcaggctgttttacttcagagttcctgctggacctaccctcactttttcctgccttcagctaagctcgagagggaacttcaagagaaccattcgtatccccgagagtcaaaggacgggggaactggtggctgcatacacttgagaaatctacagaaagaaactggcaggagccaataaaatacagggccaggggagctgtgacgggagcacgttcaccttccactgactccagacaacactgtgtgtgtcctggagcttggatagggctcctgcaggagggaaccaacctaaggttgttgaaaacaactgtgcccaaaaggaccacttggagaggtaacaggacccccatgaaggtgggagtggtcatcaatagccagcccagggtcaaaggaggagtttctggggccagatggggacagggagatagttggcataacatgtacacacacacacacagacacacgtagttggcacaacatgtaggtacatacacacacacgcacacacacgctggagtctcactgtcctattctatccctctcctctaagcctgaccctagagcaggttagaaaaaatggtgagtgaagaggcgagatgttagaaagaaaacagccgcccaccgcaacccctgctctgtgcagctgcatgcctgactaataccagcctgagcggggcagggcagagattagaacagagggagagtggagctgacaagcttactgggctacactgaggtttctgttaactaattgttattcaaggactttgtatttcttcacaaatgaccaaaaatgttgcacagcaaggttccctgtgaaatacatactttcctccattatatatacatatatatatataaaatccagaactcttcatgctaactctagaagcagcagtggaaaatcaagacagggactgaatatgctgtacccacagatgcccccaagcccacagcatccatatctcagctgcgccagctattcaaaaactggaggccgggcgcggtggctcacgcctgtaatcccagcactttgggaggcagaggcgggcggatcatgaggtcaggagatcgagaccatcctggctaacacagcgaaaccccgcctctactaaaaatacaaaaaattagccaggcgtggtggtgggcgcctgtagtcccagctactcgggaggctgaggcaggagaatggcgtgaacccgggaggcggagcttgcagtgagccgagatcgcaccactgcactccagcctgggtgacagagcgagactccgtctcaaaaaaaaaaaaaaaaaaaaaaaactggaaatgtagacatggaccccttagaagccatgcaccatttcacaaatgatgcataatccaattacataggtggatatgaaaatcttaacccagcaacagatttgaagaaggcctagtagtgtttactgtttcctctttgtagagaaaaacacaagaggtgaaagcttgtgtcatttaccagtgcttctagaggagaccttgtgcaccccagtaagggaaggcagcaccaccctagacccaagcctgtgtgcaggaaagccccacatggcacaaacacagaaaggccaaggtggggttgtccagtttttatttgtggtcgcataagaaagtgctctgacaatatggtaactgaggaagcgaatgggaaccacagaagaggagtgggatccagggccacaggtgtagggcagagggcacgggcagggggtggggggaggtggcacctcggccctgctgcttggagttagggtggccacctcaaggcacccaaagtgggtcaacaaacagatctggttctcaagaaagccatgttttccccccagccccactcagctcaggcggtctcagttttgcaaaatgcatggatgtatctggaaatcctgagtttgacaagtgaggtgtgggggagggcatctcaatggcctcggctccctggagagcttgccctaggccatccccatctgagtttagatgggtccaggcaccctcacggtcccgagcccagcttccttctgtccttccacgggctctcactcaggctcaaggtggcagggctggccccggggaacacaacccctttctcttccagcacatgagggcaatccccagggaatgactgccagccctgcgtggaaacacaggccacaccacgggcacagcctgatttgctacccttcattattgggatggatacagcacagtttcttttgtactcgtgccctaagccttgcaagcttcaggactgaggaagaccactgtcgggaccacattccccctccacagctccatgaactcactctcactagagtgcgggttttacctgagcagaagtttctccctcttcctggtcactgcttggcctttccacaggactgttcaatgcaggtctgatgctatctgaccgctggaagagaaacagtaccaaaaacagtccagagtcacacagaaatcaaatcacagactcagggaaaccctggtgtgcagagggagctatggtacccaatccaacctgtaactctaaggaagtctactgcaccacagaaattaaaatgccataaagattaaaagcaagacaaaggagcctggggcctaacctagagttccaagtttgagagtcagcaactggtcccactttagtttccttttgaataacagtaattagacaacaaaaacaatgataacagcagagaacactgactgaacacctaacttcggcatggcaccaaggaaaactgggacatggctgtctcgtctatcttcacgtcctatgaaacaggtgctgctgttaccgtccttctagccagtttaagatctcacacaatgctgcagacactctggggaccagccagtaaggtctcgccacctcagtgctggctggccagtgtctgtatttcattgcctgaggactttctctggctgcatgaggtagttcagccacccccagaggcagccctcaactagtgagggagggaattactctgtgaacaccccagttcctcatctcctgcgagggatatgttctgcactggatcccagaggccccaaatgggaaggggcttgtcacccacagtgataacaaacctgcttgataacaaacccattactggccaccctcccttccccagctcacatccccacccacaacctgtgattcctgggaccacttcccaaactatgtgcattcaaatccttgtcccagggtccgcttctggggaaatccacagccaacagccaggtcaaagagctgagaactgggaaccacatctaatatctcagcccatgtgactgagtctatgctctttcctcttcaaagagtctcaggttttataattttattaatagatttccacatatttttacatactaaaattgaatcatttggggtagattattccctggtcatacacaaattccacggtcctgccagaaggctcatctatattaatacttcttatgctcatcaaagtagagatctgagcttttcaaaaatcaaaaccaccacctcagacagatgaacggtagctagtggaacaccacaccagtgtgcaaagccaattagggacagatggcacagctcctagagcagggggttggcaaactacagcctgaaggccaagttcactactctatttatttttgtaaataaagttttattggaacacagtcttgcttatttacttaaatactatccatggctgctgtatgacagcagagttgagaagcaacaaagatcgtgtggcctgaaatgcctaaatatttattatctgccttttaaagaaaaaaatgtggccaatccttgtccaacaggaaccaatactatgacttcctagactggcaagggcaggctggtgtagagtgtatatttgaacaaaaagtgactcaaatactcaccttatctttggtgtgtctgttctcagttattaatttgggaaagttagagagtttatagaaacccttcattaagtcataaatgatattcagctgttaagtaactaaaacagttaacctacagtattcaatctttgtgaagatagaacccatttatcatgctttaaaagcccagttttacctgtgtaggaaaaggtacttgaatccgtccttctaaaatattgtctgttgttatttcaactgagcgtgtcagctggaggtcctgcagtaccagatggtatggaacctggggaaacatctcttgaatctgatgagcctacaggaatacaaatacagagtccacagaaacgttcactgttaacagttgctcactgacgtcacagtgtctggcaggctttgggcagtgaatgtggcatcatgccctgaaaacacaggtaagggagccacctttattcagtaggtcaccttcacactgcagtccctttagtatttttccaggaagccaaacaggcaactgtggacagcatcaatttcaacataaggagagctcagaaaaccaactggatcccaagagaggctcgactagaatattccagttttaaaaagtgttcattttaactaccattcgaaccagcaatcccactactgagtatatacccaaaaggaaagaaatcattatatatgaaagatacctgcgctcatatgtttattgcagcgctattcacagtagcaaaaatatggaatcaacctaagcgtccttcaacacaggatttgataaagaaaatgaggcacatatataccatggaatattactcagccattaaaaaaaatcatatcttctccagcaacactgatgaaactggaggccgttattctcagtgaagtaactcaggaacagaaactcaaataccgtatgttcttataagtgggagctaaacaacaagtatgcatggccatccagagtggaatgagacactgtactatgaaaggtggaaaggtagggaggggagggctggaaaactacctattgggtacaatgttcactctttaggtgacggtaacactaaaagcccagacttcaccactgcgcaatacctgcatgtaagaaacctgcacttgtaacctgtaaacacatcaaataaataaatgttttaaaagtattcattttaaagctcaaaatatcttgggtataaaaatgtgttttccttaaagatataattcctaaagggaacaaacttctgatacacatagcatggataaaattcaaatacatcatgttaggtgaaagaggtctgactcaaaagccaggcatatgattccatttatatggcatctggaaacaggcaaaattatggggaaagaaacttgataagtggttgccaggggctgaggatcagggaaggaagtggttgccaggggctgaaggttggggaaggacatgactacaaaaggacctagtggagttctggagggtgcggatcaaactgttgtacatcttgtttatgatgatacacaattatgtgttgaactggatgttaaaaagggtaaatttttactctatttcaattatatctcaatttaaaaaaattatagagaatgcaaattccttatacggccctggagctgagttttccaactgtactctggagacatctcagagtttatgtagggctctagggtgggtgtgtgtgtagggagagcaggcataggcctggccacaccaccacccatactttcatccaagcagctctggattttttttccacatatgtaaattaactctataaatgtttacattcaaggttttatttttggaaaagttctaataactataacaaaaaaaggaagaaaaaaataattgccttaggggcacaataaagccctcctgagatattagctcctagggacacgttgttctgactatagaaggagcagggagtatgtcaacgtcaggaccttgaaggaaaaggtcggcaccgggctctgcttagagctcttgctgggggtggaatgttggcaacataagcagtgcccagggcccccagggcctcctcattcctgcagtcagcttgtttatgtaaacatgagttgatcattattttcccaggtcaggtcaaatctaactgggcaagagtccataaaaacctctaaaatcagataaaacttctctttattcttaaacagcttcctcctcatttcccaaatttaaaaaatgcctaggattcattttactagaccaaagcttttctaccagaaaatccagcaagttaattattagatcttaataaaaaatgcatggttccagtaaattagttgtaccaaaagtagtccactccaaaccatcacagaactggaggaagaacagccagggcctgcctgagaattctaaacaactcccagaagggaattctgattccaacacccttgaagtcttgactttttaaaggaggtcggtggggtggtccagctgcagagcttcaacagctgcctgaccccaaagaacccctgtaatgcctgccatgagcccagcagtagctgcactgggcgaccacactcccaggccacctatatgcaccaagatgtcaccctcactctctgttggcagtccagctgaggtttaaggagaaagaggagccaggagagtcatgcttccttcttcttttattatggccccaagcagataaaatttgccatcttaaccatttgtcagtgtaagtgagccctcagtaccactatataggtgagtttcacaggctgattcagccagccctggagcaagtgttacactgttgctgacatgtactgtatagttaggccgaggatggctgtgtctgtactgaacatgcacaggctttcttgtcattattcctaaacaatacagtgtataacaaccatttactcagcatttacattgtattaggtatcagaagtagtctagagatgatttaaaatatatggaagatgtgcgcaggttatatacaaacagtatccttcccccatcttttttttttaccttaaactattaagggttaaagtgtcccactttatatcagagacttgagcattcatggattttggtatctgaaggagggggtcctagaaccaatccccagataccaagggatgactacatagtgtggcagagttaaccacaggcacatggctgcgcaacagatctgaactttttcatcttgcaaaactgaaactatatctaagggacaacactcctatttcgcctcgcctcgccccagccctcctgcagccatcattctgctgtctgtaagagttttatgtggtatttgtctttttgtggtagacttatttcatgtagcattaatgtcctccaggttcattcatgctgcagcatgcaacaggattcccttccttttgaagtctgagtactattctactgtacaggtttgccatatcttccttatccatccatctccagtagacatttcagttgcttccaccccttggctgtgagccacgccttctttttaaaccaaatttcaatacgcccgtagctatatccatccctcctcacaaccctctctcctactcagctccccaccctagcctgttctttcagttgactcttctatttgttctgtcccatcaatctctgcccctcagtgatcattcctatgcacataccagatgtgctttcgaatctacccttaaaaaacaacagcctgacacagtggctcacgcctgtaatcccagcactttgggaggccgaggcaggtggatcacttgaggtcaggagttagagaccatccttgccaacatggtgaaaccccatctctactaaaatacaaaaaattagccaggtgtggtggtgcatgcctgtagtcccacctactcgggaggctaaggcagggcaattgcttgaacctgggaggtggaggttgcagtgagccaagatctcgccactgcactccagcctggcgacagagcaagactcggtgttaaaacaaacaaacaaacaacaacaacaaagaaaaccatggaggaaaacctgacttataactgacaaattggtacagactcagtgtaacaactctgagatgtaaacattccagggcactcaggcagaggtggctcccctgtaatactgtgagattcagtgccaggagtgatcaggtttctcagtaaatatccaacaagcatcccttcctgcttccagcacagggaggggaaaaagcacctcagtgaaatcagccagggcacactgttcttaacaacgtctgccctcaggagaaactactcaaccagaacctcatctgctggggtctgatcaaagctgcaccgaccggagggaactccagtccactcgaaccatcctgtcccacaggaggaggggaaactgagaagtagattgaagttcacagtccagagcatgggctcactaaaagacggagccctaatcccaggactacagcatgcttctttccctcccccgacacctacatcacgacaggcctgttcaccacagtcctttttacgcagtacatcatgttcaactatcatgaaaaaattataaggcatactaaaaggcaaaaaacacaatttgaagagacagagcaagcatcagagccacacagagcagagatgctgaaattaacagactgggaatttaaaactatgattaatatgcaaagagcactaatggataaagtggacagcatgcaggaacagacgggcagcatgagcaggcagatggaaatcttaagaaagaaccaaagagaagtgccagagaccagaaacaccaacacgagtgaagaattcccgtgacaggcttattaatagatggacacagctgagggaagaatctctgagcttgagatacacactttgaaaatggaaaagcaggccaggtgcagcggctcacacctgtaatcccagcacttcgggaggtcaaggcaggtggatcacttgcggtcaggagttcaagaccagcctgggcaacatggtgaaaccctgtctctactaaaaatacaaaaatttagccaggtgtagtggtgcacacttgtaatcccagctactggggaggctgaggcagaagaactgcttgaactcaggaggtggaggttgcagtgagccgagatcgtgccactgtactccagcctgggtgacagagtgagactccatctcaaaaaatggaaaagcaaacagaataaaaactgaaaataacagagcagaaaattcaaggactgtgggacaactacaaaaggtgtaaacgcacttaatgggaactgcagaaggaaaagagaaacgaacacaagaaatatttgaaacaataatggctgagaacttgtccaaattaatgtcagacaccaaaccacagatccaggaatcttagagagtaccaagcaggacaaaggtaaaaaaaaaaaaaaaaaaaaaaaacactacatcaaattcatcaaattcaaattatagagaatcaaagattaagaaaaaaatcctgaaagaagccagagggaagaacaccttacttttagaggagcaaagttaggaatgacatcgacagctcctcagaagccccacaagcaagaagacagcgaagggaaatatttaaagtgttaagaaaagactcaccaacagagaattctataccccacaaaattatccttccaaaaggatgcagaaacaaagactgcctccgacaaaccaaagttggaatatgttgccgtgagacctaccttacaagaaatgttaaaaatattaagtcgtttaaagaaattgatataggtcagaaagctcagctctacataaagaaaggaagagcatcaaagaaggtataaataaataaaaactgttctttaacataacattcgattcaaaataacagcaacagtgcattcagttatgtgtgcttgtgcacgtgtgtgcttatgtactcacatacaggtgaaatgaatgacaacaatgatacaagggacaggagcgaggaattaggattgttttgttatcaaaaggtactcacacttcccatgcagtggtacagtgttatctgaaaataaacgaattagttgcaaatgtatattacaaactctagggcaaccattaaaacaagcttgtccgactcatggcccacacagctttcaatgcagcccaatacaaatttataaactttcttaaaacgttatatttttaattttctttttttagctcattagctatcattattgttagtgtattttatgtgtggtccaagacaattcttcttccaatgtggcccagggaagccaaaagattggacacacctgcattaaaacaagtaacaagtatactgatatgctaagaaaggagaaaaatggaattctataaaatgttcagttaaaaccacaagaggcagagaaagagtggaagacaaaaataggaacaaaaaacaagggcaacaaatagaaaacagtaacaaaatggtagttattaatccaaatacattaataatcactttgaacatcaatggcctaaatgtgccaagtaagagaggttgtcagagtaaataaagaaaaccaagacctaactgaatgttgtttacccactttaaaataaagacacatacagattaaaagaaaatggattaagaaaaatataccacaccaacactaaccaaaagaaaccaggagcagctatattactttcacagagcaaacgtcaaagcaagcaaagttatcagggataaagaacagcattacaaaatgatcatggggtcaattctccaagaagacacgacatctttaaagtatatacacctgctgggcacagtggctcatgcctgtaatcccagcactttgggaggtcgagaagggcagatcacttgaggtcaagagtttgagaccagcctggctaacatgatgaaacccatctctactaaaaatacaaaaattagttgggtgtggtggcacacgcctgtaatctcagctactcagaaggctgagggaggagaatcgcttgaacccaggaggtggaggttgcagtgagccgagatcgggccactgcactccagcttgcgcaaccaagtgaggctctgtctccaaaacataaataaattaaataaataaataaatttaataaataaagtatatacatctaacaacaaagcatcagacaaactgaggcaaaaattaaaagaaccacaaagagaaacaaaatagatttggagactacaacacctatcacaaatgaacactcaagcaggcagaaaatcagttaagaacatagctgaactcaataacaccatcaatcaactgtatacaatcaacatctgtagactacttcatccaacaacagcagaatacacattcttctcaagttcacatagaacattcaagacagaccacaagctaggtcataaaacacatcttaaaataaatttaaaagaatataaattacacaatgtctgctcttaaagcagaaatcattaacagtaagaaaaccggaaaatcccaaaatacatgaagattaaacaacacacctctaaataacacatagatcaaagacgatatctcaggataaattttaaaatattttgaattaaatgaaaatgaaaacacaagttatcaaaattgtgagatgtagtaaagcagtgcttgtaggaaaatgtatagcactgaatgtatatattagaaaagaagacataaacaagtttccatcttaggaaattagaaatagaagaataaattaaatccaaagtaagcagaagaaaacaaataatcaaaatgagagcagacatcaatgaaactgaaaataaggagtcaacagagaaaaatcaatgaaaccaaaagccggtcctttgaaatgatcaataaaatagataagcctctaagccaagctaactacgaaaaaaagagagaggacctaaattactaatacaagaaatattatacagataacttcttataattagaattgccaaaacttatgcaagaacaaatagacaatgtgaagttgtatagataattaataatcttccacagcagaaggcatcagcccacatgagttcgctagtgaattctgccaaacatttaaggaagaaattgtatcaattctctacaatctctttcagaggacagaagcagaagggatacttcctaattcatactataaggtcagcattaccctaatactaaaaccagagaaagagattacaagaaaactacagaccaacatctctcataaacacatatgtaaaaatcctcaataaaatattagcaaatcaaatccaacaacacataaaaataattataaactacatccaagtggtatttattccaggtacataaggctggttcaacatttgaaaatcaattaatatacttctatattatcaacaggctaaaaaagaaaagtaacatgaccgtatcagtagatgcagaaaaatcactcaacaaaatccaacacccattcatgataaaaactctcagtaaactaggaatagagggaaactttgtcactgtgataaagaatatctacaaaaaccctaccactaacatcatgcttcatggtgagaaactcaaagctttcacattaagatcaggaacaagacaaagatgtcccatctaaccactgctttccaatgtcatcctagaagtccaagctaatacaataagacaagaaaagaaaagcaaacagattgggaaggaagaaataaaactctgcagatgacatgctcacctatgtagaaaatctggaagaactgataaaaacactcttggaactaataagcaattacagcaaagttgtgagatacaaggttaacatactacagtcaattgctttcctatatacagaaacgagcaagtggaatttgaaattaaaagcgcagtatgctttatattagcgcccacaaaacaaaataggacaaaatacatataagttctatatgaggaaaattacaaaatcttgataaatgatatcaacgaagaatgaaataaacgaagagatagtccatgttcatgggcagaaagactaaatattgtcaagatgtccattcttcccaacttgatgtacagattcaatgcaatcccaattaatatcccagcaagctattttgtggatattgacaaaatgattctaaagttatatgaagagacaaaagactcaggatagccaatacgatattgaagaagaacaaagttggaggatttgacactgcctgtctaaaagatttattacaaagcaacagtaatcaagacaatgcggtattggcaaaagaacaaatagatcaatggaacagaatagagagcccagaactaaacccacatagctgggttgacagctatactaaacccacatagctgatttttgacagaagagcaaaggcaatacaatagagaaaagatagacttttcaacaaatggtgctataactggccatccacatgcaaaacaataatctagacacagcccttatactcttcacaataattaactcaaaatggatcacaggcctaaatgtaaaatgcaaaactataatacccctagaagataacagagaaataaataacctagggtatggcaatgactttttagatacaacaccaaaggcacaatccatgaaagaaaataattgataagctggacttcattaaatgtaaaaagttctgcaaaagacaatgtcaaaaataagatgacaagccagattgggagaaaatatttgtaaaagacacatctgataaaggactgctatccaaaatatacaaagaatttttaaagcttaacaataaaaaaacaaacaacctgatcaaaaaatgggtataagatcttaatagatacttcaccaaagatagatgtacagatgccaaataagaatataacaagttgctccacatcatatgtcattagataaatgcaaattaaaacaagacaccactacatatatattagaatagccaaaatctggaacactgacaaaaccaaatgctggagaggatgtggagtaacaggaactctcattcactgctggtgagaacgcaagatgatacagccactctggaggatgattcggcagcttctaacaaaactaaacaattttaccatttgacctagcaatcatgctgtttagcatttgtatttgtcgttttctcattgctgataaagatatatccgagactggcaatttacaaaagaaagaggtttaatcaacttacagttccacatggctgaggaggcctcacgaccatggcagaaggcaaggaggagcaagtcacatcttacatggatggtggcaggcaaagagagagagcttgtgcaggtgaactcctctttttaaaaccatcatatctcgtgagacttattcactatcacgagaacagcaggagaaagacctgcccccatgattcaactacctcctaccaggtccctcccacaaaacgtgggaattcaagatgagattggggtggggacacagtcaaaccatatcattccgccccggcccctcccaaatctcatgtccttatgtttcagaaccaatcatgccttcccaacagtcccccaaagtcttatttcagcattaattcaaaagtccaaagtacaacatctcatctgagataaggcaagtccctaacgtctatgagcctgtaaaatcaacagctagttagttacttcctagatacaataggggtataggcattgggtaaatacagctgttccaaatgggagaaattggccaaaacaaaggggctacaggccacatgcaagtccaaaataaggtagggcagtcaaatcttaaagctccaaaatgatctccgctgaatccatgtctcgcatctgggtcacgctgatgcaagagacgggtttccgtggtcttgggcagctccacccctgtggctgtgcagggtacagcctccctcccggctgctttcacagactggcgttgagtgtctgtggcttttccaggcacacagtgcaagctgtcagcagatctaccattctggggtctggaggacagtggccctcttctcatagctccattaggcggtgccctagcaggcattctgcgtaggggctctgatcccacatttgccttccgcactgccgtagcagaggttctccatgaaggccctgcccctgtgccaaacttctgcctgggcatccaggtgtttccatacatcttctgaaatctaggcggaggttcccaaaccccaattcttgacttctgtgcactcgcaggctcaacaccacctgaaggctgccaagacttggggcttccaccctctgaagcccaatggcccctttcagccatggctggagcagctgaaacacagggcaccaagtacctaggctgcacacagcacagggaccctgagcatgacccacgaaaccatgttttcctcctaggcctctgggcctgtgatgagagggggctgctgtgaagacctctgacatgccctggagatattttccccattgtcttggggattaacattcagttcctggttacttatgcaaatttctgcggccagcttgaatttctcctcagaaaatgggattttcttttctatcgcattgtcaagctgcaaattttccaaacttttatgctgtttcccttttaaaactgaatgcctttaacagcatccaagtcacctcctgaatgctttgctgcttagaattttcttctaccagatactctaaatcatatgtctcaagttcaaagttccccaaatctcttaaggcaggggcaacatgctgccattctctttgctaaaacatgacaagagtcacccttgctccagttcccaacaagttcctcatctccatttgagaccacctcagccttgatttcattgtccatatcattatcagtattttggttaaagccattcaacaagtctctagggagttccaaactttcccacattttcctgtcttctcctgagccctccaaactgtcccaacccctgttagctagtttcaaagtcacttccacattttcaggtatctacagcagcaccccactcctggtaccaatttactgtattagtccattttcatgctgctaataaagacatacccaagactggatgatttacaaaagaaagaggtttaatggacttacagttccacatggctggggaggcctcataatcatggtggaaggcaaggaggagcaagccatatcttacatggatggcagcaggcaaagagagagagcttgtgcagggaaatcctctttataaaaccatcagatcttgtgagacttattcactatcacaagaacagcatgggaaagacctgcccccatgattcaactacctcccactgggtacctcccacaacacgtgggaactcaagaggaaatgtgggtggggacacagtcaaaccatatcagcatttaaccaaggaagttatgaacttacgtctacataaaaacctgcacataaatgtttatagcagctttattcataactgccaaaacctggaagcaaccaagatgtccttaagtaggtgaacgaattaacaaattgtggtatatccagacaatggaatattatttggtgctaacaagaaatgagctatcaatcccttaaagatataaaggaaacatacatgcaaataattaagtgaaagaagccatctaaaaaggctacatactgcaggattccacctgtatgacattctggaataggcaaagctatgaagatagtaaaaagatcagtggttgctagaggctagggggaggaaaggaaaggcagagtgcatacagaatctttagggcagtgaaaagactgtatcatgtggatacgtgtcactatatatttgtccaatcctatagagggaacacaaatgtaaattatggactttgggtgattatgatgtgccaacacaggtttatcaactctatcaaacataccctctgctgagggatgttgataatggggaaggctgtgtgtgtgtgggcacaggaggcatacagaaaatctctgtaccttcttcttaattttgctgtaagcctaaaactgctctaaaaaattagtcttaaaaacaaacaaaaaagactcatgagtattcaaaagaattagaagcagggtctcaaagaaatatatgcctactcatgttcacagtagcattattcacgatagctaaaatgtggaagcaatgtgagtgtccaacgacagattaatagataaataaaatgtggtatatgcatacaatgaaatattactcagccttaaaaaggaagaaaattctgacttgtgctacaacgtggatgaaccatgatgacattatgctaagtgaaataagccagtcacaaaatgacaaatattgtagaattctacttatatgaggtacctacgtagttaaactcatagagaaagcaagtagcataatggttgccaaaggctagagggaggggagaattagtagttaattgtttaatgggtatagagcaagggtatccaatattttggcttccctgggccacactggaagaagaattgtcttgagccacacataaaaatactaacactaacgatagctgatgagctaaaaaaaaaaaaaaaaaaaaaaaaaggcaaaaaaatctcatagttttaagaaagtttacaaatttgtgttgggctgcattcaaagctgtcctgggccacatgcagcctgcaggttggacaggcttggtacaaagtttcgattgtgcaagatgaaaagagttctgtagatggacagtggtgatagttgcacaatgtgaatacaccactgaaatgcacatctgaaaaatattaaaacagtagatataacgtattttactaaaatagaaaaatcgaaaaaaaaattcactttcttatttttttctgtctgaaaaagagtagcattggcttgtatgtgcctataagccttctggagcaacataatacataagaaactaacccaggctgttaagggggcgtgggagctgggcacatgggaaaaggaagggagcatgacttcactgtatactcctctctaggttctgaaacttgtaaataaatgacctattcaaaaaccttaaacaaacgaaaacacttccctggatgctacaccctatcaagctaccacctctactgctctgtgtccttcttcataacatacttcctggtatggtctatttcttcagctcccactcatttcaatctaccataatctactgtccaacccctcgggcaatggaaaatgctggttcttttccagctaatcaatcactcccactctgccaaatccaacatgcacttctatgagctcatcttgtaagaattccacacgcttgactcttccctcctggaaacccaactcctctgtgctgtgctgccaccttctcctggtctcttccctctccaccggctgtcatggctcctccctctctgccagacctctgaacatggcagaacctagagctcagatgtcagccctcttctctttgaccccctgctttagatgtcacctccaggcgtcaatctcccaaatgtgcatctctcacttgatctcctcactgaggtccagaactgcccacagagcaacccagacttacccaaatagaacaccgcgacccatcctcatgcctgttcctcccgagtcttcgcatctcagtacgtggtaccactgtcaactcagctgcttaattcaaactcagcaaggcagcttccattcagccacttctctcatcccccatatccaaccaaagcaccaagtcctgccagctcatcttacaaaagtgtcctaaacctgccacttattttcacctttattacaaatacccctgtccaagcccccatgtgaatttcccttgactactgcagcaacatcctaactgctggtcctgctgcttccatttctgaccctctataattcatccttctcccagaagcaaaatcattctgttaaatatcctgtcagtcccctggtggtggtggtgggggtctgtaagaagctctgaatggccttctaatacttttacaagatctaaatttgcctgtggcctataagaccctgcatgttctggctctgaaatctcaattcctatcacagtgttgttcccctacttgccaggccccaaccataatgacctttctcagttcctagaactttctcacctcatagcctttgcacctactgtttccacggcctccttccccctgatccagctccatctcatccttcatgttttagcttacatattacccctcagagagaacatctccaaatgcctcctctaaaatgtttcctctggcctctacccacccactccaccacactgcctaccttactgctgccagagcactcatcaccatcagcagtcaccttatttatatttatgacctgtctccccagttagtatctaccctacttgagagtaagacttgtgtctaccttaatgacattgcaggtgctatgctcactacagtgcctgtctcaggaacaggttctcagttcaaatttgttcaatcaatcaataaagattaactaattaacgaatgaaccaatgaccttccaaagcactggctgggcttatccaggtcagccagaggccctaatccaagcaggactaaggtggtttgcactggatttcaacaatggtgaaacacgtttctccatcattgtaaaataacacattcctttggaaaaatacaaagaaacttgaagtattcaaacaatatccttgagccaacagcacgcctcaacatttcaaggcatatacacacatgcatacatacacacacacacacacacacacacacacacacactcaatttttggaggtgagggaggaaaagatggggaacaaaaacacacatttggtgagcctcatgcaattttttttttttttgagacagagtttcactcttgttgctcagactggagtgtaatggcctaatctcggctcactgcaacctccacctcccaggttcaagcaattctcctgcctcagcctcccaagtagctgggattacaggtgcatgccaacatgcccagcaaatttttgtatttttagtagagacagggtttcactatatgggccaggctggtctcgaactcttgacctcagatgatccacctgcctcagcctcccaaagtgctgggattacaggcatgagccaccatgcccagtctctttgctttttttagagatggggtctcactctgtcacccaggctgtagtgcaatggtgtgagcacagctcactgcagcctcaaactcctgggcaatcaagccatctgcctgcctcggcctcacaaagctctaggattacaggagtgagccactgtgcccagcctcataaaatttttaataaaaggcacatcattcactccagccgataattccccaacatattttggctaaaggctgtacgcagtggctcacgcctgtaatccaagcactttgggaggccaaggcggatggatcactaaggccaggagttcgagaccagactggccaacatggtgaaacctcgtctctacaaaaattagccaggcatggtggtccacgcctataatcccagctactcaggaggctgaggtaagagaattgcttgaactcaggaggtagaaggtgcagtgagccaagatcgcaccactgcactctaagcctgggcaatgaaggaagaccctgcctccagaaaaaaaaattttttttttttttggctaaaatcgaaggagtcccaaggtaggcctagatcacaacagagtgaacctagtagtgttcagaaaaggttagattatccgccacagaaataaaatgaacgtttcaaaatttaaaacacaggaatgtaaatggtcccagtaaataaaaagaagcccctaaaaatccttccactctgccagagcagagtaagaccaacaaggtcatatacccggcacacacgctctagctgttctttccctcctaattcccagtgatcttcttaaagcagctagcagaccttaccattgcattgagctgggagttgctggcctgcgtaatgccaagaatgttggtggtgtgcatcacttcaaccgaaaaactcggcagccagctcgcaatccgagaccctgaaacaaacaagaatccagtgtaagtttcagagccctgactctttcccccgtcatctgctctcacggtagccactgtaatggctggtgttcactgagggcttcttgtatggcaggcttctcatgccaagtgtttcacgtggactagctcatttaatcctcactacactccacatggtacctcctattatcattcttatagtatccttctcaaagatatagcactagtacccttggtctttggtctctgaggcacttagaagttaggggacttgtccaagatcacacagtttaactatgatggccaagatgtgaagccagacaggcaagctctagaacccttcactgctgagcaatcctgctttccaggggggctggatgcagcccagcccagcgccctcacacgctcagcctgggagatgaggaagcttttcaaggctctaaagcttctacaacacatgagctttggctcctctttcacaagctacacaaatgactactcacttggaggcattttcacatttacttttaggaagtattttttctttaatcttaaaagccgtggttttctgattcaaaattctttttaaattgttctattctacaaaaaggcttgtagactaacagcaccaagaagtctgctgcttctgttatttcccgaagaaaacaggagcctaagatacaacagcaccaagaattggctgtaaaacaacccaattatcaagctacacatttaaggctgcttttcattccttcacaaagaaacactgatgcatggaacagaaaatcaagtgtggccaggagcagtggctcacgcctgtaatccagcactttgggaggctaaggcgggcagatcacaaggtcaggagatcaagaccatcttagccaaaatggtgaaaccctgtctctactaaaaatacaaaaattagccaggcatgggggcacgtgcctgtaatcccagctacttgggaggctgaggcaggagaatcacttgaaccagggaatcagcggttgcattgagttgagatcacgccaccgcactccagcctggcaacagggcaagactccatctcaaaaaaaaaaaaaaaatcaagtggaatggctatctcaaaggtcttgagatgggtacaaacaaaacgtacccatttaagaaatggatacttatttcatgtactaactagggagaaataaagttgactttatctattttgactaaatttttagtagtcataattcacaaaataatggattacatagccaggtctcatctctaatattgctagtatatttcagaagttttacctggaagagcccttcattcacagccaccaaaccaggtcctctaaacccctctagcattctgggcccagccagccaagtagccccacctactcttctgggagacatgactctactccccctagtcccttctttgagggatttcaccaacacgacaccatccccactgtactccattcttgaaactcaaatcagggatgcgaatagcactactgctaacaaaattccagggatgcttgtgttacagtaataattataaacatgaactcacagaatttagcagtactggactgttgaaaatcaacagcagcttaatgtgaattaaggaaggatgatcaaccagaccttgatatgtcatagccttagaattttaagtgtggttttcattacaactccttttaacactgccgggaggcagaacatttatattttatggacaaagcaacagggttccagctctgattctgcttctggtactcaccagaaaggcttctcaatgatccttcattatatgcttaaatgctacacaaatgcaatatattattagcaaaggttaactattgagctaattaagtgtgctccttgaaggcatggttgattcagttttactcctccaccctcctgccccaccctgcccatattgacatggaatcaggcaaaatgcctggaacccctctgtttgttctatctctatccatccatccatccatcccacctaaacactttcaattaaaattgaaatacagtcaatgcgtagcttaacaacagggacacattctgagaaatgtgttgttaggtgatttcattgttgtgcgaacatcatagagtatatttacataaacctaaatggtatagcttactacacacctaggctatacgatatagtctattgttctaggctacaatcctgtacagcatgttactatactgaatgctgtagaggcaattataacacagtgctaagtatttgtgtatctaaacatatctaacagaaaacatacagtaaaaatatggtacacaaaaagtacacctgcatagggcacttaccaggaatgaagcttgcatgattaaggctgctctgggtgagtcagtgagtggtgaaatgtgaaggcctaggacattactgtgaactcctgcagactttataaacactgtacacttaggctacactaaattcatgacaaaatgtttctttctatattcaataaattaaatttagcttactataagttttttacttcataatcttaatttttttaactttttgactcttgtagtaacacttagcttaaaattcaaacaccctgtacagctgtcgaaaatattttcttttttattctataagagtttttctatttctaaaagttttaattttactttttaaatttttttggctaaaaactaagatacaaacacacgcattagcctaagcctacacaggtcaggagcatcagtatcactgtcgaccacctccacctcctgtcccactggaacgtcttcaggggcagtaacacgcatggagctgtcatctcctagaataacaataccttattttggaatacctcctgaaggacctgcctgaggctgctttacagtaaattttttttgtatgtaagtatgagtacactttaaaataatgataaaaactgtagtaaataccagactacaggaattttttaggtccattatcatcttatgggaccactgccatatatatggtttgccatggagtgaaatgtcgttatggggcacatgactgtataatattaaactggtctatacagggcaatttataactaaaatagtatctgcttaagggagaacaccccttaggtatagtttcagaggttgaaaccaactaaccatcgaaatggaagaagtgattgtgttggtttaagcgaggtctcccttcggctgctgctacaggaaccaaattctcatccaagttctctccttgatgttcttccctgacacgattattgtcggcaatattaagagacattctgcatgttggacaggaggtgtcttgttctagccaggaacgaagacaggagctaccaaaaagtccaaaagaagatacgtcagcatccttgattgttccttagcatactttgtgagaattcacccagaagtactctggatatatcaaatgtgctccaatttgattttctctctaccactagtgagatttaagtgttgagaagcatttatggactttacctacttgccctacttcactttaatacacttccagtgtgtcctgctgggaacatgaattctttaccatatgaagtcatctaccaagctcctcgttgtgacccctcttcaatggggcttcctagcatggctcaccatcttctcatccaactccatttggctacttcaaaatccatgtggctgaatcatccaacaccctggcctctcatgtccttgagtcctccactctgacgctcatgtctttcactctgctttagctaccaccagcacagtcatcaccttggcttgtcttcaaaatcttgatgtcaaaattctcactcattcactcaagctcctctccttccaactcacttatctggcaccaaacttactaagacctcccatctgctttctcctcaagcatgacagccgtacaggtccttacctccctgttcccctggctcacctctaacctctcctctccattcaccacctcaatgtcctccaccctcttctctttgcacgctgttttcccaacaaggccgaagcttcttttgccctctctcaggagatgataatgccttaattatggtagacattcaataaatacttgaggtgtccattaaagaaaggaaagggtactagagtaagaagcagaaaatgtgagatcagtcccaattctccctctaactagctgtgtgatccaggcaaacccttcaacctctattgactagtcctctccactaaagaatgaaatggctggatgaattaatctccaaggtccctcccattttatgagaatttgttatctttctctaagggctcaagtaggcactgaataaaaatgctgtatcttcttttaaatatctacgaacatgtgtagatataaagttataaaggaaaacctcaccataatatgataatcctcagagtctccagcaactaaatggtacataagtaacaggagtttcctagaggccaagatggagctacttcttaatcactctgtgtcataagagtgtgtgacagtcgtgttccaaaataatgtcatctgtctgtatgtgtatacccaactctcatattttgcaataattaaatacctataatttgtatgtgataatttagtcaaataaatgatttttttaagtccaattctcctactgacacctttaaatcacaccactagtataataaaattagccttgtgggagattataaaaatatgtaagatccttgccttccaataatgctacactgtgacatactttttataagcaaatctaaatttatttcacagagtgcaaaatcctcccacataaaatataacagcctaaaaactccaaggtgagtacaactagttagatatagttttctgtttaaaaaaaaaaaaaaatgctagagttccttaactgagagaaatcaaactttagagagaaaacagatctattcactggactctgaaatgttgcaaaaatatcctctacagcaacaaattatctagctattgtgcctgcaggaatatagacattacctttatcacaaattaaaatgaatttgccttagattctcagcacacaatcattccggaagttacaaagcaaagcaaaccaagagcatatcctaacaactatttgttcactcaacccgaggcagataagtgttttaaaattaaatcctaactcttaagcaaccactgagtaaagaagaaatcatgggttccaagatggccgaataggaacagctccagtctacagctcccagcatgagtgacgcagaagatgggtgatttctgcatttccaactgaggtaccaggttcatctcactggggcttgtcggacagtgggtgcagcgcaccgagcatgagccgaagcagggcaaggcatcgcctcacccgggaagcgcaaggggtcagggaattccccttcatagccaagcaaagctgtgacagactgcacctggaaaatcaggtcactcccaccctaatactgtgcttttccaatggtcttagcaaatggcacaccaggagattatatcctgcgtgtggctcggagggtcccatgcccacggctcggagggtcccatgcccacggagcctcgctcgttgctagcacagcagtgtgtgattgaactgcaaggtggcagcgaggctgggggaggggtgcccaccattgctgaggcttgagtaggtaaacaaagcagccgggaagctcgaactgagtggagcccaccgcacctcaaggaggcctgcctatagactccacctctgggggcagggcatagcagaacaaaaggcagcagaaacctctgcagacttaaatgtccctgtccgacagctttgaagagagtagtcgttctcccagcatggagtttgagatctgagaatggacagactgcctcctcaagtgggtccctgacccccgagtagcctaactgcgaggcaccccccagtaagggcagactgacacttcacacggcggggtacccctctgagacaaaacctccagaggaaccatcagacagcaacatttgctgttcagcaatattcactgttctgcagcctccactgctgatacccaggcaaacagggtctgaagtggacctccaggaaactccaacagacctgcagctgagggtcctgactgttaggaggaaaactaacaaacagaaaggacatccacaccaaaaccccatctgtacgtcaccatcatcaaagaccaaaggtagataaaaccacaaagatggggaaaaaccagaacagaaaaactgaaaattctaaaaatcagagtgcctctcctcctccaaaggaatgcagctcctcaccagcaacagaacaaagctggacagagaatgactttgacaagttgagagaagaaggcttcagacaatcaaacttctccaagctaaaggaggaagtttgaacccatcgcaaagaagttaaaaaccttgaaaaaagattagacgaatggctaactagaataaccaatgcagagaagtccttaaaggacctgacggagctgaaaaccatggcacgagaactacgtgacgaatgcacaagcttcagtagccaattccatcaactggaagaaagggtatcagtgattgaagatcaaatgaatgaaatgaagcaagaagagaagtttagagaaaaaggaataaaaagaagtgaacaaagcctccaagaaatatgggactatatggaaagaccaaatctatgtctgattggtgtacctgaaagtgacggggagaatggaatcaagttggaagacactctgcaggatattatccagaaggacttccccaacctaggaaggcaagccaacattcagattcaggaaatacagagaatgccacaaagatactcctcgagaagagcaactccaagacacataattgtcagattcaccaaaggtgaaatgaaggaaaaaatgttaagggcagcaagagagaaaggtcgggttacccacaaagggaagcccatcagactaacagctgatctctcagcagacactctacaagccagaagagagtgggggccaatattcaacattcttaaagaaaagaattttcaagccagaatttcatatccagccaaactaagcttcataagtgaaggagaaataaaatactttacagacaagcaaatgctgagagattttgtcaccaccaggtctgccctaagagctcctgaaggaagcactacacatggaaaagaacaaccggtaccagccactgcaaaaacatcccaaattgtaaagaccatcgaggctaggaagaaattgcatcaactaacgagcaaaataaccagctaacgtcataatgacaggatcaaattcacacataacaatattaaccttaaatgtaaatgggctaaatgctccaattaaaagacacagactggcaaattggatagtcaagacccatcagtgtgctgtattcaggaaacccatctgacgtgcagtgacacacataggctcaaaataaagggatggaggaagatctaccaagcaaatggaaaacaaaaaaaggcagagattgcaatcctagtctctgacaaaacagactttaaaccaacaatggtcaaaagagacaaagaaggccattacataatggtaaagggatcaattcaacaagaagagctaactatcctaaatatatatgcacccaatacaggagcacccagattcataaagcaagtccttagagacctacaaagagacttagactcccatacaataataatgggagactttaacaccccactgtcaacattagacagatcaacgagacagaaagttaacaaggatacccaggaattgaactcagctctgcacccagcagacctaatagacatctacagaactctccaccacaaatcaacagaatatacattcttctcaccaccacaccacacctattccaaaattgaccacatagttggaagtaaagcacttctcagcaaatgtaaaagaacagaaatcataacaaactgtctctcagaccacagtgcaatcaaactagatctcacgattaagaaactcactcaaaaccgctcaactacatggaaactgaacaacctgctcctgaatgactactgggtacataacaaaatgaaggcagaaataaagatgttctttgaaaccaacgagaacaaagacccaacataccagaatctctgggacacatttaaggcagtgtgtagagggaaatttatagcactaaatgctcacaagagaaagcaggaaaaatctaaaactgacaccctgacatcagaattaaaagaactagagaagcaagagcaaacacattcaaaagctaacagaaggcaagaaataactaagatcagagcagaactgaaggagatagagacacaaaaaacccttcaaaaaaatcagtgaagccaggagctggttttttcaaaagatcaacaaaattgatagactgctggccgggcgcagtggctcacgcctgtaatcccagcactttgggaggccgaggcaggtggatcatgaggtcaggagatcgagaccatcctggctaacaaggtgaaaccccgtctctactaaaaatacaaaaaattagccgggcgcggtggcgggcgcctgtagtcccagctactggggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaattgatagactgctagcaagactaataaagaagaaaagagagaagaatcaaacagatgcagtaaaaaatgataaaggggatatcaccaccgatcccacagaaatacaaactaccatcagagaatattataaacacctctatgcaaataaactagaaaatctagaagaaatggataaattcctcgacacatacaccctcccaagactaaaccaggaagaagttgaatctctgaatagaccaataacaggctctgaaattgaggcaataattaatagcttaccaaccaaaaaaagtccaagaccagacggattcacagccgaattctaccagaggtacaaggaggagctggtaccattccttctgaaactattccaatcaatagaaaaagagggaatcctccctaactcattttatgaggccagcatcatcctgataccaaagctgggcagagacacaacaaaaaaagagaattttagaccaatatccctgatgaacatcgatgcaaaaatcctcaataaaatactggcaaaccaaatgcagcagcacatcaaaaaccttatccgccatgatcaagctggcttcattcctgggatgcaatgctggttcaacatacgcaaatcaataaatgtaatccagcatataaacagaaccaaagacaaaaaccacatgattatctcaatagatgcagaaaaggccttctacaaaattcaacagcccttcattctaaaaactctcaataaattaggtattcatgggaagtatctaaaaataataagagctatttatgacaaacccacagccaacatcatactgaataggcaaaaactggaagcattccctttgaaaacgggcacaagacagggatgctctctctcaccactcctattcaacacagtgttggaatttctggccagggcaatcaggcaggagaaagaaataaagggtattcaattaggaaaagaggaagtcaaattgtccctgtttgcagatgacatgattgtatatttagaaaaccccatcgtctcagcccaaaatctccttaagctgatatgcaacttcagcaaagtctcaggacacaaaatcaatgtgcaaaaatcacaaacattcttatacaccaataacagacaaatagagagccaaatcatgagtgaactcccattcacaattgcttcaaagagaataaaatacctaggaatccaacttacaagggatgtgaaggacctctcttcaaggagaactacaaactaatgctcaacaaaataaaagaggacacaagcaaatggaagaacattccatggtcatggataggaagaatcaatatcgtgaaaatggccatactgcccaaggtaatttatagactcagtgccatccccatcaagctaccaatgattttcttcacagaattggaaaaaactactttaaagttcatatggaaccaaaagagagcctgcattgccaagtcaatcctaagccaaaagaacaaagctggaggcatcatgctacctgacttcaaactatactacaaggctacagtaaccaaagcagcatggtactggtaccaaaacagagatatagaccaatggaacagaacagagccctcagaaacaataccacacatctacagccatctgatctttgacaaacctgacaaaaacaagaaatggggaaaggatttcctatttaataaatggtgctgggaaaactggctagccatatgtagaaaactgaaactggatcccttccttacaccttacacaaaaattaattcaagatggattaaagacttaaacgttagacctaaaaccataaaaaccctagaagaaaacctaggcaataccattcaggacataggcatgggcaaggacttcatgtgtaaaacaccaaaagcaatggcaaccaaagccaaaattgacaaatgggatctaattaaactaaagagcttctgcacagcaaaagaaactactgtcagagtgaacaggcaacctacagaatgggagaaaatttttgcaatctactcatctgacaaaaggctaatatccagaatctacaaagaactcaaactaatttacaagaaaaaaacaaacaaccccatcaaaaagtgggcaaaggatatgaacagacacttctcaaaagacacatgaaacagccaacagacacatgaaaaatggtcatcatcgctgaccatcagagaaatgccaatcaaaaccacaatgagatatcatctcacaccagttagaatggcgatcattaaaaaggaaacaacaggtgctggagaggatgtggagaaataggaaaacttttacactgttggtgggactgtaaactagtttgaccattgtggaagacaatgtggcgattcctcagggatctagaactagaaataccatttgacccagccatcccattactgggtatatacccaaaggaatataaatcatgctgctataaagacacatgcacacgttatgtttattgtggcactactcacaatagcaaagacttggaaccaacccacatgtccaacaatgacagactggattaagaaaatgtggcacatatataccatggaataccatgcagtcataaaaaatgatgagttcatgtcctttgtagggacatggatgaagctggaaaccatcattctcagcaaactatcacaaggacaaaaagacacacaccacatgttctcactcataggtgggaagtgaacaatgagaacagctggacacaggaaggggaacatcacacaccagcacctgttgtggggttgggggagtggggagggatagcattaggagatatacctaatgtaaatgacgagttaatgggtgcagcacaccaacatggcacatgtatacatatgtaacaaacctgcacattgtgcacatgtaccctagaatttaaagtataataaatacatacatatattttatatataatcatttataatatataaatgtatcatttataatatataaatgtatcatttataatatataaatgtatcatttataatatataaatgtatcatttataatatataaatgtatcatttataatatataaatgtatcatttataatatataaatgtatcatttataatatataaatgtatcatttataatatataaatgtatcatttataatatataaatgtatcatttataatatataaatgtatcatttataatatataaatgtatcatttataatatataaatgtatcatttataatatataaatgtatcatttataatatataaatgtatcatttataatatataaatgtatcatttataatatataaatgtatcatttataatatataaatgtatcatttataatatataaatgtatcatttataatatataactctatcatttataatatataactctatcatttatatatataactctatcatttatatatataactctatcatttatatatataactctatcatttatatatgtaactgtatcatttatatatgtaactgtatcatttatatatgtaaatgtatcatttatatatataaatgtatcatttatatatatataaatgtatcatatatataatatatcattatatgatacactatgctgcactccaatattggagaagtgaatattttgaagggatatgtattttcaagggatatatatatctctacatatataaggatatagatatatatatcccttgaaatgtagagatatatgtgtatatacatatatacacctatacacatagatctctacatgtttctttgataatttaactgaaatttgctcttattttaaaaataaactatagtttacctgtaaatatacagatattaaaaaaaaaaatcacttgggaaatgagacactttgagacaaatgaaaacaaaaccacaacatatccaaacttatgagatgcagcggaagcaatgctcagaggccaatatgcagcagaaaatgcctaaaaagaagaaagctctcaaatcgaaaacctaactttatgcctatagaaccagaaaaatagcaaactaaacccaaagccaacagaggtatctagagtaattcatagagtcaaaaaaatagaatggtggttgccaagggctttgggaggagcagagagggacttgctatatactggagacaatttcagtttcataagacaaaaaagttctggagatagatggtgatgaaggctgtacaacaatgtgattgtacttcatgccaccagaccatatacttaaaaatgactaatggtaaattttatgttatattttaccagaataaaaaaaatatacttaagaattattactaaaaaaaaaaacaaaattcaccataataagaaaacacttcacacccacgagaatggctataataacaaaaatagaaaatgacaagtgttggcaagagtatgaagaaactagacccctcaggtattgttgggggaatatcaagtggtacagctgctgcaccactttggcgtttcctcaaaagttaaacatagaattatcatatgatccagaaattccactcctaggcatatacccaaaagaagtgagaacaagtcctcaaacagatacttcttacaagctcatgttcctagcagcattattcacaatagtcaaaatgtggaaacaacccaaatgtccaccaatggatgaatggataaactaattgtttaatttataaaattatttaaattcacccataaaaagtactgatacatgctacaacttgagtgacctcaaaaaatactaagtgaaagaggccagtcacaaaaagtcacatgttatatgattcctttatatgaaatgtccagaataggttaatccatagagacagaaagtggatcagtggttgccaggtgatggagaaggaaggaatggagagcacttacttagtgactatggggcactattgtggagtgataaaaaggttttgaaactagcgagaagggtggttgcacaacattgtgaacacattaacggcaactgaactgtacactttaaaatagttaaatgtatgttatctgaattttgcctcaaagaaattaaatcctaaaattaatctaaccatatgcttgaaaatattatttctgagctaaaatagagttattctgagttattcttcccaactagcctccaagctccttaggggctaactaattttgagaaatgtgtgcaaattccgtcttcccaacctcaacaaacagcaccactctccacccaactgcccaacctgcataactagagaaacgctggtacctctttcattcctcactttccctcggccggtctggcatcacacccttcctgatccctcaaatctgtcttctcactaactctacttctaccaccagagtccaagctacttttttgttttttagatggagtttcgttcttgttgcccaggctggagtacaatggcacgatctcagctcactgcaacctccacctcccaggttgaagcaattctcctacctcagcctcccaagtacctgggattacaggcacctgccactttgcccagctaatttttttgtatttttagtagaggtggggtttcaccttgttggtcaggctggtctcgaactcctgacctcgggtgatccacctgcctcagcatctcaaagtgctgggattacccctgaaccgctgcagccattactaaccaatccccctggatcttttcaagcagcaaatctaacccgccagtccttaacattcaatagcatctcaccactcccaaaggtcctccagaccctgcctatgtgtctcctgcctcagcagacacccctctcctttactctctgggatcggccacacagcttctcttttagtctcttccatttcttcctgctgcacagatgctccctctcaagtacctagtaccacgtgatccctcctttttgttgacttaactcctacttatcctcaagagtcacttccttcaagtttgagttggattttttcattacaagctctcaagaaccatgttcctttgctttaaagcacttatctcattgatactttaaaattcataaatatgcctggttcattcgcttttgactcctccattcgactgtaagctacaggaaagcaatgaccacagtggtcattttcattttatccccagagcctaacacagcactcagcacattaaaaaaaaaaaaaaaaaaaaatctgtcaacatatgtgttgagttaccgagactctagctcccatatgaaaaagaagaaaatctctttgagactataaaataaagaaaggaagattaaagatgcaaagatcagaactttcccaatatgcaaaattgaaaacacatgcaaaaggccaaaagatacctcaaggtccatcaacatcaaaacaccaaacctatacacacagtcatttacgtgagacagacagaaccccaatgacatctcagatctacttccatctggaaggattacagaagagactatttgtaatcctcgataacagacacagctcttctgtgctgtttagcggtcctggtctagtcccatctcaatccacttctctggtgtgctcttaaggcttcttttgggcatgtacaaaatgcaaaattatatattctctctcccagttagataataagctgtctgaaagcaaggactccccgctaatcctttcttttaaatcttacaggcatatttgctatacttcagagctaaaatggagaagaaatatgaagacagctaccatacccagaaactaagatggcaaactatgggtgggaaacagtcctatgatgtagggaagaggctaaggaacaaagaaggatacccaagagcttcccagaacactcagtgccagcagcaaggccaggctgaggtaatgtccccactcctccactaggatgagtctcgagcctgggtacacaaagcacacacacgccctggacagaacacctgtcccacatggcccttcacaaagctcctacttgtggaaaagatgtccacagggcagtttccgcgcagcctgcatggagtcccaacagatggcacagtcgtcattgttgacagccagctcctctggagttgcaactgcaaacctgtggaaacaaaacaagcccagcaggaacctcagtcagttccacacgcacactaaacaccacttgatagactgcgcctgtatcacaacacagttacagagaaagcatgttcagcaaaacattcttgataatcaaaaatataatttaccttcaaagccctttcaaaagtgagtaacttatgcacaggaactttgtctaaataatggttgctaggccgagcgcggtggcttatacctgtaatcccagcactttcggaggccgaggtagggggatcatgaggtcaggagttcaagaccagcctaaccaacatggtgaaaccccgtctctactaaaaatgcaaaaattagccgggcgtggtgacaggcgcctgcaatcccagctactcaggaggctgaggcaggagacttacttcaacctgggaggcggaggttgcagtgagctgagattgtgccactgcactccagcctgggtgagtgagactccatctccaaaataataataataataataataatggctgctgttagtgaagacctcggagaccatatccggacaaatcagaggagtaaggcccccagagatccaatctgtgtccctggccacaaagaagagatccaagctgtccccctgggtgcaaagaggatacccattaatcttgcacctccaggcgtggcttagccccagcttggcaaaaaagtgcctccttcaatgaggttaagtatgtgtgtgtaaacatgcatgtgcaaagaactgagacccactttcaggaaatgaacagggtagaagcccaatgaagtgtctatttgataataatgacaataaaatcatgacaaataagagcctaatactgagcactatctgcccagtaccattctaagtacatgaattatctcaccaaattctcccaatagttcaggcagaaggttctgttttcatccctaatttagaggtgaagtaaattgccccaaatcacacagcacctaagtggggattcacacccgggcagtctgactccagagcctttcctctccaccactctattagcagtttacaaacatacattctgacatactctgggatctgctgttattaaaaaactaaaatgagtaaacttaggcaacatcaacttgtgcttccttacctggcctccatgtttccaaccacacgtagatagttcttgtgccgacgaattcgacgttgcacctcatgaaacaggtaacgcagctgcataaagatgaccaggctggccatggataaccagatgttgccaaataacttagagagaaagagaataaaacacacggtaaaagcgaacgtgaacttgctagtgatgaaggcgcagtatgcagcggaagctcttcactgttggtgatggtgaactgcaatgtctttcagaaaggaaatacacagatttatctcattactctaaacaatgcacatcctcgtcagcctaggtgctccaatgccagtcatctttcctgagaaactcatcagaaatggaaaagctttatgcaaaaagatgtctatccatgcaattataaaacagaaaatatgaaaatgaacaaaatgcccagaagaacagttaggttgtaaactcatgtaatgtaaaattatatagtcattaatttcacttattatactatataactacatattactattatatttgtatatataacagttctgaaggtcaattatgggaagatagtactagataaatgaaaaaagcaagatataactatctttatcaaactaatacatgataaaaaatatgtaaaatgtgaaatagcaaacaaccaaatataatctaaataacccattgtgggatgcggtttattaaatcatggtacagctatctgatgatatttttatcctgaaagtattaaaatggcttagaagaactgatgttagcacaggaaaatgttcataatacattagtttttaaagaacagaactatatgtctaaaatatgatctcaatttatgaatgtatgtactcaaatacataaaaagaatcagttaaatacaaaatacataaaaatacaaaatacataaatacaaaaaatacataaaaagaagcagttaaatacaaaaaatacaagcatgaggaaaaaaaatttaaaaaaagaagataaaaaatcttaacagttatctttggccatttgtttgtcccctttttgaggggggagggaggctttttttttttttttgggacggagtgtcaccctgtcgcccaggatagagtacagtggcgcgatctcagctcactgcaacctccatttcccaggttcaagcaattctctgcctcagcctccccagtagctgggattacaggcatgagccaccgcgtccagccgaggctcttttttaaaaaaaagaattacatactttctttaaaaagtatgttttcaaagtttctttcaaaaagtagacttagaaatgtgccacgtctagcccaataattttaaaatgctacttgctaggcttataatttaaataaattgcccaccaactattttaattctcaccattattagatcactgaagggccaaccaatgaagcagatctacgacaccgtaacgtctaacataccaaagtaaaatgtaaacaatgatggtagtaggaatgtaggaattaagtgtaaagactttttttaattacaaagatggaaaatgtataaatctgtgaagtagctaacactgcaggaattcccattaccacctacaaagtacctgctaaatatttaaagccatagaaactatggggaaaggcagctccttaatttcatgctaaaagaataatctattgacttggtcagcagagttaactaagtctcccaggacagcaaacacctcctgagttaggcaccagccaaagcagttccatggcactgccttacacccagtggcaaaaagagggagggtttgcagccacattcatttttagtctttaagtagtccatccacatcttatttctaaagtttcattttttaatgaagaaaccattactgttcctgattctgaaaggcttgccctctgttagagctccttctgaggaaacttaccaacatgtgaatatggtgcatgaggtccagggacaggagagtgagctccatgacaaagtctgtgtaatagacatacgtcccctttccttcccacgtcccttcgtggttgaggtcccagaggtgaattacgtatctgtaatgaagagagaaaacaccttagtaatttactgttactactgaatttggtttaaccatgttgtaatttagtccgatttttatatatttcatacctgctacatcttaaaatcaactgtatgagtaggcctccatcacctccctccccaatttcactcaccgtaaaatcacatgagcagtcctcactgtcacaagaagagactataaaaaaggatattttctttttagtaaaatgtagcattgctcaggccaaactttttataaaatgataaaagacaaacatttctcagttcaattaaaaagcagattgttcaagtttacccattattttattttctctgcttcaaatttctgtaaaatatttttatgacctagaaacccaacttttattgaggaaaagtcctgttaataggtgacaaccaattacacctaccccccaggaatccccctacaatcttgaggtttaccctggtagtctgaccatcaattctatttcacacagcattaagtcactatcactgattacttagaagggtgatgctgtaactccaagtatagttcaggtactgctatcctagacacgaggacctgctctctccctagtgctttgtgcactccctttgtccaccagcagaaaaaagaacgaaagcaatcaaaagcaaaataaggccagccacatcacacctttaatcccagcactttgggagaccgaggcaggaggattgctcaagcttaggagttcaaaaccagcctgggcaacatggtgaaaccccatctctacaaaaaatacaaaaattaggtgggcatggtggcacgtgccagtagtcccagctacttgggaggcagaggtggaaggatggattgaacctgggaggtggaggctgcagtaagcagagatcgcaccacagcactccagcctgggtgagagagccagaccccagaccctgtcagaagggaaggggaaggggaagaagtggaaggggagaggggagaggggagagaggagaggagagaggagaggagagaggagaggggaggagaggagagggacaaaataagtctctcatggcttttttttttttttttgtagagacaaggtcttgctatgttggctaggctggtcttgaagggtattttttttattacagaaattgacggccaggtacagtggctcacacctgtaatcccagcactttgggaggtcgaggcaggccgactgcttgatctcaggagttcaagaccagcctggtaacatggcaaaaccccatctctacaaaaaaatcaaaaattagccaggcatggtggttcatgcctgtggtcccagctactaaggaaatgagaggatcacttgagcccacaaggtggaagttgcagtaagcaactgcactccagcccgggcaacagagtgacaccttgtctcaaaaaaaaaaaaaaaaaaaagatatttttcattaagaaaaaaagtcctcttaatctagtagaataaaactattacattatttatgttttagattaaattcccatttgtaagtgaaaaatattttacaggagagagaaacactatgaatgtaagaaatgatttagtttaaaatatcaaatctgtaatatgataaattatcttaaaagaataaacagtaacaagctaaaataaaagtatatactatagtatgagctgacgggcctaagttaaatgtgcttatttttaggtatacccttttcaaagtttggataatattatattagttgaaagttagagaatcaaaaaaaggcaaacataagtatcattctaactttgcaataaatctaaagcaaataagtcagtgtaaatggatttttcaacagattttctgtcaagacgaaatacggttgtatatttttcatatacagaagtattcacctaagattacatatcttattatttatattaggactattgtattttaattacaatattataatatgataattaacattatgtatttaaatgtttcttttctaattttacttacactactaaatgtactcaaaaatgaatgctatcaaacagaaataaactttaactctgctctaccaaattcccaatgagtagttcaaatgtagtgttttgatattagccaattagcttcagtttatctaatatctcattttttaattaataatactaattatgggtaagataaaagtattttgcctttggcctgaagaaaaggcaaatatagccattaaatataaggacatacaaacaatttttatttctttttttttttgagatggagtctcgctctgtcacccaggctggagtgcagtggcgcaatgtctgctcactgcaacctccgcctcccgggttcaagcaattctcctgcctcagcttcccaagcaggtgggactacagacgtgcgccaccacgcccaactaattttttttttgtatttttagtagagacagggtttcaccatattggccaggctggagaatttttatttctactgaacagaaattggtattttcagaaaggtttaaaagagtgaaaaatttttaaatcttaaaatattcatgaatagaccagatttttccttcaaaatgatgagtacagtttattcattattttgtaaaatctttataccctacgtaaagaaagagttacataaaataccacacaaaagcattcagtaccagtacccaacacacaaaaaggaactgaaatgcttgttaaaatgaaagaccaaatatccacctgtcatttcatgggtgaaaataacttgtcaaacatccagcttccttgaaaacagacagaaatacaatctgagcaagtcctgcatccagtatctcacctctgcagccatgaaagccaaggtgtgcattccgtgggtgtagccggtgatggagcagacggccgccagtccacagcaggaaagcagcatggcaaccaacagggacaggactcgaccgtggctgctcatcggcgtggtgggcgagaaggaaagctgaaatgcacacagtaggaaactgctcattcttcttcatggaagtgttaaacttcactgagaaattcaaggtcaatcttggcttctctgcttagggttctgtgctaagcacagaaaagcatcccattactatatggtcctattctccaataacccaaatatgagcatgaggtgatatttagagatccgtgtcatttaatttactgagtataacaatatgcattatattttcatcccttactctcaaagatcctcctagcactgggattataaacctctagaagcaatgttccgagggtatacaactctctcctctcaccttcaacaggactcaggacagtgcctgttctgttctgtttctttctcaatcttgctctagtcctcctctctgaaattggcattcctagtctattagggctagcacaattgaaatgcaatccaggcacaggtttaccactactacaacgtgatgtcagcattatgcaaggagaggcaacagtctgaaaagaaggcctagagctgcaactcctgaggtcacaggcggagattaaaaaaaacagtttgggaggttagaagctcctgtttgtgacttcaaatgagggttgaatgtgaaagaaataaaggctgtgagagtgagattaactcaaaccaaggtgcaaggtccatgtggactgggtaaagacagggaaaaacaaggccctggagcgggtttaactgaggggcagcactgtagatgcacatttatctgggactcatgagactacttcaggtcactaatgggttgaaggttcactcatacagctatgatctgaaaccaagtgacagatcttgtaccagacataaaatgattcacttcgcaaacaaggaagctgagggagctaattcagtcctggcccggggtggaaatagtataaactactcagaaagaagagctccacgaaccagagtaagctgggagagacagaaggagactagaacagaaaatatctagaaaagaccagattttattgtttatgtatcaaggtttccttgcactgtgaacaaaacagtctgcataggtgaagtgaccccatgttagcagtaagtaaacactatggggttgggaagaaagctccccaggagacaacgattctgcatctcttggctgctgtagaaagttcttcaagaaacaggcaatgggggcctgatctagaagtcttcccagaagagctaccctgaccatgcctgctgtggctcattcacattacacaattcaaagttggcaaacgtggtgactaagcaagcaaaaagcttggctaaaaactcacatattcaaatcgatccttgcagagctgaaccatcaggtgcagaaagacaagtccggcaaaccagaggcaccacatgaccacctcttccactgtctggacattcagcacaccaaagatgaaaatgaacttgtagaaaataaaattccaaaatttgtctttgagatgctaaaaaagaaaaatgtttatgaaggtgagtaccatcacacctaccccatttgagggaagttaccataacaaaagccggcttctatggaagatatattctgcacttggctttctaatacttgtcctcaagaaaacagaaaaaaaaaaaaaaaaaaaaaaagcagccatctgaagaatggaggtaagacacccagaaactaatctgtaaactttggactataaccctaaatcaattatggaatgttagctattcaaaggatagcgatattagtttagtaacttatatattaagaaataggccaggcgcagtggctcatatctgtaaccccagcacttttggaggctgaggtgggtagacagcttgagctcaagagtttgagatgagcctcggtaacatggggaaaccccatctctaccaaaaaaaaaaatacaaaaattagctgggaatggtggtgcacacctgtagtcccacctactcaggaggctaaggtgggaggattgcttgagcccaggaggtcaaggctacagtgagccatcatcatgccactgcactccagcctgggtgacagagcaagaccttctctcaaaaaaaagaaaaaaatgcttacatttttaatgcacaatgaaaaagaatggcaagggctatcatttttactacttctaccttccagattcttacacaatagaaaagattagactttgtaaaaaaaattcttcaaattaaaaaataacacaacacaaccacttgccagcccataataaaggcggcataaaaagtacaaagaaaatgaaaaatgctgccttaacatttttatgaattttcttgtcttttccctatgtacaaaacacattactttttgtacaatgctttctttcacctattgtattgttagaaccttaacaatgtcaatgaatattctctgaatataccaatataccgtttcaatggctaaagatggacactgaaactgttttaaaattttcaccacgcaaaaaaaacattataatgagggccgggcgtggtggctcatgcacgaaatcccagcattttgggtggccagggcaggcggatcacttgagcccaggagttcgagaccagcctgggtaacatggcaaaatcctgtctctactaaaaatacaaaaattagctgagcatggtggcacaagcctgtaatcccagctacttgggaggctgaggcattagaattgcttgaacctgggaggtcgaggttgcagggagccatgatcatgccactgcactccagcctgggcaacagagcaagactctgtctcaaaaaaaaaaaaaaattgtgatgaatatttttgtatgtatctttgtatgagttacttcagcactgtcaaatcaaaaattgcaaagatttttatggtttatagtaaaatctacctaacttccaaagcagtcctgtaagtgtacattcccatgggcagtgtgtatgcatatttgcttcactgtactcttttacacagagggcttccagttttaacaatcttcactaaccctgaaataggagagcaataaggagggtctagttcccccacatgttaaaatagactatcaagccgtctaggggggtcagggagaactgactgaagaggataagaatggaagcatgattctaagtatacttttttttttttttttaaagagacagagtctcactctgtcatcctggctggagtgcagtggcccagtagtagctcactgcagccccaaactcctgcgctcaagcgatcctcccacctcagccttctgagtagctgggattacaggcacatgacatcatgcccggctaatgttttttatatttatattttgcagagatggggcctccctctgttgctaaggctggtcgcaaactcctgggctcaagtgatcccaccttggtctcccaaaagaatgcttttatatgtaatttggaaccatgtaaatgtttcacaaattcaaaaaataaacacaaaaaagcaaaatatactacaaattaacaacgtgactccttaaagattttgagaacttaaacacactgtactctgaccagatatcttttgtagagaacaaaataaagtggaaaaaaatcatagagtatgccctaattctatccatcaaaagggcagagacaccctagtggtaatgagcacactcagccagtatacagcttggcttctaaatatcattgcccaataacgtgaactaggaatcgttggtgaaatgtctgtttccagacctggtgcagggaaagtacaaggtgaacttaggacattttgtgccctggttttgaatgacactgccacttggctctgccatttagtttctgtgtgaccttgggaaagtcacttaacatccctgtgctttagtttcctcatccatacaataggtcttataataacagcatatacctcatagaattgttgggggaattatacataatatatgtgaaatggttagacaagtgccatactaggcactaagcacttaaaaacgcatcaaaaagcttccttgctctaaacctccacttaacattttaatcattttagatattcgatgtctttgcctctagcattactctatttctagaactttaagcacccaagagcaaacccatgtcaatcctagagatttctaactcaaaatggttcctaattgatgctactggatgacattaaacataaataaaccaacacagaacagcagggaagatgcgatcgatgctgaaaaaaattaaagtggagctggataagaaatatgctcattataattacctctggatctagttaaaaaatctctaaaatactccaaggttatactttctataaatttcaacctgatagaagtaaccttttagggaaaagaaagtatataaagcccactggtgccagatcaatccaccaagcctgcctggcctgaccaatttctggtccacaaataaaaaatttgaagagaaacttgaagaagtatcaaaagaagcatttaagccagtagaagtggctcacacctataattccagcactttgggaggctgaggcgggcggactgcttgaactcaacagtttgagaccaacctgggcagcatggtgaaattccgtctctacaaacacctaaacaattagccaggtgtgacacatgcctgtagtctcaggtactcaggaggctgagatgggaggagactgcttgagcccaggaggttgagactgcagtgagtggagatcgcaccactgcactccagcctgggtgacagagcaagacgctgtctcaaaagaaaaaaaaaaaaaggcagcatttacaacctatctgggagacctctagagtcgatactggagaaagtgctgaaaatgaaaaatctctgagaatacaaaatagtcctgttcacaatggcatccaagggctcaaccaccaagtaatacatgtcagctctaaactaggacttcagctgattttataaaaggaaatttgggttgaaaagggtaggtaaggagagaatggaacactctgaacataaagtaaagctgctgttgtgcttttcatatagtaggttcctgtgttttatcactgggataagatagaataaaacacaattttgttcttatgttgtgattttgaaggccagttctaaatttttactttaaaacataccatgccaggcacagtggctcacgcctgtaatcccagcactttgggaggccaaggcaggcggatcacctgaggtcaggagtttgagaccagcccggccaacgtggcgaaatcctgtctctactaaaaatatataaattagctgtggtgcacacctgtattcccagctacttgggaggttgaagcaggacaagtgcttgaacccgggaggcagaggttgcagtgagctgagattgcgccactgcactgcagcctgggtgacagagcaagactccgactcaaaaaaaaaaaaaaaaattattctacaccctacccactcaaatcctcagcgaactgccaatctatacagtatgcttgtggcgtaattcttcattgaaagcatcccctgcccattctgagtcactttccaatgtcagacaatctcacccaaaacaagaacaaatctcctaattttatgcttttagaacaatgattcttaattcaccttcccacagagaaaattatcttggtaaattcttttggaaaagaacccacattctacagagtgacatttatgatcattcaaaataaaacaaatctaggcttctttaaaaacgacattcctaaaagtcatgaagaaaaacagctataaaaaacaatattgggacaacttggctacactgaatatggactgtggattagacaaagtattttttcaatgttaaatttcctaattttaatcactgtgctgtaaaaatgcctttgctcttagaaaatacaaactgaagtatttaggggtaaaggggtaatgatgtccacaacttactctcaaatgaatcagaaaaaaaagtatgtataaataaaaagtgaagattaaagcaaatggaacaaaatattaacaactggcgaatctggataaagggtatataggagttttctgtagtattcatggaacttttccacacatctgaaatcataatacaaagtttaaaaaaaaaaatctagtcacaagaatccatcctttcagtgtagacttacctgtctctcactcactcgaagagggccaaacacaatacactggatgagcttagccaccaacatcaaaacacagcaagcggtatttactagaacctgtaaacaaatcagagaaaggaagtttatttcttcctgctgaaaaataaaagcagctctaaaaatctcatattaggaattcagccatcatttccagtgactgagcctttctggttctctcccaatgcaagataaggaatatctgaaaaggcacactgttctggggagtgggtgttagggatgaggaccggaaagagaggcaccagctcaccagctaagtcacagttcttgtcccaatacgcaccctccagcaggccaccttatctttcatccttaactgaattgtgtgtatactttgtactgtatgtgcaaaactacattaacctcgtaaactgcaggtccttcccaagtacctcatttccgacattattttgacagccttgaagaaaactgttctagaaattgaagttaccgtgaatagtaaaacccagcacccagagattctgccctgccaaacaaataggaggtaggggtaggagtgtggatggtcacaaaaaagtctcatcataaggaactaataatataaatatatatatacagagagaatattttaatatttattggaatggaaaaatctttcaaccaaaagataaatgttctccatgcttggtgttggctttgaagtaaaggttttgtggcactgcagcagggtggaatgggttaaacagaaggaaaagaaaaccggcgagaggggccaagagatgaaaggcaacctggggataccaatgcaaaaccaaggccttcttcaacagtctatgagaaaacttgaaaaacaaaacaaaacaaaacaaaactctaaatgatgaatatccttacacctaaacgccaaatcttaatgcttacaaaatggaagagttggctgtccccaacccagagattagtgtggggtatcacattactctgaatgactccaaaaagccaaaaggaccttgataaaaacagtacagatgacttgttgagagcaaatgaaaaggaactccaattcaatgtaaagctgcttctgcctctgattcactacgtttaccatattacccttgccaagtcattcttccctctacttttaaaagcaaatgataattttaaagaagaaagaaaggggatagaggagagtaatttaagaaagcaagatccctgagatcacctcagggtctgtttagtacctcatgccatccctcctttgggagaacacttaagggcagccctgattcattacaaatgattaaatttagttctattctgtctgcctaatgggccaaggaagtatgtaatacatttttaaaggattgaaacgaaaatagttctgctaaagaaataaactgttttggtacttaaatccttcaaacaaccaggaacaaacgcccaaactagttgccccaaatatcctaatctgtgtaacagacctattcaaaatggtccagatcaccaggagcatggtggctcacacttgtaatcctggcactttgggagaccaaggtgggaggactgcttgaggccaggaatttgagaccagcctgggcaacacagcaaaaccttgcccctactgaaaaatatataaaattttttaaaaagaaaaaacaattcaggtaacttgaaatgttcatttttaaggtgatgaaatagatgctaaaaagactcaccttcattgtgatctaaccaatctcagccacattaactaagagaaatgtcataagacaaaaccacaacccctcatgtcacatcccccagccaaacatgccccagctttattacgacgcaatttcttaaaataattcttcccgtttttacatgtagtcagtcatatgaatttaaaaaataaatgcaacacatttagcacttgttcgaggcatgtgggaaatcagaaaaatgagggagctctgaaccctaaactcaaagagcttttagaatctacaagagatagagcatggtaagcaatttaacagaaggccaagcaggctactacgagagtaatgatggagaaaaaaaacaaatttagggtcacttaaacatttctctattcaaaacagtactgtcacacacatcttaagttatcaaataaaaaataaagtattatttactatttctcaaactctttaaataaaagtctatttatttattttttttctgacagtctcactctgttgcccaaactaaagcacaatggtgcaatctccgctcactgcaacctcggccttccaggttcaagctattctcctgtatcagcctcccaagtagctgggattacaggtgtgagctaccacactaatttttgaatttttttatagagacatggtttcaccatgctgcccaggctggtctcgaactcctgggctcaagtgatccgtctgcctcggcctcccaaagtactgggattacaggcatgagccactgcgcccagcctaaataagtctttgaattcaaataaggtataaaaaatgtgtatctttaatttatccaaaaaaaggtaaaagtctcttataatcccatcacccatagaacaaccacttcctattttaatttaaatgaagatttgaaaattaacatggctaaccaggaaaaaaaaaaaaaaagtctgagtatactgatactaaaaagggaatttatgtaaaaagtagataagctgttgtgaactttgtaaccaaagctacaaaggattgaaagcaatccttattttaagattataagcaaagttttttaaaacaccttaatgattattaataactattccatgtctatttatagaaaaataccttaattataatgattatatgttaattacaaatactgacctggcacagtatctcgcacctataatcccagcactttcggaggccaaggtggggggattgcttgaactcaggagttcaagaccagcctggccaacatagtgaaaccccatctccacaaaagatacaaaaattagccgggtggggtggtgtgcacctgtagtcccagctactgaggaggctgaggtgggaggatctcttgagcccaggaggtcaaggctgcagggaaccgtgattgcaccactgtactgctccagcctgagcaacatagtgaggccttgtctcaaataaataaataaataatattgtgtcatacatataacttctcaacttcagttaacaaaggcttgaaaaattgtaaatacaattgagcaaccctgatgcaaaaatccaaaatctgaaatgctccaaaatccaaaactttctgagcaccaacatggcgtcacaagtggaaaattccacacctgacctcatgtgacgagtcgcagtcaaaatgcagacttacaacagtttactcagtgtccctaagggaaaaatgaaactaccttcagggtatgtgtatgaatgagatgtatatgaaacagaggaatttcatgtttacatttgggtcccatccccaaaatatttcattatgtatatgcaaatattccaaaatccaggaaaaaaatcccaaatccaaaacttcgggtcccaagcattttggataaagtattctcaacctatactgaaagaaacataactggagcattcctcatttaaaagcactggctcatgtctataatcccagtactttggaaggccaaggtgggtgagttgcttgagtccaggggttcgagaccagactgagcaacatggcaaaaccccatctctactaaaaacacaacaaatgtagccaggcatggtggtgtgtgcctgtagtcccagctacttgggaggctaaggtgggagaatcaccctagacacagggaggttgaggctgcaataagcccaaatagcatcactgtactctagcctgggcaatcggagtgagactctgattcaaaaaaaaaaaaaaaaactgcttaaaaaaagtaaactaaaataaaataaatccctgaatcaggcacagtggaacatgcctgtaatcccagcactttgggaggctgacgagggagaatcacgacgtcaggagttcaagaccagcctgaccaacatggtgcaaccccatctctactaaaaatacaaaaattagccaggggtggtagtgctctcctgtaatcccagctagtcaggaggctgaagcaggagaatcgcttgaacccgggaggcgtaggttgcagtgagccgagatcatgccactgcactccagcctaggtgacagagtgagactccatctcaaaaaaaaacaaaaaacaaaaaaacgccaggcgcactggctcacacctgtaatcccagcactttgggaggccgaggcgggcggatcacgaggtcaggagatcgagaccatcctggttaactcagtcaaactccatctctactaaaaatacaaaaaattatccgggcacatggtgggcgcctgtagtcccagctattcaggaggctgaggcaggagaatggagtgaacctgggaggcggagcttgcagtgaaccgagatcgcgccactgcactccagcctgggcaacagagcgagactccgtctcaaaaaaaaaaaggaaatatgtgcacacacgtttgtataatatgtaggtgtgaactgtcaaggacttgatcaatttgggtatttcttagtctcctacttaacaacagtacttattacaagaatttgataattgccatttctggaagagagaagcaggtaacagggagagagagagatctacttttcactgcatgtcacttctgtatcccttaacttttttttttttttttaattttagacagagtctcactctgtcgcccgggctggactgcagcggcgcattcttggctcactgcaacttccacctcccaggttcaagcgattctcctgcctcagcttcccaagtagctgagattacaggcacctgccaccatgcctggctaatttttgtatttttagtagagacgggtttcaccatgttggtcaggctggtctcaatctcctgacctcaggtgatcctcccacctcggcctcccaaagtgctgagattacaggtgtgagccaccatgccaggcctgtaccccttaacttttgtaccctgagcatgcattatctattttttaaaatttttttaaagtttagaatctactaaactaacctgactagttctgcaattccacattatttttctcaccatatgatgacaaactgatgagtaacaaaccaaaacaagttctcctgttacagcacagtatttcaactatggccaggcgtggtggctcatgcctgtaatctcagcactttgggaggccaaggttagtggatcacctgaggtcagcagttcaagaccagcctggccaacatggtgaaatcccgtgtctactaaaaatacaaaaaattagctgggcatggtggtgcacacctgtaatctcagctacttgggtggctgaggcaggagaattgcttgaacccaggaggcggagattgcagtgagccgagattgtgccattgcactccagcctgggcgacagagaaagactctgactcaaaaaaaaaaaaattcaactatattaaaacacttcagaatgtttctcatagctatagtgctgtcaaagcttcaagtcattttttaaaaactcaccaaatgccttttttttccagtctacacaaaataaaaacaagttttacttgtccccgttcagagtgtagcaggtcaggcagcagtgatcccagcaaccctgacttactcaaggctcaaagttaattcccttcactccaaggcccagcaggaaaatgtcccttccagaatggttctactcttctactggagaaaacagaaactaaattataaaatagttaggcctgcctgggagaaaaagagaggaaggtgcatttatcaccatgtaaccctacaggtgtttttgaccctgtaaaatgttggccaccaacaggtgcttatttatgaccttgcaaagacatgggattaaactactaggaacctattccaagacatggtcaatctggatatttcttagactcctgcctacaccagcaccactcccctgcgccccctaccatttggtggtttcctccctttaaggacaattcacgtattgttacctctctgcaggctcccagaaacaaacacataatacaaacatgcacacactccccttcatcacatagatgataactgtgttccttctttaacaagactagggaaatagacgagagtccgcacgcaaagcatacctaggaggtgatcaaatagcagtccccttctccctcacctggaagacattccttttatttttaatttatctaggctcacatccaattattcacaagtttagtcttttttccttcagctgccccaacatttctggagctaacatttttccctcatataccttgaaatagtcaactcataaagactaaaacctaggaagtcactttcagctcttaattttgttttgttttttttttttgagaccagagtctcactctggcccaaactgcagtgcagtggcacaatcatagctcactgtaaccttgagcttctgggttcaagcaatcctcctgcctcagcctcccaagcagctaggactacagcacaggccactacacttaatttgcataattaagtcagaaccttgacagtagtttcatatttctatttctccatttacatgtcttgctcttagaattttagaagcaggtattttatatctttaaagggttgtaaaacaaattaaataaggaagttgcagagcctaaaatattcaccatctgagagcactttagagaaaaattggctgactcttattttaaaaagcctattttcacataattataatggtgactaattttttttttttttttggtagagcagggggtctcactatgttgcccagactcctgggcagctcctggcctcaagcaatcctccacctcctgcctcagcctccgcctctcaaactgctgagactgccggtgtgaaccactgaacccagcccttaagttttataataatacgaaaatcggctctttaaaataggattcagccaatttttctctaaagtgctctcagatagtgaatattttaggctctgcaacttccttaatttatttaatttgttttacaaccctttaaaaatataaaaaccattcttagctgttaagacaaaaacaggcctagtcaaataggtcacgagtttgccaatccctgttctaaatggtcaattcacttttatccacttttgtttgtggtcatttttccccttgagagttctatttaaatgatattatttgcataattaagtcagaaccttgacattagtttcatatttctatttctccattcacgtatcttgctcttagaattttagaagcagatatttaagaaagcagaaaagggaactaataaaagtaatgagtaagaattaaaaaatgaaaaagccaaaacacctgaacaatccaaaaccatgctagaatggaccaagaggtagctgaatggaagcattatctgagcaatgtaaaatagcccagaaatgagtaacaaaataaaaactcatctgaaatgaaactttaggatggaagttttagaaagacaaggagaaacaaattctcaggtcaaacccacatatttgttagtgtaaaaaccctgaagtctcctcccaaatcctttctcaatgtcatgcctgagggccacctggagaggcccccttgggaggaggaagttttaggtcactagatctcccgtcctcttcccactctacataaatctatcttccacactgctcccaatcttctaaaagaaatcatgccagcacccccactcctccatgccccacccccacttaagccccatcaatggcttctctcactccacaaaatactgtccacacttggtagagcaagcaaggtcaaggttacatgacatcacactctagcctcttcctaggtcagtttttcaaccactagtgttcctcaaatcacctagggcattcattaaaatgaagattccaaggctccacccttctctctgaaatggatccccagggaaactacattttacaagtaccccagatgaccacataccaggatgccagaggtccacattttgagaaagaaaccttcaagggggttgctcacctcctcctctcacagcagagccacctgccccacctccttcacctcctccccacctccttcacccccggtctcctcttcaccttctcaacctccctcttaaatcagaagattcaacagacttttaatttaacagcccagcttccggaccaccctgcctgtgcctagcactgtcctccccacgccagaccgagctccacatgctggtttctctatctggaatacccattgctactggttgagacccttcccaccttccaagctggttcaaacaccaccttccatgaacccttccctgggcacaattcctttctttttcctccaaactctgcttcattttatttatctattatcccctataaaattttgccatattactgagggtaggggaaagtgttgttcacagatatgccctccaaagtgcccaaaataacaccttcgaaaggttttaaattgtgtttgttcatgaaaaacctcctgtgatgctatcagaccgatattattctaaactgtgctctaaaaagataagttttgggaattacaatatgttaatatctagcaggacttgcactggcagaaggatcagtctttgttttgtcttgcttggccttggcaggcagtgttcgtgaaaaagttgaatctgaattcaatagaactaggggagggcgcaaggaggatccagttgacaaaggcaccaccacatagggtattcactcaacaatcttaatctgtcccaccactggggaaggcttttgagattgtcacttctactcagctgctaaagcagaaactacatatacactgagtgatgagacaaacagtgagcacatggagggtctgagaaaccaaagcaggccaaagtaaacacgtggagaccccagaggaaagatggaagaaaaacagcactaggatcaactgagaaatgaaaatatcatcagcggagagtaagaagtgataaacctgccagaggtaagacctctactgaaaatgctggaagaaaaggaaatttcctaaaaagtaatcatcatcacagaaaaatcaacagcttttatgtaatgttttctgaagagatattaactttagaatctgaacatggcttttatcaaaataaagtcctgcggggggaaatccattaaacaataccagtgttgttatataaataaaataagggttccttctcaaaggcttatttatatcttagacttaaaaaatatcaaagactacattataatcttaacatggcaaaaacactctccatatcactttgtttacctgctaactcaaatgcaaaaacagatttgaaattaagcaagagatgtgagttgagttctttcgcttctcccttctttaggactgtaaagttcagctttacacagcagtagataaacaggaacttcacccttcactgccttctactaaactctccatcagaaggaccaggagacttaatctacagcccacagagtccataaatcccaccgcttcctgatgaagcacagtgggactaattataacaaatgagttgcatatcatactatcaacttggaatattaatctctcagtcatttacagcccactttcaaccccaaatgggaacatgcaaggagacaagatccaagaagccatattaaatccaagtgaggctttaaatcctggagaaacttttctgatcactgcgggatttacataagtattcaaggccaagatgaaagcaaaattctctagccaaaataccgttgatctgatcagtctgaaattatctgttctaatgaacgaaaccagcatgtgtgccttatcaatgctgcttatctcgcaggggcagacaacctggaaactgtgttagaatagatcctcaaataagaaacattcagttaaaatgatgggctgcctcttgacactgtgaatgttttgctgcgttcagacatcaaaggaaaactgtcatgaacatcaggtaaaggcagcagaaaaggaagcacagtttggtgtttgtttcattacacagctcccaaaggggacaatcgaatactaagcggcaaaaaagttgtgggagacggcctctctccaaccggaatgtccaaagacacctgagtgccgaaaattcccccatactcaacgtctgaattctcccctctgccctctcctcttcgtcggaagaaaatccgctaacaatcccatgcctgaccaagtgggaaaagctttcaacttcactctacttcgtccaaccctcgggataacgcactcccagatcccgacctccccttgaacctgccctctgagatcttctagtttctcccgagggtccctcagaaaacccagcccgttcctccccactgccccttaaccccttcccctgccccaggccccgtccgcgccccagcgcagaccatcacccgccgcctccccgacccccttcccggagccctcaacgctggcctgcccctcggggcctcctcctcgcaaccccacgcgatgttcctcccgcccgcggccccctccccctccccgcgcctcaccactctccctcagcagcgctcccgcgagcaaggccgcgccccccaggcgctcgccctcgggggtccctggcggaggggcccctaggcccaccacgcccccgcggataaagggtgacgcagcggaccccgcccctgccccgcgggcccggccgcctcgctcacccacacgaagaggctgtctgagagcaggtactgggccacatcgcgggcccggggtcccccggcgctcggccgggcgggcgccggcggctcaggctgcagcgaggccgttagctggtccggctcgccggggccggcctcgggctggctgagcgcgcggtaggcgctgatgatggtgcccagcagggccaggccgctgaggcccgtgtaggtgcggaggctgggccaggggaagcgctcgaggaagagcagcggcatggcggcagcggcgacctctggcccccaggcttccctgcgctgcggccgggcctctgcggcggcctcgcgaacggcgcccacgggctctggcgtcgctgccgctgccgctgccgccgccgccgccgcgccgggccgggccgggccgctcctggctgctggcgccgctccgccccgcgctgctcccgctgctgcccctgccggcgcggaagagcctgggcgggctcgggacaggccgccgcccccagcgggacgctggcgggacgggcgcaggggcgcggccttcgtcccccgcccccagcggtcgcgccgccgcctagcgggcgtagccccgggcctcaggccggggggcgggcacccagcatcatccgccgtccgcaccacggcttggctgggcccgcagacacagagggcacctgctccggccgcggcgcaggggtcactcgggctcgcaggcgctggcaggcgggcagggcctcagggcgcggggcaccctggccaccaggccgtcggccacttgccccccccccaccccattaaccctctgaagaggttacccccagcactcctaggggccgcgcagcttccctggtgcccgaaaccccagaagaaagaatattaacagtctttcaagtttctgctgtttgctagtagcctccagcagaaactaaaaaatgaacctgatttagcgggaaataaaaatgtgttccctcataccccagaagtgagaatgtcaaatggtgcagctgtcttggaaaataacctgtcctttccttaaagtcaaacaagagtgaccatttgacccagtaattccactcctctaagaaaagtggaaacatacctccacacaaaacttgtacacaaatgttgattacattctaacaatcaaaagatgggaacaacgctaatgtccgtcaagcgatgagtggataaatgtgatacatccataaaatgtactattcggccataaaaatgaactactgatacatgctacaataggaacgaaccttaaacacgtgctaagtcaaagaagacagccacaaaggtccacgtgttgtgtgattccattgatatgaaatgtccacaataggcaagtacatatacagacacagaaagttgattaatgattgcttagggatgggaggaagaggggagtagggggtgataaagggtgcaggtttcttttaagagacagggtctgtggcccaggctagagtacagtggcatgctcactgcatcctccatctcctggactcaagaaatcttcctgcttcagtctctccagtagctgggattacaggcgtatgccaccacacctggctaatttttaatttttggtagagacagcgtcttgctatgttgtccagaccagtctgtggctcctgagctcaagtgatcctcccaccttgccttcacaaagtgcagggattacaggcgtgagtcactggctgggataggtttgttttcaaagtaatgaaaatgtaaaattgaggtgatgattgcccaactctgaattgaaaaatcattgtacactttaaatagttctatctcaatatgcgaattgtatctcaataagctgttaccaaaggaaaaaaatgttaccttgggagttttattccttttgcatccccagggcctgtaagagttctcagcccagagtaggtgctctgtaaatatttgtaggattttccaaactttctaaagaaaaggaccaaattatctttcaaggtctttttcatgcctaatattctaaaagtctattaactagaaaacaaaagatctctcaagcttacaattccactttggaaattttagaaacatcttgttaaagggtctttgatgaacgtttggctttaccgggacagggagaggccttacctttgcacacgtgcatttttttaatacaaggtctatatgaatactagacttgaattcactttggttctcttcccacagccatgcaattaaaatgctaaactttaaactttatcagtaaaataaaggaaagctttattttgaaaaactattgtaattttccagggaagtgttctactttacaggtcaagatctgagccaccataacttttaaaccactgactggcaatctttattcaatcctagccacagtagttctaaactgtcacaaaccaaatttgtcccatcacccttagaaacaggctgctgttaacagatctgcccttattaaacttttagaagcttgaaccttctgaaacttcacatgaatgggggaagttaacccaaaagaacgtaaatcgtttgtgtttggatcttttactagaattagtaatttttctaccattactttttcctttcccactccaagacacactccaagaaggtactttgcacaccgttgttctcaaggaaggacattttggcaataaccaaacaagccttcttaaccaatacttctagttcttggtaactgcatcttactccatgagaggactgggaaggaggcaggacccaaaagggatgaatgcttaatgtgcctggggagactagatcaacatacgggctacctgtcagctgtgtcccaagccccaagtgtggcagacagatgacagcatcagactttgagaggctggtcctgcttggacaagaatcaatagagtccatgatgaaagctagaggtcccccgtcaccacaaccttgatttcagaataacactatgccttccagatttgagacttcaaataggtccttcatttccattatgactgatagacttaatttcctgccgtctttgtgggatggtggttctgacttggtttgatttaaagggaataaaataattacttcagacaaatcagtttgtgtggagtaagattcatacctagatacaatgctattttcatttttaaaatatctgaagtcctttcatattcatgacctcattcaccatcatgtgagacgggttgggtggctttgttgttgcttaagattctcagaatcctagaagctgaacttcactatctaatccagtagctttaaatgtattcccatggcatgctagtgtttcatcagctggacccatgttccacagctaaatctagcagagagaaaaataaccaactcttcaagtttttagaggaaaaactaaactaatggatatatttccatttgtagcttttctttcatatttatttttcatagatctttggtgcctgctataaaatacacaagtagtaaagttttcagaaaaaacctttcaatttctatcaggtttcattcacacttctgttcagatataaaggctgaaaaggctatagttttatcagacacacatatattcccgtattttgggtaaactttctatttaagataacattgaattacacagtattacatatgcagcaggtatggtgtgtgtcatagaacattatgaattccaggcaagtttgagaaaaaaaactaaaggagtcaaccctccctttacagatgaggaaactcggactcagtccccaatgatatggactacacacagttaacacaactgtgtagcaacttctaacttgtggccttcatgttccaaatctagtgaccctttcacacctcaggaaactgaaacactgctaacacacaatgggaggagggagtgtgtggggcacaaggagagggcaacatcagtgacccaggccatcaggcccttgctattatgctaagctgtctcttacctaaaggccctcggccactcacagtgacgaaccatgcaagatttctactagcacagtaggatcagcagccacacatacaggactactatcccaaaacaatcacagagtcattctctttcaaatattttttattgaaatgacaataaaataaaaaaagaacagtgatcactttaaccaaacttactttacaaatataaaaatataaccaaaacttgtttcttttatacatttgccataaacgtaataccagaaaagttctcaaaaccaaactataaatgatgcttgaatactatgatgtgaacacaataaccaaaagtttaaatttctaaatacatgacctttccctcaacagaacagcataatcaatatatcttcccaacttatctctatttttacgatatgatccattactaagatacaaaatacacctgaactggcctaatctagagttacctaggttttagtaagtttttttccacaaaaacaagcttaataactataatacaagctaatattaaaatgtgttttatggctcaaatcaaattacagtattaggtttctcatcacgatttgaacaaaagcaaactgcttgaaatgagtccagtttaacccaaataatcagtgatgtataacaagtgaagtaagtatgggaaaatcaaatcttatgctacagaaagctgacttatactacagtcaacaaccactaagccttctttggcaatgaaacatacaaaattgcaaactctgatgcagtctcagtgattggcatatactgttccaaacactatgaactagtaaaaacattaagtttgaggatggaaaagctaccccaagcatttcatctcaagtgactgaacaagtactgtaaaaataaagtcattaaaaagccgagaacataagagcacaacatttaagaaagggaattttaagccgattgcttgctggcctgttgaatttgaagtacttctacctctcacttctaattaaacatggaagaaaacagactggctaatttggtcacactttgtccaaatacagtgttaacttaatggaacccttaaatatccaaaataataagtgaatgctatttataagacaataaaaagttttaaaatcttccaaatgtgctgttaacagtacaaattcaagtgcagaattattacgccattttaagtattatctacttttttaaaaaatcacagtggtcttcatcacatggcgaaaaaacaaacttcactcttctccaaagggataagtccatcctaaatgtaactacaaacaattgtataaacctttatagtttttccccctaatctactaaacatattccagtgtcatttagtagttttacatagaatctgcactatacttggatactcagggaaaataagatgacatatattgtagttttagaacgcaaaagagctttcattttagacaaatatacaacatagaagccactaaaaaatatgggtctattaatcaagagcccatttcaaaatgataagagcatttagtatgtagatctggaatgcacagtttctggaagtattagaacttagtgttaaacagtgcccttataccctcttctaatactgtagacacctaccaaccagatttgatttcccctaattctattatttccatcagaaaaccaaaaacagattattggggatccacctgtaactgaccagagcaaaaagtttttaagacttccgtttgtgtgttgcaacttttacattcaaaaccagatctcttacatttcaaggttagtaacccagccatcctgaatcaaaggtttttctcaactaggccttagtgtatggatgactggctcacgtacttactgtatattgggaagaagtgaagaagtgagaagtgaagaatttcttggtcaaagtttaagttacaaagaacatgagtggcctcgaatcagatgactcttcaactcaaacactccttactgagagtactttataaaacacacaacaaaagtctacctctctccaccctccacaaattgcaaaagtgaacatctgaaatgtggccactgtagcttttccctcaaaagcaatcatggaaggtgagctgaatcaatccatcttcatatccacttcctccaatctaaaggaatagctgaaggacgcagctaatggatgagcttaccagcaaaatacattacatgagaaatatgctaatgtaggctagaggggtaggactgttaggggcaggagggaaaaggacaattcacagaactagtggctttttcaaaggaaactggggcatttttgatcatggagactggtgctcacctaccatgaaggacatgcacagttagtcactacttaaccaccatgtgagggtttgacatgaccccaactaaaaaaacttgagtgtttattaattgctcagctacacttggcctgatttcctcaagtatcatatacctttgacatcacccaatattcaggaaaatagccctgtgactggcaccatactaatcaaaagttcatttctattaaaaacccttttttccttaagtagctacatctggcaagattcctttttacattaagcctatagtcaacaagtctgtaataaggcatacatgctatactttgatcattaaataatgacacaaccagcaaactcctttgctctaatattttttattcccccaaatttgatccgaatttatcagtattttttaaagtttttaaaatttcgtttttctcttaacctgagaaaacctgtcctctgccttgcccccagttttcggttgattcacattattccaaaaatatttttgaaggctctgtcatttgctaaaaccaaattttcttctctatgtacacaacttcaagttaattgaatatttgtgcaatctcagagttcaaaacctaatacatccaattttagaaatttccttcacagatccctatttttaccatggctttaagaataagacacataatttcgcaacagcacaaataattaatacccccattatgtgaagaaaactctgagctctaaatgagtctcttcttataccaattcctatgactactgatcgagccaattttaatagtttcctgtatgtttaaggtctgttgcttgcaaaccaaggcctggatggttataaaatgtactggtcagtgaattatactgggagttctctgcaacacaattcatttaggagttgcaccttggactcactcagataaatatagttttcagaagtaatggaagctcttcatcacaaaaatctaatacaatcttggagtatgtgcccaagaatggtatcaaagcaagggtccaataaacttgactgacttaaacctgtcattgtgttgcaacattcaccatcctaaggtggggggaaaaatgatcctcacctataagaattttagaagtttaatgagaaattaaaataaaaaaagtccattttctttaatgttgtacaaaaaagtatgagcagaaccgaaagtaaataaacattatcacatttgtttacaccactatctagttcttcatattaattttactattcaaacaatagaaaggtggcaatttagggatcgcaaaagagataaaaccaaaaaaacttttctaccacatttattctacactgtatatagctgtgctcacagagacaagcggcttcttttacttctccactgcgcaggaattcagttgtaaataaaattgaacctgaattttaaaaagaacaatacctttattaaagacagtacatactactttccatattagataaataaatttatctggatgtttctgccctcccttagcatgtctggcattttctttttttccccttcgaatgcctttttaccacgtttggcattttctacaccaattttccctcactggtcacatcttacacactaaaaacacttgttgaatacttataataaaaaaaattaagactataaatttgattaattatccactaataagttctttaaggcaggaaaagtttctacatgtccttatactctgactactcagcacagttcctgcacttgacaagtaggtgtttgaataaataatatgactcttttccccccatatgcatttcaacttgtaacctatcaggaggccaaagtggagtggcaaaagataaggtttgattagtgacgaagtagaaagagcaatttcatactcaataagctttcacaaaaggccaatttcactaacatttattaagtatgtaccagattactggcactgttgtaagcattttatatgcattatttcacttggtcctcataatcctctgaagtagagactactatccccatttacagaagaagaaacagtcaaataggtataatagtttgttcaaggtcacactgccagcaagtactgaggttgggcttcaaatccaaaacactgactgcagaatctactttcataaccaccatgttattctgcaattcctatatatggctggctctaatagagacctcaaccagtacaagtcaacttttaaaaaactgcatttcttatcactctaactgcctaaagattcaaaccccacgtaaaagttcaggacctaatcccacaagcctcaatttgggccaaaatatagtaagtttcaaaaaaggaaaacgaatatattacaccaagatattcgatttgccaccttttttttcttttttttagatggagtctcactctgtcgcccaggctggagtgcagtagcgtgatctcagttcattgcaacctctgcctcccgggttcaagcaattctctgcctcagcctcccaagtagctgggattaaaagcgctggccaccacgcctcactaatttttgtatttttagtagagatggggtttcaccatcttggccagactggtctcgaactcctgacctggtgatacacccccgcctcagcctcccaaagtgctgggattacaggcatgagccactacatccagccaatttgccacattttaatacagacaactccgctcatatttacacactgttgactgctatttaaccatctcttttttgaataaagacatcaaccttaactcttgagaatatcagaattagggaagagcagttgcacaaataccagaatgtcatgccgaaacttaagagtctggggatggtattagtcacaattaatctatggcttgcacatgatctaagagtctatctactttcttagtttccttaaagaccaaaattcatgaactataccttcccaagtggctcagaatattttaaatttgacagttaatatggatgaaccaaaaaatgttcaactttctgtacctgctcaacagctgagggagactagaaatgatgggtccatatcctggtgcattgtcatacaattcaaacaatggtgcagctaccagcttgtaatttttagggactgcaaacaaggctaaaataaaacagaattcattattataagttattatataatcactgcttccatttcatttttaaattaccaattttacatttaataaaaagtgtaagaaaaaagataattctcattaatacattttggttgtgtctttcaaggtagatttcctagccacagatttgaaactaaaagcatggtatacatctttagttttacaacaaacccaaaagttcaaggaactttgagaaaacacaaatagaggtatccttgaaattattctacagaatttttagatggctacctttgaaaacaaaataacttacctttttcttgaagctgaaccagaaacaacttcttatgttccttaggctttgtaatatgtgcaggaatatatggatactgaaattacaaatgaatacaactttaatatgtattccatggcttcatttctttacatgtttactccccagtatagtataaactgttgggagaagcatactactttctgtcctctttaccaggacttatctaacagatacactagtaaataaatgctttaatgcatataaaataacaagcagtaaaccagtcaaccattcgagataaaatatgtagtcacaggatttatagcttgagatacttaaaacataatgaagtccgattttaattagtatctttaataaaagcttttttttgtttgtttgttttttaagacagagttttgctcttgttgcctaggctggagtgcaatggcgcaatctcggctcaccacaacctctgcctcccaggttcaagtgattctcctgcctcagcctcctgagtagctgagattacaggcatgcgccaccatgcctggctaattttgtatttttagtagaggcagggtttctccaggctagtcttgaactcccgacctcaggtgatccacctgctctggcctcccaaagtgctgggattacaggcatcagccaccatgcccagcctaaaagctggttttttaaaaatatatatataggctgggcacagtggctcacgcctgtaatcgcagcactttgggaggccaaggcaggcggatcatgaggtcaggagatcaagaccatcctggctagcacagtgaaatcccgtctctactaaaaatacaaaaaattagccaggcgtggtggcgggcgcctgtagtcccagctactcgggaggctgaggcaggagaatggcgtgaacctgggaggcagagcttgcagtgagccgagactatgccactgcactccagcctgggcaacagagtgagactctgtctcccaaaaaaaaaaaaaaattatatatatatatatatatatatatatatatatatatatatgatcagtaagttaaacagtctagaatcctgttgtagacctgtttacattaaaaattcaaatataagctgtgaggcatttgacaagatgcttcttgctcctccttccagccccaacctcaaacctccccgtatgccaaggtgcatgcttcaggaataccagaagagcagtctaagtgaagttttgccagatgggcaaagccaaattactcgaggaaacaaatataaaaatatatatataatatatatgtatattttagagaatttaaagggatgaagagaattagagagggaagttgctacccgggaaggaaaaattctgacacagaacaaaaaaaaagtctaagggttatacaattcttgtataaatctctccacaatacattcagaaatctacttttgctgttggagttgtatctgagagctggggaatttaaaattgctgaaaacagatataaggggaaagtgagataaaagcagaagctgccaaaaggaggtattagcatcatcctcaatttacacagaatcacatgctaagagaggctaagtatctttcccaagattactcagccaagttgtgaagccaagatttaactgtatctattcaactcttatctaattataaaagcctatgttatttcccactgtgttactcattggcacctaaccagtattccagttagaataattatatatcagagccatccctagggtacaatgaattgaggcaattgtcccaggctttggaggttccttaaactgtcatgaaaaccagatacattaacagtcacagagaaagtggcctgaatagcacaagctaagagatctgtggatcacatacaataaaagttcccaaaccatgatcaaacaaaatgagtagcatttccccaaatttcttctgctcaaggctacatgttcctatttttttaagcctttcttctctggtcttaatgtttaagttgactgtactttatacaaaaagactgagataggaagatgatatgctccttttccactgacatctaactaatactctaggcttcctaaataaatcaatacacttaccttatgtcaaataccaccagggccaactctaggccttactgaatgaagagaactgtcctaggacagtggtaggggagatgagtgaagatattcagaaaagttatctggaaaaccactggggtcactactaagcattttccaattagatcaaggcatgttcaggaagccaaaaaaaagtttagaataactgtactatgtatctttgaacaagtaacttcactgtttccatatgaaattgttcttccttaaagccaagatgtgttcctggcaattcttaggtagtgaacaccagcatcagcttccacagcccctatcttcttgtccctctgccatacaagggagtcagaagcaagagaaaagaacgatcttttgcttggttgatattttgtgcaatgcttgacctgaaacatcttgtcatgtaaaggagctataaagtcatagggctttttaatttgcctaaagaattcaggatccaactttaagaagttccaccattagcaaaaataggaatatttgagcatcagtaacatcatcactcattatcatggattaaaatatttcaaattatttaaatccaaaaggtcatactgacactttaaaggtcactgaaacatgctttttgtgtgtgtgtgccccacattacgctacctctgatttcggggcagctatgtttgaaaagtatcagagggttccctgtttgctgccactgtctcaacaagcactcaagactcaacatggaaatgcaagggagttcatgcaacccttatccaatggggtataggagtccctacatggttcctggtccttaacagaacaaatccagttgcccacaggtgtaaaaagatcaataacatgccctgtcttacttctgctgcttctggtctctctctcccctgtattctgctgcttcctggaatcacctctcaaactgcctgtacccaagtcttggtcttaccctctcttttgaataaagtcaagtctttagaggatgctaaggaattaagtcattcttctgaaaaatgttaagtaaaggaatagcagcatattttttttttctacacaaaccacacacttcagtaatacataagtttctttttatatgaggatcacaacccttatgaattcatagaccaggaaatgatcatcaatgagctgctaacattacaacaagaaacaaccaaatatttttaaattcctgatggaagtacactataccaattgtgatagactgccttaagatgacccccaatgattcctgtctcctggtattcactgctttgtgtagtccctcctatagcgtaccagggttggcttgtgtgaccaatagcacacagcagaagtgatggtatgccactgccaagattaggttatcacagactgaggcttcctacttgggcactcctctagcactctgtctctcactatctcttggatcacacagccttgggtaagccagctgcctgagagttgtccttttagagatgttctcatggcaaggaactgagggagaccttgagacaacagccagcaacacctgaagcaaagctttagtctaacagcccagatgaaactaagaagtttgctaacacacacacgtgtaagctcgggatcagatactttaaccccagttccaccttatgatgcagtcccagctgacaacttgactgtaacttcatgacagagcctaagccagaaccaccctaagcaactcccagaggcctaaaggctgctaaattttgaggtaatttgttatgcaggtatagattatataccgcctatgacaagccttgttacccctccccaaattaactgagcctgaatacaatttctagatctaactatcaatttgcaagacacacaggggaaacagctacatattcaacaacaacaggggaatgcaatcgaaatggaaacattagcctgttttcattaacaaataaaacacaaggaaaaaaaaaaggtgccaagtgtgtaaaagagactttagagactatcctaatccaaacaaattataaaaagaaaatagaaataatcaggatacgcgaacagtgactatatatttgacaataatatggaattgtttatttttagtatgataataacagtactatagttatctttttaaagagatccttatttttatgattcacactgaaatatttacaattgaaatgaatagctaggatacacttcaaaataatccaagatgagggtaggagaatgaagcggtggaatgaggggttgtgatgtgctaactgttaaaggcagacgacgggtagcgcaattcattcacttttaccattctctcttcttttgtatttgttctatttatttatttattttttgagaaggagtctcactgttgtccaggctggagtgcaatggcacaatctcggttcactgcaacttctgcctcccaggttcaagcaattctcctgcctcagcctccggagtagctgggattacaggcttgtaccatcaaacccagctgatttttacattttttagtagagacgagctttcaccatgttggccaggctggtctcaaactcctgacctcaacaggtgatccacccgcctcggcctcctgaagtgctgggattacaggcatgagccacctcgcccggccttgtatttgttttacattttcctttaaaataagaagtgcttggcttaattttgtaatttaaattaaggagggaagaaaagaaaatttcaagtcaaattctactttaatcttttttaaagtggctagaattaaacgagctttctgcttccaaaatgcccagcaaatgtaactgaacactgacctgaggaggttcaaaatttggtctccaccagttaccaatgcaatcgtcaatgacccagtcttgcaaaactccatcctgacgacccagtatctgtcaaaaagaaataagccagtaaacaactaaatatatgtactcacaaatccccttcttcagtgaacagaaaattcttagcagtgctcctaattgaaacatagggataatatgccttccatacagattttctatgatttgttaatatagatgtcactctgcccaagacatacaatattagttcaaaactggcaagctagtatcaacataaaaattgtgttcaaaattcagctttcatttttattaatttgtatagcagaacactaaacttattttaaccaaagtcatactctacatattttaagtggccaaaaatagttctacaatgttcatggtgagaaactgcagttctctgtcctgcttcacccattcccactggctgtaactttcaactcttggttgtttttcccctcatgttttcttctatttttaaaagcattcttcttggtcttaaataaacggtttattttaggatagttttagatttacagaaaacttgcaaaacttgttcagagacttctcatataccccacacagtttccccgactgttaacatctcacactagtaaagcacatttgtcaaactaatcaaccaataccaagacaagattattaactgaagtccatatattattcagatatccatagtctttaacctaatgtcctttttcatttttcagtcccaggatcccatctaagataccatattacacttaatcttcatttcttccgaggttcctctacattgtgacagcttttcataccttccttgtgtttgatgatcttgatagctttgaggaatactggtcaagtattttgtaaaacatccctcaattaaattgaagttatgagcttttgggaagaaaactacagaggtaaaagggccattctcatcacgtcatatcaaaggtacatgctatatcaatatggcttatcactaatgggctgaggtactgtttatcacgtttcttcaatgtaaagtcatatttttcaaaaaaaaaatttttttttgagacggagttttgctcattgcccaggctggagtgcaatggcgcaatatcggctcactgcaacctccacctcccaggttcaagtgattctcctgtctcagcctccggagtaggtgggattacaggcacatgctaccatgcccagctaattttttgtctttttagtagagatggggtttcaccctgttggtcaggctggtctcgaactcctgacctcagatgatctgcccacctcactctcccaaagtgctgggcttacaggcatgagccactgcaccgggcctcaaaactacattttttaagagatagggtcttgctctgtcactcaggctggagcacagcgacgcaatcatggctcactacaactcctggcctcaagcaatcttccggcctcagccccacaaagcactgggattacaggtgtgagccaccatgcccagccaaaatattcttttatgacagtttcttgattttcattttattttattttatttttttgagacagagtctcgctctgttgcccaggctggagtgcagtgccgcaatcttggctcactgcaacctccaccacccaggtccaagcgactcccctgcctcagcctcccgagtagctgggaccacaggtgcccgccaccacacccagcttttttgtatttttagtagagacagggtttcaccatgttggccaggatggtctcgatcttttgaccttgtgatccacctgcctcggcctcccaaagtgctgggattactggcgtgagccactgcgcctggcctcttgattttcattttaaaaacattttttaaaagcctataaccctctactatgaatgagaatttagatattaaaatcacacatcctagttacactttttcttccaccatcttcccattatcaatatttggttaagtcaatattcagtatttaagttagtatgatccggtagatcagtcacaacagagcaatgattagcaaaccgtatctccttacttgttcaactgtcctattctttagttaataactttcatttcctttgctatcactaaattcatttcccacattctccatgataacttaaatttcttcccaattcaaatatcaattgtcagttattctattaatttcatcttttctaagacatgtttttccttttttcaagacaagatctgtcacccaggctggagcgcaatggcgcgatctccactcactgcaacctccacctcatgggttcaagcgcttctctcacctcagcctcccctgcccccagcctcccgagtagctgggactacagatgcaagccacagcaccaggctaatttttcaccatgttgccaagggtggtctcaaactcctaggctcacgtgatctgcccatctcagcctcccaaagtgctgaaattgcaggcatgagccaccacacccagcctaagacacgtttttctatcatcctgctgtaatctgtacttgatagtctcaaccctgcttcacagctggagtccttattttattccattttgggggtgaacaccctctagtagcttcctgagaaaaggtacaagagatgtaactttttgaaactctgcatgtctagaagtaacttttacccacacacttgatttatagtttgattagaaaattctaggacagagattatattctctcaaaattacaaagacaacactccaccatcccttagcttccagaattatttctgggtagtttaatgcaatttctgattttgatgttttgcatttaacctctctgcttaccaatcctccacctcccactttggaagcttttacatctttttgtttttattttcgtttgtaggatctaaaacgtcatgatgatatgcctttgcgtggatctttaaacattcactatagaggcaaggccagtaggtcttctcaatctcaaaactcatgccctttgaggtttgagaaattttctctaattatgctttgctaattcttccttttactctgttctatttatctatagtttatattggtccttctagaatgacccactaattttatctattcttacctacattctatctttttatcttttcattctattttctggtagaatgaacctcttaactctttactgaatttttcatttcttccaacatttttttaatatccatgaggtttttcttggctaaaatgtctttttaatagcactgtttcacaggtgcaaaatctcctctcatctcaccaagaatattaatcatagttttgtcaatggttgaattttctgcttctgttgaggtccttttgcttcttttgatctttttcttgttaagaagttttctccaaaagcctggtgatagttggttgtgtactcacaagggagaagcaacaagatgcttaattgtcacctctgtgtgcatgagtgataggactacaatatttttttttcttttttttttttgagacgaagtcttgctctgttgcccaggctggcgtgcagtggcatgatcttggctcactgcaacctccacctcctgggttcaactgattctcctgcctcagcctcccgagtagctgggattacaggcacccgccaccacgcccagctaatttgtttatgtttgtagagacggggtttcaccatgctggtcaggctggtctcaaactccagacctcatgatccacccgccttggcctccccaagtgctgggattacaggtgtgagccaccgcgcctggcccaggactacattatttctatagaaaattcttgctttggtttggatatggtttgtctccctgcccccaaactcatgttgaaatttgatccccaatgtgacagtgttggcaggcagggcctagtggaaggtgtttgagtcatgcaggtggatccttcatgaatagtttaatacccttcctccatcaggaatggattagttccctggagagagggttgttaaagagtgtggcttcctggattcactcttgcttcctcccttgccatgtctctttgcacatgcccactcccattttgctttctgccatgagtggaagcaccatgaagccctcaccagctgcccaatcttgccaccagaactggtgagccaaataaatctttttctttataaattacccagcctcaggtattctgttatagcaacattaaacagacgaagacagctcccaaatggcagtatctgaagtttttcttggactggtcactttttccagaaacaagaattccaaccctcagcctgggatatataaatctaattgttggctgggcctggtggctcatgcatgtaatcccaatgctttgggaggactgcttcaggccaggagtttgagaccagcctgggcaacatagcacgatctcatctctataaaaaacttttctttaattagccaggcatcatgggcacatacctgcagtcctagctactcaggaagctgaggcaggaagattgcttgagcccaggagtttgtggttacagtgagctatgatcacaccaccatcctccagcctgaggaacagagtgagaccctgtctctaaaaaaaataagtaagcctagactgacagtggctcacacctgtaatcccaacactttgggaggccaaagcaggcagatcacctgaggtcaggagttcgagaccaacctggccgacacggtgaaaccccatctctactaaaaatataaaaattagctgggcatggtagtgggcacctgtaatcccagctactctggaggctgaggcaggagaatcgcttgaacccaggaggcagaggttgcagtgagcaaccattgctcacattggagatcacgccactgcactccagcctgggcgacaagagtgaaactccgcctcaaaaaaaaaaaaacaaaaacaaaaaaaaaaaaaaacaagcctaattgttaacattctgtcagcctaatagaggtccaagagtctgactattcagaataggaactcttattctccccatcccctaaacttttttcattgctagttgttctctgattcaattactacagagaatcatcagccagtctttgcctaattacagagtggggaagacaatctagatacacaggttgaacatcccaatctgaaactccaaaatctcaaactttttgagcactgacatgatgctcacaggacatgctcaggccgggcgtggtggctcatgcctgtaatcccagcactttggaaggccaagacaggcagatcacctgaggttaggagttctagaccagcctggtcaacatggtgaaaccctgtctctactaaaaatacaaaaattagctgggcgtggaggcaggcacctttaatcccatctactcgggaggctgaggccggagaatcgcttaaacccgggaggcggaggtgacagtgagacaagattgcaccattgcactccagcctgggtgacaagagagagacttcgtctcaagaaaaaaaaaaaggaaatgctcattggagcatttcaagttttgtatatgggatgcttaactggtaagtataatgcaaatattccaaaacctgaaaaaaatcccaaatcctaaccacttttttaatttttaatttttttgagtacacaagatgttttgatacaggcatgcaatgcgtaatattcacatcatggagaatgggatatccaccccctcaagcatttatcctttgtgctacaaacaatccaattatactcttttagttatttttaaatttacaattaagtgattattgactatagtcaccctgttgtgctatcaaatagcagctaaacacttctggtcccaagctctcagataaggaatacacaacctgtataaatatactccatatatactttgaaccagtccagttttcagcccatgcatgcccccactttcataagtacctagcaccttcagttcctcagtcattctggtactctgcaatgctagattctgcctgcctgtctgctggactaaggtttctgctaagttagttataatttgcccatctgttttccagtttccaaaaattttgcttttgtgattctctcattttgcactccctcaaccttaatggacttatatctttgtaccatacattatataaatggaagtccaagcacaggaaaatgtttaagagttataatacatttttagaaatactagaaagacaaaccaataggtcaaaagtgggagaattacgggtgactttagttttgtttctcctttgcttttctgtgtttgccaagctttttgcacagagaatatatgagctttgtaacaggggcaggcggcaattgaatgttaaagaagaaaactaacattgaaaacaatttacaatctcaaaatcctcagtatctatgcatttggccccaagtctttacatgcaggcattacaatgatttttaaaaagtagaataatttgggcaaagtctaaaaaatatgtgaaaaaagtgaaaacacaggcatctttctcttttcaaaattctatagaggcctactcttgaacaaaactacctgcattcaaacctctggctctacaacacactagctatataacaagaagtaatttaaacttaataatatctacttcctacagttgtggtggtgattaaaggaattagcgcatgtaaagcactcagaacagtgtctagcacagtaatacttaaatgtcagttttaatttaccattgctgtgacacagtttaacattttaaaaattgaaataagtgtaacttcaacttgtaaaaaaaaatcaacattgtactaaccttctggagtttaagttgtatttattgaaaactaaatattccaaaataagcatcctttttacaagacattaaaagccaaataactagtaagttgatggtattcaaagtggttaaacagaaaaatacctctgtcattaagcgttttagtccttcaacttcatcttctcctgggttaagttcaccaccaggtctgtataaaagttaagaatttcagctttcaacttaatacaatttggagataacaaataacacaataattgttatttctaccaagtcactaagaacatatttcagcataataaggcaatcaaaacaagtatcaaagtgaagggggagaatat

SEQ ID NO: 43 - DNA, 193074 bp, Homo sapiens
tatgaccagctgtccccaagacccctgagatcagtgtttcttcagcctccagggctaacctgctgagggctgaggtgcctgcagacacacagaccagcctccagtcactgcctccaccttatgttaaagataaaaataactacaaggcgggaaatgtcctagagaaactaccttgaaattcagaaaacatgaagccaggcttcatctaattaagatgacattttaaaaggggggacggggggaggcttgggtggcattttaaattgcaagctgattgtgcagcctaattttggttctgagcaaagattccagttggaccagaaaacaggacttcaaaggcactgcctactgctggccaggcaaagggagtgaaaagggcagcgtggggcctcgggcacaatgtggccgggaactctgggcaaaggctgggggccgcggggggctgcagcccttgggagcctgctgtgcctctgaggagatcagtggagccgctcctgggaggagagctaattgaggtagcgacttctccttggagagtgagctttggtccaccccagcccatcttgggggcagtcactggacagaactctggcctggtggtcccaggcatgcccccacccaagtctcccccaggagctacagaaacaggcctggttcttatgcagagcgcccagtgccctccccaggagggggctgctcccttccggggacttctcctgccagcctctaagattcaccaggcgaagaaggccagctccctccttcccagaatcccgggaggggcagccccagtccctttcagattggagggcagcggctgggcctccgcgttggtagggagatatggcagccagctagcctgggaggtggagcatctgcccccagaggctcctgcatgtctctcctttttgtgcaccatagcttatctcacaaagccagcttcactcagcagattttgtagttattgttattattactcattctactgacatagatctgggcacatgcacacaccccacgatttaagtgctccacagtcagaaagcccattccccagactctgggttctctcacaggagccctgggaggagagcatggcatgaagaacaccatttacggttgaggaaactgagtcacaaggtgtcacatgactaacccagatcctctgaggccacaccctgacacttcccacaagtgttgtgaccttggtggagtcactgcttcccacttgacatttcctggtggagacaccatggtgtctgtcttccattccctctggccactgtctcactctctctcagcagaggtctttccccagctcctccataggaaggatggtgagatgagcatgagctaacagatgggaagagtcgaaggagctggtgggcaagggaccttggttcttccatggctgccagtggggagcacggagggttccactgtggcgccattgaaagactcagcggtggatgagagggagattaggaggccagtctggagtcgctgccctcatccatgcagggaggcaggggtgtccttggaaggtaagaagaagggacagattcacaccttcctgagggtaaatgaccttgggaatcagccagctgcaggaaaggaggaagagtggagccaactttggggtccccagcctgtgtcatgggaagcacagaaatgccattggaaagaggctgtgtgtccccaaagagtggtgtgcgctttcctggggcacacaaatgacctggcagtttttacagaccaacagctttggttttagtagttttattattttagtgtatattagaaaaattagcacacaaacctctggttctgtggatattgtggcctagggtaagctggcttttttaaatgagtccaatttaataacattttcaaaaatattgagtcagcagtgacggtgacttgctgatagggcagaaagctggagaatgaggcaggaaggaatgcgatgctggagccttggatgggaaaccaggaggggagtctaactggggacacattgagttgagtctgaaaggccagtgacccagaggttaggtaggggtaatccagttgttccctgcacagaggaaaatcaggcaggatctggctcagggagaaggtggctcgggaaagcaagaaggggtttgaggactgagtccttgggaacattggcacctaaatgttgggtggaggaacaggaccacagttggagacagaggagggatcacagtggactgaggtgaaccggcacccacggggctgggcgcccagagaagaggagaagtgggcgtgatggagagggcactgcgagccctcatggagtggagagggaggcagcaagacagaaggaggaggaaggggaggacagtggcttcacggggaggccagctcagaggacgggttaggatggaggggccagagacccccacccccaccttttcatcaggtcaagtctaacttggggtgaagggtacagactttccttttggggtttccctgaagttcatgtagctggatggggctttagaggcttgggaggaagcagccctggacttggtttctatggctccccgcaggccctctcccagtcacaggagacagcccccttcccacctgcttcactcaagctcaagtgctctcctagctgctgtggggacagacaggcagggtgggctccctcttgctccttcccagctcccttctacgaggacagtggccactaggagaccagaagttaccatgacaacaaagctccttcacagaacagagcccctgggctccctgcaactgtgtccgggatatttgaggtgatcttctctcaaaaaggatgaggccccaagttggcttttagagatggggagagatgataggaggaggtagggacagattcatgttgccagctctcccacccagccaaggaacgtgtgggtgccccttcccttcccataggatgccacacactccttggggagcccaccagtgggctcattccaccttgaaaccaagaccaaggaaccaagggtggggacaaggacagagaagggagcaggaggtctgcgggcttggaagcctggactcagtggcatgaccagatcactgccgcctgcctgcaagcactgtacattcccagccaatcagggttgttctcaggcctcacaggaccagaagccaaggcccttctgctaggagaagagggaggtgaagtgacctgtttccagtcccaccacccaggggccagacccggacccactgctcctgtgcgtgccgctctgctccctcatagctgaggaatgtgcagcagtgcctgctgtgctgggtgctggggcagtcctccccagagtggagaaaggacatcagttttagctggcatgatggattaacatgttgatttttatctcaatatttatgaattcattttcatggatattagaaaaagataaaagctagcatattaaatacatcctttcccagacattgttggtactaaatttccttttgcttgaaataaatttaagtagaaaaagtctgaaggaaaatattaggtcagatgcagtggcttatacctataatccaagtgctttgggaggccaaggcaggaggatcacttgaggccaagaagaccagcgtgggcaacatagtgagaccccatttctaaaaaacaaaaaaaagaaagaaaaaaaaaagaaaaaatcagcaggacattgtggtgtgctcccgtagtcctaggtactcgcaggaggctgaggcaggaggattgcttgagcctggggggttcgaggttgcagtgagctatgattttgccactgcactgcagcttgagtaacagagcaagaccccatctaagaaaaatattaagtaaattaaagtacaagttttatacaaacagcagaaatttaatgatcatttattgagcacctattatgtgctatagtgttctgtggatacagtggtgaacaaaaattatgcgagtaactgaggcttgggagatgctgctgtggagcatgacttttacccttcttagggggagtattggcacagcacagatctctaagactccagaaaactcacctgtgctctttcaccagcttacagtcttattgagagggcactctattgctcactgaagcattagaagagggaccgtactcagtaatccacaatgcaggataaacagaggtcagatgtcaaatagggaacaaaagccaggagaagaaggacaatggcagaatgtgttagtaagggtgccctagctgctataacaaatacacccaaaatgtttcgtggttcagatgcaataggttatttcttgctcatctactagtctggggcaggtgttcttggtgggtgggtggctctcctccacacagtgactcatggaccaacaccttccatcttatggcaccaccaccccctaggattttgtcatcatgtgcatacaggagacacactcacatcttaagagccttgacccagaagtggtatgcttcattttcacatttcattgatttcaacttagttacatggcaggttgtggcctacagaaaagttcccgactagcagaccatgagagggctgaaatccagtgcaccttcccttttctaagccttacaacctgcagaaaggaactccttttttctaattgtaccggctggcttctatctaccctggccagggtgtggggcttgggggtggagatgggggagagaggcatggaagggggtaagaggagtgacagggatgaaggaaagcaagaaatgccttggaggggagtggaacctgagcccaggtggcatttggtggccctgtagtttcagagagtgagtgccaacctgagctggttccccctgcccccactgggttaggagctgcagtgccaacctctcacccagtgagccctgtgcagctcttccccagcagagggcagagttgatacccttccccacccgggcctgaccccatacccagagtcacccagtgtctgtcagggaagatgaggatggcaggggctaagtagaggccatgcaccctgatcccagacctcagagaaaaactgttggggtgatggcgccttggctggagcaggccacccacctggccctgcgctgaactgagaacccgaggagcgcgtcccctccctcctccctccctgctgacatagcttggcagatgagtccccggaggcttggctcagcccctgaccccctgtaccccaggggccaggctctgggagtcagaggagctggcatccagccctggctccactgggctgtccacctcctgccccgcccagcacggcccgctgggacctccttgcctggcccagctgctgcatggccatgggtgccactctgcctcacctgtgttttagttgacaggagtatttgtcacccttgtttttacacctgtcaccatcccacctgccgcatgtaaacactaccagcatcaacacggtaatgccggttcccctgggtgggcaccagccaagccctctgggagctgagaagagcaggtgatagcagctggagaggtcccaggggccagccttccctgaccctgccctcggggagacagggctgccgggctctgggccagctctgcccctggcttgctgatggccccacctcctactcacgggcctccatttcctctcggaagaccaggccactaaatcacagggaagcagggctgcacggggctggcgatgtgggctccggagtcaggcggctggcgttcaatcccagctctaccacctactggctgagggaccgtcagcaagtctcataacccatctgatcttcggtttgtctgagtataaaatgggggaaacgataatacttgtgaacatcaaatggagtaagcctcctggtaagtgctcgacagatactggctgctgtcatgatctcttggggcctctctttgacaccaggcccctgagtgcatgtgtgggtgtttgtctgtctatctgagtcccaaggctcacagcaaacactgaggcggccacagcctgggcttgctgtatccttctggactggttggctcagccagctctgacccctgaacccagaggtccctcctcgaccccaactctgacaaccttcctgccaccactgactttttgcaaagactcataattctggatttcctacctgaggtggtggctgtggccgaaaggcccattctcacccatgagaaggtctcctgagaatgagccgcacctctgcaggtggaggccttgccatccagccctgggatgtgctgcatgggacggtctgcccagggccttccaagtggggcacgtgccaccgctctgtgagatgagatggctcagtgggacaaggctcacacatttaatagcatgggctcaccgagtcagaaagtggttccttctctctcagcttgtctgagagcctcaaaaagaaagtctcaggctggtgcttggaccttcataacacctctgaacctatctcctaggtcaacaaagagagcaaggcctcaagcccagagccttctacaggcaggggatccagagaatttagcatcctattctgctctcattgtagttattcttatgggtgttttctatttaaaatactttatacaagttcttcacttatcatagggatatgatgtttataaggtaaaaagatgtgtctaggaaaaatagtaagtattactcattcggtgatgcaggactttggcagaacttatgaagatattagggtatgatgcttgggaaagaatgctcttgtccagcagctcttaaacattttggtttatactcctaaaaattatcaaggaccccagtaagcattttgtttatgtaggttatatctatcaatttttattgtattagaaattaaaattaaggaaaatttaaaatatatatttatttgaaaataactataagtccattacacattaatataaataaaatttttatggaaaagtactgtatttttcaaaaatattttagtaaggagaatgtcattgttttacatttttgcaaatgtctttcatgtccagcctgatagaaaatggctcggttctcacacgtctctgccttctctctgttgtgatgtgttgtttggttgaagaaaaatttggccccacacgaacagggaaggagtattttactagccttttcagataattattctttgaaactcccaggacttggcaaatggtagtttattaaaggagagttgcaatgtggaatctgaaagtatatcaatgacccttctttttttactttttttgagacggtatctgtctcgcccaggctggagtgcagtggcacgatgacaactcactccagcctcaacctctgggctcaagcaatcctcccacctcagcctccccagtagctgggactacaagtacacaccactcccagggggccaccatgcctggctaattttttttaatttttatagagacggggtctcactgtgttgcctgtgctggtcaatgaccctttcctgttctgttacattaaaattcactggcctaccttgcactttgaatggatctcttactatgaatgatttttaacaccattttggtcatttggaaaatattggttcatgagttacacagatctgaatgttgacacatttcagcatattatatcaaaaactcacatttgttaatatcaacactgatctttgagaaaagctttaggtattgggaagttaccaagtttacagtggtaaacacaagtcttccacaattctgcattttcacttgaaagccagaattttataattttggtaacaaatatgtcagtggttttctttgaaatcgtggctcactggttcatttttgggagaacttctgccagagaccccagtctgaaatcctactgcttgccgctcaggcttttcaaggaaaagcagtgtcccatgaaggaagggatgagtccggcttgcaactcagcctttccccagtacagccgccacccttacatttgcagcacgtgttttgtgcttacttcccatgtcatcatctcacagaattctcagacgggtactcgagtggagttttttataagtcgtaatttttacttcttcaccaacgacattcttcagtccagccagcatttgctttcttggcatgcatggtggtagggagtgcaatggcagctctgcagcccggcgccgagtccagcgccggcgcctggcttctggctaaggagaccacgattgtatctgctgctgctacttttgcaccatccgtgcaaatgttaacactgttaggaaggcaagtgacatcttagttttgttatgaaaatagttttgatttcatggacccccttgaaaggatctcagagacccctcggggtccactgaccaccctttgagaaccgctgatctagccaatcccttccttatgcactagggacactaagaccccacaaggagaagagacttgcccagggtcccaaagccagtcagaggcagagtgacctgaagcccaaagctctgagatcctggaagcaacgtgatctgcaccttttctaacaaaacagtatgtgcccactctgatgaatggcacaggagccagtgtccccggggaaaggatgaggaggcaagagggatgaaccagcctggggataggcaccagttggccaaccctgtcaacttcaggacttgcctattcccaccctgcaccttatgtgtagcgctgcatcttccatcttttctcttccatagctgtgttgctaatgtctcccagccgaggcggctgtaattaaactattcaccatcgtcacttcgtgttctgaagagatgaggtcggccattatcatttttccttccctttgactgagctctgtgtgggtaatttcattctgccttgttcatttcttagaaattttgtctatccaattttagttcttttttcctcttagaacactgggctcaggggaaaggaggtggaggatgagggcatcatggatttggaaatttctgtcccattcaccttaaagcttttttgggacaggatagtgcctgcttggtggtgcagctatccagagagcccccatccaggagagatacccaggaggtgtagaacaggggtctggacccactgaggggagaagggcaccaagacaaagaggcaccacgtaaggctgtcccagaggggcagtggttggagctttggacagacagcgtccccacccctttcctggtggtcagaagccttgctgacataaaaacccccctgcctctgggggcccaggacaggcttctgttgctaatgaaagtgagcaggggccaggcacagtggatcacacctgtaatcccagcactttgagaggccaaggcgggcagatcacgaggtcaggagttcgagaccagcctggccaagagaccagcctggccaacatggagaaaccccatctctactaaaaatacaaaaattagccgggcatggtggcgggcacctgtaatcccagctactcgggaggctgaggcaggagaattgcttgaacccgggaggcggaggttgcagtaggccaaagatcttgccactgcactccagcctgggcaacaaagtgagactctgactcaaaaaaaaaaagagtgagcagggcctccatcctgcgtttcctctccccggcgtgccctgccaggcctccactagctcccctagggcccccatgcccactctacacagatgctggcagggctgacagctcccctgctcctgcaggaagaggccaggagcccacgccacacagaaaacgtgaatgtcccaggccccaacacatggaaggcctggcatttcctctgccaggctctatggggaagcattttctctccatcagggctgccccaggatggacactggcctgcccaccaggggtagggcaccccctcataggcatgaccagcaacctggccgagaggctgtctgtgcttgagcccctgagccatctgtgtgcccacaggtggctgtcctaagtttaaccttctagggctgcatgaccccactgctgtcctcaggccctgctgatggctgccagagcatctggtgcctccaggacccactcttgcccgtcaaggccctcagtgttgcctgggtctcgcctcacctctctttaattccctcctcacctcccgagaagccccatgtctcccaccatccacaaacctgttcctcctgaggcccagaccctgcctccctggggtggcctccccactccccagctggtgctgatggatctgacgcccctagtggactgcaggcacgggcagggcagggtccagttcctgctggcagttctgtccccagcactcagccctgggcttcacacagagacgtcctccaatctgtggggaaggaagattcttaggtctcgccctggctcctgcttaactgtggccagggccaggagtgggaaactgcaccagccactgacaggtggtttctgggtgaaaactttcaggtgtgcgggaaccagtgacagggcctcagaggacttgggccacagtcgccttcccaccccctggcccctggttctggaaggaacatagtaagcagtttctgtctaggaaaaacctgcttctcagtcattggaagatccctgagttctgaggctgaaaaggaaagaaagttaggatcaaaaaacccaagccttctttactccacaggagacatcctgggtccaggcagggaaggttctcagaaaggcttaggacaaatcctggggcatccagaaggtttgaactgctttctgaacccaggtggggacttcaggaacgccttgcttaacacagtcacagacccctgacacagaagggaccatgggacagaggcagggaaaacctcaggggctgctctccctccaccccgatgtgttcaaggcaccaactactgagctggggagattccctttgtcaaatgttaaagtccttaaggcccagaccccactcagtgtctgccacctagcaggtgtaaatggatacatagtagatgggtgaatggatgagtggatcaaggagagaatgaatgggtgggaggcgagttggatcaaacaggagtggatgagtaactaagggatagatagatgccagggaagagtggaggggatggtggtgggttggaagggatgtgagtggatggatgaactggggtggctgatgggtagatgatgtatagatgggtaggtgcacaaggtttgataggtaggtatcctgggtaggtggtgcaggatgtgtggctggctggctggagaagggatgatgggtggatttgaaagaagagagtgggaggatcatcatcctaaatggagaaggaaagcaagattagagatggcactgaatccttggttctgctgcaggatctttttgaggaaccaggaaggttcccttccctaaagcaatggtgagcccatgaggtcccctacctcctcaagagaccctgtgagctgaggacgttctgtaggcgcaggccttgctcagaatcctaagcccaagcgaggaaagagccccagccgccaaatgcctgcagcaccccagttgttgccactaccaaagactggtcacaaatgtctaacgtgcgcccggggtggcaatttggtaccacttccactgagagtcacaggcagagagccatctgccagcccaaggccaggaaagcagacccccgccccggaagggagtgctccccactgttctgacgcccagctgcagagagggaggggcggggggctctctcctgtgccggagagaacggagagaacgtgacggtgtttcctcagatgtgcaggcctgggtgggagcgctagttactaagtacccagaattcttcgccagctggaattgtagtggccaggctgggcccccccagcggctggggtctctctgccccttcgcgttgaagagcaagtcggcagcccaaggaaggcgcgatggccgccgggcccggccctgcaatgcctggtctctggctcggcgggtccagctcacgctccctctcccattggcctgtgcactcctgccccctggtgggtacagggacaactacagtacatggggcagggtggggccagatggaggtttttccctgcaactggaggactgggtttgtgtgtgtgtgtgcgtgcgcgtgcatgtctgcagactcacacttcacttggcctaaaagattagagatggaggaaagctctgaatgatccaaagcagctcctcaaatggaaggggttattattataattactatgattattgttatcaagattatcatgcttgcctagaaagtcttgtacaaagcaggcttattttgtgtcagcttgttgtttgtgtctgaggcatttcatctttgcttataataactaacattggcaggcttctttcatgttgcaaagctgtgtcacatcctcaccccgttttatctgcacaaacagccctgtgcagtggggagtagtgagagaacagaggctcagaggttcagtgttctgtccaaggtcacatggctaaaaagatgcagaagccaggatttgaacttgggtcacacaatgaaaatccctgttcatttccccatcatatccttggcacctcatcccttgagagggaagaggccttttattaagctttagctccaagcctctttgccactgatatttgctgaaaagcttacattgccatgaagagaagggaagggttttgaagactcaagtgttaaaagtgcagtttaccatcccagtttcacacaaagaatatacctgggcttttccaagtccctgcagtacctggggtgtgagtggagaatgaggtcttctatccttttcgctcaggttctcttggtcaccaccaccacccctggggtgtggcacaggacagacaggcatctgctacatctctgagaagcgcggaagaaggtgctatgacaggagaagctggtgcagggggactgtctgtgtcctggtgggtaggagctgggtacacagggggcagggccctgactgggctctgggagcctacgcccctccttggagcatgggttctatctccagggaccagctggctgactggagagagctttctggaagcagcacccctacctgctgcgcaccatgggctgttatactgattgtcaccagggtgctgcttccccagcacactcgtgaccagccgccagcagcacatgtcctcgtggcaggacacagggcctgtgtgccaggataagggaccccctgtgtaatgccagttccggagcatcactaccctaccacctcccaggcatcctgctccccagcaacagcccaaagcaacccacttctggggggtacctgtaccatgctccccacccctctcaatgctggaatgtcccctgggccctgtctccacaggcctcttcctctccttgcccacccctttctccagctgctgacaggtgccatgcaaaggtttacatagggggttctctggagccttgagcttccccaaaagtgcctcatctccactgtggcagctttgagccatttatttgtcaacattaagagtgagatatcatttaaccagaaagattgtactggttactatgataaaaatatgttcatgctgtctttaaatcattgatgtggaaaagagtcctgtaggtggccttgagaaatgacaacctctcctggcctcctgatcctaaacccataagaatggcatctcgcttactgttagcattcagaaatatacagtcccagccatgccccatagaagagtcccatcctcctcccgtgtgcccaatcatcatgagggtgggcgggttgctcttatctctatgtggcagccctgggcagcctatgacgtggagccgtgtatactcgtccactgggtggacagcagcgcagcccacccctcagggccatccctgtgctaagtgccctccgtttgctcacacaacagccttgcagagaaaatgatggtgctgtcatccccattttgcaggtgagaacactgagcctcagaaagatgataccccttgctcaagctggaagctaaagctggagctcaggtctgggtagctcctgaatttacagtctgaagcccgcagaaagctgcatggagcagcactaaaagtccaaggagggagtgagcaaaggaagctggcagaggaggctcctcgaagggtgtggggtggcaagagaatcagatgttggattccatggtgggttccagcaggtgcggaatgatgaggtgggggcattctgggcccttaatgattacaaaacccatcccacctgcacctatacatccgaggaaatgcagtcaggttttccctcacacacacagcagagagccccctcccttcctctctgtagctgggccttagaaccactgtaactgggacagtggtgggaagagggacccactccttcatgcctcaggcagacatgcatgtccatgaactccttacaggactgcctgctactgaatcccccagactgcctttagtgtgcagcatgtatgtggccagtgctcacaacacagctagtgccataccagtcccatgggagagagaggggccacccacacaggaaacaccacacggcatgtgggcactgtgcacggggtgtggtcagatagtaagagaggagcgggctcagaagccaggaaagccagtggcgctgcaggaatgggagggggtcttcctgcaggaggtaggccacacattagccttggccgactagggggcataataggactatttggggtacaagtgcaaaaataaaccaaccaaacaaacaaacaacatatcctccaatggatttttaaaagcaggggattgattgactcaagtaactagaaagcccagaggtctctgtggctgcaggcgcagctggatccaggcgttgacatattatgactcaggtgcctccctctcagctctgctttcctcagtgttggctgcacactcagagggggcctccctttgagagcctctctttcctaatagctgctacaagtgtcctggggctggctgggactagagactgattgttagtctcatttgacaaatagggattctttgtccaccccagactcttcacaggccagtgagatgggttggccaagcccagagcatgtgtccacccctagaatcaggggagatttagctcaacgcagaccactcagactgggctggagaagggtgcttcacttctgggaactggggctctgctgccgtaaaacaagagaaaaaagccacaaaggcagagagggcagctgcccaggagaacaggactgggcagagaggagcgggcaggccttcactgccacctggtagcggtcactgctgtctctcctgcagaactgcctgggcgggagcacgcagtgagttttctaaagaagtcagctctagccgtctgccccgcgtaaaatactcacaggccagacctggtatcttcatccattcaggctaccatagcagaataccataagctgggtggcttatacacaacagaaatttatttctcacagttctggaagctgggaagttcaagatgaaggtgctggcagatcactatcaggtgggggctactttctcttagacggccccttcttgctgcgtcctcacgtggtggaaggggtgtgggtctttggggcctctcttataagggcactaacccccttcctgagagctccacctttaagacctaatcacctcccaaaggccccatctccgaacgccagcatcttgggggttaggatttcagcataggaatcttagggggacataaacaatcagactacagcacctggtgagtctgcccagagaacatgcatgtgttttgtcacatctcatatggcctgggcacccaggcacgctctgaccagcaagaaacagcagtgtgatggggccgtagcagaaagaatggtgctagaaaatacccaccacacacaacccataggcccaggaggagccttggatgggaaattcaggctcagcctgagccccgtcccccagacccctaaaagcaggcagacaaaggagcagggtctcccctggctctagtaattgcttgtgaagcccaccatccttttttttgtgctggcaaagcccttccttcccctcaggcctggcccttctatcttatgcatctcccttccctctgcttgggggctgggctgggtacccgttagttctcagcttgggcctcaggtggccaggccttgtctgagatgtgaagtccagagctgctggctgtggcacaagaggaggtcgactttgagtccaggctctccttactggcgatgtgatctttagcaagctccctcgcctaagcaggatacccacctgccgtaatcattaaatgagacacaaactgacaagagctggaggatagataggattgagtgagaaactggggccaagcctcatattaaaatgccaaggatccatacatcctgcagacgtggctgagcaccaactctctaccaagcacggtgtgaggcccaggtaccatgagaaatcaggaaacgatccctgccctgaggaccaggctcatacagcaccagctgtaccatggtgttgctgtgcgctgtgggagcagggaggtgggcttccctaaggaggtgacatttgagatagggtgggactgagaccagagtgatctggacagatggagcacccagcttatttggggaacaggagtaaggctgtatggctggagccccgtgagagggggcaagttggaggatgtcaggacagagaggcagtcaggggctttgtaggccccaaggagtctggaatgcgggaatgatgggcagctgttgaaaggaagagctatacccattatgattaagtttaactgaataccagaaactctggaaattatgccttaaataagatagaaattgatttaagtattaagaaaacacacactgaagatagtgtgaggatgacttcagatagtgtggagtctgatccttgacctaggctgtttttggatcactattccactatccctagggtgttgaccttgtcttcatgatcccatttagttgctagagctccagccatcacatccaagttccaggcattaggaaagagggaatgagagaaaaagggtgccccttacctttaaaacaacctttcctgaggccttacttcacttcagcttacctttctttgtgcagaatttgtcacatggtcacaactagctgtaagcaaaaaaaaaaaaaaaatccagccttttagttggatatcagtgtgcccaaccaaaaatttctggattctttttgtaaagaagaaggggagaattgatgttaataggaaactaatggtctccttctgtgtggggagcaggctgaagaggagaaggaccgaggcagggagcccatgggagggaaccatggaggcctggacttagaagtcggggaggagatgaggaggagcagacagctgaaagcagatctgaaagaagaactgcagggcactgggcatgggaaggactcagtgaaatcaagcaggtctcctggtctttgaatttgagcagttgagccaatgtggaagacaggagagagcgggaagggcggggggccagggggtgttgctgccagcacaggacccctccccgtcccacaacaggaaggcctagacccctgggctatctgctggagaatcccaggaaatcatttatcccagatgtccccaaactgtagaatgcatcctactggagtgggacccattaaattccaggccacacatggaagctcaaacatgggagcacagtagctttgtggcctcggtttgtaaatcacaccgtcttgagtgtcctcctacaaagcctgttgtggctccagggcccccacattagcgtgtgatcctcaggtccagggaaggtcttgcctcgcaggcgtccccaaccctgctctcaggtcctgacttgttctgactcaggtgctccacagatctacagaaaccatgaaggtagggcccaaagaaggaagagttggaaaactcttgccaggtccaccacccgcattcctcagatgggaaagtaccccaagattgcccgaggtcagccaggcgtgaggagcaggatcgctgcaggtccctgactcataggccttgcactgtttttagccccaggtggaggcgccacccctgctcacccacctgctgctgccctgagtcatccctgcctgcctggggcacccaaagcccaggccccagggctggctttccaggtcactgctgccaggggggcccggacagccttcatgcccagtgagggcgaagtcagaccccacgggctgggttgttggcgatactgacccttggatgctgggtcaggtcagcatggggacttggccttccagcctctgcaccattgtagcttccttcccaggacaggcaatgggaggggcacagcttccagaactttctcactgcccttctgcagtggacaggctctgacatgtaaatagcactttagctggacagctcaattctggaagagctttggcctcacacttcttttgtacagacctttcgttggcgacaaaacttccagatgctgacctcattttctttgtgtctctcccatccccaaggatgcctgcagactttcagtacctcccactcacttctagagccacgtgccatgggctgggcagtcagtctctctcctccggcctaatcagagggttgggagttgaaggggtttgcggcagaaaaattatctaataataatactgcatgcagctgggcgctgtggctcacgcctgtaatcccaacactttgggaggccaaggcgggtggatcacctgaggttgggagttcgagaccagcctgaccaacatggagaaaccccatctctactaaaagtacaaaattagccgggcgtggtggcacatgcctgtaatcccagctactcaggaggttaagccaggagaatctcttgaacccaggaggcggaggttgtggtgagctgagatcatgccactgcattccagcctgggcaacaagagcaaaactccatctcaaattaataataataataataatgcacacatgaataaaatatcccaattctggagagcccgtgaaatcggggagatggtaggcctggtgtatgcgactctcagaccccagtggggtctcagtctctgttgggctccaggactcgtgcggtctgaaaccagggggaaggcggctggaggaaggaccccagctccctgcctccacctcctccagtgctgagcatcttgtcttgggcctggtagtagtcagggtctctgtgagtgcaagtggcagaaactaacgggatagggctcacaggacaggtcacatgaagggtaaagggacccagccttggggacctaaataccatgacacttccctgcttctttctggtagctttattctgagagtcttcttcatgggttgggggacgcttgtctcagtgatactagcgactctggggccacattctcctaagcttcccactttgaaaaatcccagggaaagactacaggtggcccagcatggtcacatgctcaccagccacctcctccactcatcgaccctcttccttgccttggcatcccacacctggttcccagggcctggcatggactggaagctggcctgggctccacaggactcagggtccagcacactcctgtcctggccctgtgttcccagccatgcctcttcctgtcgctgggacatctcgcagtgccactctgctggtgcacaccctgaggcgtggtgccccaggcgggcagtagtcactaggcaggggtgttctcaggacctgctaggattcagccaggaatagaggggccactcggatggtggttaccttgcattttggttaggagagtggtctgagcaaagtcctgtcagccacagagacatgtgaagagcaagaagacagggtatgtctggtgcctgggctgagacaggggcttgctgtcctcaagacagcttctagaggtttaggttcctttagaagcttatctgagaaaaggatttgggtgagacaaggagtttatttgggaggtcatttcaggaagcaccgaggaagtggggaagccacacaggaagggagggaagccatgaaggggagctcatgggtggcctgccacgttggctgctggggctccatcccatggggatcctgtctgaatgtgtagcttgtctcagaattgcctccctgggagggcaaggaagccgggttatttgcccattcctgtctgtccggggcaccgactcaaactgcagccagctatacacctgaggcagtgagctccatgggcagaggcaggagggcggcccggggcagcacctgctctgctctcacctactctgcgttggacattaaaggctgtggctgcctcagacggagcacatatcttcctgggcaaggccacttcagctgtggtctagacccctctaccaggccctgtcagccgtccagggagctctcggcacaggtgggtctgatcatagaggctgggcctggagtccgaaggcacctcatcttgagtcccacccctgccactcaccatcgggttgttaagtgagtgccttcctctctgtggccctcaatttccccactatgaagtggagatggtaatactacagcaactgctgtattagctgtgccacagcaatgctgtctactgagcctctcctaaacccagccacttagttctgcagatcagagacccagggcaggctccactctgtaccaggctccccgagtcctcttcccaggatgaatgacagagcccgggcgtattcatggcgatggcagggcccacgaggaccagcagaaacacggcctctcaaggagctggcacagtgccactgctgcaccattctgtgggccacggcgagtcctgtgccatactcaacatcaagcagacaggacatatactcagcctttagcaggaggagctgaagaggcgcagggcaaagggtgtgggcagaggaggggtgaaaggcccaacgacacagctcttgccactcgctcctgaggtgggggaggttctgaggacggagtgtgttcaccaaatcctttgtacgctaagtactactcccgtgtgcaaggtggcggtgacggtgcagtcctgggatgtctgcaggagccttcttatcttcaaagaccaccacactcctggttgtgatgttacatgcatgtgattgtagtctttgaaaaggcgaccccactttggtatccaggatgaggggaaggggaagaaacctgttaattatgcagtactttttctgtaatttcaagaaggctcagcctacacgtgtgcaccttaagcaaattcatctacacccactcagacaaggaggaagggaggaggcagaggaggagagtgctccaagctcattacctgtcctttcccatttccatgtttcacctgacctaggagcttcccctgcccccagagaaaggtaggccccaggtcacaaacaaatcaagaaaaattaataaaatggacttttggctttgagcagtccaagggccaaagttcttgagatttagtgttggcatgagatatttttgccatctgcactaacttggcaaccagcccctcccctcccccagtcctgaggcacagccccgctgtggcccatccctcagctaaccggaattctctaccgaaacgtctgctcctctacatagcccagttctagggactgcattccaccctgtgtaagaagtatagaaaattacagctcagccaagaacattgatttttttctcccccgaacaaaataaccgagttttcaggatgaaagcagagctgctggttgagttggagggtggagagcagagccaggcccactctgccttcctgctggttgagttggagagtggagaacagagccgggcccactctcccttcctgccccagaaaactctggggccccatgggctgcagcttggagctcctgctttaggacatccatgtggtagaaggccccacgggccccaggaaccccaactgtgcatgctcaggtcgtggccctccctggagcaggctgtgggctgagctgcggtcctgctgcactggctgggctctcatcacagtccccgctaggggagagcccttggctggcagaggtcttctgtccccaccaaagcgtcaaagcccaccatccacctctcctcacaggctgacgccaagatggtgtgtgatgtggtgagtcggatggaagacaccgagcccttctctgcagagctgctttctgccatgatgcggctctggggcgactcaggaatccaagagtgcttcaaccggtcccgggagtatcagctcaacgactctgccaaatagtgagtgtcccagcgggcgcatggcctggagccgggcagtgatgcgggagtggaagggactggtgatggggattggcagagcaaggaggattctcggctgaggtcacgcctgccgggagatgttctcccataggtagagggtgtcaggaaggaatgagaaggggcctctcttcctgcaccccaggaggagaaagaggccagaggaggcagaggacgcaagagacaaccaaacagtggaaattcccagagggccgggaccttgtcactggcttgtcctggagagtgcctggcactgcaaaaagacagctttcaagtgtagcagctttgtttttttatagggagcccctgaccgcataaatacaaaccaaaacaacagccatataggcagaaaagaaatggtgccattttgttttattttagaaaaaataataagctttccattccccatctttaaaattaagaataaggaatatgtaagtctaattaatataataaatgtatactttaatactatttataactaaataagggggatgacaggagggcaggaggacggaaggaagaaaggaaggggagagagggagaaagaagaggacagaagagaagacggagaggtgggaagtggtaaaagctggagctggttagaaggtgctcccggctcttcccatcacagcaggtcacaggtccactggctgcagctttatcactctaggcatctccaaggacatcctcactgcttccgtgcccttggcctctagattggaggctccagagccctgggatggtcagcgttggtcagggacatgtcttctgtcatggagatactgggattgcccccttggctttcgggaaatgcaccccacctttgcaattgcaatctggtacccatacattcagtgggggctttctgcaaggagcccttgagctttatcccactagctgggaagattctgacatgatccagtccagccattttcaccaggtctcagctggggcctttttgcctccaggggacattcagcaacatcgggagacatttttgatggctgcagctagagtggtgctcccggcagctagcaggtagaggccagagatgctgttaaacaccccatagtgtgcaggacggcccccacaacaaagagttacgtggccccaaacatccatagtgccaagattaagaaaccctgatctacgcaatgccaatggacagaggctgaggccaatgttcactcctggacatttccacgggccacatggcagccaacagactagggacttgagcaaggccgggagcggcttcccatttctgcacacctagattgtccagagggcaaatgccgaagtcctgtgagtcccaggtgatgactacctaggcccccgggcctgatgagctcccagggacaccctggtggtcagggcagtgagcccagaagctcagtgtccaccattccgtatgcacaaatcacagaccagagctaggcaggagagagtgactttcagctgccctcctcccttcttccactccctgtccctgccctggagtccagggcctcctccccgagggccagcaagaccctcaagggcctttagggccagctggcccaaatctgtcttctagtggctcagcaaattctgctctccacttacatttttacccatttcactaattataacatgaatccattaccaaaaaaaaattaaacaaatgcagagggatgtaaaatgagaagtaatcttcctactccccccaccagccctgcccctcccacttttacccacttccatttatttgtcccagtggcatccagaaaaacttgatcctctgactcaaaatagtatttactgccacccactctggaatcgagggagctcagctcaccttccttccttccatcgctctccaccttcacctccggctttttgctagttacaggattatttttagttcttccggtgcttacctttataactttaaataagaaacttgagtcagtatttgtcaactccccaccaagtaagctgaggaaattctcctccctgcagcctcatctctgccttctttcaaattttccacttcccaggttgatgatgttaccattctcttctgtcactgtggctgggccttccgtgtctcccctctgggagagggcaggaaagacaggggacacacaggtggccagggccggaagggcctggcacatttcctgtcttagcagttagacctcagcttctgacaaagtcttgggcccagtatagaaagcagatcagagtaggtttgttgtgctggaaaggagagggaggactcacagggctgccacagcacgtgcttccagggggtgccattgacaccctaatgccccaaccaccaaagcacttctctgcccagccctttacaggggagggaccagggcacaggctcctgagcaggctcttggtgcaccccggcctctgtgaacagggctggctctcccttctggataactacctagaggcaggtcccagaaaccctgggcacatccaaccaggggctgtgaaaggtgctctggggcctggttggcattggctttcctcaaatccagttccccactgagttgtccatgctggcgtccgacgtttcctctcctcaccttctctcttgaccccactcctatcgagctcttgctcctccgcctgctgagatggctcatagcccagtcctatcctgggggctgctccatcagcctcctcccactcagggttcagggttcagtcccctagtacctggtacctcctttcactcccagcccccgcctcctctcgggccgccctttccagactccctcgatgcctcctgcccacccacccaggcaactggtgatgggggaggtctgctgggggctgctgtatcccgtccccaagctccatcccagaagcacctcctctcaaggcctggtgcctggtgaccttctcctgtctcgttttaaacaccttgtacacttggacaactctcaaattcatatcgccagcccagccctccctcctgacttctgcctactcagtgcctgtttggacatcaaatgagtctcaagttaacatgagcccgtggaacccctggctcccatcctcccactagaagctgctctgtgtgctcctccctccctctaaatgtgtctcattccaccacgtggaggtatctctacttctgctcgtcctcctgtatcccacaccgaggccaccagcagatgcagctcccctggcaggtacatcagattctgaccactcacaccctccacagccacccccactgtgccagtgccatctggtgacgacagcagctctgcaggccccacccgctgacctgctctcatggcagcaacagggccgttgtcaacatgcttctggccagaaccctcgaggggctcccatctcactcagagcaaaagctcaagccctgacaatgacctcaagggcctgcttgccccagccggactctggccaccctcacctccaccaccttccccagcctcacccaccacctggcccctccacgtgtgcttcctgccgccatgcctgccagtgtttccactgggccactcgaggcccacttgctccctcattcccctcagtctcccctatccagacgccttccccaaccaccctgcatcaaatagcagcccccagcagctctcccccatcactaatagcctgattcgttctctcacactacctcctgacatatcatctctctgactcttctgtttaccacctcacacacgtgtgcacactcacttggaacacaggccctgggaaggtggggctgtgtcgactgccccatccccagctcctggaacagtggctaggtgggatggacagcaggtgcacagtcagccttcccgactgggttgttaagcagttctcccacaccttgcccaccctccacagccgtctccttgcatgaggctcggccagcacagagaggccagagggccaggttgcccatctaaaggaggtttgccctggctgggaaaggaagagcaggaccaaacgcttccaggctggtgtccagctgcagatgacagcagagggcgtcctcacagcttggaagcagaggtcatgggcgccagggcggggcaggcacagaggcttgggagaggctccttctggctgagaccagagcctgcccagatgccactggctggcgaggaggctgtgaggccgggggcgtgtacaggtctgctctgcagcctcggctctctcaccccatccccacaccgttcctgtccacggagggcagtcaggctcaggagaggaggccaggagtcctgtttaaattttttttctggatttttaaaatgctgatgatgtccagtttaagagcgtggggtctggagccagtcagaactgggctggaatcccagccaagtgcattttctttttttcttttttttttttttctccccgagacagagtcttgctctgtcacccaggctggagtacagtggcacgatctcaactcactgcaacctccgcctcctgggttgaagcgattctcctgcctcagcctcctgagtgctgggattataggcacctgccaccaggcccagctaatttttgcatttttagtagagatggggtttcaccatgttggccaggatggtctcaaaatcctgacctcatgatccgcccaccttggcctcccaaagtgctgggattacaggcgtgagccaccgcacccggctgccaagttcattttctcgcagtgtgacttcaagcttacctccctgagccttggaagccacccttctgttttcttttcttaggggcattctcacaaggattgtcactgggttctatcagtgaacaccctagctggcgaagtcatctgccctttccagccctgtggacatccatgagctggtcagcatgcccatctctcatgcagtggtaactgcaggtccagccagcaagctggcccccagcaggtcctggagcagatgcagcctgggaccccacatcgttctgtggttcagacacttggggctcctccctgtgggctgcttgtggtttgccccggcagcagggatgggtggcctggcaggctccatggatcactgagtcttccttcaggcctggcccagctccccacttcctgatttcccagatcctaccctggctttaggttcaaacttaacccacaatgaaccccaaagcccttgcaggcagcgtcctctgagtgcttggcctgaggcctgggcaggtgacttgcaaaagcctggtctgtccccacagcaggaggtagcaggggtaaagagccctgattccaaagaccgggtcccagggaggcccagccgctgtatggctgtgcagccctgagcctccaagagcatcaaattggaaggggcacacagaccccttggtaagtgagaaggaagtgtggagaaggcagggaactgctcaggggccgctgaagccccagacagtaataaaattatggcctctggagccaagggtccgggtcacagcctcaggcaaggtacttaccttcgatgagccccagttttagtacatttaactcagggaaattacacatgaaacatggttacacatgcaaagaatagaacctatctgttggccattattatcttttaaatgaaaaaatgacaaaacagtattataataaacatggtagtctcatataaaagcttgatcttgtctgagtgtcccgggagctgcatgcgtagcccttttggctgtgaatgagtgcgtgaggccaagacccctaagacccacttcctcagtcgcccccactccctatggcctggaatggaggtgatgtcttttccacagtgacctggaggggccctgaccgagactggactctgaagatgggtggcctggccagtcccgaacagtgtccaggcatttggtccatagtcccctgtttgttgccatcctcagctacctggacagcctggatcggattggggccgccgactaccagcccaccgagcaggacatcctccgaaccagggtcaaaaccactggcatcgtagaaacccacttcacattcaagaacctccacttcaggtgaggcccagagaggcccccaggccctggcgagggctaagatgggacatgcccagcctctcagcgcattgcgtttacagcgcccaaacatcatcctgccccagggaacctgcgggctggggcaggcagctagatactagaaggaacctgtctgtgtttctgccaaggttaggggctggagtgagcagggaggctttctggaagaagattcccagagtggggctgtgaggaacagggaggatttggacaaggaggggcagcctgtccctgaggtgacttccaaggaggaggaggaggtgggctaccagggggcccttccaaggtcaccttggggggaggagccaagagtggggctgggtaagcccaagctacctctgtgagaccctgaggacccaagtaatcccagagctggaaggagcagagagagctgacccaccctctcctagtacgcttgggaagctgaggcctgacaagagcagggcttttcccaggcacagagcacagctagaacccaggggctctggggcctcagagcaggggcctgacgggtgagctggttcccagggtcctgctgcagcgctgtgtccccacctgcagtaacatgcgtgcactgaggcctgctccgtcctgtggggaagagaggccagcagagaaggggagggcagggacccctgctgggagagctggattctaatattccctgcctcccatgtccccaactcctgcccgctcctgttcagactgaggggccgaggctctgggcccaggaacccctaggcctccgcagatctggggagcaaaaccttgggcagagcagccctgaggggcctctcttgccttcccaggctccttggtctctcctgctcccccactgggagcacaggatggggatctcagctcaacccagcccagcaaggcggggtctgagaataagcattctggaggggccacagaggccatctgccaacgcccctgcatttcagatggggaggtgggatccaggggaggatcccctgattgatggaatgagaaccagacccattccttgctctgagcccacactaatctctgcctgcagtcactccgttgtgtccggtgggaccagagatccttccctgtccccctctggcaggctgtgtgtcagcaggcatcccagatctaggaggctacaggactcctcgctctggggattggggtgggagactgaccttttacttccaggacgtaagtcccacctgcccacagtctcttccagaatttttgtgccccctcgggagtagagtctgagagggggaagaggccaggctctgatctgccagaaaggggccgtactgggcagaggtgagagcgccagctttgtccacagccagacccagctccaccacagctggactctcgccagcttgggcatgtcctaagcccatgggtggctcacttctgccatccacataacaggtgacatctcctgcctgcctccctcccaggctggtttggagtttgcccagagcaaacccaggaaggaatagactgagaggagggtcctcatgcgaggaggactctcagaggcacttcctgggggtggctcaggtgcgccctcttagtaaaatgctcctcagatgcaagggcaggtctttgagtcatgatctgtgagcacagccagtcccaggacagactccaggggtagtgcctggggatggcagtgatccagctgtctgtcatcacctggagtgacaaggtcttctagtgagggcttttagcaaggctctgagcaccatggcccccatcctctgcctctcagcgtgctcacagcttaatccccaggcagccctcacctgcctggaccctgcgcctaccagctccctgcctcctacaggctgtttgacgtcggaggccagcgatctgaacgcaagaagtggatccattgcttcgaggacgtcacggccatcattttctgtgtcgcgctcagcggctatgaccaggtgctccacgaagacgaaaccacggtgagtggcctgggccccccgggcagggggcagcgctgaggagacggccgcaggataggccagccctctgagcactgggcctcgggtgcccacaatggctctggggtccagccagctgttgtggttagaggtttccatcatggacaggccgtgccggcactccaccaattctgtattgccaaggcaaatgcctcatgatgccagtgtggcagagcctgtgtatgcaacctgatcacacagagccgtgcagaatgtgcctcttccataaacttggtggagtcacagaggccatcaggccatagcaaatttaagcaaaccctaaaaaaaccaggaggcagccaagcaagaatgtacaggcaacagaaatagcagtcttagcctgacagccatccctggggcactggcgtcagatgctgctgaagcagcatggggccggggatgctgagggagaggtggggagggcccaggatgctgcaggagagttgcgtggggttgggggtgctggggagcagtgtgtggggctgatgggccaggaagggcaatggggatgaggcatgctggtgagtgacagtcgtggctctgggctcctttgccaaatgccagaccaggctcctaccttctgtcttgcgtcacattcagcctagggcctcagtgaggggacattcccctgggagagtgcagccttcctctgggtctagtcctggctctgctactcactggcttgctgctgaatttaggcagcaccctttctggctcagttactattttccataaaagggagataataatagtacctgcctgtggggggctgttggcagtggggtgggtgatgcgtgtgcagcgctctggagctgtttctgggacagcagcgccaagctggtggttgtacagttgctggtgattgccctgagcctgcaggtccactgcgtggtccccttctgggctgcagcccgccaggcaccgagcatggcccacagggtcactggagacaagccccaacactcctgacagcggggcccataggctatggggtcacagcctggcgtctgtcatctccttctgtctggaacacatgcaaatcccccaccccacgcctctgaaggctggcaccgagggtttgaggttggaggtggggcttgttgtcatgctgggccttgagcgaggcctgtcctctctctgggtctgtttcctcgtcatttctggcccagctggtccactgggctttgtgaggatgggatcaactttggggtgtgggctacggggcacagtgctatagggaggaggagccgccgccctgaggggcttacacagagtgatggggctttgggctggtggtgtgggtagtctggacccgttccgtgtacaggcttacccacctgactcttcctatttcaggcccacctgtacccctgacttgggtttctgctgtaattgttctcaatggcatctgcaggcagtgatgtcagtcaccagcccagtcttgatgctgagtggggcaagggtggatgcgcttcctgggccgtgcttggacccagactcactgaccacccaaagcccaggtcagcttcctggccatgtgcccctcacagtgactacccagacatttcccactccccactgctagactctatgctattacggccactgctccaactcctggggtctgagctccacttggctcatcttttttcccccatgtccaccacggtttcaaagagagcaaaggagctagaagcaggaagccaggagggcccttccccctggaatccagcctctccctggacctgccctgccaggcctgtggatggcttcaacccaagtcccaggcccaccggccatggggctgggctctcgctcacctctggaagatggaagcaagggacgtctgggtgagcctagcagccacaggccctgagctctgcagcccatgggtccccagtgagcatgagcctggtgctgggcctggcactgggtgaccttccagcctgcgggccttgctgcctggagcacttgccctccggtcttctccaccttctctcacctccctttttccccatttcccccacccttccacacaagggctggagcagaggaccttggagaagccaaagcaaatggagccaaggtcacaggcaggctcttcctgtgtccttccttccccaaggctggccacctttgcagcccggggaagagtagcagctcgtgcagggaatggggatgactttgcaacctgacagcagccacaaaggcagctcattgccgtggtggcagcaagaacaatactggcgctgtagaactaagcagtcatcgccgtgcgctgggggcgcatgcagaggtggacagcttgggagtcagacagatctggtccagggtctagcatcacccctgccgcctgtgtgatcatgggcaaccgccccaccctgcccgggcctgcacctcctcctctgtagatggtgacaatggtagaatggaccaccgggctaaaagctgtaaaagtgcctgtacacaggaatcatcactcagtgaatagctcctgtggctacaacattcagatgccatggctagaggtcaggttctaggatgtgggagctctgtctgcctcagggaggcaagagccaggccccaggaactcaggccttggtcctcagccatcctctctggtcagcgctgtgcatccctctctggcctggggtgagagcctgcaacaaaggtgtctggaagcagcttctggagccaggccaggagagccctggggctagtggctgccactggccatccagccgccctgtccgctgcatcccgggagcccgagagcctggtcctggcctcgtacctgctctcagcaccgcccagccgggcctgcggctgccacagcttctccactaccacggtcgcctccactgcctgcagggccttatcttgccaaaccaaggccaaaaccagttctgagagaccctccaagcccggaaggtatgaagcacctccctccaactgaatccatcagctaagagttgaaagcagcaggttctcagggcaccgctgggtgactttgctgtgatgcctgcccagcccgcccctgcgcccacactcctctccagccacttggcctgggctcatcccacccatcctgcatctcttgccctgcaatccacaggcccaggatggccatggcccctgtgagcccgcaccgggctctctgcaggagctagccaggatgccctggccctgagactggttgaaccaatttttcagtatttttctctctttctcttgttgggtttttatcttctctgttttcatctgttttgctgtgtttcatcttggggttcctctggcccctctactgagaaaccagccccaacaaccagttctcccagagcctcccccgctccagcccaccaacgagaccaccaaccacaccaaggccacagcaagctcacccccgagacgctattccctggtgtctgcttccaactcgggattaattcgaggatctcttagtcctcagttaatgtttcccaactgaatgcgtgcacccttccaaccttgctgtcaaaaccgaatgagaccctggtagagaaatctgcatgagcagggttccgcgcagatgcgttcggtggtggttgcggcccctgcgctgtacgtgcatggtgcatgtcctctccgtgagctggagcctctccagtgacctcactgcccccacctggggccagctctctttggaagggggcagcatcccccaaccctgcccggccctgctccgccccgccctgcctgcgtgtggaatgaaacaggaccacgtcccgtctgtccttgtgggtcctcccgtctccgtcctggtggtctccgtcccggtggtgcatccagccacattggtggaccttccctttgcttgtcccgctgtgtcattggccgcggtgggtcagggccctggatgctgccgcccctcactcacccctccactctgttgcagaaccgcatgcacgaatccctgaagctttttgacagcatctgcaacaacaaatggttcacagacacgtccatcatcctgtttcttaacaagaaggacatatttgaagagaagatcaagaagtccccgctcaccatctgctttcctgaatatacaggtagagacccctccagggacagcaggcccccgagggagcgggccccgttcccaaagcccagtccacccttcctgtgctctgtggatgcccctgactctgccacagagaatccacacaaacggtcccccaccctgcccccagattgtgctctagagaggaggggcagctagccggggcttcctcatcagggaaagccggtagagccctggctctgccacttacgagctgtgtgaccatggcggcctctgggagcctgagctccactgtctgcgcacaggggctctctgtgacgagacgagcaaacgccgagaagatgaggggcggggcacagaggcttggagttaggcagcccaaggtttatgccccagctccgccactcacaagcagctcaggcaggtcatgcagcctctctgaacctcagtctctgggtctgtgagatggggtgatggctgtgattgccctcgcctccctcaccaggtgctatgaagagggaatgagctgatgggcacgcagagcttcgcgtggtgccgcacataggaagcgctccctgcctgtctgctcttgcctttagggttatgcctgtaactcacacggggctgctgcaagactcaaatcacagagctttgcaagcagcagagccctggccccctatatagggtgctggggatgagaggccagccctgccagtgctgtggtgggtttacctgaccatggggtgggcgggcagccaggagggcagcatgaccagggcccctgaggagctgcaggttggcagctctggtcagtgacaccagagcggttacagggccccagcatagctcgggtgcccatcagctcttctgagatggccagaccctgtccagagaagtgagtgggaggagaagtggggcaccctcagcccgacctgccctgaggccttggagggcacagagcaggggcagacagagtcccagtggggcatcccgggggcttggggccaggcaagcagcacagctctcctacctcctgcctccgcccatccccccatatcaggctgagtgcctggcaggccaggacccaggcatgtccagctggagttgagtagggctcagcctccctggaagctcccagccagcttcctctctagccatagttgagggcctgtggatcctgccctagtgacccgggcttgtggcctgtggggcagtggaaacaggtggggtcggtcagttaccaaggccagtgtgggcctggagtggggaaggaggaggggacaagggaggctgagtagtcagctgcagtcctaggacactccccaacctccagcccagattgagcaaagagctgaggtctggcaggccctccaggctttctgcacagcagcccactccagcttagagctgcggctctgaactccagctcccctccctgctgccccctccacagccctgcttgcacctggcatggattcctggaggctgagggccttcagtgcaaagctggggtcctgttcttctgccccttcccaaactagaagcttctctcctagactctcctctccctgagcctacctgagaaccagctcagtgtgttgccccctgaggaaggcagcatgtgagccaggcggttgttaatcccctgtgagtggacagcagaaacaagaagtttataggcttcttctcccatctggcccagcagtggccacaggaggtgatatcaaggcctgctctgtggactcccaaaggaaaaggcccacccacagggtgtgcatcgaccagggctacctgcatgagcccagtgccctcaaacttccttgctcatgacccatgataagatataacatttgccttaggagtccataaatggctgggcatggtggctcacacctgtaatcccagcactttgggaggccgaggagggtgggtcgcctgaggtcaggagttcgagaacagcctggccaacatggcgaaaacccatctctactaaaaatgcaaaaattagtggggcgtggcagcacgcacctataatcccagctacttgagaatcacttgaacctgggagtcggaggttgcggtgagctgagatcacaccactgcactccagcctgggcgacagaacaagactccatctccaaaaaaaaaaacaaacaaaaaagaaaaacaaaaagaggagtccataaatgcatgtataaaaggaaaatggaagtttcacaaaacgtgctccttttaatacaggtgattggccgggcacaatggctcacgcctataatcccagcactttgggaggctgagatgagaggatcacttgagcttaggaattcaggaccagcctggccaacatagtgagatcccatctgtattaaaaataataataataataataataagccaggtgtggtttccagctactcaggaggctgagaagagagtattagtcacttgagcccaggaggtagaggctgcagtgagccctgatcgtaccaccacactccagcttgagcaacagagcaagaccctatctcaaaaaaaaaaaaaaaagataaatacaagtgatatactgggagacctgatattttgtatctttcatgacttttacactggatctgtcccactgactggatccaggaccccctattaactttgctgacccctcaggtcccctccatcaggttttccctgtgcagttgtctctgagaggcccaaggccggatggccacacaggccaggctggggtcgtccatgccaagcagtcccatgggcctctcgcctcaccacaccttgcctgtttgctctgcaggccccagcgccttcacagaagccgtggcttacatccaggcccagtacgagagcaagaacaagtcagcccacaaagagatctacacccacgtcacctgcgccacggacaccaacaacatccagtttgtctttgatgctgtgacggacgtcatcatcgccaaaaacctgcggggctgtggactctactgagcccagccgccctgcccggcacccttgccctgcctggcctgccgccccccctcccctggaaccaggctccaccactctcagaccactctttgcacttgaggaagaagacctcagaggctggcaccaagggagggaggagggagcatcctccacccgcaccccccaacagaacttgtggtaacgcaggggcggggcggggctgctgagtgcatgctgcaaggccaggagactccacgctcacagcctctgtgtcatctctgagtgcttgatcgggaagctggggggacagggcagggcccagatgggcacaccctgcacctgatgactcactggaagcctcggagtgtcctcctgtcatcttgggtggtgcaggggcgcagatggccctgcagcagggtgctggcagggtggggtcataggagccatccttcagctttgcctggggtctctggtggagggcagttccgtcaacaaaagccagggtgggatcaggccaacttggtgtgggttggaggactcaggccttggcgatggcctccgtctccctgctccctcccctgggtctcagcccttccttctctgggtcatcctcccttgcctttgctctcccagagaactcccatccctgactcctccgagttctggaaatgcttcttgagactgatttatggctcagatagatggtggcgtggagcggggggagggagagatgggaggtgcggggaagggaggtggaagctcctgtgtcacctgggctggggcctcccgcccagtcctcgcaggccaaagggtgacccatttcttttttccagtcaccaggagctcggatggtcactctgaggtgtgaatagatatgtttttccttcagtccacactgaattcaactcaaaccagcaaaggcctttgggctggggattctgtggttgcagaggtctagagggggtggacttttgcagccagtgcctccgcctcaccgtcttggtgaagaaatcagcgagtttgttcacagccgttggtgtcttcccagcccctggggacagaggacagcagggggatggagctgacaccctggagtatttggacccaggccagcacaaacacacccccctgtccccaactctaaagggagagtcctaggactccttagaggaggcttcactgcggagatccctgagcagaagggggcggggtagcttctcccggtgacggtgacgcaggtctggctggccttgggcaaccaacacacctctcccactccaagatgcctccaggtggctgaggccaacgcccacacccaggccagtcgtgtgcttgtacagcaggctgtgcctggggacctagatgtgccatgggagggaggagggtacccactgacaggcctctgcctccctcctcaagccctctgttctccctgcccccactctggacactgcttagtccccagccaggcagggcccctgggtttccacttgcagcccccggactgccccagagccgggaagcaccagtgccaacagctctggacttgttggacccacaggcacagagctctgagtggtgcccaggagacccaggaaccttccctagtgccaaatgcctgcagggaccggtgcctggggagcctctggcagccggactgcaggagccaccccatcagcccaagtccacctctgttttgttcacctcggtcatgttttggaccttgcaccaggtgctgggacgtggcagaggacaggccctgggaaccaacagtgtcctaccatggacagccagggccagctaagctaagccatcccgcccaacacagaagacatggcagttatttctcagcagcaccacgctgggtgaggccagttgttccgcttactctgctccgaactgtaaccccaggctcagaagcagccggcaaaagggggatgctggccacgccccacctctaaggccatcaccctggaggtggaagtcactgggctggagggctctccatgtcccccagcagccgccctcagaacacagtggccagagcaccaggctgggtccaggcctccaatccaggccttccctgtccctagaactggggctggaggagtgggtgctcagcccttcctgccctccatccccagcctgcctttctcttcctttggatgctccatcctccttggtttcttgcactgctctcaatcctcccaccctagcctgggggtggtccttggtcctcaggggtatccggggagaaattctctccctgtgcatgacacctgtcatccatgtcgtaaccagcggctccatcttgtggggtggtgactgagggtgacaaatgagatttggctccgtcgtggatgtggatgtgggaggaatgttgcgagtgacacgtgtgggtttctaatccacagtggtcctgcgtgtgccctgaggggccatggtaacctctccgatggctcggatttagcaggccaagcagaaactgatttctacgaagagcgtctttgccaaactcatgaaaattgtgcctgccactttcatgcctatgggccagttttgtgacctgcgccgctgaccatcctaagaaccaggtcttggccttccctctgagcactgatagaggtccccaaggctctctggcctgaggagggtgtggggtctgcccagccccaagcagagagcacagtctgggcccctgaccaacagctttggcattctgggttccatggggaccctagagctcaggcacaagaacaacaccatacctgctgccaggacgcagctgtctcccaggccctccccacagcccagctcccactggcaggaactggacacatccctgccctccatggtctgcactggtcttctctgagtattcttaggagcagaggcagccccaagttccaacttgcaagccctgtaactaagctgtctataaaccccagcagggaaggccaagggatggtctcacccatgcccttccctttggccaacatgagtcctgcagtggggagcttagcccctgctcccacctaacactctacagttagcacccaggggttgattcaggaagttcttcctttttctagcctgcatccttcctggccaccccctttatttctcagtctgacctggtgcactcttggcaagtgagtccattgcagtcccaggtggatatttaatgagcactcggactgtttcctccaagtcagctagtggcctgccctcctccttttcaagaagtctggggcacagagcctcctctggctgcctcttctcttctctgagcctctgggagccttcaggcaaaacctggcagttctcaggaacccagacctgaggctccagctccgcggccaccagagattcagtgtgcagtgccgaaggcagtcacccccaggcagttcctgctgtcaggccgcaagcctagagcgcaggatcccagcagcccagggaacagggccggcgtgtgagctgctgccgtggggtctgtggtagggctccccatctcccacccctcagcaagaagagtcctgacccctgaccccaccctgcccagagaggagctggggcctccagacagaccccactgcagccagatgaaggcccctgtcaaagaaggggcaggctgggggaaaagcagaaagaatggcccccagtccaaactcctggatcccctccatgagagaggggctccccctggaacagaagctctcatccccaggcccagtgcacaagaccaccagcagagacccaccgcccttcctggcagagcaccacttcctggcagtgcagctccgaggcaccactactgtcctccccttccctccccacccctcccctccctttccctcctctcccctcccctccacacctgccctgttactcccacagctctgggcagccaggccctcccctcctgcctcctggtcttctctactccgctggttctgacccatcccctggctctgcccgccgtcccccaccctgcccctgctgagtatcttcttcctccccacgcacccccctcccccatctaggcgaggtgggctcgggcgtcccaggccctccttagaaaagccgtctctctcgagtgcagtggtcccacctcccaaccccatcactgctgcccaccccatattaactgtaattttgtaagaagagtgacttgttggtttaataaatctctagttattgtaataatttattggctgccataatgtatttattagtcgcctaccgttaataaaaagtgcccgctttcctagcgtgagtgtgatgtgttgtcagggcccagggagctcctgccaggtgcacttgcacgatgtgtgtcctcgggccctgccccatcctggtcccaggactgctggcagcctggcagagtgggcacactcctgctggggacagaggatcagggcgactgggcgccctgcccccctgtcaggatcgccatctggtgggaagttgctccgttctgcgccgagccaccttcctgtcctggagagcttggtggccacctggacactgctgtgggtgacgtggcagtggccatggttgcgctggcactgcttcctgctgctcctgggcctccactgcagcctggggcaggtggaggtctagggggttggctgtcagccatctatgatctctgacttctttctcttttctcaaatggtggtatctcttctttgaatgtaccccggcgtctgcttcctctggggagcttgtaaggatgagctgtgctctcagctccttggcaatgggttccaggcagcgtgccgagggagggcagtcaggcctggggggctggcaggggtctcagtgccggcgcctcccctgccctgcaggatctcccctcctcactgccctccccgagtctccaggatcagccgccttttggggctccctccaaggccctctccccataaaaccaggtttggttatgcctgtcctctgctccccaagtcctcccctgcactgccactcctgggaccacagactgtgatcatctttctccagctggactctgagctctcggagagcaggagcctgatgtggtcattcttacatcctcggggcagcccagcagagagccctgcacacagatgccaggcagtactgactggaggagcgagtgtggtgtgagtcgtgctctgtggccctgagatgtaggggctgtggcgggggctcagccttaaccagtggaactgtggagcctaaatgagccggacttgatttctcctccacacctaagctcagtggccaagggggcacagtccccactcccagctcaggtcactctagtggctgctcctggcagtgcctgggaagatgtgcagtggaggagggagcttggctctggctgtgggtttccagctctctgttaggcagctgcaggccaaggtggctctgtggagtggggagcatgttcctgtggaatccttggggtctcagagcctcaccactctggcctcataatgtggctcaatgagcttgagtgtggacagcccgaggccctggacacaggttcactgggcctcccagaagcctccggctgcccttttctgaacagatcccagtgaggtggctcagggcaagcgagacctgctcctccccggagggatcacacagatgacagggaaatgctcctggggaatcagaatgaaatttactgattgaggataggagagtgatgagatcatatgagtttactgaatctgtttagcagaatgaaagggcagtgccgtgtactacagctcctggggggtggggaataacgccatgccagctgtccaggtgcccctgagaggcagctgagaacgctgccctccgccgaccaacttcagctaataggaaccaggggctggggctggccgcctctacaggtcatggtagaatgatgtaggcacgggggagatactgaagggaggactggccgtaagacgcacggagcccgccatgctgctgttagtatcgattcctcgaaagccccacagcctgctgatatggactggagagacccattgcataagttctggatctggcccagctgtgtcaccgcggtgtcccctcaggccagatgaggttaagtgacatgggcagggagagcgctggcacagtgtgggcctcagtgactggtgtggtcacttcatcttcattgccctccttctgctcagaggggggcggtgtggcagtgggaccagcaattcctcagcacccacggtgtgctcacccctgggggaggaggtcatctccccgtagatgcccagtggcatctacaccagctgtcttctttttcttgttacttgtgtcactcttcttatttcagaggtagagtttagcctggttcacctctgggctttagatccagagagctgggtttacagtgagcaagttcccagggctaggacagggttcttggggaaaataagggaaactgtcccttcctcccactccctgtgcagaaatggattcgttcacagagaaagatgccctctgtgctgctgagagacagactctgcccaagtgaatgagctcagcgccccaaagcagagtttttgcccagggcaagaggctgcccccgttcggcatctgtggggcgcccatcacgttcatccatttgctaaacaggctcctgtgtgcagggcagccctccacatctgccttgcttagaacatcatgcagtgtcagatgcagctgagtaggacccagccagaggaggtgtggccagtcccccaggtgctcctggaggtggccctgccaggagcctctcccctgagtggtggcacccaggatgctggcaggacctggcatgccttcccctgagaccataggaagggcccggagtctctcaccactcccagagaacatccccctacccaggatgggcccaggaggagaggtctaggcaggaagggccaaagcccagctctccggctccggtccagactcccccaacgcccacacacacaggcacacacacaggcacgcacacacactcaagcacatggatgcacacaggcatgcacacacaggtgcacacacataggcacacatgcacacgaacacacacaggcacacataacaggtgcatgcacacacacacaggcacatgcacacagccacacacacgtgtgctgggagaccctcacatagctgggaactctgcagtggggagagcccgggtcaccctgtcctcagcctccccagagagccatggctggtgtccagtccagtctctgcctctggccccgacatgacgggttctccggaagcagggaatgagatgtgctgtgaggtgtaactgactcaggttccatctggcagcctctcggaggagctgccgagtagcccagtccctctctgtcaagcctaattctctccttctctttccctgtctctgtgtctccctcccgctgtctgtcctctctcctcccttcctgcggccgcagaaccgcatgcacgagtctctcatgctcttcgactccatctgtaacaacaagttcttcatcgatacctccatcattctcttcctcaacaagaaagatctctttggcgagaagatcaagaagtcacctttgaccatctgctttcctgaatacacaggtgggtgccaggcagtcctgtgcagggggaagcctgcccctgacagggacccatggctcagagaacaggctgctcggccagcactgctggggctagctggcgagcgggacccattgcaggagactggtggggcgcaaaagaaaaacagtgctgtgccaccaggtttgggcttcccaggacacagccctcagcgtggtggaaatggcccctcctaagatatatgtgttaggaccaagtgactcaggagtggtggggagcagggggcaggacaggatcacaggcttcccccttcctcctggtcaccctctagaagaggtctcaggacagcctcctgtaatctcagcagtggcctcccctcacccctgcccagagccccacagcacctttgcatgaaaccgaaaagtggacacgtggcctgtgaacagggcctggactgcctcttggccccacctgctttccctgctccctgctttggtgcccggaacatgcttcatctctgtgcagccgcccagccagaccactccacccatcccacatcgtgcctgccctccctccccaaccccagccccattgcgcctcctctctccccttcttccttcgtccctggtctttgccccaaatccaaccactccagctatctgcaagcctcctgtatcactgcctccctttcttctgccttctctggggctttcttcttgctctcaggggaatgtgtcacagaccttcccccccacccggctcaatgacgctctttccaaatggatggatgagggatggtggcttccgtggaatgggccaactctgggctactgctaatgcctaaaagcagcactgatgggatgccagagcccagccctggtccctctaggggctgggaagcttctaggggtccctggggtaggagttgcctttgcagactacagagtgcacagggccagcaccctgccatggaggaggaggtgtcctgtcatccgccaggtcagggcacaggttggctcggccaggaacccatgttctgacagccctggagtaaggctttgggcatgggctcagtctcagggccacacgggtccccaagctcagccacagggtgcctacatccagcataggtcgatgctggtctccccacccttccccacagctgggagcagtgtgtgaagaagggctgtcagcttgttctgagcacaaaccgtgtcctcactgatggtccgtgctaatgtgaatttgcaaggttcttgcccttcccaaggtgcagagcaggaggtggggccaggaactgtgccctgcactcgaggctctccagcaaagtcccaatagggcagagagcccaggtagcctctggagccagaccacctgcagctcagcaagttgctcagtcatctgtgcctcattctaatctggtcaacacaatgggtaatcatgcccaccccaagggtgactggaaggacagctgcttggtgccaggtctactgaagtgctggctgtggctgccattggtattattcagaggatggaaactaggggagggggaactggccacggagaaggtgccctctgcaggatggagtgagggcaggagggcacaggacaagccctgaaaggccagccccaggtggcccttgggcagagccaggctgtagcccactctggcagccactcctgacctctcccagccacaacgatggagtccagtaggccccctcaggccagggctaccctcagagacaggcccaaccctacggctctttcttgcccagtgtcccactggggcctgacttgggagtggccagtctcactgctgtggagtgcaagcactagatgccccagcgaagggcagttggaacctgagaaacaagttctccagggccttcagaggaatccagtttgaattcaggtatcatggatgacagatggtcaccagtgcagtggccccatggagtgcaaacctgtgagggcacaaaacaagcagcaggggtgggacgggaggtggccggctgtctaagggacgtgtgggccagcatggctgggtggcagcagggctgtgtgaggacgctgggctcggcagacacagcgaaggcacgaggcgctcctcccacctggacggcttcctgtggccaccttccaccctgggctgtgcccagttcggctctctccagacaggaagctcctgggcagggtccacacgggctgctttgtccaatccttaacagctgtgctgtgggcttggcatctctgcaccagtggatcaaggatgaggctttgcactgtgggtccaggcactcctgctgggctgcccagagctggtctcagccatgacaacccacccaaggctgtcccaaccccctgccccttgccccttgtacacccaaggaattggtggggacagagggcccccagttggcatcatacatgctgatgtccccttaaacttcccaccttggggacatcaatgccccaatgtcctggccactcgcttaagaaccacgcctactaatgatatgctgccagccctgccaagtggcctcttcttaaaggaaaccaatgaggaaggagtgcaggtccctctgagtgcccaccaccctcttgggcaggcccctctccagactttgttttcatggtttactggaatcagcaggattggtttagaccatggggcggtgcctcaatttgctcatctaggaagcaaaagcgttcatctgtggccactgctgtcccaggcggggcttccgggtggatctggtgtgaaaacagtaagagatcttgcaaagtccaaagccaggcaaatgctcagcctgtgtatggttggtgcaaaagtaattgcagtaattgcagttttgctatcaaaagtaatggcaaggccaggcgtggtggctcacgtctgtaatcccagcactttgggaggccgaggcaggtggatcacctgaggtcaggagttcgagaccaacctggccaacatggtgaaaccccgtctctactaaaaatacaaaaattagctgggcgtggtggcacgcgcctgtattaccagctactcaggaggctgaggcaggagaatcgcttgaacctgggaggcagaggttgcagtgagctgagatcgtgccattgcactccagcctgggcaataagagcaaaactctgtctcaaaaaaatagttctttaatttaaaatgcaactatggcttggaactgcccagcagttcctactgctcccttcctgtctcatcccacttcctgggacacgccacaacccacttcttgtcttcatgtccccagccctgtccacccacagcgctcatcagggcctctccccgttcttctgtgtcttgttacaggccccaatacctatgaagacgcagccgcctacatccaagcacaatttgaaagcaaaaaccgctcacccaacaaagaaatatattgtcacatgacttgtgccacagacacgaataacatccaggtggtgttcgacgccgtcaccgacatcatcattgccaacaacctccggggctgcggcttgtactgacctcttgtcctgtatagcaacctatttggtaatgattccagcacccacagaacagcttgcgtgcgcgcgcatacacacacacacacacacacacacacacaccactaacaaatgcaagttggtaaataaactttaaagaggcataacaaaaccttatatatatatatatatatacaaatatatatttaaaaaatctttttagtttgtactagaaagagctgcggacagaactgaccaccatcccatagctcatggaggttttcctgggacggcacgtgagcatgcacgtgtgtgtgtgtacacacactcacacatgtccagatgggagcttggtttgggagtccctccttttgaggatagccccggggtgttcctctcagccccatttctgagaacaggtgaatggcagaacagccctggccttggcccagccagctctctgtgttgcgcccttagagcctctgcgccctcagttccgtcctgctcttggcaaattccagaccctttcagaaatggccgaagccctaagcctctcctcactctgcactcccaaaaacagaacaatttaaggatgcttctctttcgggtggtggtggttgttaatttcaggaatttagaagaatcattgctccgaccaatccactgtctcctgagttttctttattcatgttaagatggcaagaatcagagaacagggagacttggtctgctttctaaaagcagctgacaggaggggactcaagttcacctgcagagttgaaaccagccccgctccaagagggcatgtgggaaggtggggagcgaggggaacaggcgtggcggggagggccggacttgtgggcctgacccgagtcagggtctcaggggggggccaggcttccccaggtgcccgggatgggcttcaatggggttcctgacccctcgtgctgctgccccatctcgcccaaccccagcagtagtcaaaatgttctagggttttttggttggttggttggtttttaaaatcaaagaaaatggtcagactggaccccttatctctctctctacagactgcttcacggactctttgctgttgacgttgatctcctggtagcatgaccttttggcctttgtaagacacacagcctttctgtatcaagcccctgtctaacctacgaccccagagtgactgacggctgtgtatttctgtagaatgctgtagaatccggttttagttgagtcttcacatttagaatttgaaaggaaaaacagaacatttctcatgtgctttgtagcttaaaaaaaggaaaactcaccatttcatccatatttctttttcttgcaaaacaaacatacccatctgcaccgacgcctgcccccgtcccacctcgcggcgcagcccctggagctcctgctggggggcagggcccatctgccgcctggggctccggtgcggtgcactggtccgaggagtgtgctcaggccgggctttccagaaggccacaggccactgcaaaccctgctgcctgccggccgcccagacaccacagacgccacctggcggccctaagccactcccgccacacgctcactccaggttcgtatagaaaaagcacagctctcactggccagtagctgccaaaaagaacacccatcgtataaggaaatccagccccatagaaaacaatctgcccaccgaccccctttctaaggatagcctttgtaggggttttttggttccttttttttttttttcagtttttgtttttacttttgtcccgccgagtactatgtattaccagccccccaccccacagatcagttttcctagtctttgggaaacgggttgtgttttttttcctttgccgtgttggatttccggtcccggctgacacctcccttcgtgtgtgcgcccctccccacccctgcctttgtttcggtgccctgtgtccgctctctcatgtggggatgtttgtgctgcagacaaaaagaacaaaaaaaaatttttaaataccacaagatggaaaaaaaaaacaaaaaaatttaaaaagatggaatgtagtgtttacattaaagccgccgttttcatgaccaatcctatgtcatttctactttgactaatacccaaaccctaaacctcttcacggtttcacttttaagacttaatctttgctgaagaagaccagtcacagccatttcaaataaagaggaggcaaaaagacaaaacacacaaaaaattaaaaaaaaaaacttaaaaaaaaaaggaaaaaagaaaaaaaagcccacgggtctttgtaagcctttctattcccaatcggtgaggtttctgtgatatcttacacactgccagtctacttctctgactaatggaaaattcctgtgtagctcaataaaagagaatgtttgtctgtactcctgagtctcaccctgtgccttccaacgatggttatttggggtgggcttcattctggcaggagagggaaggagggactcggccacacacgctggtaggccggtggttaggagtcccccacaggaccttcccatcccctcagtgccgtcactggagccccagctcagagcacagttgacgcgaccactgcccagtgctgcctgggaatgagggcaggggagccgccactttctcctgcgatgccctctcctcccggctcccggtgcctcctcaccctcagtaggttttgtttgcttttgagaaatgaggtggaagtggggattaggaaggaagaaatgcaagaagggcaggcaagccccctctcctatcatgcaggatcctctttcttctgtagccggcggttcccccacagtgggaggatgggtggtcccaagaatgaggccaattgcctgagcccatctgcacccaagagttcccagccactcacatgcccaggacgagcttgggcccagcctgaccaggaaggctgccttcgatttgctccctgactgcacctggatgccaggaagccccctgcaggccgaacacgcaggaggtaacccagcagtgcagtggggcacacggagtctgatccctgttcctcccctagactgtaggtctcacccgtcccctacattggcccgcttttgctgtaataattagcaaatgggttgcaacggggacctggaggcaacggcagcccactgaacttgcatcatgtccacacgccacttcctgtacaagcggccaagagcatcatgtatcatgctgtcttcagtgagatgggggagctgccaagaggtcagttacctggaatcctctccacatctcaacaaatgggaattagaggctcagaagggcctctctcgggcaagttccagcagtcttttgaatcaagggggtggaggcaggggatattgtttcagagactatggaagaacaagaggcactgtgataaatacccaaccaatacaggcaccccttaaacctcttctgctttccccctggttccccaaaccccaacttatctgcagagaggggcacatgacctaccctctccattgaggggaaggtttgcaatccaggccacagtttgactttgtaacaaaccaagatccacatggaaggctgaaggaaaccatgacattttctatatatggcacatttgaatttttctgaaaaccaagccatattctaatagggttcttcccaactttcaaatgagttttgcaataaaaccaacagaagtttatttgcctcatttttcttagaagggaggtcatagcattttttggaaaggatgcagcaaaaaggccaattaaatcggaacaaggagagtgggggcagaacctatctgatatatatatttttaaagatcctttttcccccctagtttatctgtgcacacaattgtaaaaagctagttctaattagaaccaaatcaaataggagatttacttccaatggcacctaaatagcttctaaaagaaattctgagaaaattgcctctattcaggaggtaaacaaaaggtatccatcatcaccacctgtggaatccctccaggtctttgatctctgccctgaaactctactgagaaagtctcagagtcgctgtgaacctcttctggctctgggggctgccagattcctgaaccattctttgcccagttagaccacccaatgaagaggggctccaaaatgcacttttgttgcctagctggcagttgcttaaggcaataagacaggtaattaaaagagtaattctctaaaggggggaaatgcacacaaaactactgagattataaaaatgcagatccaaccctttttttttttctaaaccaggactaataaccgacactgatgttggaatgctaacatccagagaatgatccgagcaatattccggctgagatcagatcagatctgaaaccagttaaaatcctttaaacgctcaatccgcctgcttcggatcccaggcaagatttaaaaaaaaaaaaaaaaaaaagtggtcctttcactgctacagccaattccattcccagagaattagttcctttggtttgatattcatgtgacttttgatgtttggggataaggctttgccacttaggagagtatctttggttaaaaagactcaaaagccagaaatatcagctgtttgtcccagctaaaattgggtaatatgagatttcaaaggattttaagagctctacggttagaagtcagcttaattaaaaactgatattcaggatatatgtttatcttggtaaggccttcctgctttttctcttttgggatcctgtttttggtaattttttttctagttgactggaaccccctctctaaaaaaaaatgatgtgcttgtttcctctgtgcacttcagttcctaaaaatcatcctcccgcttacttcctctcttccctctttcttctctgccatcttggctaccacatgaaaagacctagaggggacctctaatgactcagagctcttaaggaaaatagaaaaggcaccacagactcctctcttggggagaaatctgtgtttcccccacagaactggaaccccaagagttgcaagtggacagatacctctcaagtcaactctgccctcttttgtatttcatgactggatctccttggtcccagagactgctctgtcctgcgctgtgagagcctgaccttgcgtgtgtgatggctgccagaggcggctcactgcagttgtttacagtaaatgactctatctaaaagctccacaagtgattctaacatgcagccaaggttggaaccatgtctaacctaacagatgagcagcagccctgcaagatggaggctccaaatgacggagggccttcgagggcaggcaggcggccgctgctccttgccagggcttgtcggcaaggccatggcttccttttccatgtgtgtccagctccagcaggactgaaagtccccacagacaggatcaagttggctggctacagataaaaggacacattgtctacttagcccaagtggaaaatcaggcccaagaggccgcctgggcacctggattcacatcaatacaagtgaaacagccacatggcccaccatcctctatggtacagaagagcctcaaaattcaaaacaaaacaaaaactgaggagaacctaggaagtcaaaacagggccactaagaaaatggagagggcaacacagcctcattccaaaagagcccacagaggccaggggcagcccaaccaccattcaccagagcacccggatgctccttctgctgcgcttacaaacctggacccacagccctgagtgctgcttctccaggggctgggcgtgaggaccatctgcctgaccctgcagctggcagggcagcaaaagtggtcctgggaggggaagcccccagcataactgccactgccctcagcacctgtcccggacgcccccaggaagtggtgaaatcctcaagtatccaggtgtaaaatggaagggcggactgagaacttcacttcttgcatcattttaagctacttaataagctcctgctctaaacactgtgatatggctgttttgtaatgtgtcaagaccctctaaaattgatccaagtaattttctcttttcacacatcagaaacctgtgaacatgtggaattagtggcacctacaatgggtgcaacgtgtgaagtataatgtaattcgaggacagtaaaataatctttcgctacacacttacctgaaaaaaaaaaagatataaatacaaggggaagaaaaatgtagttctgccttccccaaatacactactaggaaaaacaaaagttcccaattcaaaaacatgggaaaaaaccctccaaccaaaatagtatacacaaaatccaaatcaaaatggggtttaacgttggcacctctggaaaaagatgccttagcttccagccacacaaaaacatgccttagcttccagccacacacaacacaccaatagagtttgctttttattattattattgttttacaataaaaacaaatagctatgctctcagcaaaacaaattaaaaaaaaaaatcacagaaatttactaacagcatttcaaggtaaggcttttgaaagatttattgaaataaattatctttgcctaaaaatttacctatcacctttttcaattacttttcaacattctaaaaactttccgttatgtaaaatacatttaaactttgccaataattgtggataatactggattcttcccaaaaggactaccacaaaacaaagctttcaaagagtaaaaaaaaaaaaaaaaaaaaaaaaaaaaaaagtaatccaatggggcataaaactgaggtctgtaacctatgacttcatggttcaaatccttaaagttaaacatgtgaagaatttgaagagatttgggacctgggccctctccaaggcaggtaggttcacaccttaccttctctgctgaattaaaccaggaataacacagctaggaaaacgcagtgctcccaggataaaagatacaaaagttcttttttatttctttaataaagcccttcaaggtttactctcccatcttgcaaggcccacatcttgttcaaggaccaaacccacaggctttagcactgcctaatttacttcaccaatgaatgaaaaccataaaccaaagcttgctgcctaaccactccccaggtccagacgggacaaggaaatgctgagaggggaggggacccatggggcacactcatgagatgcaggagcaccagagttcacggaaatcaagccggctttggactggaggctcggaaagtcagtcccagatgtagtgggacagaaaggggtgacttcatcacaccctatagccctggactttcccctcctctgctccaggtatcgaaccaagagttccttttccaagatgccctgctggctcaggggtgcatgagcccgtgggtctggcctctggcacagtctacatgcttccacaacaacgacagcagtttgataacagatgttaccccacgacgtgggggcgggctcacactgtgcgcctcccccacactcttcccactgggtgtggtgctcaggacacctgcatttgtgggacgtacgcatgaggcaggagtagaagctgcctgctgcaggcaggcgactgctcacttcctcctgatcgtcccccaccccaagcagtccagtcaacaccagaagagatcatacctacagttaaaatttgcagtgtttctaaggggaagagaaatgtcacatagaaagtattacaaagaaggattaaatttatcagctgtccaaacactataagaccacatgctttatacagcggcaatgcagtcaagcccgcttttccatggagcgggcagaattgggacaggcctcctccagtcagtcgggcacagggcgcaggaggcagctgaggaaggcaagggagcgctaggaggtctgctgcttctgaagcctccgttccgcggcggcagccagcatccttcgacgcagggtcacggggtcagaggacgcaccttccgaggggaggaagctctctgaggccgcatcatcttcagaacttttgttcaagaaacgtctagaaaaaacagaagactttttctctctcataggagagatggggagctgtggaacacagccagaaggttgatttcacatctccccatgtccaggcaccttcatgaagctgtcactcagcaccacccaatgaccaagacatccagcccccaacagatgggcgcaaattctctctgcaccagggaggaacccttcagtgctgttccctgctgtctcttcctgcccatcccctccacccacagacacagcacagaactcccacaatcacagggtctgccagggcccaaacccacttgaggaacacagtgctggccctgtccttaagagctggaacaaaaccccctctatccacaggacacacctgctgtagctgccaccaaccatgggtgtgtgacgcacagatgcgctgagtgtgtgtacaatgctcagctgaaaggcagagtggtcaacagggaggacctgggagacagacgccagggccaggccagtgctaacctctccagcctccatttcttcagctgtatgtcagctgaatgggttaacagtgctccctcttagagctgttaaagtaattcatataaagggcttagatcaggttagcacacaagtgctctctcggcaagcgtggccaaaggggtccatgggagatgactgacagtaccagcatcagaggtagaccagtggggcccagtgttaccagatgctctggttttttcaagagaggcttgaaatctgagttttggggtggcatgtaatgccgtttcactgttggcatctgtttaaaaagagaagacggcctgacaacggccttcagccactagtttttgatctggattatgccaggtggtctggagaagcgactcacttgcgagcttgctggaggagttcgtccttacgctgcaccagcatgcgctgtctctcatcagcagacttggagaagcggctcccacgagcctcgaagtcttccacctcactgggctccacttccacctcgccgaagtccagcgtctcctccaggcgaggactgaggtccagtggcacacgctcggtctggacacggggcaggaagcaaggaggcagctgtgagcacaggcctccctcctaagcaggttcctcacctacagggcaccccagacacggctgttctggacgcaaagagaaggctgctgccaagcagggaggcagaaactaggaaccacaagctacggataatggagcagcagcttccctgagggcaggcctgctgcctatggcttgagtagtactaagaacaggacctgactcacacagaatgttcggcatcagagggtaagtaaatgattaccagcatgaaaaacgtaagcaccttcaagctgcactcttagaatacgctaccaacacgacaaccgtgagtttacatcctgggaattttctgttcacttctactaattgctcaaacatttaaaccagtcttatccaatcttctgcacaaattttatatcctcaattgactctgaaaacagaggtaaaaaggaaaactgctaggcatctatttatttatttatttacagacagggtctcactctgtcacccaggctggagtgcagtggcacaatctctgctcaccacagcctcaacctccccaggctcaggggatcctcccaacttagcctcccaagtagctgtgaccacaggctcgtgccaccacatctggctaatttttgtattttttgtagagacagggttttgctttgttgcccaggctggtctcaaactactggactcaagcaatctacccacctcagcctcccaaagtgctgggactacaggcatgagccactgtgcccagccctaaggatcttttgaaaagacacaggatggattatatggttccttggctttggttgaagctccaaagtccacgacaatgcccaggcacccccaggtcctagcaggtgcctgaccatctgcgctgctcatgctcccagatgcagacctgcgctggccagggtcagcccattgcccgcttctaggctgtgacagaatggaggtgggtgcagctgagaggcaggctgttttacttcagagttcctgctggacctaccctcactttttcctgccttcagctaagctcgagagggaacttcaagagaaccattcgtatccccgagagtcaaaggacgggggaactggtggctgcatacacttgagaaatctacagaaagaaactggcaggagccaataaaatacagggccaggggagctgtgacgggagcacgttcaccttccactgactccagacaacactgtgtgtgtcctggagcttggatagggctcctgcaggagggaaccaacctaaggttgttgaaaacaactgtgcccaaaaggaccacttggagaggtaacaggacccccatgaaggtgggagtggtcatcaatagccagcccagggtcaaaggaggagtttctggggccagatggggacagggagatagttggcataacatgtacacacacacacacagacacacgtagttggcacaacatgtaggtacatacacacacacgcacacacacgctggagtctcactgtcctattctatccctctcctctaagcctgaccctagagcaggttagaaaaaatggtgagtgaagaggcgagatgttagaaagaaaacagccgcccaccgcaacccctgctctgtgcagctgcatgcctgactaataccagcctgagcggggcagggcagagattagaacagagggagagtggagctgacaagcttactgggctacactgaggtttctgttaactaattgttattcaaggactttgtatttcttcacaaatgaccaaaaatgttgcacagcaaggttccctgtgaaatacatactttcctccattatatatacatatatatatataaaatccagaactcttcatgctaactctagaagcagcagtggaaaatcaagacagggactgaatatgctgtacccacagatgcccccaagcccacagcatccatatctcagctgcgccagctattcaaaaactggaggccgggcgcggtggctcacgcctgtaatcccagcactttgggaggcagaggcgggcggatcatgaggtcaggagatcgagaccatcctggctaacacagcgaaaccccgcctctactaaaaatacaaaaaattagccaggcgtggtggtgggcgcctgtagtcccagctactcgggaggctgaggcaggagaatggcgtgaacccgggaggcggagcttgcagtgagccgagatcgcaccactgcactccagcctgggtgacagagcgagactccgtctcaaaaaaaaaaaaaaaaaaaaaaaactggaaatgtagacatggaccccttagaagccatgcaccatttcacaaatgatgcataatccaattacataggtggatatgaaaatcttaacccagcaacagatttgaagaaggcctagtagtgtttactgtttcctctttgtagagaaaaacacaagaggtgaaagcttgtgtcatttaccagtgcttctagaggagaccttgtgcaccccagtaagggaaggcagcaccaccctagacccaagcctgtgtgcaggaaagccccacatggcacaaacacagaaaggccaaggtggggttgtccagtttttatttgtggtcgcataagaaagtgctctgacaatatggtaactgaggaagcgaatgggaaccacagaagaggagtgggatccagggccacaggtgtagggcagagggcacgggcagggggtggggggaggtggcacctcggccctgctgcttggagttagggtggccacctcaaggcacccaaagtgggtcaacaaacagatctggttctcaagaaagccatgttttccccccagccccactcagctcaggcggtctcagttttgcaaaatgcatggatgtatctggaaatcctgagtttgacaagtgaggtgtgggggagggcatctcaatggcctcggctccctggagagcttgccctaggccatccccatctgagtttagatgggtccaggcaccctcacggtcccgagcccagcttccttctgtccttccacgggctctcactcaggctcaaggtggcagggctggccccggggaacacaacccctttctcttccagcacatgagggcaatccccagggaatgactgccagccctgcgtggaaacacaggccacaccacgggcacagcctgatttgctacccttcattattgggatggatacagcacagtttcttttgtactcgtgccctaagccttgcaagcttcaggactgaggaagaccactgtcgggaccacattccccctccacagctccatgaactcactctcactagagtgcgggttttacctgagcagaagtttctccctcttcctggtcactgcttggcctttccacaggactgttcaatgcaggtctgatgctatctgaccgctggaagagaaacagtaccaaaaacagtccagagtcacacagaaatcaaatcacagactcagggaaaccctggtgtgcagagggagctatggtacccaatccaacctgtaactctaaggaagtctactgcaccacagaaattaaaatgccataaagattaaaagcaagacaaaggagcctggggcctaacctagagttccaagtttgagagtcagcaactggtcccactttagtttccttttgaataacagtaattagacaacaaaaacaatgataacagcagagaacactgactgaacacctaacttcggcatggcaccaaggaaaactgggacatggctgtctcgtctatcttcacgtcctatgaaacaggtgctgctgttaccgtccttctagccagtttaagatctcacacaatgctgcagacactctggggaccagccagtaaggtctcgccacctcagtgctggctggccagtgtctgtatttcattgcctgaggactttctctggctgcatgaggtagttcagccacccccagaggcagccctcaactagtgagggagggaattactctgtgaacaccccagttcctcatctcctgcgagggatatgttctgcactggatcccagaggccccaaatgggaaggggcttgtcacccacagtgataacaaacctgcttgataacaaacccattactggccaccctcccttccccagctcacatccccacccacaacctgtgattcctgggaccacttcccaaactatgtgcattcaaatccttgtcccagggtccgcttctggggaaatccacagccaacagccaggtcaaagagctgagaactgggaaccacatctaatatctcagcccatgtgactgagtctatgctctttcctcttcaaagagtctcaggttttataattttattaatagatttccacatatttttacatactaaaattgaatcatttggggtagattattccctggtcatacacaaattccacggtcctgccagaaggctcatctatattaatacttcttatgctcatcaaagtagagatctgagcttttcaaaaatcaaaaccaccacctcagacagatgaacggtagctagtggaacaccacaccagtgtgcaaagccaattagggacagatggcacagctcctagagcagggggttggcaaactacagcctgaaggccaagttcactactctatttatttttgtaaataaagttttattggaacacagtcttgcttatttacttaaatactatccatggctgctgtatgacagcagagttgagaagcaacaaagatcgtgtggcctgaaatgcctaaatatttattatctgccttttaaagaaaaaaatgtggccaatccttgtccaacaggaaccaatactatgacttcctagactggcaagggcaggctggtgtagagtgtatatttgaacaaaaagtgactcaaatactcaccttatctttggtgtgtctgttctcagttattaatttgggaaagttagagagtttatagaaacccttcattaagtcataaatgatattcagctgttaagtaactaaaacagttaacctacagtattcaatctttgtgaagatagaacccatttatcatgctttaaaagcccagttttacctgtgtaggaaaaggtacttgaatccgtccttctaaaatattgtctgttgttatttcaactgagcgtgtcagctggaggtcctgcagtaccagatggtatggaacctggggaaacatctcttgaatctgatgagcctacaggaatacaaatacagagtccacagaaacgttcactgttaacagttgctcactgacgtcacagtgtctggcaggctttgggcagtgaatgtggcatcatgccctgaaaacacaggtaagggagccacctttattcagtaggtcaccttcacactgcagtccctttagtatttttccaggaagccaaacaggcaactgtggacagcatcaatttcaacataaggagagctcagaaaaccaactggatcccaagagaggctcgactagaatattccagttttaaaaagtgttcattttaactaccattcgaaccagcaatcccactactgagtatatacccaaaaggaaagaaatcattatatatgaaagatacctgcgctcatatgtttattgcagcgctattcacagtagcaaaaatatggaatcaacctaagcgtccttcaacacaggatttgataaagaaaatgaggcacatatataccatggaatattactcagccattaaaaaaaatcatatcttctccagcaacactgatgaaactggaggccgttattctcagtgaagtaactcaggaacagaaactcaaataccgtatgttcttataagtgggagctaaacaacaagtatgcatggccatccagagtggaatgagacactgtactatgaaaggtggaaaggtagggaggggagggctggaaaactacctattgggtacaatgttcactctttaggtgacggtaacactaaaagcccagacttcaccactgcgcaatacctgcatgtaagaaacctgcacttgtaacctgtaaacacatcaaataaataaatgttttaaaagtattcattttaaagctcaaaatatcttgggtataaaaatgtgttttccttaaagatataattcctaaagggaacaaacttctgatacacatagcatggataaaattcaaatacatcatgttaggtgaaagaggtctgactcaaaagccaggcatatgattccatttatatggcatctggaaacaggcaaaattatggggaaagaaacttgataagtggttgccaggggctgaggatcagggaaggaagtggttgccaggggctgaaggttggggaaggacatgactacaaaaggacctagtggagttctggagggtgcggatcaaactgttgtacatcttgtttatgatgatacacaattatgtgttgaactggatgttaaaaagggtaaatttttactctatttcaattatatctcaatttaaaaaaattatagagaatgcaaattccttatacggccctggagctgagttttccaactgtactctggagacatctcagagtttatgtagggctctagggtgggtgtgtgtgtagggagagcaggcataggcctggccacaccaccacccatactttcatccaagcagctctggattttttttccacatatgtaaattaactctataaatgtttacattcaaggttttatttttggaaaagttctaataactataacaaaaaaaggaagaaaaaaataattgccttaggggcacaataaagccctcctgagatattagctcctagggacacgttgttctgactatagaaggagcagggagtatgtcaacgtcaggaccttgaaggaaaaggtcggcaccgggctctgcttagagctcttgctgggggtggaatgttggcaacataagcagtgcccagggcccccagggcctcctcattcctgcagtcagcttgtttatgtaaacatgagttgatcattattttcccaggtcaggtcaaatctaactgggcaagagtccataaaaacctctaaaatcagataaaacttctctttattcttaaacagcttcctcctcatttcccaaatttaaaaaatgcctaggattcattttactagaccaaagcttttctaccagaaaatccagcaagttaattattagatcttaataaaaaatgcatggttccagtaaattagttgtaccaaaagtagtccactccaaaccatcacagaactggaggaagaacagccagggcctgcctgagaattctaaacaactcccagaagggaattctgattccaacacccttgaagtcttgactttttaaaggaggtcggtggggtggtccagctgcagagcttcaacagctgcctgaccccaaagaacccctgtaatgcctgccatgagcccagcagtagctgcactgggcgaccacactcccaggccacctatatgcaccaagatgtcaccctcactctctgttggcagtccagctgaggtttaaggagaaagaggagccaggagagtcatgcttccttcttcttttattatggccccaagcagataaaatttgccatcttaaccatttgtcagtgtaagtgagccctcagtaccactatataggtgagtttcacaggctgattcagccagccctggagcaagtgttacactgttgctgacatgtactgtatagttaggccgaggatggctgtgtctgtactgaacatgcacaggctttcttgtcattattcctaaacaatacagtgtataacaaccatttactcagcatttacattgtattaggtatcagaagtagtctagagatgatttaaaatatatggaagatgtgcgcaggttatatacaaacagtatccttcccccatcttttttttttaccttaaactattaagggttaaagtgtcccactttatatcagagacttgagcattcatggattttggtatctgaaggagggggtcctagaaccaatccccagataccaagggatgactacatagtgtggcagagttaaccacaggcacatggctgcgcaacagatctgaactttttcatcttgcaaaactgaaactatatctaagggacaacactcctatttcgcctcgcctcgccccagccctcctgcagccatcattctgctgtctgtaagagttttatgtggtatttgtctttttgtggtagacttatttcatgtagcattaatgtcctccaggttcattcatgctgcagcatgcaacaggattcccttccttttgaagtctgagtactattctactgtacaggtttgccatatcttccttatccatccatctccagtagacatttcagttgcttccaccccttggctgtgagccacgccttctttttaaaccaaatttcaatacgcccgtagctatatccatccctcctcacaaccctctctcctactcagctccccaccctagcctgttctttcagttgactcttctatttgttctgtcccatcaatctctgcccctcagtgatcattcctatgcacataccagatgtgctttcgaatctacccttaaaaaacaacagcctgacacagtggctcacgcctgtaatcccagcactttgggaggccgaggcaggtggatcacttgaggtcaggagttagagaccatccttgccaacatggtgaaaccccatctctactaaaatacaaaaaattagccaggtgtggtggtgcatgcctgtagtcccacctactcgggaggctaaggcagggcaattgcttgaacctgggaggtggaggttgcagtgagccaagatctcgccactgcactccagcctggcgacagagcaagactcggtgttaaaacaaacaaacaaacaacaacaacaaagaaaaccatggaggaaaacctgacttataactgacaaattggtacagactcagtgtaacaactctgagatgtaaacattccagggcactcaggcagaggtggctcccctgtaatactgtgagattcagtgccaggagtgatcaggtttctcagtaaatatccaacaagcatcccttcctgcttccagcacagggaggggaaaaagcacctcagtgaaatcagccagggcacactgttcttaacaacgtctgccctcaggagaaactactcaaccagaacctcatctgctggggtctgatcaaagctgcaccgaccggagggaactccagtccactcgaaccatcctgtcccacaggaggaggggaaactgagaagtagattgaagttcacagtccagagcatgggctcactaaaagacggagccctaatcccaggactacagcatgcttctttccctcccccgacacctacatcacgacaggcctgttcaccacagtcctttttacgcagtacatcatgttcaactatcatgaaaaaattataaggcatactaaaaggcaaaaaacacaatttgaagagacagagcaagcatcagagccacacagagcagagatgctgaaattaacagactgggaatttaaaactatgattaatatgcaaagagcactaatggataaagtggacagcatgcaggaacagacgggcagcatgagcaggcagatggaaatcttaagaaagaaccaaagagaagtgccagagaccagaaacaccaacacgagtgaagaattcccgtgacaggcttattaatagatggacacagctgagggaagaatctctgagcttgagatacacactttgaaaatggaaaagcaggccaggtgcagcggctcacacctgtaatcccagcacttcgggaggtcaaggcaggtggatcacttgcggtcaggagttcaagaccagcctgggcaacatggtgaaaccctgtctctactaaaaatacaaaaatttagccaggtgtagtggtgcacacttgtaatcccagctactggggaggctgaggcagaagaactgcttgaactcaggaggtggaggttgcagtgagccgagatcgtgccactgtactccagcctgggtgacagagtgagactccatctcaaaaaatggaaaagcaaacagaataaaaactgaaaataacagagcagaaaattcaaggactgtgggacaactacaaaaggtgtaaacgcacttaatgggaactgcagaaggaaaagagaaacgaacacaagaaatatttgaaacaataatggctgagaacttgtccaaattaatgtcagacaccaaaccacagatccaggaatcttagagagtaccaagcaggacaaaggtaaaaaaaaaaaaaaaaaaaaaaaacactacatcaaattcatcaaattcaaattatagagaatcaaagattaagaaaaaaatcctgaaagaagccagagggaagaacaccttacttttagaggagcaaagttaggaatgacatcgacagctcctcagaagccccacaagcaagaagacagcgaagggaaatatttaaagtgttaagaaaagactcaccaacagagaattctataccccacaaaattatccttccaaaaggatgcagaaacaaagactgcctccgacaaaccaaagttggaatatgttgccgtgagacctaccttacaagaaatgttaaaaatattaagtcgtttaaagaaattgatataggtcagaaagctcagctctacataaagaaaggaagagcatcaaagaaggtataaataaataaaaactgttctttaacataacattcgattcaaaataacagcaacagtgcattcagttatgtgtgcttgtgcacgtgtgtgcttatgtactcacatacaggtgaaatgaatgacaacaatgatacaagggacaggagcgaggaattaggattgttttgttatcaaaaggtactcacacttcccatgcagtggtacagtgttatctgaaaataaacgaattagttgcaaatgtatattacaaactctagggcaaccattaaaacaagcttgtccgactcatggcccacacagctttcaatgcagcccaatacaaatttataaactttcttaaaacgttatatttttaattttctttttttagctcattagctatcattattgttagtgtattttatgtgtggtccaagacaattcttcttccaatgtggcccagggaagccaaaagattggacacacctgcattaaaacaagtaacaagtatactgatatgctaagaaaggagaaaaatggaattctataaaatgttcagttaaaaccacaagaggcagagaaagagtggaagacaaaaataggaacaaaaaacaagggcaacaaatagaaaacagtaacaaaatggtagttattaatccaaatacattaataatcactttgaacatcaatggcctaaatgtgccaagtaagagaggttgtcagagtaaataaagaaaaccaagacctaactgaatgttgtttacccactttaaaataaagacacatacagattaaaagaaaatggattaagaaaaatataccacaccaacactaaccaaaagaaaccaggagcagctatattactttcacagagcaaacgtcaaagcaagcaaagttatcagggataaagaacagcattacaaaatgatcatggggtcaattctccaagaagacacgacatctttaaagtatatacacctgctgggcacagtggctcatgcctgtaatcccagcactttgggaggtcgagaagggcagatcacttgaggtcaagagtttgagaccagcctggctaacatgatgaaacccatctctactaaaaatacaaaaattagttgggtgtggtggcacacgcctgtaatctcagctactcagaaggctgagggaggagaatcgcttgaacccaggaggtggaggttgcagtgagccgagatcgggccactgcactccagcttgcgcaaccaagtgaggctctgtctccaaaacataaataaattaaataaataaataaatttaataaataaagtatatacatctaacaacaaagcatcagacaaactgaggcaaaaattaaaagaaccacaaagagaaacaaaatagatttggagactacaacacctatcacaaatgaacactcaagcaggcagaaaatcagttaagaacatagctgaactcaataacaccatcaatcaactgtatacaatcaacatctgtagactacttcatccaacaacagcagaatacacattcttctcaagttcacatagaacattcaagacagaccacaagctaggtcataaaacacatcttaaaataaatttaaaagaatataaattacacaatgtctgctcttaaagcagaaatcattaacagtaagaaaaccggaaaatcccaaaatacatgaagattaaacaacacacctctaaataacacatagatcaaagacgatatctcaggataaattttaaaatattttgaattaaatgaaaatgaaaacacaagttatcaaaattgtgagatgtagtaaagcagtgcttgtaggaaaatgtatagcactgaatgtatatattagaaaagaagacataaacaagtttccatcttaggaaattagaaatagaagaataaattaaatccaaagtaagcagaagaaaacaaataatcaaaatgagagcagacatcaatgaaactgaaaataaggagtcaacagagaaaaatcaatgaaaccaaaagccggtcctttgaaatgatcaataaaatagataagcctctaagccaagctaactacgaaaaaaagagagaggacctaaattactaatacaagaaatattatacagataacttcttataattagaattgccaaaacttatgcaagaacaaatagacaatgtgaagttgtatagataattaataatcttccacagcagaaggcatcagcccacatgagttcgctagtgaattctgccaaacatttaaggaagaaattgtatcaattctctacaatctctttcagaggacagaagcagaagggatacttcctaattcatactataaggtcagcattaccctaatactaaaaccagagaaagagattacaagaaaactacagaccaacatctctcataaacacatatgtaaaaatcctcaataaaatattagcaaatcaaatccaacaacacataaaaataattataaactacatccaagtggtatttattccaggtacataaggctggttcaacatttgaaaatcaattaatatacttctatattatcaacaggctaaaaaagaaaagtaacatgaccgtatcagtagatgcagaaaaatcactcaacaaaatccaacacccattcatgataaaaactctcagtaaactaggaatagagggaaactttgtcactgtgataaagaatatctacaaaaaccctaccactaacatcatgcttcatggtgagaaactcaaagctttcacattaagatcaggaacaagacaaagatgtcccatctaaccactgctttccaatgtcatcctagaagtccaagctaatacaataagacaagaaaagaaaagcaaacagattgggaaggaagaaataaaactctgcagatgacatgctcacctatgtagaaaatctggaagaactgataaaaacactcttggaactaataagcaattacagcaaagttgtgagatacaaggttaacatactacagtcaattgctttcctatatacagaaacgagcaagtggaatttgaaattaaaagcgcagtatgctttatattagcgcccacaaaacaaaataggacaaaatacatataagttctatatgaggaaaattacaaaatcttgataaatgatatcaacgaagaatgaaataaacgaagagatagtccatgttcatgggcagaaagactaaatattgtcaagatgtccattcttcccaacttgatgtacagattcaatgcaatcccaattaatatcccagcaagctattttgtggatattgacaaaatgattctaaagttatatgaagagacaaaagactcaggatagccaatacgatattgaagaagaacaaagttggaggatttgacactgcctgtctaaaagatttattacaaagcaacagtaatcaagacaatgcggtattggcaaaagaacaaatagatcaatggaacagaatagagagcccagaactaaacccacatagctgggttgacagctatactaaacccacatagctgatttttgacagaagagcaaaggcaatacaatagagaaaagatagacttttcaacaaatggtgctataactggccatccacatgcaaaacaataatctagacacagcccttatactcttcacaataattaactcaaaatggatcacaggcctaaatgtaaaatgcaaaactataatacccctagaagataacagagaaataaataacctagggtatggcaatgactttttagatacaacaccaaaggcacaatccatgaaagaaaataattgataagctggacttcattaaatgtaaaaagttctgcaaaagacaatgtcaaaaataagatgacaagccagattgggagaaaatatttgtaaaagacacatctgataaaggactgctatccaaaatatacaaagaatttttaaagcttaacaataaaaaaacaaacaacctgatcaaaaaatgggtataagatcttaatagatacttcaccaaagatagatgtacagatgccaaataagaatataacaagttgctccacatcatatgtcattagataaatgcaaattaaaacaagacaccactacatatatattagaatagccaaaatctggaacactgacaaaaccaaatgctggagaggatgtggagtaacaggaactctcattcactgctggtgagaacgcaagatgatacagccactctggaggatgattcggcagcttctaacaaaactaaacaattttaccatttgacctagcaatcatgctgtttagcatttgtatttgtcgttttctcattgctgataaagatatatccgagactggcaatttacaaaagaaagaggtttaatcaacttacagttccacatggctgaggaggcctcacgaccatggcagaaggcaaggaggagcaagtcacatcttacatggatggtggcaggcaaagagagagagcttgtgcaggtgaactcctctttttaaaaccatcatatctcgtgagacttattcactatcacgagaacagcaggagaaagacctgcccccatgattcaactacctcctaccaggtccctcccacaaaacgtgggaattcaagatgagattggggtggggacacagtcaaaccatatcattccgccccggcccctcccaaatctcatgtccttatgtttcagaaccaatcatgccttcccaacagtcccccaaagtcttatttcagcattaattcaaaagtccaaagtacaacatctcatctgagataaggcaagtccctaacgtctatgagcctgtaaaatcaacagctagttagttacttcctagatacaataggggtataggcattgggtaaatacagctgttccaaatgggagaaattggccaaaacaaaggggctacaggccacatgcaagtccaaaataaggtagggcagtcaaatcttaaagctccaaaatgatctccgctgaatccatgtctcgcatctgggtcacgctgatgcaagagacgggtttccgtggtcttgggcagctccacccctgtggctgtgcagggtacagcctccctcccggctgctttcacagactggcgttgagtgtctgtggcttttccaggcacacagtgcaagctgtcagcagatctaccattctggggtctggaggacagtggccctcttctcatagctccattaggcggtgccctagcaggcattctgcgtaggggctctgatcccacatttgccttccgcactgccgtagcagaggttctccatgaaggccctgcccctgtgccaaacttctgcctgggcatccaggtgtttccatacatcttctgaaatctaggcggaggttcccaaaccccaattcttgacttctgtgcactcgcaggctcaacaccacctgaaggctgccaagacttggggcttccaccctctgaagcccaatggcccctttcagccatggctggagcagctgaaacacagggcaccaagtacctaggctgcacacagcacagggaccctgagcatgacccacgaaaccatgttttcctcctaggcctctgggcctgtgatgagagggggctgctgtgaagacctctgacatgccctggagatattttccccattgtcttggggattaacattcagttcctggttacttatgcaaatttctgcggccagcttgaatttctcctcagaaaatgggattttcttttctatcgcattgtcaagctgcaaattttccaaacttttatgctgtttcccttttaaaactgaatgcctttaacagcatccaagtcacctcctgaatgctttgctgcttagaattttcttctaccagatactctaaatcatatgtctcaagttcaaagttccccaaatctcttaaggcaggggcaacatgctgccattctctttgctaaaacatgacaagagtcacccttgctccagttcccaacaagttcctcatctccatttgagaccacctcagccttgatttcattgtccatatcattatcagtattttggttaaagccattcaacaagtctctagggagttccaaactttcccacattttcctgtcttctcctgagccctccaaactgtcccaacccctgttagctagtttcaaagtcacttccacattttcaggtatctacagcagcaccccactcctggtaccaatttactgtattagtccattttcatgctgctaataaagacatacccaagactggatgatttacaaaagaaagaggtttaatggacttacagttccacatggctggggaggcctcataatcatggtggaaggcaaggaggagcaagccatatcttacatggatggcagcaggcaaagagagagagcttgtgcagggaaatcctctttataaaaccatcagatcttgtgagacttattcactatcacaagaacagcatgggaaagacctgcccccatgattcaactacctcccactgggtacctcccacaacacgtgggaactcaagaggaaatgtgggtggggacacagtcaaaccatatcagcatttaaccaaggaagttatgaacttacgtctacataaaaacctgcacataaatgtttatagcagctttattcataactgccaaaacctggaagcaaccaagatgtccttaagtaggtgaacgaattaacaaattgtggtatatccagacaatggaatattatttggtgctaacaagaaatgagctatcaatcccttaaagatataaaggaaacatacatgcaaataattaagtgaaagaagccatctaaaaaggctacatactgcaggattccacctgtatgacattctggaataggcaaagctatgaagatagtaaaaagatcagtggttgctagaggctagggggaggaaaggaaaggcagagtgcatacagaatctttagggcagtgaaaagactgtatcatgtggatacgtgtcactatatatttgtccaatcctatagagggaacacaaatgtaaattatggactttgggtgattatgatgtgccaacacaggtttatcaactctatcaaacataccctctgctgagggatgttgataatggggaaggctgtgtgtgtgtgggcacaggaggcatacagaaaatctctgtaccttcttcttaattttgctgtaagcctaaaactgctctaaaaaattagtcttaaaaacaaacaaaaaagactcatgagtattcaaaagaattagaagcagggtctcaaagaaatatatgcctactcatgttcacagtagcattattcacgatagctaaaatgtggaagcaatgtgagtgtccaacgacagattaatagataaataaaatgtggtatatgcatacaatgaaatattactcagccttaaaaaggaagaaaattctgacttgtgctacaacgtggatgaaccatgatgacattatgctaagtgaaataagccagtcacaaaatgacaaatattgtagaattctacttatatgaggtacctacgtagttaaactcatagagaaagcaagtagcataatggttgccaaaggctagagggaggggagaattagtagttaattgtttaatgggtatagagcaagggtatccaatattttggcttccctgggccacactggaagaagaattgtcttgagccacacataaaaatactaacactaacgatagctgatgagctaaaaaaaaaaaaaaaaaaaaaaaaaggcaaaaaaatctcatagttttaagaaagtttacaaatttgtgttgggctgcattcaaagctgtcctgggccacatgcagcctgcaggttggacaggcttggtacaaagtttcgattgtgcaagatgaaaagagttctgtagatggacagtggtgatagttgcacaatgtgaatacaccactgaaatgcacatctgaaaaatattaaaacagtagatataacgtattttactaaaatagaaaaatcgaaaaaaaaattcactttcttatttttttctgtctgaaaaagagtagcattggcttgtatgtgcctataagccttctggagcaacataatacataagaaactaacccaggctgttaagggggcgtgggagctgggcacatgggaaaaggaagggagcatgacttcactgtatactcctctctaggttctgaaacttgtaaataaatgacctattcaaaaaccttaaacaaacgaaaacacttccctggatgctacaccctatcaagctaccacctctactgctctgtgtccttcttcataacatacttcctggtatggtctatttcttcagctcccactcatttcaatctaccataatctactgtccaacccctcgggcaatggaaaatgctggttcttttccagctaatcaatcactcccactctgccaaatccaacatgcacttctatgagctcatcttgtaagaattccacacgcttgactcttccctcctggaaacccaactcctctgtgctgtgctgccaccttctcctggtctcttccctctccaccggctgtcatggctcctccctctctgccagacctctgaacatggcagaacctagagctcagatgtcagccctcttctctttgaccccctgctttagatgtcacctccaggcgtcaatctcccaaatgtgcatctctcacttgatctcctcactgaggtccagaactgcccacagagcaacccagacttacccaaatagaacaccgcgacccatcctcatgcctgttcctcccgagtcttcgcatctcagtacgtggtaccactgtcaactcagctgcttaattcaaactcagcaaggcagcttccattcagccacttctctcatcccccatatccaaccaaagcaccaagtcctgccagctcatcttacaaaagtgtcctaaacctgccacttattttcacctttattacaaatacccctgtccaagcccccatgtgaatttcccttgactactgcagcaacatcctaactgctggtcctgctgcttccatttctgaccctctataattcatccttctcccagaagcaaaatcattctgttaaatatcctgtcagtcccctggtggtggtggtgggggtctgtaagaagctctgaatggccttctaatacttttacaagatctaaatttgcctgtggcctataagaccctgcatgttctggctctgaaatctcaattcctatcacagtgttgttcccctacttgccaggccccaaccataatgacctttctcagttcctagaactttctcacctcatagcctttgcacctactgtttccacggcctccttccccctgatccagctccatctcatccttcatgttttagcttacatattacccctcagagagaacatctccaaatgcctcctctaaaatgtttcctctggcctctacccacccactccaccacactgcctaccttactgctgccagagcactcatcaccatcagcagtcaccttatttatatttatgacctgtctccccagttagtatctaccctacttgagagtaagacttgtgtctaccttaatgacattgcaggtgctatgctcactacagtgcctgtctcaggaacaggttctcagttcaaatttgttcaatcaatcaataaagattaactaattaacgaatgaaccaatgaccttccaaagcactggctgggcttatccaggtcagccagaggccctaatccaagcaggactaaggtggtttgcactggatttcaacaatggtgaaacacgtttctccatcattgtaaaataacacattcctttggaaaaatacaaagaaacttgaagtattcaaacaatatccttgagccaacagcacgcctcaacatttcaaggcatatacacacatgcatacatacacacacacacacacacacacacacacacacactcaatttttggaggtgagggaggaaaagatggggaacaaaaacacacatttggtgagcctcatgcaattttttttttttttgagacagagtttcactcttgttgctcagactggagtgtaatggcctaatctcggctcactgcaacctccacctcccaggttcaagcaattctcctgcctcagcctcccaagtagctgggattacaggtgcatgccaacatgcccagcaaatttttgtatttttagtagagacagggtttcactatatgggccaggctggtctcgaactcttgacctcagatgatccacctgcctcagcctcccaaagtgctgggattacaggcatgagccaccatgcccagtctctttgctttttttagagatggggtctcactctgtcacccaggctgtagtgcaatggtgtgagcacagctcactgcagcctcaaactcctgggcaatcaagccatctgcctgcctcggcctcacaaagctctaggattacaggagtgagccactgtgcccagcctcataaaatttttaataaaaggcacatcattcactccagccgataattccccaacatattttggctaaaggctgtacgcagtggctcacgcctgtaatccaagcactttgggaggccaaggcggatggatcactaaggccaggagttcgagaccagactggccaacatggtgaaacctcgtctctacaaaaattagccaggcatggtggtccacgcctataatcccagctactcaggaggctgaggtaagagaattgcttgaactcaggaggtagaaggtgcagtgagccaagatcgcaccactgcactctaagcctgggcaatgaaggaagaccctgcctccagaaaaaaaaattttttttttttttggctaaaatcgaaggagtcccaaggtaggcctagatcacaacagagtgaacctagtagtgttcagaaaaggttagattatccgccacagaaataaaatgaacgtttcaaaatttaaaacacaggaatgtaaatggtcccagtaaataaaaagaagcccctaaaaatccttccactctgccagagcagagtaagaccaacaaggtcatatacccggcacacacgctctagctgttctttccctcctaattcccagtgatcttcttaaagcagctagcagaccttaccattgcattgagctgggagttgctggcctgcgtaatgccaagaatgttggtggtgtgcatcacttcaaccgaaaaactcggcagccagctcgcaatccgagaccctgaaacaaacaagaatccagtgtaagtttcagagccctgactctttcccccgtcatctgctctcacggtagccactgtaatggctggtgttcactgagggcttcttgtatggcaggcttctcatgccaagtgtttcacgtggactagctcatttaatcctcactacactccacatggtacctcctattatcattcttatagtatccttctcaaagatatagcactagtacccttggtctttggtctctgaggcacttagaagttaggggacttgtccaagatcacacagtttaactatgatggccaagatgtgaagccagacaggcaagctctagaacccttcactgctgagcaatcctgctttccaggggggctggatgcagcccagcccagcgccctcacacgctcagcctgggagatgaggaagcttttcaaggctctaaagcttctacaacacatgagctttggctcctctttcacaagctacacaaatgactactcacttggaggcattttcacatttacttttaggaagtattttttctttaatcttaaaagccgtggttttctgattcaaaattctttttaaattgttctattctacaaaaaggcttgtagactaacagcaccaagaagtctgctgcttctgttatttcccgaagaaaacaggagcctaagatacaacagcaccaagaattggctgtaaaacaacccaattatcaagctacacatttaaggctgcttttcattccttcacaaagaaacactgatgcatggaacagaaaatcaagtgtggccaggagcagtggctcacgcctgtaatccagcactttgggaggctaaggcgggcagatcacaaggtcaggagatcaagaccatcttagccaaaatggtgaaaccctgtctctactaaaaatacaaaaattagccaggcatgggggcacgtgcctgtaatcccagctacttgggaggctgaggcaggagaatcacttgaaccagggaatcagcggttgcattgagttgagatcacgccaccgcactccagcctggcaacagggcaagactccatctcaaaaaaaaaaaaaaaatcaagtggaatggctatctcaaaggtcttgagatgggtacaaacaaaacgtacccatttaagaaatggatacttatttcatgtactaactagggagaaataaagttgactttatctattttgactaaatttttagtagtcataattcacaaaataatggattacatagccaggtctcatctctaatattgctagtatatttcagaagttttacctggaagagcccttcattcacagccaccaaaccaggtcctctaaacccctctagcattctgggcccagccagccaagtagccccacctactcttctgggagacatgactctactccccctagtcccttctttgagggatttcaccaacacgacaccatccccactgtactccattcttgaaactcaaatcagggatgcgaatagcactactgctaacaaaattccagggatgcttgtgttacagtaataattataaacatgaactcacagaatttagcagtactggactgttgaaaatcaacagcagcttaatgtgaattaaggaaggatgatcaaccagaccttgatatgtcatagccttagaattttaagtgtggttttcattacaactccttttaacactgccgggaggcagaacatttatattttatggacaaagcaacagggttccagctctgattctgcttctggtactcaccagaaaggcttctcaatgatccttcattatatgcttaaatgctacacaaatgcaatatattattagcaaaggttaactattgagctaattaagtgtgctccttgaaggcatggttgattcagttttactcctccaccctcctgccccaccctgcccatattgacatggaatcaggcaaaatgcctggaacccctctgtttgttctatctctatccatccatccatccatcccacctaaacactttcaattaaaattgaaatacagtcaatgcgtagcttaacaacagggacacattctgagaaatgtgttgttaggtgatttcattgttgtgcgaacatcatagagtatatttacataaacctaaatggtatagcttactacacacctaggctatacgatatagtctattgttctaggctacaatcctgtacagcatgttactatactgaatgctgtagaggcaattataacacagtgctaagtatttgtgtatctaaacatatctaacagaaaacatacagtaaaaatatggtacacaaaaagtacacctgcatagggcacttaccaggaatgaagcttgcatgattaaggctgctctgggtgagtcagtgagtggtgaaatgtgaaggcctaggacattactgtgaactcctgcagactttataaacactgtacacttaggctacactaaattcatgacaaaatgtttctttctatattcaataaattaaatttagcttactataagttttttacttcataatcttaatttttttaactttttgactcttgtagtaacacttagcttaaaattcaaacaccctgtacagctgtcgaaaatattttcttttttattctataagagtttttctatttctaaaagttttaattttactttttaaatttttttggctaaaaactaagatacaaacacacgcattagcctaagcctacacaggtcaggagcatcagtatcactgtcgaccacctccacctcctgtcccactggaacgtcttcaggggcagtaacacgcatggagctgtcatctcctagaataacaataccttattttggaatacctcctgaaggacctgcctgaggctgctttacagtaaattttttttgtatgtaagtatgagtacactttaaaataatgataaaaactgtagtaaataccagactacaggaattttttaggtccattatcatcttatgggaccactgccatatatatggtttgccatggagtgaaatgtcgttatggggcacatgactgtataatattaaactggtctatacagggcaatttataactaaaatagtatctgcttaagggagaacaccccttaggtatagtttcagaggttgaaaccaactaaccatcgaaatggaagaagtgattgtgttggtttaagcgaggtctcccttcggctgctgctacaggaaccaaattctcatccaagttctctccttgatgttcttccctgacacgattattgtcggcaatattaagagacattctgcatgttggacaggaggtgtcttgttctagccaggaacgaagacaggagctaccaaaaagtccaaaagaagatacgtcagcatccttgattgttccttagcatactttgtgagaattcacccagaagtactctggatatatcaaatgtgctccaatttgattttctctctaccactagtgagatttaagtgttgagaagcatttatggactttacctacttgccctacttcactttaatacacttccagtgtgtcctgctgggaacatgaattctttaccatatgaagtcatctaccaagctcctcgttgtgacccctcttcaatggggcttcctagcatggctcaccatcttctcatccaactccatttggctacttcaaaatccatgtggctgaatcatccaacaccctggcctctcatgtccttgagtcctccactctgacgctcatgtctttcactctgctttagctaccaccagcacagtcatcaccttggcttgtcttcaaaatcttgatgtcaaaattctcactcattcactcaagctcctctccttccaactcacttatctggcaccaaacttactaagacctcccatctgctttctcctcaagcatgacagccgtacaggtccttacctccctgttcccctggctcacctctaacctctcctctccattcaccacctcaatgtcctccaccctcttctctttgcacgctgttttcccaacaaggccgaagcttcttttgccctctctcaggagatgataatgccttaattatggtagacattcaataaatacttgaggtgtccattaaagaaaggaaagggtactagagtaagaagcagaaaatgtgagatcagtcccaattctccctctaactagctgtgtgatccaggcaaacccttcaacctctattgactagtcctctccactaaagaatgaaatggctggatgaattaatctccaaggtccctcccattttatgagaatttgttatctttctctaagggctcaagtaggcactgaataaaaatgctgtatcttcttttaaatatctacgaacatgtgtagatataaagttataaaggaaaacctcaccataatatgataatcctcagagtctccagcaactaaatggtacataagtaacaggagtttcctagaggccaagatggagctacttcttaatcactctgtgtcataagagtgtgtgacagtcgtgttccaaaataatgtcatctgtctgtatgtgtatacccaactctcatattttgcaataattaaatacctataatttgtatgtgataatttagtcaaataaatgatttttttaagtccaattctcctactgacacctttaaatcacaccactagtataataaaattagccttgtgggagattataaaaatatgtaagatccttgccttccaataatgctacactgtgacatactttttataagcaaatctaaatttatttcacagagtgcaaaatcctcccacataaaatataacagcctaaaaactccaaggtgagtacaactagttagatatagttttctgtttaaaaaaaaaaaaaaatgctagagttccttaactgagagaaatcaaactttagagagaaaacagatctattcactggactctgaaatgttgcaaaaatatcctctacagcaacaaattatctagctattgtgcctgcaggaatatagacattacctttatcacaaattaaaatgaatttgccttagattctcagcacacaatcattccggaagttacaaagcaaagcaaaccaagagcatatcctaacaactatttgttcactcaacccgaggcagataagtgttttaaaattaaatcctaactcttaagcaaccactgagtaaagaagaaatcatgggttccaagatggccgaataggaacagctccagtctacagctcccagcatgagtgacgcagaagatgggtgatttctgcatttccaactgaggtaccaggttcatctcactggggcttgtcggacagtgggtgcagcgcaccgagcatgagccgaagcagggcaaggcatcgcctcacccgggaagcgcaaggggtcagggaattccccttcatagccaagcaaagctgtgacagactgcacctggaaaatcaggtcactcccaccctaatactgtgcttttccaatggtcttagcaaatggcacaccaggagattatatcctgcgtgtggctcggagggtcccatgcccacggctcggagggtcccatgcccacggagcctcgctcgttgctagcacagcagtgtgtgattgaactgcaaggtggcagcgaggctgggggaggggtgcccaccattgctgaggcttgagtaggtaaacaaagcagccgggaagctcgaactgagtggagcccaccgcacctcaaggaggcctgcctatagactccacctctgggggcagggcatagcagaacaaaaggcagcagaaacctctgcagacttaaatgtccctgtccgacagctttgaagagagtagtcgttctcccagcatggagtttgagatctgagaatggacagactgcctcctcaagtgggtccctgacccccgagtagcctaactgcgaggcaccccccagtaagggcagactgacacttcacacggcggggtacccctctgagacaaaacctccagaggaaccatcagacagcaacatttgctgttcagcaatattcactgttctgcagcctccactgctgatacccaggcaaacagggtctgaagtggacctccaggaaactccaacagacctgcagctgagggtcctgactgttaggaggaaaactaacaaacagaaaggacatccacaccaaaaccccatctgtacgtcaccatcatcaaagaccaaaggtagataaaaccacaaagatggggaaaaaccagaacagaaaaactgaaaattctaaaaatcagagtgcctctcctcctccaaaggaatgcagctcctcaccagcaacagaacaaagctggacagagaatgactttgacaagttgagagaagaaggcttcagacaatcaaacttctccaagctaaaggaggaagtttgaacccatcgcaaagaagttaaaaaccttgaaaaaagattagacgaatggctaactagaataaccaatgcagagaagtccttaaaggacctgacggagctgaaaaccatggcacgagaactacgtgacgaatgcacaagcttcagtagccaattccatcaactggaagaaagggtatcagtgattgaagatcaaatgaatgaaatgaagcaagaagagaagtttagagaaaaaggaataaaaagaagtgaacaaagcctccaagaaatatgggactatatggaaagaccaaatctatgtctgattggtgtacctgaaagtgacggggagaatggaatcaagttggaagacactctgcaggatattatccagaaggacttccccaacctaggaaggcaagccaacattcagattcaggaaatacagagaatgccacaaagatactcctcgagaagagcaactccaagacacataattgtcagattcaccaaaggtgaaatgaaggaaaaaatgttaagggcagcaagagagaaaggtcgggttacccacaaagggaagcccatcagactaacagctgatctctcagcagacactctacaagccagaagagagtgggggccaatattcaacattcttaaagaaaagaattttcaagccagaatttcatatccagccaaactaagcttcataagtgaaggagaaataaaatactttacagacaagcaaatgctgagagattttgtcaccaccaggtctgccctaagagctcctgaaggaagcactacacatggaaaagaacaaccggtaccagccactgcaaaaacatcccaaattgtaaagaccatcgaggctaggaagaaattgcatcaactaacgagcaaaataaccagctaacgtcataatgacaggatcaaattcacacataacaatattaaccttaaatgtaaatgggctaaatgctccaattaaaagacacagactggcaaattggatagtcaagacccatcagtgtgctgtattcaggaaacccatctgacgtgcagtgacacacataggctcaaaataaagggatggaggaagatctaccaagcaaatggaaaacaaaaaaaggcagagattgcaatcctagtctctgacaaaacagactttaaaccaacaatggtcaaaagagacaaagaaggccattacataatggtaaagggatcaattcaacaagaagagctaactatcctaaatatatatgcacccaatacaggagcacccagattcataaagcaagtccttagagacctacaaagagacttagactcccatacaataataatgggagactttaacaccccactgtcaacattagacagatcaacgagacagaaagttaacaaggatacccaggaattgaactcagctctgcacccagcagacctaatagacatctacagaactctccaccacaaatcaacagaatatacattcttctcaccaccacaccacacctattccaaaattgaccacatagttggaagtaaagcacttctcagcaaatgtaaaagaacagaaatcataacaaactgtctctcagaccacagtgcaatcaaactagatctcacgattaagaaactcactcaaaaccgctcaactacatggaaactgaacaacctgctcctgaatgactactgggtacataacaaaatgaaggcagaaataaagatgttctttgaaaccaacgagaacaaagacccaacataccagaatctctgggacacatttaaggcagtgtgtagagggaaatttatagcactaaatgctcacaagagaaagcaggaaaaatctaaaactgacaccctgacatcagaattaaaagaactagagaagcaagagcaaacacattcaaaagctaacagaaggcaagaaataactaagatcagagcagaactgaaggagatagagacacaaaaaacccttcaaaaaaatcagtgaagccaggagctggttttttcaaaagatcaacaaaattgatagactgctggccgggcgcagtggctcacgcctgtaatcccagcactttgggaggccgaggcaggtggatcatgaggtcaggagatcgagaccatcctggctaacaaggtgaaaccccgtctctactaaaaatacaaaaaattagccgggcgcggtggcgggcgcctgtagtcccagctactggggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaattgatagactgctagcaagactaataaagaagaaaagagagaagaatcaaacagatgcagtaaaaaatgataaaggggatatcaccaccgatcccacagaaatacaaactaccatcagagaatattataaacacctctatgcaaataaactagaaaatctagaagaaatggataaattcctcgacacatacaccctcccaagactaaaccaggaagaagttgaatctctgaatagaccaataacaggctctgaaattgaggcaataattaatagcttaccaaccaaaaaaagtccaagaccagacggattcacagccgaattctaccagaggtacaaggaggagctggtaccattccttctgaaactattccaatcaatagaaaaagagggaatcctccctaactcattttatgaggccagcatcatcctgataccaaagctgggcagagacacaacaaaaaaagagaattttagaccaatatccctgatgaacatcgatgcaaaaatcctcaataaaatactggcaaaccaaatgcagcagcacatcaaaaaccttatccgccatgatcaagctggcttcattcctgggatgcaatgctggttcaacatacgcaaatcaataaatgtaatccagcatataaacagaaccaaagacaaaaaccacatgattatctcaatagatgcagaaaaggccttctacaaaattcaacagcccttcattctaaaaactctcaataaattaggtattcatgggaagtatctaaaaataataagagctatttatgacaaacccacagccaacatcatactgaataggcaaaaactggaagcattccctttgaaaacgggcacaagacagggatgctctctctcaccactcctattcaacacagtgttggaatttctggccagggcaatcaggcaggagaaagaaataaagggtattcaattaggaaaagaggaagtcaaattgtccctgtttgcagatgacatgattgtatatttagaaaaccccatcgtctcagcccaaaatctccttaagctgatatgcaacttcagcaaagtctcaggacacaaaatcaatgtgcaaaaatcacaaacattcttatacaccaataacagacaaatagagagccaaatcatgagtgaactcccattcacaattgcttcaaagagaataaaatacctaggaatccaacttacaagggatgtgaaggacctctcttcaaggagaactacaaactaatgctcaacaaaataaaagaggacacaagcaaatggaagaacattccatggtcatggataggaagaatcaatatcgtgaaaatggccatactgcccaaggtaatttatagactcagtgccatccccatcaagctaccaatgattttcttcacagaattggaaaaaactactttaaagttcatatggaaccaaaagagagcctgcattgccaagtcaatcctaagccaaaagaacaaagctggaggcatcatgctacctgacttcaaactatactacaaggctacagtaaccaaagcagcatggtactggtaccaaaacagagatatagaccaatggaacagaacagagccctcagaaacaataccacacatctacagccatctgatctttgacaaacctgacaaaaacaagaaatggggaaaggatttcctatttaataaatggtgctgggaaaactggctagccatatgtagaaaactgaaactggatcccttccttacaccttacacaaaaattaattcaagatggattaaagacttaaacgttagacctaaaaccataaaaaccctagaagaaaacctaggcaataccattcaggacataggcatgggcaaggacttcatgtgtaaaacaccaaaagcaatggcaaccaaagccaaaattgacaaatgggatctaattaaactaaagagcttctgcacagcaaaagaaactactgtcagagtgaacaggcaacctacagaatgggagaaaatttttgcaatctactcatctgacaaaaggctaatatccagaatctacaaagaactcaaactaatttacaagaaaaaaacaaacaaccccatcaaaaagtgggcaaaggatatgaacagacacttctcaaaagacacatgaaacagccaacagacacatgaaaaatggtcatcatcgctgaccatcagagaaatgccaatcaaaaccacaatgagatatcatctcacaccagttagaatggcgatcattaaaaaggaaacaacaggtgctggagaggatgtggagaaataggaaaacttttacactgttggtgggactgtaaactagtttgaccattgtggaagacaatgtggcgattcctcagggatctagaactagaaataccatttgacccagccatcccattactgggtatatacccaaaggaatataaatcatgctgctataaagacacatgcacacgttatgtttattgtggcactactcacaatagcaaagacttggaaccaacccacatgtccaacaatgacagactggattaagaaaatgtggcacatatataccatggaataccatgcagtcataaaaaatgatgagttcatgtcctttgtagggacatggatgaagctggaaaccatcattctcagcaaactatcacaaggacaaaaagacacacaccacatgttctcactcataggtgggaagtgaacaatgagaacagctggacacaggaaggggaacatcacacaccagcacctgttgtggggttgggggagtggggagggatagcattaggagatatacctaatgtaaatgacgagttaatgggtgcagcacaccaacatggcacatgtatacatatgtaacaaacctgcacattgtgcacatgtaccctagaatttaaagtataataaatacatacatatattttatatataatcatttataatatataaatgtatcatttataatatataaatgtatcatttataatatataaatgtatcatttataatatataaatgtatcatttataatatataaatgtatcatttataatatataaatgtatcatttataatatataaatgtatcatttataatatataaatgtatcatttataatatataaatgtatcatttataatatataaatgtatcatttataatatataaatgtatcatttataatatataaatgtatcatttataatatataaatgtatcatttataatatataaatgtatcatttataatatataaatgtatcatttataatatataaatgtatcatttataatatataaatgtatcatttataatatataaatgtatcatttataatatataaatgtatcatttataatatataactctatcatttataatatataactctatcatttatatatataactctatcatttatatatataactctatcatttatatatataactctatcatttatatatgtaactgtatcatttatatatgtaactgtatcatttatatatgtaaatgtatcatttatatatataaatgtatcatttatatatatataaatgtatcatatatataatatatcattatatgatacactatgctgcactccaatattggagaagtgaatattttgaagggatatgtattttcaagggatatatatatctctacatatataaggatatagatatatatatcccttgaaatgtagagatatatgtgtatatacatatatacacctatacacatagatctctacatgtttctttgataatttaactgaaatttgctcttattttaaaaataaactatagtttacctgtaaatatacagatattaaaaaaaaaaatcacttgggaaatgagacactttgagacaaatgaaaacaaaaccacaacatatccaaacttatgagatgcagcggaagcaatgctcagaggccaatatgcagcagaaaatgcctaaaaagaagaaagctctcaaatcgaaaacctaactttatgcctatagaaccagaaaaatagcaaactaaacccaaagccaacagaggtatctagagtaattcatagagtcaaaaaaatagaatggtggttgccaagggctttgggaggagcagagagggacttgctatatactggagacaatttcagtttcataagacaaaaaagttctggagatagatggtgatgaaggctgtacaacaatgtgattgtacttcatgccaccagaccatatacttaaaaatgactaatggtaaattttatgttatattttaccagaataaaaaaaatatacttaagaattattactaaaaaaaaaaacaaaattcaccataataagaaaacacttcacacccacgagaatggctataataacaaaaatagaaaatgacaagtgttggcaagagtatgaagaaactagacccctcaggtattgttgggggaatatcaagtggtacagctgctgcaccactttggcgtttcctcaaaagttaaacatagaattatcatatgatccagaaattccactcctaggcatatacccaaaagaagtgagaacaagtcctcaaacagatacttcttacaagctcatgttcctagcagcattattcacaatagtcaaaatgtggaaacaacccaaatgtccaccaatggatgaatggataaactaattgtttaatttataaaattatttaaattcacccataaaaagtactgatacatgctacaacttgagtgacctcaaaaaatactaagtgaaagaggccagtcacaaaaagtcacatgttatatgattcctttatatgaaatgtccagaataggttaatccatagagacagaaagtggatcagtggttgccaggtgatggagaaggaaggaatggagagcacttacttagtgactatggggcactattgtggagtgataaaaaggttttgaaactagcgagaagggtggttgcacaacattgtgaacacattaacggcaactgaactgtacactttaaaatagttaaatgtatgttatctgaattttgcctcaaagaaattaaatcctaaaattaatctaaccatatgcttgaaaatattatttctgagctaaaatagagttattctgagttattcttcccaactagcctccaagctccttaggggctaactaattttgagaaatgtgtgcaaattccgtcttcccaacctcaacaaacagcaccactctccacccaactgcccaacctgcataactagagaaacgctggtacctctttcattcctcactttccctcggccggtctggcatcacacccttcctgatccctcaaatctgtcttctcactaactctacttctaccaccagagtccaagctacttttttgttttttagatggagtttcgttcttgttgcccaggctggagtacaatggcacgatctcagctcactgcaacctccacctcccaggttgaagcaattctcctacctcagcctcccaagtacctgggattacaggcacctgccactttgcccagctaatttttttgtatttttagtagaggtggggtttcaccttgttggtcaggctggtctcgaactcctgacctcgggtgatccacctgcctcagcatctcaaagtgctgggattacccctgaaccgctgcagccattactaaccaatccccctggatcttttcaagcagcaaatctaacccgccagtccttaacattcaatagcatctcaccactcccaaaggtcctccagaccctgcctatgtgtctcctgcctcagcagacacccctctcctttactctctgggatcggccacacagcttctcttttagtctcttccatttcttcctgctgcacagatgctccctctcaagtacctagtaccacgtgatccctcctttttgttgacttaactcctacttatcctcaagagtcacttccttcaagtttgagttggattttttcattacaagctctcaagaaccatgttcctttgctttaaagcacttatctcattgatactttaaaattcataaatatgcctggttcattcgcttttgactcctccattcgactgtaagctacaggaaagcaatgaccacagtggtcattttcattttatccccagagcctaacacagcactcagcacattaaaaaaaaaaaaaaaaaaaaatctgtcaacatatgtgttgagttaccgagactctagctcccatatgaaaaagaagaaaatctctttgagactataaaataaagaaaggaagattaaagatgcaaagatcagaactttcccaatatgcaaaattgaaaacacatgcaaaaggccaaaagatacctcaaggtccatcaacatcaaaacaccaaacctatacacacagtcatttacgtgagacagacagaaccccaatgacatctcagatctacttccatctggaaggattacagaagagactatttgtaatcctcgataacagacacagctcttctgtgctgtttagcggtcctggtctagtcccatctcaatccacttctctggtgtgctcttaaggcttcttttgggcatgtacaaaatgcaaaattatatattctctctcccagttagataataagctgtctgaaagcaaggactccccgctaatcctttcttttaaatcttacaggcatatttgctatacttcagagctaaaatggagaagaaatatgaagacagctaccatacccagaaactaagatggcaaactatgggtgggaaacagtcctatgatgtagggaagaggctaaggaacaaagaaggatacccaagagcttcccagaacactcagtgccagcagcaaggccaggctgaggtaatgtccccactcctccactaggatgagtctcgagcctgggtacacaaagcacacacacgccctggacagaacacctgtcccacatggcccttcacaaagctcctacttgtggaaaagatgtccacagggcagtttccgcgcagcctgcatggagtcccaacagatggcacagtcgtcattgttgacagccagctcctctggagttgcaactgcaaacctgtggaaacaaaacaagcccagcaggaacctcagtcagttccacacgcacactaaacaccacttgatagactgcgcctgtatcacaacacagttacagagaaagcatgttcagcaaaacattcttgataatcaaaaatataatttaccttcaaagccctttcaaaagtgagtaacttatgcacaggaactttgtctaaataatggttgctaggccgagcgcggtggcttatacctgtaatcccagcactttcggaggccgaggtagggggatcatgaggtcaggagttcaagaccagcctaaccaacatggtgaaaccccgtctctactaaaaatgcaaaaattagccgggcgtggtgacaggcgcctgcaatcccagctactcaggaggctgaggcaggagacttacttcaacctgggaggcggaggttgcagtgagctgagattgtgccactgcactccagcctgggtgagtgagactccatctccaaaataataataataataataataatggctgctgttagtgaagacctcggagaccatatccggacaaatcagaggagtaaggcccccagagatccaatctgtgtccctggccacaaagaagagatccaagctgtccccctgggtgcaaagaggatacccattaatcttgcacctccaggcgtggcttagccccagcttggcaaaaaagtgcctccttcaatgaggttaagtatgtgtgtgtaaacatgcatgtgcaaagaactgagacccactttcaggaaatgaacagggtagaagcccaatgaagtgtctatttgataataatgacaataaaatcatgacaaataagagcctaatactgagcactatctgcccagtaccattctaagtacatgaattatctcaccaaattctcccaatagttcaggcagaaggttctgttttcatccctaatttagaggtgaagtaaattgccccaaatcacacagcacctaagtggggattcacacccgggcagtctgactccagagcctttcctctccaccactctattagcagtttacaaacatacattctgacatactctgggatctgctgttattaaaaaactaaaatgagtaaacttaggcaacatcaacttgtgcttccttacctggcctccatgtttccaaccacacgtagatagttcttgtgccgacgaattcgacgttgcacctcatgaaacaggtaacgcagctgcataaagatgaccaggctggccatggataaccagatgttgccaaataacttagagagaaagagaataaaacacacggtaaaagcgaacgtgaacttgctagtgatgaaggcgcagtatgcagcggaagctcttcactgttggtgatggtgaactgcaatgtctttcagaaaggaaatacacagatttatctcattactctaaacaatgcacatcctcgtcagcctaggtgctccaatgccagtcatctttcctgagaaactcatcagaaatggaaaagctttatgcaaaaagatgtctatccatgcaattataaaacagaaaatatgaaaatgaacaaaatgcccagaagaacagttaggttgtaaactcatgtaatgtaaaattatatagtcattaatttcacttattatactatataactacatattactattatatttgtatatataacagttctgaaggtcaattatgggaagatagtactagataaatgaaaaaagcaagatataactatctttatcaaactaatacatgataaaaaatatgtaaaatgtgaaatagcaaacaaccaaatataatctaaataacccattgtgggatgcggtttattaaatcatggtacagctatctgatgatatttttatcctgaaagtattaaaatggcttagaagaactgatgttagcacaggaaaatgttcataatacattagtttttaaagaacagaactatatgtctaaaatatgatctcaatttatgaatgtatgtactcaaatacataaaaagaatcagttaaatacaaaatacataaaaatacaaaatacataaatacaaaaaatacataaaaagaagcagttaaatacaaaaaatacaagcatgaggaaaaaaaatttaaaaaaagaagataaaaaatcttaacagttatctttggccatttgtttgtcccctttttgaggggggagggaggctttttttttttttttgggacggagtgtcaccctgtcgcccaggatagagtacagtggcgcgatctcagctcactgcaacctccatttcccaggttcaagcaattctctgcctcagcctccccagtagctgggattacaggcatgagccaccgcgtccagccgaggctcttttttaaaaaaaagaattacatactttctttaaaaagtatgttttcaaagtttctttcaaaaagtagacttagaaatgtgccacgtctagcccaataattttaaaatgctacttgctaggcttataatttaaataaattgcccaccaactattttaattctcaccattattagatcactgaagggccaaccaatgaagcagatctacgacaccgtaacgtctaacataccaaagtaaaatgtaaacaatgatggtagtaggaatgtaggaattaagtgtaaagactttttttaattacaaagatggaaaatgtataaatctgtgaagtagctaacactgcaggaattcccattaccacctacaaagtacctgctaaatatttaaagccatagaaactatggggaaaggcagctccttaatttcatgctaaaagaataatctattgacttggtcagcagagttaactaagtctcccaggacagcaaacacctcctgagttaggcaccagccaaagcagttccatggcactgccttacacccagtggcaaaaagagggagggtttgcagccacattcatttttagtctttaagtagtccatccacatcttatttctaaagtttcattttttaatgaagaaaccattactgttcctgattctgaaaggcttgccctctgttagagctccttctgaggaaacttaccaacatgtgaatatggtgcatgaggtccagggacaggagagtgagctccatgacaaagtctgtgtaatagacatacgtcccctttccttcccacgtcccttcgtggttgaggtcccagaggtgaattacgtatctgtaatgaagagagaaaacaccttagtaatttactgttactactgaatttggtttaaccatgttgtaatttagtccgatttttatatatttcatacctgctacatcttaaaatcaactgtatgagtaggcctccatcacctccctccccaatttcactcaccgtaaaatcacatgagcagtcctcactgtcacaagaagagactataaaaaaggatattttctttttagtaaaatgtagcattgctcaggccaaactttttataaaatgataaaagacaaacatttctcagttcaattaaaaagcagattgttcaagtttacccattattttattttctctgcttcaaatttctgtaaaatatttttatgacctagaaacccaacttttattgaggaaaagtcctgttaataggtgacaaccaattacacctaccccccaggaatccccctacaatcttgaggtttaccctggtagtctgaccatcaattctatttcacacagcattaagtcactatcactgattacttagaagggtgatgctgtaactccaagtatagttcaggtactgctatcctagacacgaggacctgctctctccctagtgctttgtgcactccctttgtccaccagcagaaaaaagaacgaaagcaatcaaaagcaaaataaggccagccacatcacacctttaatcccagcactttgggagaccgaggcaggaggattgctcaagcttaggagttcaaaaccagcctgggcaacatggtgaaaccccatctctacaaaaaatacaaaaattaggtgggcatggtggcacgtgccagtagtcccagctacttgggaggcagaggtggaaggatggattgaacctgggaggtggaggctgcagtaagcagagatcgcaccacagcactccagcctgggtgagagagccagaccccagaccctgtcagaagggaaggggaaggggaagaagtggaaggggagaggggagaggggagagaggagaggagagaggagaggagagaggagaggggaggagaggagagggacaaaataagtctctcatggcttttttttttttttttgtagagacaaggtcttgctatgttggctaggctggtcttgaagggtattttttttattacagaaattgacggccaggtacagtggctcacacctgtaatcccagcactttgggaggtcgaggcaggccgactgcttgatctcaggagttcaagaccagcctggtaacatggcaaaaccccatctctacaaaaaaatcaaaaattagccaggcatggtggttcatgcctgtggtcccagctactaaggaaatgagaggatcacttgagcccacaaggtggaagttgcagtaagcaactgcactccagcccgggcaacagagtgacaccttgtctcaaaaaaaaaaaaaaaaaaaagatatttttcattaagaaaaaaagtcctcttaatctagtagaataaaactattacattatttatgttttagattaaattcccatttgtaagtgaaaaatattttacaggagagagaaacactatgaatgtaagaaatgatttagtttaaaatatcaaatctgtaatatgataaattatcttaaaagaataaacagtaacaagctaaaataaaagtatatactatagtatgagctgacgggcctaagttaaatgtgcttatttttaggtatacccttttcaaagtttggataatattatattagttgaaagttagagaatcaaaaaaaggcaaacataagtatcattctaactttgcaataaatctaaagcaaataagtcagtgtaaatggatttttcaacagattttctgtcaagacgaaatacggttgtatatttttcatatacagaagtattcacctaagattacatatcttattatttatattaggactattgtattttaattacaatattataatatgataattaacattatgtatttaaatgtttcttttctaattttacttacactactaaatgtactcaaaaatgaatgctatcaaacagaaataaactttaactctgctctaccaaattcccaatgagtagttcaaatgtagtgttttgatattagccaattagcttcagtttatctaatatctcattttttaattaataatactaattatgggtaagataaaagtattttgcctttggcctgaagaaaaggcaaatatagccattaaatataaggacatacaaacaatttttatttctttttttttttgagatggagtctcgctctgtcacccaggctggagtgcagtggcgcaatgtctgctcactgcaacctccgcctcccgggttcaagcaattctcctgcctcagcttcccaagcaggtgggactacagacgtgcgccaccacgcccaactaattttttttttgtatttttagtagagacagggtttcaccatattggccaggctggagaatttttatttctactgaacagaaattggtattttcagaaaggtttaaaagagtgaaaaatttttaaatcttaaaatattcatgaatagaccagatttttccttcaaaatgatgagtacagtttattcattattttgtaaaatctttataccctacgtaaagaaagagttacataaaataccacacaaaagcattcagtaccagtacccaacacacaaaaaggaactgaaatgcttgttaaaatgaaagaccaaatatccacctgtcatttcatgggtgaaaataacttgtcaaacatccagcttccttgaaaacagacagaaatacaatctgagcaagtcctgcatccagtatctcacctctgcagccatgaaagccaaggtgtgcattccgtgggtgtagccggtgatggagcagacggccgccagtccacagcaggaaagcagcatggcaaccaacagggacaggactcgaccgtggctgctcatcggcgtggtgggcgagaaggaaagctgaaatgcacacagtaggaaactgctcattcttcttcatggaagtgttaaacttcactgagaaattcaaggtcaatcttggcttctctgcttagggttctgtgctaagcacagaaaagcatcccattactatatggtcctattctccaataacccaaatatgagcatgaggtgatatttagagatccgtgtcatttaatttactgagtataacaatatgcattatattttcatcccttactctcaaagatcctcctagcactgggattataaacctctagaagcaatgttccgagggtatacaactctctcctctcaccttcaacaggactcaggacagtgcctgttctgttctgtttctttctcaatcttgctctagtcctcctctctgaaattggcattcctagtctattagggctagcacaattgaaatgcaatccaggcacaggtttaccactactacaacgtgatgtcagcattatgcaaggagaggcaacagtctgaaaagaaggcctagagctgcaactcctgaggtcacaggcggagattaaaaaaaacagtttgggaggttagaagctcctgtttgtgacttcaaatgagggttgaatgtgaaagaaataaaggctgtgagagtgagattaactcaaaccaaggtgcaaggtccatgtggactgggtaaagacagggaaaaacaaggccctggagcgggtttaactgaggggcagcactgtagatgcacatttatctgggactcatgagactacttcaggtcactaatgggttgaaggttcactcatacagctatgatctgaaaccaagtgacagatcttgtaccagacataaaatgattcacttcgcaaacaaggaagctgagggagctaattcagtcctggcccggggtggaaatagtataaactactcagaaagaagagctccacgaaccagagtaagctgggagagacagaaggagactagaacagaaaatatctagaaaagaccagattttattgtttatgtatcaaggtttccttgcactgtgaacaaaacagtctgcataggtgaagtgaccccatgttagcagtaagtaaacactatggggttgggaagaaagctccccaggagacaacgattctgcatctcttggctgctgtagaaagttcttcaagaaacaggcaatgggggcctgatctagaagtcttcccagaagagctaccctgaccatgcctgctgtggctcattcacattacacaattcaaagttggcaaacgtggtgactaagcaagcaaaaagcttggctaaaaactcacatattcaaatcgatccttgcagagctgaaccatcaggtgcagaaagacaagtccggcaaaccagaggcaccacatgaccacctcttccactgtctggacattcagcacaccaaagatgaaaatgaacttgtagaaaataaaattccaaaatttgtctttgagatgctaaaaaagaaaaatgtttatgaaggtgagtaccatcacacctaccccatttgagggaagttaccataacaaaagccggcttctatggaagatatattctgcacttggctttctaatacttgtcctcaagaaaacagaaaaaaaaaaaaaaaaaaaaaaagcagccatctgaagaatggaggtaagacacccagaaactaatctgtaaactttggactataaccctaaatcaattatggaatgttagctattcaaaggatagcgatattagtttagtaacttatatattaagaaataggccaggcgcagtggctcatatctgtaaccccagcacttttggaggctgaggtgggtagacagcttgagctcaagagtttgagatgagcctcggtaacatggggaaaccccatctctaccaaaaaaaaaaatacaaaaattagctgggaatggtggtgcacacctgtagtcccacctactcaggaggctaaggtgggaggattgcttgagcccaggaggtcaaggctacagtgagccatcatcatgccactgcactccagcctgggtgacagagcaagaccttctctcaaaaaaaagaaaaaaatgcttacatttttaatgcacaatgaaaaagaatggcaagggctatcatttttactacttctaccttccagattcttacacaatagaaaagattagactttgtaaaaaaaattcttcaaattaaaaaataacacaacacaaccacttgccagcccataataaaggcggcataaaaagtacaaagaaaatgaaaaatgctgccttaacatttttatgaattttcttgtcttttccctatgtacaaaacacattactttttgtacaatgctttctttcacctattgtattgttagaaccttaacaatgtcaatgaatattctctgaatataccaatataccgtttcaatggctaaagatggacactgaaactgttttaaaattttcaccacgcaaaaaaaacattataatgagggccgggcgtggtggctcatgcacgaaatcccagcattttgggtggccagggcaggcggatcacttgagcccaggagttcgagaccagcctgggtaacatggcaaaatcctgtctctactaaaaatacaaaaattagctgagcatggtggcacaagcctgtaatcccagctacttgggaggctgaggcattagaattgcttgaacctgggaggtcgaggttgcagggagccatgatcatgccactgcactccagcctgggcaacagagcaagactctgtctcaaaaaaaaaaaaaaattgtgatgaatatttttgtatgtatctttgtatgagttacttcagcactgtcaaatcaaaaattgcaaagatttttatggtttatagtaaaatctacctaacttccaaagcagtcctgtaagtgtacattcccatgggcagtgtgtatgcatatttgcttcactgtactcttttacacagagggcttccagttttaacaatcttcactaaccctgaaataggagagcaataaggagggtctagttcccccacatgttaaaatagactatcaagccgtctaggggggtcagggagaactgactgaagaggataagaatggaagcatgattctaagtatacttttttttttttttttaaagagacagagtctcactctgtcatcctggctggagtgcagtggcccagtagtagctcactgcagccccaaactcctgcgctcaagcgatcctcccacctcagccttctgagtagctgggattacaggcacatgacatcatgcccggctaatgttttttatatttatattttgcagagatggggcctccctctgttgctaaggctggtcgcaaactcctgggctcaagtgatcccaccttggtctcccaaaagaatgcttttatatgtaatttggaaccatgtaaatgtttcacaaattcaaaaaataaacacaaaaaagcaaaatatactacaaattaacaacgtgactccttaaagattttgagaacttaaacacactgtactctgaccagatatcttttgtagagaacaaaataaagtggaaaaaaatcatagagtatgccctaattctatccatcaaaagggcagagacaccctagtggtaatgagcacactcagccagtatacagcttggcttctaaatatcattgcccaataacgtgaactaggaatcgttggtgaaatgtctgtttccagacctggtgcagggaaagtacaaggtgaacttaggacattttgtgccctggttttgaatgacactgccacttggctctgccatttagtttctgtgtgaccttgggaaagtcacttaacatccctgtgctttagtttcctcatccatacaataggtcttataataacagcatatacctcatagaattgttgggggaattatacataatatatgtgaaatggttagacaagtgccatactaggcactaagcacttaaaaacgcatcaaaaagcttccttgctctaaacctccacttaacattttaatcattttagatattcgatgtctttgcctctagcattactctatttctagaactttaagcacccaagagcaaacccatgtcaatcctagagatttctaactcaaaatggttcctaattgatgctactggatgacattaaacataaataaaccaacacagaacagcagggaagatgcgatcgatgctgaaaaaaattaaagtggagctggataagaaatatgctcattataattacctctggatctagttaaaaaatctctaaaatactccaaggttatactttctataaatttcaacctgatagaagtaaccttttagggaaaagaaagtatataaagcccactggtgccagatcaatccaccaagcctgcctggcctgaccaatttctggtccacaaataaaaaatttgaagagaaacttgaagaagtatcaaaagaagcatttaagccagtagaagtggctcacacctataattccagcactttgggaggctgaggcgggcggactgcttgaactcaacagtttgagaccaacctgggcagcatggtgaaattccgtctctacaaacacctaaacaattagccaggtgtgacacatgcctgtagtctcaggtactcaggaggctgagatgggaggagactgcttgagcccaggaggttgagactgcagtgagtggagatcgcaccactgcactccagcctgggtgacagagcaagacgctgtctcaaaagaaaaaaaaaaaaaggcagcatttacaacctatctgggagacctctagagtcgatactggagaaagtgctgaaaatgaaaaatctctgagaatacaaaatagtcctgttcacaatggcatccaagggctcaaccaccaagtaatacatgtcagctctaaactaggacttcagctgattttataaaaggaaatttgggttgaaaagggtaggtaaggagagaatggaacactctgaacataaagtaaagctgctgttgtgcttttcatatagtaggttcctgtgttttatcactgggataagatagaataaaacacaattttgttcttatgttgtgattttgaaggccagttctaaatttttactttaaaacataccatgccaggcacagtggctcacgcctgtaatcccagcactttgggaggccaaggcaggcggatcacctgaggtcaggagtttgagaccagcccggccaacgtggcgaaatcctgtctctactaaaaatatataaattagctgtggtgcacacctgtattcccagctacttgggaggttgaagcaggacaagtgcttgaacccgggaggcagaggttgcagtgagctgagattgcgccactgcactgcagcctgggtgacagagcaagactccgactcaaaaaaaaaaaaaaaaattattctacaccctacccactcaaatcctcagcgaactgccaatctatacagtatgcttgtggcgtaattcttcattgaaagcatcccctgcccattctgagtcactttccaatgtcagacaatctcacccaaaacaagaacaaatctcctaattttatgcttttagaacaatgattcttaattcaccttcccacagagaaaattatcttggtaaattcttttggaaaagaacccacattctacagagtgacatttatgatcattcaaaataaaacaaatctaggcttctttaaaaacgacattcctaaaagtcatgaagaaaaacagctataaaaaacaatattgggacaacttggctacactgaatatggactgtggattagacaaagtattttttcaatgttaaatttcctaattttaatcactgtgctgtaaaaatgcctttgctcttagaaaatacaaactgaagtatttaggggtaaaggggtaatgatgtccacaacttactctcaaatgaatcagaaaaaaaagtatgtataaataaaaagtgaagattaaagcaaatggaacaaaatattaacaactggcgaatctggataaagggtatataggagttttctgtagtattcatggaacttttccacacatctgaaatcataatacaaagtttaaaaaaaaaaatctagtcacaagaatccatcctttcagtgtagacttacctgtctctcactcactcgaagagggccaaacacaatacactggatgagcttagccaccaacatcaaaacacagcaagcggtatttactagaacctgtaaacaaatcagagaaaggaagtttatttcttcctgctgaaaaataaaagcagctctaaaaatctcatattaggaattcagccatcatttccagtgactgagcctttctggttctctcccaatgcaagataaggaatatctgaaaaggcacactgttctggggagtgggtgttagggatgaggaccggaaagagaggcaccagctcaccagctaagtcacagttcttgtcccaatacgcaccctccagcaggccaccttatctttcatccttaactgaattgtgtgtatactttgtactgtatgtgcaaaactacattaacctcgtaaactgcaggtccttcccaagtacctcatttccgacattattttgacagccttgaagaaaactgttctagaaattgaagttaccgtgaatagtaaaacccagcacccagagattctgccctgccaaacaaataggaggtaggggtaggagtgtggatggtcacaaaaaagtctcatcataaggaactaataatataaatatatatatacagagagaatattttaatatttattggaatggaaaaatctttcaaccaaaagataaatgttctccatgcttggtgttggctttgaagtaaaggttttgtggcactgcagcagggtggaatgggttaaacagaaggaaaagaaaaccggcgagaggggccaagagatgaaaggcaacctggggataccaatgcaaaaccaaggccttcttcaacagtctatgagaaaacttgaaaaacaaaacaaaacaaaacaaaactctaaatgatgaatatccttacacctaaacgccaaatcttaatgcttacaaaatggaagagttggctgtccccaacccagagattagtgtggggtatcacattactctgaatgactccaaaaagccaaaaggaccttgataaaaacagtacagatgacttgttgagagcaaatgaaaaggaactccaattcaatgtaaagctgcttctgcctctgattcactacgtttaccatattacccttgccaagtcattcttccctctacttttaaaagcaaatgataattttaaagaagaaagaaaggggatagaggagagtaatttaagaaagcaagatccctgagatcacctcagggtctgtttagtacctcatgccatccctcctttgggagaacacttaagggcagccctgattcattacaaatgattaaatttagttctattctgtctgcctaatgggccaaggaagtatgtaatacatttttaaaggattgaaacgaaaatagttctgctaaagaaataaactgttttggtacttaaatccttcaaacaaccaggaacaaacgcccaaactagttgccccaaatatcctaatctgtgtaacagacctattcaaaatggtccagatcaccaggagcatggtggctcacacttgtaatcctggcactttgggagaccaaggtgggaggactgcttgaggccaggaatttgagaccagcctgggcaacacagcaaaaccttgcccctactgaaaaatatataaaattttttaaaaagaaaaaacaattcaggtaacttgaaatgttcatttttaaggtgatgaaatagatgctaaaaagactcaccttcattgtgatctaaccaatctcagccacattaactaagagaaatgtcataagacaaaaccacaacccctcatgtcacatcccccagccaaacatgccccagctttattacgacgcaatttcttaaaataattcttcccgtttttacatgtagtcagtcatatgaatttaaaaaataaatgcaacacatttagcacttgttcgaggcatgtgggaaatcagaaaaatgagggagctctgaaccctaaactcaaagagcttttagaatctacaagagatagagcatggtaagcaatttaacagaaggccaagcaggctactacgagagtaatgatggagaaaaaaaacaaatttagggtcacttaaacatttctctattcaaaacagtactgtcacacacatcttaagttatcaaataaaaaataaagtattatttactatttctcaaactctttaaataaaagtctatttatttattttttttctgacagtctcactctgttgcccaaactaaagcacaatggtgcaatctccgctcactgcaacctcggccttccaggttcaagctattctcctgtatcagcctcccaagtagctgggattacaggtgtgagctaccacactaatttttgaatttttttatagagacatggtttcaccatgctgcccaggctggtctcgaactcctgggctcaagtgatccgtctgcctcggcctcccaaagtactgggattacaggcatgagccactgcgcccagcctaaataagtctttgaattcaaataaggtataaaaaatgtgtatctttaatttatccaaaaaaaggtaaaagtctcttataatcccatcacccatagaacaaccacttcctattttaatttaaatgaagatttgaaaattaacatggctaaccaggaaaaaaaaaaaaaaagtctgagtatactgatactaaaaagggaatttatgtaaaaagtagataagctgttgtgaactttgtaaccaaagctacaaaggattgaaagcaatccttattttaagattataagcaaagttttttaaaacaccttaatgattattaataactattccatgtctatttatagaaaaataccttaattataatgattatatgttaattacaaatactgacctggcacagtatctcgcacctataatcccagcactttcggaggccaaggtggggggattgcttgaactcaggagttcaagaccagcctggccaacatagtgaaaccccatctccacaaaagatacaaaaattagccgggtggggtggtgtgcacctgtagtcccagctactgaggaggctgaggtgggaggatctcttgagcccaggaggtcaaggctgcagggaaccgtgattgcaccactgtactgctccagcctgagcaacatagtgaggccttgtctcaaataaataaataaataatattgtgtcatacatataacttctcaacttcagttaacaaaggcttgaaaaattgtaaatacaattgagcaaccctgatgcaaaaatccaaaatctgaaatgctccaaaatccaaaactttctgagcaccaacatggcgtcacaagtggaaaattccacacctgacctcatgtgacgagtcgcagtcaaaatgcagacttacaacagtttactcagtgtccctaagggaaaaatgaaactaccttcagggtatgtgtatgaatgagatgtatatgaaacagaggaatttcatgtttacatttgggtcccatccccaaaatatttcattatgtatatgcaaatattccaaaatccaggaaaaaaatcccaaatccaaaacttcgggtcccaagcattttggataaagtattctcaacctatactgaaagaaacataactggagcattcctcatttaaaagcactggctcatgtctataatcccagtactttggaaggccaaggtgggtgagttgcttgagtccaggggttcgagaccagactgagcaacatggcaaaaccccatctctactaaaaacacaacaaatgtagccaggcatggtggtgtgtgcctgtagtcccagctacttgggaggctaaggtgggagaatcaccctagacacagggaggttgaggctgcaataagcccaaatagcatcactgtactctagcctgggcaatcggagtgagactctgattcaaaaaaaaaaaaaaaaactgcttaaaaaaagtaaactaaaataaaataaatccctgaatcaggcacagtggaacatgcctgtaatcccagcactttgggaggctgacgagggagaatcacgacgtcaggagttcaagaccagcctgaccaacatggtgcaaccccatctctactaaaaatacaaaaattagccaggggtggtagtgctctcctgtaatcccagctagtcaggaggctgaagcaggagaatcgcttgaacccgggaggcgtaggttgcagtgagccgagatcatgccactgcactccagcctaggtgacagagtgagactccatctcaaaaaaaaacaaaaaacaaaaaaacgccaggcgcactggctcacacctgtaatcccagcactttgggaggccgaggcgggcggatcacgaggtcaggagatcgagaccatcctggttaactcagtcaaactccatctctactaaaaatacaaaaaattatccgggcacatggtgggcgcctgtagtcccagctattcaggaggctgaggcaggagaatggagtgaacctgggaggcggagcttgcagtgaaccgagatcgcgccactgcactccagcctgggcaacagagcgagactccgtctcaaaaaaaaaaaggaaatatgtgcacacacgtttgtataatatgtaggtgtgaactgtcaaggacttgatcaatttgggtatttcttagtctcctacttaacaacagtacttattacaagaatttgataattgccatttctggaagagagaagcaggtaacagggagagagagagatctacttttcactgcatgtcacttctgtatcccttaacttttttttttttttttaattttagacagagtctcactctgtcgcccgggctggactgcagcggcgcattcttggctcactgcaacttccacctcccaggttcaagcgattctcctgcctcagcttcccaagtagctgagattacaggcacctgccaccatgcctggctaatttttgtatttttagtagagacgggtttcaccatgttggtcaggctggtctcaatctcctgacctcaggtgatcctcccacctcggcctcccaaagtgctgagattacaggtgtgagccaccatgccaggcctgtaccccttaacttttgtaccctgagcatgcattatctattttttaaaatttttttaaagtttagaatctactaaactaacctgactagttctgcaattccacattatttttctcaccatatgatgacaaactgatgagtaacaaaccaaaacaagttctcctgttacagcacagtatttcaactatggccaggcgtggtggctcatgcctgtaatctcagcactttgggaggccaaggttagtggatcacctgaggtcagcagttcaagaccagcctggccaacatggtgaaatcccgtgtctactaaaaatacaaaaaattagctgggcatggtggtgcacacctgtaatctcagctacttgggtggctgaggcaggagaattgcttgaacccaggaggcggagattgcagtgagccgagattgtgccattgcactccagcctgggcgacagagaaagactctgactcaaaaaaaaaaaaattcaactatattaaaacacttcagaatgtttctcatagctatagtgctgtcaaagcttcaagtcattttttaaaaactcaccaaatgccttttttttccagtctacacaaaataaaaacaagttttacttgtccccgttcagagtgtagcaggtcaggcagcagtgatcccagcaaccctgacttactcaaggctcaaagttaattcccttcactccaaggcccagcaggaaaatgtcccttccagaatggttctactcttctactggagaaaacagaaactaaattataaaatagttaggcctgcctgggagaaaaagagaggaaggtgcatttatcaccatgtaaccctacaggtgtttttgaccctgtaaaatgttggccaccaacaggtgcttatttatgaccttgcaaagacatgggattaaactactaggaacctattccaagacatggtcaatctggatatttcttagactcctgcctacaccagcaccactcccctgcgccccctaccatttggtggtttcctccctttaaggacaattcacgtattgttacctctctgcaggctcccagaaacaaacacataatacaaacatgcacacactccccttcatcacatagatgataactgtgttccttctttaacaagactagggaaatagacgagagtccgcacgcaaagcatacctaggaggtgatcaaatagcagtccccttctccctcacctggaagacattccttttatttttaatttatctaggctcacatccaattattcacaagtttagtcttttttccttcagctgccccaacatttctggagctaacatttttccctcatataccttgaaatagtcaactcataaagactaaaacctaggaagtcactttcagctcttaattttgttttgttttttttttttgagaccagagtctcactctggcccaaactgcagtgcagtggcacaatcatagctcactgtaaccttgagcttctgggttcaagcaatcctcctgcctcagcctcccaagcagctaggactacagcacaggccactacacttaatttgcataattaagtcagaaccttgacagtagtttcatatttctatttctccatttacatgtcttgctcttagaattttagaagcaggtattttatatctttaaagggttgtaaaacaaattaaataaggaagttgcagagcctaaaatattcaccatctgagagcactttagagaaaaattggctgactcttattttaaaaagcctattttcacataattataatggtgactaattttttttttttttttggtagagcagggggtctcactatgttgcccagactcctgggcagctcctggcctcaagcaatcctccacctcctgcctcagcctccgcctctcaaactgctgagactgccggtgtgaaccactgaacccagcccttaagttttataataatacgaaaatcggctctttaaaataggattcagccaatttttctctaaagtgctctcagatagtgaatattttaggctctgcaacttccttaatttatttaatttgttttacaaccctttaaaaatataaaaaccattcttagctgttaagacaaaaacaggcctagtcaaataggtcacgagtttgccaatccctgttctaaatggtcaattcacttttatccacttttgtttgtggtcatttttccccttgagagttctatttaaatgatattatttgcataattaagtcagaaccttgacattagtttcatatttctatttctccattcacgtatcttgctcttagaattttagaagcagatatttaagaaagcagaaaagggaactaataaaagtaatgagtaagaattaaaaaatgaaaaagccaaaacacctgaacaatccaaaaccatgctagaatggaccaagaggtagctgaatggaagcattatctgagcaatgtaaaatagcccagaaatgagtaacaaaataaaaactcatctgaaatgaaactttaggatggaagttttagaaagacaaggagaaacaaattctcaggtcaaacccacatatttgttagtgtaaaaaccctgaagtctcctcccaaatcctttctcaatgtcatgcctgagggccacctggagaggcccccttgggaggaggaagttttaggtcactagatctcccgtcctcttcccactctacataaatctatcttccacactgctcccaatcttctaaaagaaatcatgccagcacccccactcctccatgccccacccccacttaagccccatcaatggcttctctcactccacaaaatactgtccacacttggtagagcaagcaaggtcaaggttacatgacatcacactctagcctcttcctaggtcagtttttcaaccactagtgttcctcaaatcacctagggcattcattaaaatgaagattccaaggctccacccttctctctgaaatggatccccagggaaactacattttacaagtaccccagatgaccacataccaggatgccagaggtccacattttgagaaagaaaccttcaagggggttgctcacctcctcctctcacagcagagccacctgccccacctccttcacctcctccccacctccttcacccccggtctcctcttcaccttctcaacctccctcttaaatcagaagattcaacagacttttaatttaacagcccagcttccggaccaccctgcctgtgcctagcactgtcctccccacgccagaccgagctccacatgctggtttctctatctggaatacccattgctactggttgagacccttcccaccttccaagctggttcaaacaccaccttccatgaacccttccctgggcacaattcctttctttttcctccaaactctgcttcattttatttatctattatcccctataaaattttgccatattactgagggtaggggaaagtgttgttcacagatatgccctccaaagtgcccaaaataacaccttcgaaaggttttaaattgtgtttgttcatgaaaaacctcctgtgatgctatcagaccgatattattctaaactgtgctctaaaaagataagttttgggaattacaatatgttaatatctagcaggacttgcactggcagaaggatcagtctttgttttgtcttgcttggccttggcaggcagtgttcgtgaaaaagttgaatctgaattcaatagaactaggggagggcgcaaggaggatccagttgacaaaggcaccaccacatagggtattcactcaacaatcttaatctgtcccaccactggggaaggcttttgagattgtcacttctactcagctgctaaagcagaaactacatatacactgagtgatgagacaaacagtgagcacatggagggtctgagaaaccaaagcaggccaaagtaaacacgtggagaccccagaggaaagatggaagaaaaacagcactaggatcaactgagaaatgaaaatatcatcagcggagagtaagaagtgataaacctgccagaggtaagacctctactgaaaatgctggaagaaaaggaaatttcctaaaaagtaatcatcatcacagaaaaatcaacagcttttatgtaatgttttctgaagagatattaactttagaatctgaacatggcttttatcaaaataaagtcctgcggggggaaatccattaaacaataccagtgttgttatataaataaaataagggttccttctcaaaggcttatttatatcttagacttaaaaaatatcaaagactacattataatcttaacatggcaaaaacactctccatatcactttgtttacctgctaactcaaatgcaaaaacagatttgaaattaagcaagagatgtgagttgagttctttcgcttctcccttctttaggactgtaaagttcagctttacacagcagtagataaacaggaacttcacccttcactgccttctactaaactctccatcagaaggaccaggagacttaatctacagcccacagagtccataaatcccaccgcttcctgatgaagcacagtgggactaattataacaaatgagttgcatatcatactatcaacttggaatattaatctctcagtcatttacagcccactttcaaccccaaatgggaacatgcaaggagacaagatccaagaagccatattaaatccaagtgaggctttaaatcctggagaaacttttctgatcactgcgggatttacataagtattcaaggccaagatgaaagcaaaattctctagccaaaataccgttgatctgatcagtctgaaattatctgttctaatgaacgaaaccagcatgtgtgccttatcaatgctgcttatctcgcaggggcagacaacctggaaactgtgttagaatagatcctcaaataagaaacattcagttaaaatgatgggctgcctcttgacactgtgaatgttttgctgcgttcagacatcaaaggaaaactgtcatgaacatcaggtaaaggcagcagaaaaggaagcacagtttggtgtttgtttcattacacagctcccaaaggggacaatcgaatactaagcggcaaaaaagttgtgggagacggcctctctccaaccggaatgtccaaagacacctgagtgccgaaaattcccccatactcaacgtctgaattctcccctctgccctctcctcttcgtcggaagaaaatccgctaacaatcccatgcctgaccaagtgggaaaagctttcaacttcactctacttcgtccaaccctcgggataacgcactcccagatcccgacctccccttgaacctgccctctgagatcttctagtttctcccgagggtccctcagaaaacccagcccgttcctccccactgccccttaaccccttcccctgccccaggccccgtccgcgccccagcgcagaccatcacccgccgcctccccgacccccttcccggagccctcaacgctggcctgcccctcggggcctcctcctcgcaaccccacgcgatgttcctcccgcccgcggccccctccccctccccgcgcctcaccactctccctcagcagcgctcccgcgagcaaggccgcgccccccaggcgctcgccctcgggggtccctggcggaggggcccctaggcccaccacgcccccgcggataaagggtgacgcagcggaccccgcccctgccccgcgggcccggccgcctcgctcacccacacgaagaggctgtctgagagcaggtactgggccacatcgcgggcccggggtcccccggcgctcggccgggcgggcgccggcggctcaggctgcagcgaggccgttagctggtccggctcgccggggccggcctcgggctggctgagcgcgcggtaggcgctgatgatggtgcccagcagggccaggccgctgaggcccgtgtaggtgcggaggctgggccaggggaagcgctcgaggaagagcagcggcatggcggcagcggcgacctctggcccccaggcttccctgcgctgcggccgggcctctgcggcggcctcgcgaacggcgcccacgggctctggcgtcgctgccgctgccgctgccgccgccgccgccgcgccgggccgggccgggccgctcctggctgctggcgccgctccgccccgcgctgctcccgctgctgcccctgccggcgcggaagagcctgggcgggctcgggacaggccgccgcccccagcgggacgctggcgggacgggcgcaggggcgcggccttcgtcccccgcccccagcggtcgcgccgccgcctagcgggcgtagccccgggcctcaggccggggggcgggcacccagcatcatccgccgtccgcaccacggcttggctgggcccgcagacacagagggcacctgctccggccgcggcgcaggggtcactcgggctcgcaggcgctggcaggcgggcagggcctcagggcgcggggcaccctggccaccaggccgtcggccacttgccccccccccaccccattaaccctctgaagaggttacccccagcactcctaggggccgcgcagcttccctggtgcccgaaaccccagaagaaagaatattaacagtctttcaagtttctgctgtttgctagtagcctccagcagaaactaaaaaatgaacctgatttagcgggaaataaaaatgtgttccctcataccccagaagtgagaatgtcaaatggtgcagctgtcttggaaaataacctgtcctttccttaaagtcaaacaagagtgaccatttgacccagtaattccactcctctaagaaaagtggaaacatacctccacacaaaacttgtacacaaatgttgattacattctaacaatcaaaagatgggaacaacgctaatgtccgtcaagcgatgagtggataaatgtgatacatccataaaatgtactattcggccataaaaatgaactactgatacatgctacaataggaacgaaccttaaacacgtgctaagtcaaagaagacagccacaaaggtccacgtgttgtgtgattccattgatatgaaatgtccacaataggcaagtacatatacagacacagaaagttgattaatgattgcttagggatgggaggaagaggggagtagggggtgataaagggtgcaggtttcttttaagagacagggtctgtggcccaggctagagtacagtggcatgctcactgcatcctccatctcctggactcaagaaatcttcctgcttcagtctctccagtagctgggattacaggcgtatgccaccacacctggctaatttttaatttttggtagagacagcgtcttgctatgttgtccagaccagtctgtggctcctgagctcaagtgatcctcccaccttgccttcacaaagtgcagggattacaggcgtgagtcactggctgggataggtttgttttcaaagtaatgaaaatgtaaaattgaggtgatgattgcccaactctgaattgaaaaatcattgtacactttaaatagttctatctcaatatgcgaattgtatctcaataagctgttaccaaaggaaaaaaatgttaccttgggagttttattccttttgcatccccagggcctgtaagagttctcagcccagagtaggtgctctgtaaatatttgtaggattttccaaactttctaaagaaaaggaccaaattatctttcaaggtctttttcatgcctaatattctaaaagtctattaactagaaaacaaaagatctctcaagcttacaattccactttggaaattttagaaacatcttgttaaagggtctttgatgaacgtttggctttaccgggacagggagaggccttacctttgcacacgtgcatttttttaatacaaggtctatatgaatactagacttgaattcactttggttctcttcccacagccatgcaattaaaatgctaaactttaaactttatcagtaaaataaaggaaagctttattttgaaaaactattgtaattttccagggaagtgttctactttacaggtcaagatctgagccaccataacttttaaaccactgactggcaatctttattcaatcctagccacagtagttctaaactgtcacaaaccaaatttgtcccatcacccttagaaacaggctgctgttaacagatctgcccttattaaacttttagaagcttgaaccttctgaaacttcacatgaatgggggaagttaacccaaaagaacgtaaatcgtttgtgtttggatcttttactagaattagtaatttttctaccattactttttcctttcccactccaagacacactccaagaaggtactttgcacaccgttgttctcaaggaaggacattttggcaataaccaaacaagccttcttaaccaatacttctagttcttggtaactgcatcttactccatgagaggactgggaaggaggcaggacccaaaagggatgaatgcttaatgtgcctggggagactagatcaacatacgggctacctgtcagctgtgtcccaagccccaagtgtggcagacagatgacagcatcagactttgagaggctggtcctgcttggacaagaatcaatagagtccatgatgaaagctagaggtcccccgtcaccacaaccttgatttcagaataacactatgccttccagatttgagacttcaaataggtccttcatttccattatgactgatagacttaatttcctgccgtctttgtgggatggtggttctgacttggtttgatttaaagggaataaaataattacttcagacaaatcagtttgtgtggagtaagattcatacctagatacaatgctattttcatttttaaaatatctgaagtcctttcatattcatgacctcattcaccatcatgtgagacgggttgggtggctttgttgttgcttaagattctcagaatcctagaagctgaacttcactatctaatccagtagctttaaatgtattcccatggcatgctagtgtttcatcagctggacccatgttccacagctaaatctagcagagagaaaaataaccaactcttcaagtttttagaggaaaaactaaactaatggatatatttccatttgtagcttttctttcatatttatttttcatagatctttggtgcctgctataaaatacacaagtagtaaagttttcagaaaaaacctttcaatttctatcaggtttcattcacacttctgttcagatataaaggctgaaaaggctatagttttatcagacacacatatattcccgtattttgggtaaactttctatttaagataacattgaattacacagtattacatatgcagcaggtatggtgtgtgtcatagaacattatgaattccaggcaagtttgagaaaaaaaactaaaggagtcaaccctccctttacagatgaggaaactcggactcagtccccaatgatatggactacacacagttaacacaactgtgtagcaacttctaacttgtggccttcatgttccaaatctagtgaccctttcacacctcaggaaactgaaacactgctaacacacaatgggaggagggagtgtgtggggcacaaggagagggcaacatcagtgacccaggccatcaggcccttgctattatgctaagctgtctcttacctaaaggccctcggccactcacagtgacgaaccatgcaagatttctactagcacagtaggatcagcagccacacatacaggactactatcccaaaacaatcacagagtcattctctttcaaatattttttattgaaatgacaataaaataaaaaaagaacagtgatcactttaaccaaacttactttacaaatataaaaatataaccaaaacttgtttcttttatacatttgccataaacgtaataccagaaaagttctcaaaaccaaactataaatgatgcttgaatactatgatgtgaacacaataaccaaaagtttaaatttctaaatacatgacctttccctcaacagaacagcataatcaatatatcttcccaacttatctctatttttacgatatgatccattactaagatacaaaatacacctgaactggcctaatctagagttacctaggttttagtaagtttttttccacaaaaacaagcttaataactataatacaagctaatattaaaatgtgttttatggctcaaatcaaattacagtattaggtttctcatcacgatttgaacaaaagcaaactgcttgaaatgagtccagtttaacccaaataatcagtgatgtataacaagtgaagtaagtatgggaaaatcaaatcttatgctacagaaagctgacttatactacagtcaacaaccactaagccttctttggcaatgaaacatacaaaattgcaaactctgatgcagtctcagtgattggcatatactgttccaaacactatgaactagtaaaaacattaagtttgaggatggaaaagctaccccaagcatttcatctcaagtgactgaacaagtactgtaaaaataaagtcattaaaaagccgagaacataagagcacaacatttaagaaagggaattttaagccgattgcttgctggcctgttgaatttgaagtacttctacctctcacttctaattaaacatggaagaaaacagactggctaatttggtcacactttgtccaaatacagtgttaacttaatggaacccttaaatatccaaaataataagtgaatgctatttataagacaataaaaagttttaaaatcttccaaatgtgctgttaacagtacaaattcaagtgcagaattattacgccattttaagtattatctacttttttaaaaaatcacagtggtcttcatcacatggcgaaaaaacaaacttcactcttctccaaagggataagtccatcctaaatgtaactacaaacaattgtataaacctttatagtttttccccctaatctactaaacatattccagtgtcatttagtagttttacatagaatctgcactatacttggatactcagggaaaataagatgacatatattgtagttttagaacgcaaaagagctttcattttagacaaatatacaacatagaagccactaaaaaatatgggtctattaatcaagagcccatttcaaaatgataagagcatttagtatgtagatctggaatgcacagtttctggaagtattagaacttagtgttaaacagtgcccttataccctcttctaatactgtagacacctaccaaccagatttgatttcccctaattctattatttccatcagaaaaccaaaaacagattattggggatccacctgtaactgaccagagcaaaaagtttttaagacttccgtttgtgtgttgcaacttttacattcaaaaccagatctcttacatttcaaggttagtaacccagccatcctgaatcaaaggtttttctcaactaggccttagtgtatggatgactggctcacgtacttactgtatattgggaagaagtgaagaagtgagaagtgaagaatttcttggtcaaagtttaagttacaaagaacatgagtggcctcgaatcagatgactcttcaactcaaacactccttactgagagtactttataaaacacacaacaaaagtctacctctctccaccctccacaaattgcaaaagtgaacatctgaaatgtggccactgtagcttttccctcaaaagcaatcatggaaggtgagctgaatcaatccatcttcatatccacttcctccaatctaaaggaatagctgaaggacgcagctaatggatgagcttaccagcaaaatacattacatgagaaatatgctaatgtaggctagaggggtaggactgttaggggcaggagggaaaaggacaattcacagaactagtggctttttcaaaggaaactggggcatttttgatcatggagactggtgctcacctaccatgaaggacatgcacagttagtcactacttaaccaccatgtgagggtttgacatgaccccaactaaaaaaacttgagtgtttattaattgctcagctacacttggcctgatttcctcaagtatcatatacctttgacatcacccaatattcaggaaaatagccctgtgactggcaccatactaatcaaaagttcatttctattaaaaacccttttttccttaagtagctacatctggcaagattcctttttacattaagcctatagtcaacaagtctgtaataaggcatacatgctatactttgatcattaaataatgacacaaccagcaaactcctttgctctaatattttttattcccccaaatttgatccgaatttatcagtattttttaaagtttttaaaatttcgtttttctcttaacctgagaaaacctgtcctctgccttgcccccagttttcggttgattcacattattccaaaaatatttttgaaggctctgtcatttgctaaaaccaaattttcttctctatgtacacaacttcaagttaattgaatatttgtgcaatctcagagttcaaaacctaatacatccaattttagaaatttccttcacagatccctatttttaccatggctttaagaataagacacataatttcgcaacagcacaaataattaatacccccattatgtgaagaaaactctgagctctaaatgagtctcttcttataccaattcctatgactactgatcgagccaattttaatagtttcctgtatgtttaaggtctgttgcttgcaaaccaaggcctggatggttataaaatgtactggtcagtgaattatactgggagttctctgcaacacaattcatttaggagttgcaccttggactcactcagataaatatagttttcagaagtaatggaagctcttcatcacaaaaatctaatacaatcttggagtatgtgcccaagaatggtatcaaagcaagggtccaataaacttgactgacttaaacctgtcattgtgttgcaacattcaccatcctaaggtggggggaaaaatgatcctcacctataagaattttagaagtttaatgagaaattaaaataaaaaaagtccattttctttaatgttgtacaaaaaagtatgagcagaaccgaaagtaaataaacattatcacatttgtttacaccactatctagttcttcatattaattttactattcaaacaatagaaaggtggcaatttagggatcgcaaaagagataaaaccaaaaaaacttttctaccacatttattctacactgtatatagctgtgctcacagagacaagcggcttcttttacttctccactgcgcaggaattcagttgtaaataaaattgaacctgaattttaaaaagaacaatacctttattaaagacagtacatactactttccatattagataaataaatttatctggatgtttctgccctcccttagcatgtctggcattttctttttttccccttcgaatgcctttttaccacgtttggcattttctacaccaattttccctcactggtcacatcttacacactaaaaacacttgttgaatacttataataaaaaaaattaagactataaatttgattaattatccactaataagttctttaaggcaggaaaagtttctacatgtccttatactctgactactcagcacagttcctgcacttgacaagtaggtgtttgaataaataatatgactcttttccccccatatgcatttcaacttgtaacctatcaggaggccaaagtggagtggcaaaagataaggtttgattagtgacgaagtagaaagagcaatttcatactcaataagctttcacaaaaggccaatttcactaacatttattaagtatgtaccagattactggcactgttgtaagcattttatatgcattatttcacttggtcctcataatcctctgaagtagagactactatccccatttacagaagaagaaacagtcaaataggtataatagtttgttcaaggtcacactgccagcaagtactgaggttgggcttcaaatccaaaacactgactgcagaatctactttcataaccaccatgttattctgcaattcctatatatggctggctctaatagagacctcaaccagtacaagtcaacttttaaaaaactgcatttcttatcactctaactgcctaaagattcaaaccccacgtaaaagttcaggacctaatcccacaagcctcaatttgggccaaaatatagtaagtttcaaaaaaggaaaacgaatatattacaccaagatattcgatttgccaccttttttttcttttttttagatggagtctcactctgtcgcccaggctggagtgcagtagcgtgatctcagttcattgcaacctctgcctcccgggttcaagcaattctctgcctcagcctcccaagtagctgggattaaaagcgctggccaccacgcctcactaatttttgtatttttagtagagatggggtttcaccatcttggccagactggtctcgaactcctgacctggtgatacacccccgcctcagcctcccaaagtgctgggattacaggcatgagccactacatccagccaatttgccacattttaatacagacaactccgctcatatttacacactgttgactgctatttaaccatctcttttttgaataaagacatcaaccttaactcttgagaatatcagaattagggaagagcagttgcacaaataccagaatgtcatgccgaaacttaagagtctggggatggtattagtcacaattaatctatggcttgcacatgatctaagagtctatctactttcttagtttccttaaagaccaaaattcatgaactataccttcccaagtggctcagaatattttaaatttgacagttaatatggatgaaccaaaaaatgttcaactttctgtacctgctcaacagctgagggagactagaaatgatgggtccatatcctggtgcattgtcatacaattcaaacaatggtgcagctaccagcttgtaatttttagggactgcaaacaaggctaaaataaaacagaattcattattataagttattatataatcactgcttccatttcatttttaaattaccaattttacatttaataaaaagtgtaagaaaaaagataattctcattaatacattttggttgtgtctttcaaggtagatttcctagccacagatttgaaactaaaagcatggtatacatctttagttttacaacaaacccaaaagttcaaggaactttgagaaaacacaaatagaggtatccttgaaattattctacagaatttttagatggctacctttgaaaacaaaataacttacctttttcttgaagctgaaccagaaacaacttcttatgttccttaggctttgtaatatgtgcaggaatatatggatactgaaattacaaatgaatacaactttaatatgtattccatggcttcatttctttacatgtttactccccagtatagtataaactgttgggagaagcatactactttctgtcctctttaccaggacttatctaacagatacactagtaaataaatgctttaatgcatataaaataacaagcagtaaaccagtcaaccattcgagataaaatatgtagtcacaggatttatagcttgagatacttaaaacataatgaagtccgattttaattagtatctttaataaaagcttttttttgtttgtttgttttttaagacagagttttgctcttgttgcctaggctggagtgcaatggcgcaatctcggctcaccacaacctctgcctcccaggttcaagtgattctcctgcctcagcctcctgagtagctgagattacaggcatgcgccaccatgcctggctaattttgtatttttagtagaggcagggtttctccaggctagtcttgaactcccgacctcaggtgatccacctgctctggcctcccaaagtgctgggattacaggcatcagccaccatgcccagcctaaaagctggttttttaaaaatatatatataggctgggcacagtggctcacgcctgtaatcgcagcactttgggaggccaaggcaggcggatcatgaggtcaggagatcaagaccatcctggctagcacagtgaaatcccgtctctactaaaaatacaaaaaattagccaggcgtggtggcgggcgcctgtagtcccagctactcgggaggctgaggcaggagaatggcgtgaacctgggaggcagagcttgcagtgagccgagactatgccactgcactccagcctgggcaacagagtgagactctgtctcccaaaaaaaaaaaaaaattatatatatatatatatatatatatatatatatatatatatgatcagtaagttaaacagtctagaatcctgttgtagacctgtttacattaaaaattcaaatataagctgtgaggcatttgacaagatgcttcttgctcctccttccagccccaacctcaaacctccccgtatgccaaggtgcatgcttcaggaataccagaagagcagtctaagtgaagttttgccagatgggcaaagccaaattactcgaggaaacaaatataaaaatatatatataatatatatgtatattttagagaatttaaagggatgaagagaattagagagggaagttgctacccgggaaggaaaaattctgacacagaacaaaaaaaaagtctaagggttatacaattcttgtataaatctctccacaatacattcagaaatctacttttgctgttggagttgtatctgagagctggggaatttaaaattgctgaaaacagatataaggggaaagtgagataaaagcagaagctgccaaaaggaggtattagcatcatcctcaatttacacagaatcacatgctaagagaggctaagtatctttcccaagattactcagccaagttgtgaagccaagatttaactgtatctattcaactcttatctaattataaaagcctatgttatttcccactgtgttactcattggcacctaaccagtattccagttagaataattatatatcagagccatccctagggtacaatgaattgaggcaattgtcccaggctttggaggttccttaaactgtcatgaaaaccagatacattaacagtcacagagaaagtggcctgaatagcacaagctaagagatctgtggatcacatacaataaaagttcccaaaccatgatcaaacaaaatgagtagcatttccccaaatttcttctgctcaaggctacatgttcctatttttttaagcctttcttctctggtcttaatgtttaagttgactgtactttatacaaaaagactgagataggaagatgatatgctccttttccactgacatctaactaatactctaggcttcctaaataaatcaatacacttaccttatgtcaaataccaccagggccaactctaggccttactgaatgaagagaactgtcctaggacagtggtaggggagatgagtgaagatattcagaaaagttatctggaaaaccactggggtcactactaagcattttccaattagatcaaggcatgttcaggaagccaaaaaaaagtttagaataactgtactatgtatctttgaacaagtaacttcactgtttccatatgaaattgttcttccttaaagccaagatgtgttcctggcaattcttaggtagtgaacaccagcatcagcttccacagcccctatcttcttgtccctctgccatacaagggagtcagaagcaagagaaaagaacgatcttttgcttggttgatattttgtgcaatgcttgacctgaaacatcttgtcatgtaaaggagctataaagtcatagggctttttaatttgcctaaagaattcaggatccaactttaagaagttccaccattagcaaaaataggaatatttgagcatcagtaacatcatcactcattatcatggattaaaatatttcaaattatttaaatccaaaaggtcatactgacactttaaaggtcactgaaacatgctttttgtgtgtgtgtgccccacattacgctacctctgatttcggggcagctatgtttgaaaagtatcagagggttccctgtttgctgccactgtctcaacaagcactcaagactcaacatggaaatgcaagggagttcatgcaacccttatccaatggggtataggagtccctacatggttcctggtccttaacagaacaaatccagttgcccacaggtgtaaaaagatcaataacatgccctgtcttacttctgctgcttctggtctctctctcccctgtattctgctgcttcctggaatcacctctcaaactgcctgtacccaagtcttggtcttaccctctcttttgaataaagtcaagtctttagaggatgctaaggaattaagtcattcttctgaaaaatgttaagtaaaggaatagcagcatattttttttttctacacaaaccacacacttcagtaatacataagtttctttttatatgaggatcacaacccttatgaattcatagaccaggaaatgatcatcaatgagctgctaacattacaacaagaaacaaccaaatatttttaaattcctgatggaagtacactataccaattgtgatagactgccttaagatgacccccaatgattcctgtctcctggtattcactgctttgtgtagtccctcctatagcgtaccagggttggcttgtgtgaccaatagcacacagcagaagtgatggtatgccactgccaagattaggttatcacagactgaggcttcctacttgggcactcctctagcactctgtctctcactatctcttggatcacacagccttgggtaagccagctgcctgagagttgtccttttagagatgttctcatggcaaggaactgagggagaccttgagacaacagccagcaacacctgaagcaaagctttagtctaacagcccagatgaaactaagaagtttgctaacacacacacgtgtaagctcgggatcagatactttaaccccagttccaccttatgatgcagtcccagctgacaacttgactgtaacttcatgacagagcctaagccagaaccaccctaagcaactcccagaggcctaaaggctgctaaattttgaggtaatttgttatgcaggtatagattatataccgcctatgacaagccttgttacccctccccaaattaactgagcctgaatacaatttctagatctaactatcaatttgcaagacacacaggggaaacagctacatattcaacaacaacaggggaatgcaatcgaaatggaaacattagcctgttttcattaacaaataaaacacaaggaaaaaaaaaaggtgccaagtgtgtaaaagagactttagagactatcctaatccaaacaaattataaaaagaaaatagaaataatcaggatacgcgaacagtgactatatatttgacaataatatggaattgtttatttttagtatgataataacagtactatagttatctttttaaagagatccttatttttatgattcacactgaaatatttacaattgaaatgaatagctaggatacacttcaaaataatccaagatgagggtaggagaatgaagcggtggaatgaggggttgtgatgtgctaactgttaaaggcagacgacgggtagcgcaattcattcacttttaccattctctcttcttttgtatttgttctatttatttatttattttttgagaaggagtctcactgttgtccaggctggagtgcaatggcacaatctcggttcactgcaacttctgcctcccaggttcaagcaattctcctgcctcagcctccggagtagctgggattacaggcttgtaccatcaaacccagctgatttttacattttttagtagagacgagctttcaccatgttggccaggctggtctcaaactcctgacctcaacaggtgatccacccgcctcggcctcctgaagtgctgggattacaggcatgagccacctcgcccggccttgtatttgttttacattttcctttaaaataagaagtgcttggcttaattttgtaatttaaattaaggagggaagaaaagaaaatttcaagtcaaattctactttaatcttttttaaagtggctagaattaaacgagctttctgcttccaaaatgcccagcaaatgtaactgaacactgacctgaggaggttcaaaatttggtctccaccagttaccaatgcaatcgtcaatgacccagtcttgcaaaactccatcctgacgacccagtatctgtcaaaaagaaataagccagtaaacaactaaatatatgtactcacaaatccccttcttcagtgaacagaaaattcttagcagtgctcctaattgaaacatagggataatatgccttccatacagattttctatgatttgttaatatagatgtcactctgcccaagacatacaatattagttcaaaactggcaagctagtatcaacataaaaattgtgttcaaaattcagctttcatttttattaatttgtatagcagaacactaaacttattttaaccaaagtcatactctacatattttaagtggccaaaaatagttctacaatgttcatggtgagaaactgcagttctctgtcctgcttcacccattcccactggctgtaactttcaactcttggttgtttttcccctcatgttttcttctatttttaaaagcattcttcttggtcttaaataaacggtttattttaggatagttttagatttacagaaaacttgcaaaacttgttcagagacttctcatataccccacacagtttccccgactgttaacatctcacactagtaaagcacatttgtcaaactaatcaaccaataccaagacaagattattaactgaagtccatatattattcagatatccatagtctttaacctaatgtcctttttcatttttcagtcccaggatcccatctaagataccatattacacttaatcttcatttcttccgaggttcctctacattgtgacagcttttcataccttccttgtgtttgatgatcttgatagctttgaggaatactggtcaagtattttgtaaaacatccctcaattaaattgaagttatgagcttttgggaagaaaactacagaggtaaaagggccattctcatcacgtcatatcaaaggtacatgctatatcaatatggcttatcactaatgggctgaggtactgtttatcacgtttcttcaatgtaaagtcatatttttcaaaaaaaaaatttttttttgagacggagttttgctcattgcccaggctggagtgcaatggcgcaatatcggctcactgcaacctccacctcccaggttcaagtgattctcctgtctcagcctccggagtaggtgggattacaggcacatgctaccatgcccagctaattttttgtctttttagtagagatggggtttcaccctgttggtcaggctggtctcgaactcctgacctcagatgatctgcccacctcactctcccaaagtgctgggcttacaggcatgagccactgcaccgggcctcaaaactacattttttaagagatagggtcttgctctgtcactcaggctggagcacagcgacgcaatcatggctcactacaactcctggcctcaagcaatcttccggcctcagccccacaaagcactgggattacaggtgtgagccaccatgcccagccaaaatattcttttatgacagtttcttgattttcattttattttattttatttttttgagacagagtctcgctctgttgcccaggctggagtgcagtgccgcaatcttggctcactgcaacctccaccacccaggtccaagcgactcccctgcctcagcctcccgagtagctgggaccacaggtgcccgccaccacacccagcttttttgtatttttagtagagacagggtttcaccatgttggccaggatggtctcgatcttttgaccttgtgatccacctgcctcggcctcccaaagtgctgggattactggcgtgagccactgcgcctggcctcttgattttcattttaaaaacattttttaaaagcctataaccctctactatgaatgagaatttagatattaaaatcacacatcctagttacactttttcttccaccatcttcccattatcaatatttggttaagtcaatattcagtatttaagttagtatgatccggtagatcagtcacaacagagcaatgattagcaaaccgtatctccttacttgttcaactgtcctattctttagttaataactttcatttcctttgctatcactaaattcatttcccacattctccatgataacttaaatttcttcccaattcaaatatcaattgtcagttattctattaatttcatcttttctaagacatgtttttccttttttcaagacaagatctgtcacccaggctggagcgcaatggcgcgatctccactcactgcaacctccacctcatgggttcaagcgcttctctcacctcagcctcccctgcccccagcctcccgagtagctgggactacagatgcaagccacagcaccaggctaatttttcaccatgttgccaagggtggtctcaaactcctaggctcacgtgatctgcccatctcagcctcccaaagtgctgaaattgcaggcatgagccaccacacccagcctaagacacgtttttctatcatcctgctgtaatctgtacttgatagtctcaaccctgcttcacagctggagtccttattttattccattttgggggtgaacaccctctagtagcttcctgagaaaaggtacaagagatgtaactttttgaaactctgcatgtctagaagtaacttttacccacacacttgatttatagtttgattagaaaattctaggacagagattatattctctcaaaattacaaagacaacactccaccatcccttagcttccagaattatttctgggtagtttaatgcaatttctgattttgatgttttgcatttaacctctctgcttaccaatcctccacctcccactttggaagcttttacatctttttgtttttattttcgtttgtaggatctaaaacgtcatgatgatatgcctttgcgtggatctttaaacattcactatagaggcaaggccagtaggtcttctcaatctcaaaactcatgccctttgaggtttgagaaattttctctaattatgctttgctaattcttccttttactctgttctatttatctatagtttatattggtccttctagaatgacccactaattttatctattcttacctacattctatctttttatcttttcattctattttctggtagaatgaacctcttaactctttactgaatttttcatttcttccaacatttttttaatatccatgaggtttttcttggctaaaatgtctttttaatagcactgtttcacaggtgcaaaatctcctctcatctcaccaagaatattaatcatagttttgtcaatggttgaattttctgcttctgttgaggtccttttgcttcttttgatctttttcttgttaagaagttttctccaaaagcctggtgatagttggttgtgtactcacaagggagaagcaacaagatgcttaattgtcacctctgtgtgcatgagtgataggactacaatatttttttttcttttttttttttgagacgaagtcttgctctgttgcccaggctggcgtgcagtggcatgatcttggctcactgcaacctccacctcctgggttcaactgattctcctgcctcagcctcccgagtagctgggattacaggcacccgccaccacgcccagctaatttgtttatgtttgtagagacggggtttcaccatgctggtcaggctggtctcaaactccagacctcatgatccacccgccttggcctccccaagtgctgggattacaggtgtgagccaccgcgcctggcccaggactacattatttctatagaaaattcttgctttggtttggatatggtttgtctccctgcccccaaactcatgttgaaatttgatccccaatgtgacagtgttggcaggcagggcctagtggaaggtgtttgagtcatgcaggtggatccttcatgaatagtttaatacccttcctccatcaggaatggattagttccctggagagagggttgttaaagagtgtggcttcctggattcactcttgcttcctcccttgccatgtctctttgcacatgcccactcccattttgctttctgccatgagtggaagcaccatgaagccctcaccagctgcccaatcttgccaccagaactggtgagccaaataaatctttttctttataaattacccagcctcaggtattctgttatagcaacattaaacagacgaagacagctcccaaatggcagtatctgaagtttttcttggactggtcactttttccagaaacaagaattccaaccctcagcctgggatatataaatctaattgttggctgggcctggtggctcatgcatgtaatcccaatgctttgggaggactgcttcaggccaggagtttgagaccagcctgggcaacatagcacgatctcatctctataaaaaacttttctttaattagccaggcatcatgggcacatacctgcagtcctagctactcaggaagctgaggcaggaagattgcttgagcccaggagtttgtggttacagtgagctatgatcacaccaccatcctccagcctgaggaacagagtgagaccctgtctctaaaaaaaataagtaagcctagactgacagtggctcacacctgtaatcccaacactttgggaggccaaagcaggcagatcacctgaggtcaggagttcgagaccaacctggccgacacggtgaaaccccatctctactaaaaatataaaaattagctgggcatggtagtgggcacctgtaatcccagctactctggaggctgaggcaggagaatcgcttgaacccaggaggcagaggttgcagtgagcaaccattgctcacattggagatcacgccactgcactccagcctgggcgacaagagtgaaactccgcctcaaaaaaaaaaaaacaaaaacaaaaaaaaaaaaaaacaagcctaattgttaacattctgtcagcctaatagaggtccaagagtctgactattcagaataggaactcttattctccccatcccctaaacttttttcattgctagttgttctctgattcaattactacagagaatcatcagccagtctttgcctaattacagagtggggaagacaatctagatacacaggttgaacatcccaatctgaaactccaaaatctcaaactttttgagcactgacatgatgctcacaggacatgctcaggccgggcgtggtggctcatgcctgtaatcccagcactttggaaggccaagacaggcagatcacctgaggttaggagttctagaccagcctggtcaacatggtgaaaccctgtctctactaaaaatacaaaaattagctgggcgtggaggcaggcacctttaatcccatctactcgggaggctgaggccggagaatcgcttaaacccgggaggcggaggtgacagtgagacaagattgcaccattgcactccagcctgggtgacaagagagagacttcgtctcaagaaaaaaaaaaaggaaatgctcattggagcatttcaagttttgtatatgggatgcttaactggtaagtataatgcaaatattccaaaacctgaaaaaaatcccaaatcctaaccacttttttaatttttaatttttttgagtacacaagatgttttgatacaggcatgcaatgcgtaatattcacatcatggagaatgggatatccaccccctcaagcatttatcctttgtgctacaaacaatccaattatactcttttagttatttttaaatttacaattaagtgattattgactatagtcaccctgttgtgctatcaaatagcagctaaacacttctggtcccaagctctcagataaggaatacacaacctgtataaatatactccatatatactttgaaccagtccagttttcagcccatgcatgcccccactttcataagtacctagcaccttcagttcctcagtcattctggtactctgcaatgctagattctgcctgcctgtctgctggactaaggtttctgctaagttagttataatttgcccatctgttttccagtttccaaaaattttgcttttgtgattctctcattttgcactccctcaaccttaatggacttatatctttgtaccatacattatataaatggaagtccaagcacaggaaaatgtttaagagttataatacatttttagaaatactagaaagacaaaccaataggtcaaaagtgggagaattacgggtgactttagttttgtttctcctttgcttttctgtgtttgccaagctttttgcacagagaatatatgagctttgtaacaggggcaggcggcaattgaatgttaaagaagaaaactaacattgaaaacaatttacaatctcaaaatcctcagtatctatgcatttggccccaagtctttacatgcaggcattacaatgatttttaaaaagtagaataatttgggcaaagtctaaaaaatatgtgaaaaaagtgaaaacacaggcatctttctcttttcaaaattctatagaggcctactcttgaacaaaactacctgcattcaaacctctggctctacaacacactagctatataacaagaagtaatttaaacttaataatatctacttcctacagttgtggtggtgattaaaggaattagcgcatgtaaagcactcagaacagtgtctagcacagtaatacttaaatgtcagttttaatttaccattgctgtgacacagtttaacattttaaaaattgaaataagtgtaacttcaacttgtaaaaaaaaatcaacattgtactaaccttctggagtttaagttgtatttattgaaaactaaatattccaaaataagcatcctttttacaagacattaaaagccaaataactagtaagttgatggtattcaaagtggttaaacagaaaaatacctctgtcattaagcgttttagtccttcaacttcatcttctcctgggttaagttcaccaccaggtctgtataaaagttaagaatttcagctttcaacttaatacaatttggagataacaaataacacaataattgttatttctaccaagtcactaagaacatatttcagcataataaggcaatcaaaacaagtatcaaagtgaagggggagaatatgcttgaattcatgtcaattccccagactaacagtatacaaaccctaggtttttttcctcttcgtatatatttatttttattttattgtagattcaacgggtacatgtacaagtttgttacataggtatattgtgtaatgctaaggtttaggcttctagtgaacccatcactgaaacagtgaacataacatccaataggaagtatttcaaccctcgcctccccctcaccctccccacctttggagtatacagtgtttattttttccaactttatgtccatatgtacccatcacataaaccctagttttaaacaaacagaatatataacatagcacaaacataaacaaaattgctaaccaccagtccatcccaatctcctctctgggagctatctgatgataatggagtctagaaatgctcagagaggaatggatcacattctttaggcctaaagaatgggaaactttttcaagaacgtcatctaagtattggagacttttctttttggtataatctagtcaaatagttacggatcaaatgtttgagagatgtaggagcttaaatgataaaacactaaactgttatccacaaaaacctaagtcatcttaagaacaggaaatgctaatcataccaagaaagaaatatcaattgttcttggtaatgctacaatgacatctagacattgatcttggactcaactattccatggggtttctaccaagctcaatcattaacatcaacaacatacagaaacatacagattactagttaggaaaataaatgagcactgcaatggagaaaaattactcatgattttctctttctaaagacatcattaacagcagtgtttgttgaaatgaatgaccgagggctaaaattgtattccagagctgcataaacagcaatcctactaaaaactgtcttgctgttaatttccaacactacttacagtttgaagaaagttgttcccagctgcagcagtaacacatggggtagccggtgctcatgtacaatcagaaccccttctacagtcctcctcattccaattttatcaaattcttccctcatgcgctgaaatctggctgcaacagagctgtccttctcgtagaggggctcttttgtaccaaaagtataattggtaagagggtacctgtgatccgaagacaaacatctaacatgagaactgaagaatgtaatttaccatgacagacattagcataaagaaaccatggtacaaaaaaagtgcatatattgtactcagacacaggatttgtacagttaactaaagttaatgaaacagcagagactggaatcttgctctctggactcttaaagccagagcttccattagatcaagctgctcctccatactttaactttcaagtgtagataacactatccttaaatgcttagagaaatggttatctgaacattagtaatcctctggttttataccatggctgctatttcaacattaccaatttggctaataattaatgtccccctgcattccactgactactaatctaatcagaaagttttaattatgggtgctaatggctaatttctttttcctaaaactaagccaccgtttttcatcaacatccctccagttattttctatttctctcagtcaactatcctcagatttttcttgcaccacagcctttccttttcacagcaactcttctactttctctttttgtcctctaaacctatttactagcctttggcatttattctattcagtctccttattgtttccttctcctcatctgaatcttctacccaccatatctaatcgaaaactctcttcctttaccaataatttaaaatatggctcaaactgttaaagacagttttcatcttgcctaataaggatcaaatttttctttaaagatagttaaaaaatccatacttatatgttgtaagcccttaattaaagccttacagcaagaagcctttgagtacgaatttaggccacatttgcccatccaaggtatctattctaccaaaagcccttgacattaatagtcaacattattgtatctaccccactcagccattcttgaaaggggaaaaaatcaaggttgccaaaactttaaaaattactttaattccagaagccaagttctaggcatatgaaaaagctctaaaataattaaaatataccattccaggatgctttaaaaatttaaagaacatccccggtagatccaatgctaaatctaaaaccatcatccatagcagcagcagatatgctacatagaacgacgtgccaagcaattttttaaaacgctttacatatattaacatttaattctgacaacctgagttagaaagaattaaggatagccattacacatctctgttgcaagagccagctccaatatatcagtaaggagatgtgaagatgaaatgtcagaattttcacctgtgaaatcagagtgccagcccagacatacatattgttctcatcatactgtgagcttcataaagcaggggctacaccttacttcctcaccactgtatatccagtattgtgcacagtgcctggtacaaagtaggcattcatgcaatatttcctaaaataaaatatactgggggagagggcatttgttttcaacttaatgttaactcaggtgaacttaagttcacaacacaattattatttctgaatatttgtatttacacaggagaggaaatgtactgtaaatcaacccataattttaatagagcgaagattaaaatatcttactgaaagctaactattttgccaattctacaaaatggttggatgcaaattaattcagtaatcaagacaaaacaagaaaagactgtgggttttagttctaataaccaccgaaagtaatccagaagctgtgctttcacacttttaaaaaggataacatttgcctttaccatttgatggattttttcttaatttttaaaaaaatttttgtagagacagcctatgttgcccagactgatctccaactcctggcctcaagtgatcctcccacctcagcctcccaaggtgctgggagtacagtcgtgagccgccactcctgagaacttttatacacacaactatcaactaattccagattttataaacccagcatttccattatctaaatttccaagccaacacgttttgcaaaataaaacaatgttaaccatcttttcaacttcaaatcacttttggttgggggacggggagacaatgtccgtttattttaatatgaaacagagaaacacctaaactgccttacgaaaacatcaataccaccaaatccttgcacttgtaccctgactggcataaactggccactttcctccatcctggcataaaatggaggcaccgcgttgcctcgaaaacaaatcctcagaaacgattttaaaaagcattactgacaatttcttgattaagacaccccaaacgccaattacctgctacagcgagtctgcttctgagaatgaccttgaaatgcaatggtttgaagtgttgaaacagaaaggtgttgaaaataaaacacagcccacaatgggttttctggtacaaacattctggttccctccagtctgaaagcccaaccatagcagcatccttactcccaaggaggggcctacttgtggtgcctgggatgccggcattgagacatcagacgacgcgaaggcataaggcatggggcagggcagacagccctgagcacatgaataaaatgtgttgtattcaaaaactgaagtattaagtggcacctaaaaggaagaaaactagacctaggcattacagctagatctcgaaaccttactgtcagagtgaaatctgcaaaaatgatactaggttataccattcgtatcacatcaacactcacaaagcaataccatgtacgtgatgcgaaagcataaacaattcactggaaggattaaaaaaacacacattttgaagtcggttacctctggagaggtggggaaaggatgagttaaaagcaaactccgtttttccccattatgaccgaatacataggatgggaacaagccttcctttcagaaaaggactctaaccctggaggctggaggatgagaaaggggcctgagagagggaggaaggcgcgcatccgccagcgggagttggaggcggggaggtgcagaggcgtgaagcgcgccgaaaagccgggggcgcgtcggagagtctataggagctttcacgagagaaatgcccgccaaggccgcgccgcacttacaggttgatggtgcgctccagggtgaggggcttcgtctgctggatgtacttgttgccgaactgagtgaccccccggggccagccggtctgcgagcgattgggcggtaccacagacatgctggcgagctccggcgctgacggcgagcagaaagtggcaggcagggtagactttccccgtgcgggaagcggttatctgcaatcccctcagcggctactgcccgccattaacaggacagcgcaagaggaggcgtaggcacgccggaagtgaacccggagcctctggcggcaggaagtagaggggcggtggcctgccagaccgagctccagtgggccaattgctggtgggatggctgcaatagctggagctcccattggtaaaccgggtataggttccgccttctcttactttggtgcttcccattgggtagggccgggaaacacgataaaggggacatgccgggagttgcagtaccctcaggaaggtagcgtcttgatctgcgtggcgtggttctgtgccttgggaagagatgaatgggaagcggccagcggagcccggcccagcccgggtgggaaaaaagggaaagaaggaggtgatggcggagttttcggacgctgttacggaagaaaccttgaaaaagcaggtggctgaggcctggagccgcaggacgccgttcagtcacggtaaccgggtgctctcagggaggggccgccacgcagaggtctagggatctctgaaaaagccctgggactcgcgcccagccttgggcagcggggccgcaagggaagaggctcttagaggactttggccacctcctactctcctgcctcggctgctgctccctttcactccaaattcggttgcaatttagaaacgtgagaagagggagaaatggaggccggagagttttgggaagcagagggtatgcaagagatagttgcattctggagtcaaagattactgagttagaatcctctcccctgattgggcgtcgccaggcaatggaattaaccttattaaacttcagttgcttcctaagtaaaatgggatagttcataatatttacctcggaaagtcggtgaatgggagcgacacactaatgcttgcaggcttcagtaaatgtttccctgagtaaggcccaatacacatgtggacaaatacaggagtggctgatgtcatttctcctgcaagggcattgctcagctgtcccaggagagtctagccagggcatttgtcgtgagctgccagcttgactccctagtgtactcgtctctacgcgcctgtagtttgactccatgatgtatgaaaataaacgcgctttgaccaaggaaaggcgcctacgttgaacgattccagcctcagctttaaatatcaccttaggtgttcagagctctgcttcatgcgccaggcatccccttctagagtttgccgtaatttttctttccgttgtcaagtgctttgaagaggtgagtcctgggtaggctggatgcctatagaaaacgatagcttagtgtttaagtgcaggctctgtactctcagtttcttcatctgtagaatggggagagtgataatgtctccctcagagctgttaaaaagattgaatgagatcatgggcctggcacctggtaggtggtgctgatgattacaggatggtgatctagccagccggaagcagtgggtaaatgttggggtagaaatcaaggaattagaggtggttatgcccgaactgaactgattttttttttaagtacagtaagtagtaaatgcctctgacagtaacttgggaaaagcaaaagcagggaaactgccgaccagtattgctactctcatttaatgtgctacccaaagtttgagggaaatgaattaaaaatctaaaatacattcaattcaatatgtaatcattgaaacacataaaaaaaagagtaggaaccttgatttagtgacatcacccatcactcatctcaaggactggagttgtaagcatggtatctttaaaagtagtatttaatgggtaaagaagaaaggtcagagcttatcattttttccccaaatcttagactttaagtattaggttccccaaaattcatgaccatccccttttgtattagctctgctatgttacttggatgtcaaaaatacaaaaggaaaaaagccatagataatgtttttcttccaacagaagtcattgtcatggacatggacccttttcttcactgtgtgatcccaaacttcatccaaagccaagacttcttagaagggcttcagaaggaactgatgaacttggacttccatgagaagtataatgatttatataagttccagcaggtatttattcccctgccacattaactcttccagcttggaaattcactgtctatgaagtcattgaatacctttagacttgaggttttagggtgggtttgccttgaacagtccttgcattgacattcttaagagcatgccttcatttaaccaagcttactgagtgttaactatgtgttaagtgctataattatatggaagccttagacagtgcctgccctgtaagactttaaaatctagtgttcaaagtgcaagctctgtactctcaaagacttctcagtttcttcatctgcaggatggagagagtgataatgtcttccctaggtacacaggtttctatgggtctcatggctttacctcctcttggatgtctagtaagtgtctgacacttaagtctaaaactgaattcttggtcttctctaaatttgctccacctgtagttttccccatcacagttaatagcaacgtgatctttccagttgctcaggccagaagtaataataagggtgaatgtgacggtgatagagatagtgaagaaacaaattaagccgatgagtaagtatgttataaacaaaggggttaagtacatgtgggtaagtggtatgatgatgaagagagttgtacgttgggagacaattaccatttaaaatcttgagttcgggccaggtgtggtggctcatgcctgtaatcgcagaactttgggaggccaaggcgggtagatcgcctgaggtcaggagttcgagaccagcctggccaacatggtgaaaacccgtctctactaaaaatataaaaattttctgggtatggtggcatgtacctgtaatcccagctacttgggaggctgaggcaggagaatcacttgaacccaggaggtggaggttgcagtgagccaagatcacatcattgcactccaacctgggccacaagagcaaaataccatctcaaaataaaatagagttttgagttcatgtttttgtttcaggtgacttgctatattacagtatgctctacattgcagtagggcaaagcgttaaatccgttctttttttttttggtggacagtttaattgggcagaaaagactatctctttttttttttttttaagtttggtttttctactctggaagacacagcctagtctaggtatagaaatacaggtcattggtttccccagtttgggggtatatctttcagtacatgaatcctttgtaaacctcagggacatctgtgcttcaaattggggggggaaaaaaaaaagaaagattaaaaagatgaagaataatttttttttttgcattttcccattttattttatctgggataagagagtaaataacgaatttctctctcttattcttttacactagagctgattggtcagatggttgtatcctgaccttccccagatctttctgtctttggaccttatacacatgactgaattaaccaggataaatacatgaaagatatgactcttaataattcagaaagctgaaaactaaactgctttccatggtaaggttgcacaggttaattaaaaaccgcagttacctgctgttgtgattatcgcacccttggcctcttgttgatttggggccatacgcatctgattattaaaattgaaacatcacaataatttttacttcatgcaatttggaagattaaaaatactggaagatggccgggcacagtggctcatgcctgtaatcccagcactttgggaggctgaggcgggcagatcacaaggtcaggagatggagaccatcctggctaacacagtgaaaccccgtatctactaaaaatacaaaaaattagccaggcgtggtggcacgcccctataatcccagctactcggaaggctgaggcaggagaatcgcttgaacccaggcggtggaggttgcagtgagctgagatcgcgccactgtactccagcctgggtgacaaagtgagactccacctcaaaaaaaaaaaaacaaaactggaagatataaggcaaaataataaaaagagccttgggtgattgaaaaaaaaaaaggagctgccattactttggatccacatggaagtttggtgaaactctactgtgaataatttttactgttgatcccttttggacaggaactcttcaccctaagacagtagatgtaaaatctggtttcattctcctgctcctttaatcctcatccatgctcttttctttgcttgtggtatgaattgacttgataattgggtctctgacatcttccaactcccataaccaactctgtcattaggacttgcccagtattctgtattttttaaagcaagcattattgagtgcatactttatgccatgctaagtgctttatatttattcattaaatcctcaaaacaatcccattactatacctgtttcacagttgaggaaactacattagtttttctttctctctggatcattcccttcaacataacaaaaagaaaaaaaaaactgttcttttcataagaaaaaaacaaagttcttgacctaagtttcccttcagctaccatcccattgctgtgcttctcttgacagcagaattttattcttataagagttgtctgcactgtgtccagttcctctcctgtcagtctctggtaagcccattttaatcaggctttcgcttgtactactgcactgaaactacacttgtcaagatcacccataacctccacattactaaatctgataatcagttttcagttcttccttgtctcatcagcagcatttgacctactatatcactccttcctcctggagacttttttttcactttactttcaggttaccatgctctcttggtttctcttcttcctcagtggctatttcttaccagcttcctttgctaggttttcctcttccacctgacttcttaatgatagagtattctgcatcctaatgcttggcctccttccctaggtacacaggcttctattgggtctcatggctttgcctcctctttgatgtctaatgagtttctgacacttaagttcaaaactaaacttctggtcttctccctctaaatctgctccacctgcagttttccccatcacagttaatatcagcttgatctttccgagggctcaggccaaaaaggaggtcatccttgattcctctctcaccttatatccagtccatcgtgaaactctgctatctctaccttcaaaatacaggcaatcgccacatgatattttctgtcagcaacagatacgatagtggtcccataaagtaacacctatttttactataccttttctatatttagatatgtttagatacacaaatacttcctattgtattgtctatagtattcagtagagtaaaatgccaggttgttcgtggcctgtaaacaataggctataccatatagcctaggtatatattaagttctaccatctagatttatgtaaatgcactcgatgatgctgaaacaacaatgaaatcacctaacaataaatttctcagagtgtaaatgacataccactgtatatccagagaagcccacttcttactacttccactgccaaaggccaacacctggttcaagctatctgtgtctccccgggattattctattagtgtatcaaccattttcccttctactgtcacctgcttagacagtcactgaagtcattgtattcttttaaaatgtaaatagacccaagataattaaaaatatgtaaaaatatgttcacataaaaacttgtgcacaaatgttcatagcagctttataattgccaaaaagtggaaacaatttaatgaataaacaaaatgtggtatacccatagaatggaatacaactcagccattaaaaggaatgacgtactgatactaccacaacatggatgaaccttgaaaacattaggctaagtgaaagaagtcagatgcaaaaggctacatattatatgattccatttatatgtaatgtccagaataggcaagtggttgcgaggagctggggggaggagagaagagggaatgactaacaaaattggcacaagggtttctatttggagtgttaaaaagttctgaaattaggaagtgctgatgatcgcccaacattgtgaatatactaaaatccaatgaattatacactttcaagaaattgaaattatgtggataattgtgttatgtggatattatcttaaaaaatgttctcaaaaactccaatgactttttttttcttttttttgcttcagaaatcttctcatttctttaagtcaaagccaaagtacttaaaatggctttaagtcacctattaggttttttttttagacggagttttgctcttgttgcccaggctggagtgcaatggcgagatctcagctcactgcaacctccgcctccaggttaaaatgattctcctgcctcagcctcccgagtagctggaattgcaggcatgcaccaccacgcctggctaatttttgtatttttagtagagacagggtttcaccacgttggtcaggctggtctcgaactcctgacctcatgatctgcccgcctcggcctcccaaagttctgggattacaggcatgagccaccgtgcccggccccactattacctttttggcctcatctcctactgccctccctctccctctctgctcttgcaatagctggaataggccaggcgcgcttcatgctcaggaccttgaatgctttgtgccttgatattgccttgccacacttcccagcctccttcaagtctttgtatcacctccctgaagtctaccttggccaacctgtttataattgcaaaccactccccaggcttagcactccccattctttccctgggtttctttttttcctttatgcacttctcaccatctttatactaatctgctttttgtgtctgttgtctatctccctcaatgggcatagaaactagactataataacgacttaagtatttgtttaatgaataaagcacagagggtaataacttgtcaagtcacagacccatccaatggaggggccctgtgttaaacctaagcagcctggcttcagagtctgggctcttaatgacaatgctaggaccagaacactcactaaactgctctcctttgtgtgtctcttatgtgaaggaaatcccttttttttctctattttcatgatcaagtctgatgatttgaagaagagaagagagcctcacatctccactttaaggtaaacaagtaatcatatttgttgggtgctaatatgtgccaggcagagtagtaagtgctttaaatgttacaacattgtgtatgtcatataattcttgttgacattgttaacccactttgtagaggaggaaagagaccgagaaattgagtttgcatagcttaaaattaagggagctagcatacaaacctaagtctgtctgattccaaggcccaagttctcagtgataaaatgctcaatcttgttagtaatcaaggaaacagaagttaacactggagataccatttttcacatgttaggttggtaaatattaaaaataaaaaccctagtgttgacagatatagatagataactttatacactgctgtagtctttcttcaaagatggttttgaaagatgtatcagaacccttaaaagtatgcatatctttttgtagaacagtttcacttataagaatttatcctgggggctgggcgtggtggctcacgcctgtaatcccagcactttgggaggccgaggcgggtggatcacctgaggtcaggagttcaagaccagcctgaccaacatggagaaaccctgtctctactaaaaatacaaaattagctgggcgcggtggcacatgcctgtaatcccagctactcaggaggctgaggcaggagaatcgcttgaaccagggaggtggaggttggggtgagccgagatcgagcccgttgcactccagcctgggcgacaacagcgagactccatctcaaaaaaaaaaaaaagaagttatcctgagaaaataaggatatgctcaaagattccatacaagattacttattgtaatattgtttataatattgaaaaattatatacaaatttgatcgcccatggagatttaaacataatagtacaaaacataaagtggaaactatacaaccattaaatatgatatacatgagttttgacacatgaatgtggtagttatctatgttctcaattctaagaaacttttaacattttaacacctctgggatctagtgtctcacacaatcacttttgtgtcctactttaattgacagcattttttccttagtgatatatgaaataatgatacttaacacatttttgtcaagagaaaaaaataatacacacaatttgatgctttgttgttttttctgaccaatggattcacatcacgtgatcttattttaaaaagagatacacacacctacatttggatgtctgtgtgtataaagtaaaagatttggaaaaatagagtatttaactcctgctagtaggaatacagatttttttttaatagttttttacttacatgggatttttttcctagtttctataatgaatagatgttgctttgtaatagctgtttttcacctatatggtataaattatttattctcattatattttttctctgcagtacttccatgtattataggcagcttgcacaatttcttctaaatcctgaagtattgcttgtgtgttaattgtaatgcattatgtttcatatttacttagacttttttccccctaaagaaagattatcatgaattaaggcattatccccttagttcacaacaccactctgctaagcatttcatgtgggactgagttacattccacactaaaggcttacagccagatggtgagcaagctgcaactccgtaatcgttacagagagctgatctttttatttcccacttggattctgtgagttccttcatgaatacaattaacaaatgctaacaatgacaaaataagcctgtccttgtgacactttcatagaatgaatagaagagctttttctggaatttgtgaaagctaatgttaccagtaaaggatttaagactattagttgcttacagtatcaagactttgaagaaatatttatctctcacattatctgaagcctggttcagcagtttgctatcctgacccattttacataatttccaactctgcctttaaaagttacatggcacctctgagtggactgactgagcacaattattttatggaatgttctttaagcttgttcgcagctgataatggaattttttggttttgatagtgtataatataaaaaggtatttggtaatgaaatcttagagatcaacctggagatttgatacttagttataaacaggacagttctattttatgggaatttcagtaatgtgcatttggagtaggatgatccaaaaaaatattaagtatctttgtaagcgtaacttgaactaatgtaaatctttttaaaatgttttaattcctcaaggttagtaataattcataatttcaaagttgattggctgagtgagttataaattgtgttaagagatttctacatggagagccagtttagctggtaaatggaaacgttcaccatcttctattggtatcctgttagcatcagaacttctatgaaggatttcactcattattatgcatttaattcaacactcatcattattgccatttaaagttgttttaatcttctaaaacagtgccacccaagtgttcattaaatggcggtaccagtattggtgcttgtgatttataataaatgtatatttggtcttggtctctattcctggcacagacctctctgacctcctgcaagggaagagaggctggaggttgagttaatcactaatagccaatcacttaatcaatgattccttcataatgaagcctccatcaaaaaccctaaccaaaggagttcaggattgctgaactcccatggaagtgctgggagggtggtgtacctggggaggacgtggtgtggaagctccacaccccttccccatacctcaccctatacatcccttccgtctggctgtttctcagttctgtccttttataataaactggtaatctagtaaacaaacttcttctgagttccgtgagctattctagtaaattatcaaacccaaggaggcagtagtgtgaacctccagtttataactgtttggttagaagcatatgggtcacaacttgaacttgtaatcagtatctgaagtggggttgggggagagggcacactgggggcagtctcatgggactaagcccttaacctttattaatgcctggtagatagtgtcagaattgaattgaattttaagacactcagctggtgtcagagaattggtcagtgtggggggataagcccacacatttggcattggaagtgaagtaaagtgtgtaaagaaaaacagttgaggccaggtgctgtggctcatgcctataatcccagcactggaggccgaggcaggcggatcacttgaggtcaggagttggagaccagcctggccaacatgacaaaaccccatctctactaaaaatataaaaattagccgggcgtgctggtgcatccctgtagtcccagctactcgggagactgaggcaggagaatcacttgaacccaggaggcagaggttgcaatgagccaagatcacactgctgtaccccaacctgggcaacagagcaagactctatctcaaaaaaaaaaaaagaaagaaaagaaaagaaaaacagttgagctttccattttagtgctgaaaaacttgtctgaaaatcagtaacttggactagaccactggtgtgatgagttgttatgacaaaggccaaactgctgccatgacagggcatactttaaatttaggagaaagaaaatactgagaaaacatgaaccattagaacaaaaaataacaaatataatgtaggtagagacttacatttatttttctgggaacattagacttaaactatgcaaatttgaactgagaaacatttctcagaatgtctcaaatgagatcggagaatggatctcttgaatacaatgtgatctccaggaaagaaaagttgtggcctagatccaaacagttgtgacctagatcccacactgtggcataacaagttatcttttgtttacatttctaggaaaattctgtttgaagatttccggtcctggctttctgatatttctaaaattgacctggaatcaaccattgacatgtcctgtgctaaatatgaattcactggtaaggaagataaaggcctggtgtctgtaagatataaaggctttaactcagcattaatggagagatggtatctgtgtaccaaaacactcaactgaatgtccctgcaaagcatccggatcttcctgataaagacccagttcatagacagaaatacccaccttattggaaggcataagcagtggttgtctttcagaatatgatgaaagctactgaccatattttcagcaaaatccccataacatacatacacaccaactgtacatacaatatcaagaaattcagagtgatatataaactctattcttagacttcctaaggaacaaccatctccttcaatgccattctcccttctcttttttattttgaaggcaataagtgaatgcattcttaaaggaaaaaaaatcaaacaatattgcaggtatatggtgtaaaccatgatagccttcttcaccttctccctgctccctcttctcttcagaggtacctattgtcaccagtttggggtgcatccttccatttctctttctgagcatataaatggtttttttggatacaagcttggtttttcacccagaaggaaaaggttttttcttttttaaattttactaaataaaataattctttgagtgtactctcatacactgtcctggaagtatagatggctcacaacttttagaggatgacttggtgatacataggaaaagccatatcatgtatcttcatttactgccatgtcatttcttttttgggttttttttttttttttttttttttttttttggtttgttggttcgttggttcgttttgagacggagtctccctctgttgtccaggctggaatgcagtggcgtgatctcggcccactgcatcctccacctcccgggttcaagtgattctcctgcctcagcctcctgagtatctgggattacaggcatatgccacaatgcctggctaatttttgtatttttagtagagatggagtttcaccagttggctaggctggtctcaaactcctgacctcaagtgatccgcctgcctttgcctcccaaaatagtgggattacaggtgtgagctaccatgccagtattttttttttttttttactttgaagtaatttcaaacttgcagaaaagtggcaagcatagtacaaataatttattttttcctattttacttgagagtaagttgttggcatgatgttctatgacccctgaatacttcagtaatttctacaaggacattctcctacatgataatcataaaccatcagaatcaggaaatttacgttgatgccttattccacatcaatggattatctaatcctcaggctccattcaggtttcattatttggtcctttatagcaaaaggacccagtccaggattgcatgttgcatttagttataatattgtctcttcagcctccctcaatctagaacagcccctccatctttcctggactttcatgatctttatgcttttgaagatgtacagatgagttattttggaaaacttgcttcagtttgggattgtctgatgttttctcatgattagattcaggccatatatttttggcaggattacagaaattaatcctgtattcttttcactgtatcaggtggtgcatggtttcagtgtgtcacattattagtgatatgaacttggatcacttgattaatgtggtggctgacatcaggtttttccactgttctttttccctatcagtatatattttgtggggagatactttaagattatgtaaatatcccatttctcatcaaagttcgatttgcttattttagcattctctgatgtttcttgctaaattattaccatgaaggttgccagatggtgattttataacacaatcatttctctacatttattgtcattccactctagagaagacctttctcctgatttatttattcattcgtttatattggtatggatttatggattgctggttgtgtaatgagctgttaccagttactatcattatattgatgctcatactgtccctgatttatcaaggagaaccccgtcaaactgacttctgcgttcttttgctatgtccccatcattcttttttttttcctactttctgcaaaacaagattttccaagcttatctttgtattttccatgccaacgtcctagaatgacctggagttggccattcttccaaagaatcctggttccttttagtgaagaaagatacttaacaatcaagatctggactcttaagtgtctttgctattagggtgtcactgctcccagaccccttcagtttgaagaggtggtgaatatctgtatacatgtatatacacatgtggatgcacacacatacatttacatttggaatgtatttctttttttttttttttagactgtctctcactctgttgcccaggctggaatacagtggtgcgatcttggctcactgcaacctctgcctcctgggttcaagcgattctcctacctcagcctcctgagtagctgggattacaggcgtgcaccaccatgccctgctaatttttgtatttttagtagagatggggttttgccatgttggccaggctagtctccaacccctaaccacagatgatctgcctgccttggcctcccaaagtgctgggattacaggcgtgagccaccgtgcccggcctgtatttctatatatagatatataaaactatagatataggaaactgaattcccattgattcctcgagttccaattgaacaccacagggttcattctagatttctgcatttccatatttgtaactcccttcttgaacagtgagaaacctggcttccattatcttcaatgtatttatctattgaaacaatccctccatgtgtaattggttgcagttcaccatagccttccctccctctcagcctgcacagatgcctatcttgctagccccaggacatgacttttagaagttcccctcaagaaattaatacgagcaagtacaaaagatccatgtacaataatgttcattaaattagtctttatagtagccaagaaatagaaacaacttaattaacaaatagaaaatctattaagggtggaaggaggtaagttcataatccatatagtagaataactacagccattaaaagtgataccaagtgtgtatattgatagggaaagatacttgccatgtaatttaaaaagcaggccacaaatagacactgtcggatgctattttttttaaagtaaatacatatatgtaggaaaaatactggaagatgatatgtaaaaatattgttagcgattatatctggatctatctaattatgtgctctttatttttagagttttctatattgacttatttgtttacttataaaagaggagaaataagtgtcattttaaagctggaggacatttaaagctggagctgacattacagttgaatgtcaaacggactgatattaaatgcagagtcaggtgtcagctggtcactatctgcagggatctaaggtgtccattaaactattgcagatgccctgctgtgccatgatgatgagctggaagggcgccggattgccttcatcctgtacctggttcctccctgggacaggagcatgggtggtaccctggacctgtacagcattgatggtaagataagtataagtgcatgcacttcaccaccagtggcacttctgagttaaagctgagttgattcagtatcatgtttttgtatacaatgtctgtactcctcaaaggaagtggaagctatttattatagtaactacctcaagaggaataaatgccagccctgacaaccacctctttaagttggacttaaaaatgactccagagatcaattagaatccatttaagatgagaaatagtcagaccaagcttctgaatactgactgtggaagggtggagtgcatataaggctgcctgtggctatgaatctgccaggaccagtccatttgacaaagtctaggtttttttgaatgtctagcaccagaagttgactccaggaaactttgagaacttattccagcccttctcaataatagatggatggtgtagtaagaacagatgccacgtagtcaaactcgcaagtatgagtgaagcagatggaaagggcggtatttcagggtctgaagggcacatctagatgccctcagaagtttggaaattgtcaagagtaaaatgaggcaggctggaagtggttaatgataatttattgatgtgttctttcctggtgcagaacactttcagccgaagcagattgtcaagtctcttatcccttcgtggaacaaactggttttctttgaagtatctcctgtgtcctttcaccaggtaaagactgtaagccacaaatagagtagcaaggattatgttttttaatcacccattatccaaacatgacagcttcctgttagacttgttatctgatgttgttttaatgcttagcatggaggaccctgaaattaatgtgcattggcggtaatccccctattcttcgtgttgatgtgctactgggcttctcctttcaggtgtctgaagtgctgtctgaagaaaagtcacgtttgtctataagtggctggtttcatggtccatcattgactcggcctcccaactactttgaaccccccatacctcggagccctcacatcccacaagatgtaagaagaattgctgatatccttatcttaggagctatagcatatcatttgtttctctgattttaaaattagctgttccatttaatgaaactggaccttgagcttgcccctttccacttttcttttttttttcttccttttttttttttttgagacagagtcttgctccgtcacccaggctggagtgcagtggtgcgatcttggctcactacaacctccacctcctgggttcaagcgattctcctgcctcaacctcctgagtagctgggcttacaggtgcccaccaccacgcctggctaattttcatatttttagtagagaaagggtttcaccatgttggccaggctgatctcaaactcctgacctcaaatgatccacccaccttggcctcccaaagtgctgggattacaggtgtgagccactgcacccggcctacacttttcttaagtaaacttttgagagtgtctttctcaagcagagttttccagtactttaataggagaaacttataaaatgaggatttgcatgtattttattagtgtgaaatgatgtaagagcaaaagcaataggaattattaactcacattttgcatctgctgcctcttcgtaagcatgagattttgtatgattggatcaaccctacttatctggacatggattaccaagttcaaattcaagaagagtttgaagaaagttctgaaattctcctgaaggagtttcttaaggtaagcttagcgtatgttgttctgaatattttgtttggcatgcaattttgcttcccaaatgggtgaataggcatcactggggagtttttgttttgttcctgattagaatgtttttgtcattcccttcttcaagtgaaacatagaaatgatgataacactaacattagtatcagcagtatgcttagtgggttaagaatcccttggatattccccagttctctagagtcttaaacacacacacacacacaagcttccaccctgaaaaggagttgtgtgtagttacctttctattcatctaacaaatatggtgcttcttattacttttaaaaatagattactaatagatcaatatctgttgttgaacatttgacagtgatgaggtagcttgttatagtggaaagagattagaaatcagaagactggccaggcacagtggctcatgcctgtaatcccagtactttgggaggccgaggtggccagataatctgaggtcaggagttcaagaccagcctggccaacattgtgaaaccccatctctactagaaaaaataacaaaaattagccgggcatggtggcatgcacctgtaatcccagctactcaggaggctgagacaggagaatcacttgaacctgggatgcagaggttgcagtgagctgagattgcgccattgcactccagcctgggtgacagagcgagactccgtctcaaaaaaaaaaaaaaaagaaatcagaaaacttattctcatgccctggctctgtggttttactaacctgggcagatcactaaatcactctgggtatttattttgtcttcagttaaactgggattcatacctgccttgtctttctcatagagttgttgtgagggccaataagataacttttgctggcatggcactttacagttgactgtgggtcccatggagccatggtcccaagagctattcctccatgaaaaaaggttgagactctacatcctgtctctctctagcaattttatagctgacattagcatattaaggttttgagaagtattatagtaaataaactgaataccctattcaattcagtttacctaaaccatgctatgggatctttcctttttcatgcatttataactgataggactgcttgggaaactgcattaaacaaataaatggaaagcctcttgtggagaatatttcaatggattaaccagcttcctgtgtcgtacctaactttttgaatttagaatggttattaaattaggggcctagagaatcggaattgttatacagagattgtcacggtaatgaccttgattgtaatgcagtttaattttttatcctcaaaacatcttgtgagttgtattatggtctgtattatgatcctcattttataaatgcagcagtctgggaggttgagcagattgacgtaaggtatataactacttaagagaatgagccacaatggcactcaggtctcttggctaaagcaagccaatgatgtatccagtcttcaccctggctttaccacaggaggagtaggggatcttgtatgaaaggagtgagagtcggccaggcgcagtggctgatgtctgtaatctcaaccctttgggaatccaaggtggacagatcacctgagggtcgggagttcgagaccagccaacatggagaaaccccatctctactaaaaatacaaaattagccaggcgtggtggtgcatggctgtaatcccagctacttgggaggctgaggcaggagaatcgtttgaacccaggaggtggaggttgtggtgggccgagatcacgccattgtactccagcctgggcaacaagagtgaaactccatctcaaaaaaaaaaaaaaaaaaaaaaaggaatgagagtcaactgcaccttttaggaatcagccagattgatgtttggcagagctgctgtacctgccaaaccagtgcggggtaatagggagatctgctgaatgcttctttatttgctcattttctagcctgagaaattcacgaaagtctgtgaggccttggagcatggacatgtggaatggagcagccgaggtccccctaacaaaaggtagaacccgtcatctgagatatttgcttctacattcagcacctataacatttttttataactagtaaaatgacaaaaagcctaaaggaaaaatagactgaggtgatgacaggcagttcatgaaagaaaatcaaataaccaacaggaaaaaatatacaatcatgcaccaaggctcacacccaataataggacacttgccctaatgatgttttgttctcagggacatccagtagcaggatgtcctaacaaaatcctaacaaaatctcactattgtaataacttgtgccttagtaagctgtgccaagatttaggaagagaggtacaaagctaacgatcagcttttattctgtgagtcattttacatctgtggctttgatgaacaacttgacattgctgtttttcaggttttatgagaaagctgaggagagtaagcttcctgagatattgaaggagtgcatgaagttatttcgctctgaggcactattcttgctgctctccaacttcacaggcctgaagcttcatttcttggccccttcggaagaagatgagatgaatgataaaaaagaggcagaaaccactgatatcactgaagaagggactagccatagtcctcctgagccagagaataatcagatggccatcagcaacaacagccaacagagcaatgagcagacagacccagagccagaggaaaatgaaacaaagaaaggtaagctgttgttaggatttgtccttacttaccattaaccattcaccattcaaacatgtattcattcaacaaacatttattgagcatctactgtgccctaagccctatttcaggaactgaaggacaaaacagacaaggtctctggtctttgggagcttacattctagtagaagaagacagagattaaatgtatacatgaacaacaagaaaacgtcaagtaatgataagtgctatgcaaaacattgtaatagggttatatgacaagaaatgactgagtaggccaggtgcggtggcttacacctataatcccagcacttttggaggcggaggcagtctgatcacctgaggccaggagttcgagaccagcctgaccaacatggcaaaaccccgtctctactaaaaatacaaaaaaaaaaaaaaatttgccaggcatggtggtgaacgcctgtaatccaagctactcaggaggctgaggtggaagaatcacttgaaccggggaggaggaggttgcagtgagtcgagattgcaccattgcactccagcctgggcaacagagcgagactacatctcaaagaaaaaaaaaaaaaaagaaatgactgagtagcctcttaggcgaatagatgatttagaaaagtctctctgaggagcgccatttaagctcagatctgaatataacagcctaagaatttaagaggtaacactcctgtgaaaatattggcaccattaaaaagtagcaacaaattcagcttagatgtttcagcacttactactatgtcagtgagaacatctgtcacccagtttaccattccctgcttccactcaaatttcttgagaaccctgtgcagttaggagagcagagacaaggggtggatacttgtggaaacaaaatcagtggtttgagatgctaactgaaagcaacataactcattctgtggccttccaaaactgactgaacagtcactttggccactgcagatatttagtaaaaccagacccaggtggctttttctgtgctatcttaatacacagggtagcctttctttgaaagattagttttccatgttaattgatactggcatttatgcctagaccctaagaggaaccagagtcagtatccatggagtctgtctcaaagggattttttaaaaaacttatccacttctgtttgtttgtttgtttgtttgttttgagacacggtcttgcactgtcacccaggctggagtgcagtggtgcaatcacagctcactgcagccttgacctcctaggctcgagcgatccttctgcctcagtatcccaagtagctgggatcacaggcatatgccaccacacccaactaattttcttgatttttttttttttgtaaagatgggatcttgccatgttgcccaggctggtctcaaacccctaggctcaagtaatcctcctaccttgtcctcccaaagtgcagtgattacaagcgtgaccaatcacacctggccaaaacttgtccagttctattccttttttggtttcatttttacgggaacctgcaacttaggataaaatctatatgggcagccaaaagatgctttattccattgttgagcacctactgtatacagggggccttgggtgaaagcagagtagggaatacaaaagtgaaagagaaaagtcactgtttacgaagtttaccatcttgaagaaaagctataaagcttggcaaaagctatcaaattgctgggcatatgatagcagtgctaaacattggcatagctagggcacatctagtgagataacattacagacctgataacttgaagatgattttaaaaaataaaaatacgtcaatttcagaatgtttagaaaacaagaaaaaggaaaataataatctacaagtggccatattagcatttggaatatatccttccactgtttttttgctatgtagacatatacatgtatacacatatggggggtatatttttacacatctatttttaatgagattataccatatatattgttctgtattttttccacttaatatttcataaacctctttctgatccttttacatcctttataacaatagaacaggtttgcacaccctcctcacttaggaaaccttccaccaaagcagttttgctttttttgttttggtttggtttggtttggtttggagacagagtctcgctctgttgccaggctgaagtgcagtggcatgatctcggctcactgctacctccgtcttccgggttcaagcgattctcctgcctcagcctcccgagtagctgggactacaggcgcatgccaccacgcccggctaacgttttgtatttttagtagagacggggtttcaccgtgttagccaggatggtctccatctcttgacctcatgatccgcccaccctggcctcccaaagtgctgggattacaggagtgagccaccacgcctggccaccaaagcagttttacatgtatctgctttccaacattgcatttctagaagcttttatttcaagaatgtatgccacaattaagttttgaaaaacaccgttctctagtatactttttaatgcttgcaatctattggatcagatgaccttaaccagtcctgtgttgagcatttagattttttccagttcttcactgtcataataaacgacacatccattgtgtcttcagaatgcttctcagaagtacaggtgatacatcaaagactgctcaaaattttaaggcagttgccaaattgcctccccaaaacttgtatcagtctgcactcccaccagcattgtacatgatgatgttttcattcttcctagcaaactgttatattttcttttccaacttgcttattctttaggtggaaatggcattcgcctatcattgactaatggtgcgtggttgtatatttttccctattggttacttgatttttttttttcatgagttgcctgtcattacctcagtgtatttttcctttgggctttttgtcattttattagttaattttaaaaagttacatataggagtattaaccttctttttttttttgaggtggactctcgctctgtcacccaggctggagtacagtggtgtgatctcagctcactgcaacctctgcctcccaggttcaagcgattctcatgcctcagcctcctaagtagctgggattacaggcacacgccaccatgctcagctaatattttcgtatttttagtagaaacggggttttgccatattggccaggctggtcttgaactcctgacctcaggtgatctgcctgcctcagaggagtactaaccttctgtttaacagattgtaatagttcattttttaattttgttcagcatggtttaaattttataaaatattttagtaatcaggtctatctttgcctttcctcgtttctactttaggtaataacatgctgagaaatctcttaaggttagataaaataatattcatgtcgtattttttatttttttgcaactagacttcttttccatctgaaatttattattatagagagaaatcaaaattcaacttttttttttttttttttttgagatggagtttcactcttgttgcccaggctggagtgtaatggcacaatctcggcttaccacaacctctgccacccgggctcaagcaactctcctgccttaagcctcccgggtagctggattacaggcatgcactaccacgcctggctaattttgtatttgtagtagagatggggtttctccatgttggtcaggctggtcttgaactcccgacctcaggtgatctgcccacctcagcctcccaaagtgttgggattacaggcatgagccaccatgcccggcccaaaattcaacttttttaccccaaaatagagctggtaattcctaacaatcttttataaggctggattggtagaatagcacttcaatcaaaggtttgtgggaatggtttccctgtgttgctgtatcattcctaattatgattcccttgcaatccaacagttctatcaaggttattttttaaagtttctcatctttttttttttccttagaatcaagtgttcccatgtgccaaggggaactgaggcattggaagaccggtcactacactttaattcatgaccatagcaaggctgaatttgccctagacttaattctgtactgtggctgtgaaggtaagagggaggaaagcaagcggtggattattccccgtaggaggggcagtctcttctgagggaccctttccagctgaaccaattcataagtaatttgcctagttcagaatctcacatcatgggatctcaaagtcaaagggattttacgggtcatgaattccagtctcccagctcaaaataggatttatatctgtgactaggaaatggggagatggaccacaccataattttcccctaagtgtgctcccagatctatagattttatgtaattgcccttctgggaatatttagcatttaattctctcttaattttcatattcaaagtttattgaaataagactgcatttcagttcagctgtctcaggaaattaggcatttaggggaaggcaatccatgataaactagatgataagttcaagctcataagtcatagaaccagttactgctgaactcccagatcccccactgttaagcagcatgggatcagtgatttaagtagatggtgcgactctttcaataggagctttctgaatgctgtttgtttttctcttgtaaggctgggagccagaatatggcggttttacttcttacattgccaaaggtgaagatgaagaggtaagtttcttctgatagcaaactatcatttttagttattgagaatgctttcatttttcaaagacccaatttttatgaccttctaccagtgtctttagctaataaatctctgccaggcaatggttctaatttctagtagaaaatactcaggatggaataaagatgctaaaggatactcagtaagcatttattttaccctcctgagaaattccaaattaagagccatgtggtgcattcccacaaatcttacaatgtagtaagaaataaatgtaataggtaagtacctttctaggtatatgctggaatagggcttgttggaaaatggcttgacagccacccctagtaagtgttcattcagaggacccctctatccccagattaagtgcttgatatggaaaccatctgttccatggttaatcatccaagatttgagaataagttctgtgttctgatgtgtcactgtatttgtctttttcagctgctaacagtgaatccagaaagcaattctttggcattggtctacagagacagagagactctgaaatttgtcaagcatattaaccaccgaagcctggaacaaaagaaaaccttcccaaacagaacaggtttctgggacttttcattcatctattatgaatgacagcactgggcaaagctgaacaaaaatgtgacccttcgtaattactgggaagtctgaaagagctaagcatggagtcaaggagaactacatggtagcttgcctgacagtgttcttaaaactggttgtcttttactaggactcataatgattgtcctcaaccgagaccttgagcttgcagctaagtacttatctcttgattaaaaaaaaaaagttggcttttttttttttaacatttagtcctttttccatattggcttcttcagtgaatttttaagttcaatttgtttttattgaggtaaaatatttataacataaaactgaccagcttacccatttttaaatatgcaattcagtggattaagtacattctcattgttgtccagccatcaccatcatccatctccagaagttttccatcttcccaaattctgtgcccattgaacaataactccccacctccccttcccctagcaacagccataccttttgtctctatcatcaacttcactactcatatttctcatgtaagtggaatcatacagtatttgtccttttgtgactggtttcacttagcataaagtctttaagatgcatccatgtttccagtgtttcggtttttttagaaaaactcatacgtgattgcagccgggcatggtggctcacgcctgtaatcccagcacttgggaggccaaggcaggcggatcacctgaggtcaggagttaaagaccagcctgacaaacatggagaaaccccatctctactaaaaatacaaaattagctgggcgtggtggcacatgcctgtaatcccagctactcaggaggctggggcaggagaattggttgaacccaggaggcggaggttgcagtgagccgagattgtgccactgcactccagcctgggcaacaagagtgaaactctgtctcaaaaaaaaaaaagaagaaaaaaacataagtgattgcagaattttgttcttctcataatttctggtttagaaaattatggagccttacatcctgatcatgctgggccttagaattctgacacagtgagtcatcacatttcctcccactgcctgtggccttgttccaccatgactctcacagtacagtgtaggcttagtgtagtattattcccttggaaagggtctggcctaccatcacatgccccaagaaacttctggttggtaaagaagataggctgcttattgccatgtgtagtcacttccaagtgcccactgcctttccatcctgcaattgtggcctgtgtataattaaatgattttagcctcacgtgttgcttctgttttcctaaatactgtagggtcaactatataactaattgctttttattttaagagacggaatgctaaaaccacatcagaatgccaagaggctgtgcatcttgttaatttttttcttgaactgttccagggagttacatcataattacctgtgtgtgggtatgcatgggtggatgaaagatgctgttctcattccatcccaatagagtcttctgtttcctttctcttttttacatttatttttagcttttgcagtagtgtttagtgtgggttttactaattaatagaaaaagcactgggcctttaaacttcttaactactcttctctttcatctcctaaaacttttgagtattcattcttttctgaagtttgcatttaaatgaaaatgactttcgctttggcttttaggtttagtttcaaaaaggtttaattctgcaccctagccagttaagaaatgttttagcaggtatgcccttgatatggatatttatatattttacacatgtagtaatattatttctataacttactgttataaaacactaatttttaaatgatgagataaaaagaaatatctagaactagttctaacattgtcttcccctatgcatatggtaacgaaccattttacaccatactattttggagaccacaattttttttgcgtttgagatggagtctcactctgtggcccaggctggagtacagtggcatgatatcggctcactgtgacctctgtctcctgggttcaagcaattctcctgcctcagcctcctaagtagctgggattacaggcacctgcctccatacccagctaatttttttatatttttagtagagacagggtttcaccatgttggccaggctggagaccacaattttttaaccacagtgtagcaacactcaagtgggattgcgaatactgttactaatggttaatgtcacagcttgccttttctatattccagctgactaaaggtcatctcactcacttgccttctgatgtgttttcatgagttgaggggaaagggtgtcagtggcataacttcaggaagacccagggaaaagtgcttgggtaggtgaaactgtcatgtgtgccaagcttggaaaatagtttgagactcatggctgtaggcaccatccaaggccaattttccaattctggaaagccaaatctgaatcttagaatacctcacaagtgttaaaatgtgctttttagtgtctcctttatctcagtgtgtttatgatctgtcaacacataatcatcttttatacactacaaaaagggactcgggtgtctgaggggagagaatccctaggagcccaactctgatgttgctgtcagttacatcatctacagcagcacctcttagattgtgaaggatggtgtaacttaaaagattgtgtttctgcactgaagatagatacacagtgatagtgaagtttgttttccttatagtacttcattttgcatcttgattgctttttagggcctggggccaatgtcaacaactcttaggtagcaaaagaagaattagaacatgggcatcttttttatacctctttcagataaaagctatgatgttcacctgtaaaatatatggtttctctctttattcttaatagtgagtctccaattcttataactcccatttttatccccaaagaaaatagctctatgggcccggcatagtggctcacacctgtaatcccagcactttgggaggccccgaggctggcagattacctgaggtcaggagttgggagaccagcctggccaacatggtgaaaccctatctctgctaaaaatacaaaaattagctgggtgtgctggcacgtgcctgtaatcccaggtacttgggaggctgaggcaggagaatcgcttgaacccaggagggaggcagaggttgcagtgagccgagatcgcaccactgcactccagcctgggcaacagaacaagaatccgtctcaaaaaaaatagctttctgttttttcagactatataaataacacatgctcattgtgaggtaataacatgtaatatctaaggatcacctgaaatcccaccatcctatgacagccactggtagctttgtcatgtatcaacttggctagactgaactacatttcccagaactctcttccctatgtctcaggttaggatgagccacaaattcctatgccagatctgcagggcccaatgcagcagcagcccttgagtagctggcacaccttgctggtgtgaaccacacctgtgcctgggcctgcaaccgctccaccttcccctggatggatcttccttcagctcctctgtgaagggtctcagtttcagcagaatgcccacaccatcaaggtcagaagcaacaagaacggacagattttagcatcctcacgggctccagcccatgcctgtgggttgcagcttgttctccccaactccacatcttttctgactacccgccctatgggcttcaagctccagcattggacaggaagagaacagccttacagagactacttcactacttcttctttatatgttaaccatactggaaattaggaacgttttaacaaaacttgtgaacatatttgcatctttgaataagaagaaaaataaaatgtctaaggaagtaccctataaataacactagtccttaatctttaaaattaggtccacatctttaattttaaagtccacatctttaaaatgtggaaagttagggttccaaaagaaagaatctgttagttttgaactgggcttgtctactgtttaaagattgcctctcaaaattccactgaatgtgggtttcttccccacagaacaccccctcacacacacacacacaaaaaaaaaaaaacaaaaaaaaaaacaaagcttgggttacctctcccagaccagtattttttattttttattttttattttttttgagacggagtctctgtcacccaggctggagtgcagtggcatgatctcaactcactgcaacctctgcctcccaggttcaagcaattctgggattacaggtgcctaacaccacactggctaatttttgtatttttagtagagatgggatttcaccatgttggccaggctggtctcaaactcctgacctcaagtgacccacccgccttgacctcccaaagttctggcagtatttcttgaataagaagttttggggtgcattactgcttcaacaccatgacatacttaaccactactaaacaatgaggaagcacaaaccctgttgaaaagggtcgaggagatctagtgaagtgatgccagaggagggctctccagcctgcatggaaatgggtgtcctgatgattccctctctgatgcaaaatcagtccacaaagacaatttaaaaacgacttgggaactgtccatgtgacatcacttttaggaaaagcagattctgtactgtacagattacaagatgacttcagagctagagcatagagtgtgggcaggggccagatggaaaagaggcaaaatgcgaaacaccaggctgtaatgggtgtcttactgtacttgagtttccaaatgaaattggaggtaatttagttctataatgacaggactgtgcattggcagatctgtaactgctaattataaaatttgaaacattaataacaatgttgaaaatctttcttgtaaaacacttctagggttgcataatagttttaaagttcctagttctttgatttctgaagctgctgacaggcgtattaaggacagacaatcccaagcagagcggcagatgctattctatgctcaaggcactggctcagcactggggcgagggtgacgctggttaagatgcagacaccattcttgcttaacaggggattaagatttaagtaaagaatttaataagggttaaggagtagacatgggagaggaaaggtcacctaaggagagagcatttgagcggggctttgaggtactggataggcagtcatggtgggaaataatacaaattatactcttaaaaatcctcagaacctgaattatggtactgaaagctttctctcagatatcaaaatcctcaaagtcagcttttaaatgacagctcagtgctcacttaaagcttcaatgtaattcagcagtgaaatacagctttgctgtagcttctagaagtactcagattctatcaggatagaaacatatggcaacaaaatagagaagttactgataaactcatctctccttgtccagtttttcctcactcctaagctgaacaggatgagttctaagttgggggaaaaaaggtagttgcatgttttatgaatgttttcacttcggccagtctttacttgcttgggaagtttggagtagaagaggccgtgactacttgtttccaacacctccttcacaccagggcttacccagctgtgggaccctgtacaggacactctgtcttagagctcagagcctcatctgtgaaacagacaccaacatcaacaggatcaaattactgtgaaaataacctatgaatcagaacaacttaatatgtcttgctgcaggtcaatgccttctagcctggccatgagtatttttaggtctaagaaggaagttttttagctaaagaacaacagagtgacctttgatgagattatgttattagactccctaaaaatgaatggcattatataatttaaaactagcaccaactagagattttaatctcaaatggtataaattagactatggttaaaacaaagactcaacagtaggactcaagtttcctcttgagtcactagacaggtcacacaggtcactaactctgtgacctgaaaaggaggttatttatgcctcagtttcctcctctgtgaggcacatttatttatttatttatttatttttgttttggagatggagtctccctctgtcacccaggctagagtgcagtggcatgatctcggctcacagcaacctctgtgtgaggcagatttacgatgatactttactactttggagattgaaaataatacagtgtatgtggattatctcttgagtttataggttgaaaatgaaaaacaaaagtattagcatattctcataattaggactccataaggcttaaatttcagatataggaggggccatcgtaaagtggccacatcaaaatcaataaaattaatgtttactaacctcagggaaatgctccacttcccctaaacagctattaagatattaaaactaactgaagtttcactcattaaaccagtcctgaaatctacgttagggcgaaatttttcctagggaagagactgctagctattggcacaaataccagcgttcctacaggcacacagctagattccatctcccggcctcccctgcagatgtggtcatgtgactcaatggaattctgaatggaaatgatagtgtgctactttcagaccacacttttaaaagaagaagacatgtttccctcttactctcttctaccggctcagctatatggtcatgctctgctaacaacagcagtacagtctgagaaatgcattgttaggctactttgtcatcatgtgaacattgtacagtgtgcacttatacacacctagatggtatagcctactccacacctaggctatacagtatagcctgttgttcccagcctacaaatctgtacagcatggtactatactgaatactgtaggaaactgtaacataatgctaagtatttgtgtaattatacatatctaaacacaaaggtacagtaaaaatacagtattataatcttatggtgacctaaacttcattatctggtacatggctgtaaataaccacaaggccctaggacagcccttgtcaaatagtgttccaagtgagataataaagccccactgccctaagacctccctccactgtatgtactgaatgtgaaactagtcacccaaacctttttccttaggcttagtcctttagtgaactcaggtagaaaagtttgtcctaggggatgacagagccacatgattaaaggaacctgggtccctgcataactatggagaaatccttacataataaatgaaaaatgagtcattatgattttgaggtctatttgttacagcagctaacattagcccaacaaagtaatcactctaaattgactcttccttaatgtaaatttgttgtttgcacccatctttcagtgattaaaaagcacacaaatccaaatatccacatttttttttttttttgagacagagttttgctcttgtcacccaggctggagtgcagtggtgcaatcttgctcactgcaacctccacctcctgggttcaagcaattctcctgcctcagcctcctgcatagctgggattgtaggtgtccaccaccaaacctggctaattttttgtatttttagtagagaccaggtttcatcatgttggccaggctggtctcaaactcctgacctcaggggatccacccgccttggcctcccaaagtgctaggattataggtgtgagccactgagctcagcccaaatattttttttttttttttttttagacgggagtcttgctgtcgcccagactggagtgcagtggtgcaatctaggctcattgcaacctctgccacccgggttcaagcaattctcctgcctcagcctcccaagtagcttggactacagatgagtgccaccatgcccagctaattttttgtgtttttagtagagacggggtttcaccgtgttagccaggatggtctcgatctcctgaccttatgatccgcccgccctggcctcccaaagtgctagattacaggcataagccctgtgcccagcccacatttttgtttttctctactacaaaatacaaatgggcaattctgatttggtggtgattttataatcaatcaacacaaagtttaacatctttacattttaatgaaaaagtagataatctatttgaaaagtacaaactcaattgcaatttcaagaaaaaaatatgtatttatataccataaataagcaaaattggactctgaagccctaatacttcaaaagcattcatcctattccataaaaacctagtattattcagcaacagtactactactgatttaaaaatagaaagcaagtctatcttcacatgtagttctttgtctttaatttgtacaactcaccaaggttattttcattcttagcacccggggttcaccagggtgtgatccaaagcaaaccagcataggtttttaacagaaaatctttgccaggaacttcatgacctgtattttcctcacctaggaagaagctgtccccactcgcatgattttgaacagtgtgttgatgttattgcttcgaattgcatcccgacaagcagtgatcacctggttctttggttttccaactgcataagaagaaacatcaggaaccaaaagattgttagacatgaaattataaaattagacgtcagttttaaaacaacataaaaccaggagggaaaagagttatacttgaaatatgatttatcttaccattccctaaaaaaaataacttggtgagggaattattgaaaaaactgacttagagactgtctcaaacctagaaaccaacagtcagttttacagaaaaggatcaaagctcatagtcacctagcaaagattatttctaaagaagtcaaagcatcgacccaaaacagcagaattcaggtataaatctctggctatatttctgcttccttgggtttatcctattgttcttttctaaatttttaagttagacacttagcattaattttcagtctcttttttgctaattgggccttgatggttttatttatatatatatgtttatatatttcctttgggttatatatagtaggtttttctttagaggatgcaggaaggtctaagaaaaggagctgaaggttttctctccctttgaagtccggagacaaaagccaaacactaggccgactgactgaaacataagtgactggtgccagctctggagtgtgaaaggtatgctactttcagccccaatatgaattattggatgctaccaccatcttcaatgagttccaccaaaaacattacagatcaaagtgcagtgttatgaaaagagacttaccccgcagacgacctgctctttgaattgcttgatttactgctttgaggtttcccaacagctctgtgtgattgttacagcgaattttatatccatttagcaagtctctattaaggtcatagagttccatataacgactcttcattgttttcctgtgcaaatcagtagaaatttgacatcatttcatgttgatatggcaagcttaagaaaaacttgcaaatttcttagacatacaaagaaaagacaccatttttaagctatattttcattaaaatcgagtaactgctagtttgctttgaaaatacggataagttccataaaaatattcttttccttccaaataaacagaagacaagtggccttccttggttactggtcaatggttgatttaggtggttaagaattctcaagcccactgtgctgggagtagggacaagtgagcaaggtgacagcccaccttccaagtttcagatgaatattcattagactaaagtggcctggttgacaactcagccttgtattttatcaaaggtttaaaacaaagtcataaaattaaaacagaaatgagatctatactacacaacaatgaaaataactaaagaaaaatatagctgaagataccaaatgctagcaaagatgtgggacaactggaactttcatgcattgtggacagaaatacaaaaagctgcaactactttgacaggtgatttggcagtttcttataaagttaaacacacaatgtatgacccagcaatcccattgtaaggtatttacccaagagaaatgaaaacctatgtctataaaaaacttgtatgcaagtatttatagcagctttattctactcaccaaagtctggaaacaacccaattatcctcagttggtgaatagataaatatcatatatccatacaatggaatactattcagcaataaaaaaggaactacaaatacatgcagcaacatggatgaatctctaagacattatgtaagtgaatgaagccagactcaaaaggatatatagatatagatacagtatgattccatttatatggtattttgaaaaggttgaaactacaggaaaagaaataagatgagtggtttccaggaactggaggttagaagaggtattgatacaaacagtcacaagagtgacagaaatattcttttttttttttttttttttttttgagatggagttttgctcttgttgcccagtaagctagatggagtgcaatggcacgatctcggatcactgcaacctccacctcccaggttcaagtgattctcctgcctcagcctcctgaataggtgggattacaggtacccgccaccacacctggctaattttttgtagttttagtagagactgggtttcaccatgttggccaggctggtctcgaactcctggcttcaagtgatccacccaccttggcctcccaaaatgctgggattacaagtgtgagccacccggccagtgatagaaatatcctatatctcgattgtagtagtagcaacatgattacataagtttctcaaaattgattaaactgtaaaccttaaaagcataaattttctgcatgtatgagttatatatcaattaatttgatttaaaaaaaaaaacaaatgttgacattttgcaatcaaatgcctaaagccagcaaccatttttgacttaagagagagatagagagatagagaaactagggaccctacagatagttggccaaaaagagcaaatatctatctcaatttacagatgatacaagaatacatctggaaaaactataagatagttagtaaagggcacattataaaatcaacagataaaaatcagtgttcatatgtacaaacacaaaaccataattatagaataagataatgtaaaaaatatttacaattataaaatatttcgtaattgtctaaaaatacagaaaatacctaagcataaacttaaaattggtaacatccagtatctacaagagtaaaccatgaaagcactccagaaagacacaaaacatggcttaagcaaatataaagacatagcatgttcttagctagcaagaccaaacatcactgcagcagcatcagttctccctaagttaatgcatttaacatcatctcaattaaaatacctatttttgttacggagctacaaaaattgctgatgaaattcattggaaagaacaaacaagcacaagtagctaggaaaaaccatgaaaaagaaaagcaacaggggttggggacggggcactacccacaccagatattgaaacatacaaaacatccatacatgaaagaatggcaccatcactggtagttgccagagctaaagggaagggagaatgggtagttactgtttaacgggtacagagtttcaggtttaagagataaagaattatagagatgctgctggtggtgatggttacacattatgaacgtatttaatgccactgaaccgtacactaaaagtagtatacagtagttaagatggtaaatttcacattgtgtagttcaccatgagtggggaaaaaaacaaactgttcctcctctgctcccacaccacaacaatcaacacagaagacttctgtcctcaactgtgtggaggtttttcccacacaccaagaaaacaatcagttctatagcagacaccagctgggtgtcctccaattccgttccgacacgattcccccggagacactgtcagatctcacagattaagggctcagtcccacaagactgcctgacttcagatacatatcacaagttcaggctgccagaatttctgactgatctgcttcaagttagggttcccatgaccccctctgtgggtttgattaatttactagagcagtacatagaacccagggaaacttaatggcatttgctagtttattataaaggatattacaaaggatacagatgaagagatgcatagaacgaagtattagggaaggcgcttggagcttccatgccctccctaggtgcatcaaccttcaggaaactctgtgtgttcagatgtctagaaaatctctgaatgctgtccctttgggttttgatggaatcttcattatttgggcatgactgactaaaccactggccataggtgatcaacttaactctcagcccctctccactccctggaggttgggagaggggtgggcagaaagtcccaatcctctaatcctgccttggtcgttctggtgactgacccctatcctgaagctacctaggagctgccagccataaaccaatcaatagcatacaaaaagacatcactttggagagcctaagattttaggagttattatgtcaggaaacagggttgaagatcaaatatgtatttcagaatatcacaatgaaatttatattttcttttttagagatggggtcttgctatattgcccaggctggtcttgagctcctggcctcaagccatcctcatgcctcaacctcccaaagcactgggattatagacataagctactgcacccagccaaacattaaaaaaaaaaaatggccgaggcaagaggatggcttaacctcaggagtttgagactagcctgggcaatatagtgagaccctgtctctaccaaaaataaaaaaaaattagctgggtgtggtggcacatgcctgtagtcccacctactcaggaggctgaggtaggaggatcccttgtacctgggaggccgaggttgcagtgagctgtgatcacaccactgtgctccagcctgggcaacagaataagattctgtctcaaaataattttttttaaaaaagaatgatattgtcaaatgaagtgacaagtcagaccaatggaatagtacagaaaatccagaaatagattcaactgtgtacagaaatatgatatatgataagggcagtatctgaaatcattgtaagcatgatgaactttaaaagaagtagtatcaggctgggcacagtggctcacacctgtaatcccagcactttgggaggccgaggttggtggatcacctgaggtcaggagtttgagaccagcctggccaacatagtgaaactccatctctactaaaaatacaaaaaaaattagctgggcatggtggcgcatgcctgtaatcccagctactcgggaggctgaagcaggagaatggcttgaaccaggaaggcagaggttgcagtgagccaagatagcgccattgcactccagcttgggcaacaagagcgaaactccatctcaaagaaaaaaaaaaagtagtagtattaaaataatgcaatgtggccaggcacagtggctcacgcctgaaatcccagcattttgacaggccacggcaggcagatcgcttgagcccaggagttcaagaccagtctgggcaacagagcgagaccctgggtctacacaaaaattagctggctatggtagcacacgcctgtagtcccagctactccagcagctgaggtgggaggataacttgagcccaggagatcgaggctgctgtgagctgtgatctctctgcactccagcctgggtgacacagtgagaccctatctcacacacacacacacgcacacacacacacacacacacaaaaataataataatataataataatgtgatagtcataaggaaaatgataaaactgagtttattatttatatgaacaccaggataaactccaactggaacagagacttaatgtaaaaaagcaaaatatacaagtactaaaggaaaacagatgaattactctataccctgctgttaaagaaaacttttctaacagtaattcaaaatgtaaaagtattaagaaaatgtggctgggcacagtggctcacacccgtaatcccagcactttgggaggccaaggcgggcagatcacctgaggtcaggagtttgagaccagcctggccaacatggtgaaacctcgtctctactaaaaatacaaaaatcagccaggtgtggtagcgctacttgggaggctgaggcaggagaatcacttgaatctgggaggcagaggttgcagtgagccgagatcacgccactgcactccaggctgggcaacagagtgagactctgtctcaaaaataaataaataaagtattaagaaaatgacttacattttcttaatgtagtcaaattttcttataatttgactatatacaaaattttaaaagctcttacaaggtaaaaccaacagtaaagcaaaattttttttttttgagatggagtctcactctgtcacccaggctggagggcagtggtgcgatctcagctcactgcaacctccgcctcccgggttcacaccattctcccgcctcagcctcccgaatagctgggactacaggcgcccgccaccacgaccggctgattttttgtatttttagtagagacagggtttcaccatgttagtcaggacggtctcgatctcctggcctcatgatccacctgcctcagcctcccaaagtgctgggattacaggcgtgagccaccgcgcctggcccattaaagcaaaattttttaaaaatctaagcaaagggaaaacccaaatgacaaactccggaaaacatatttgcaactcatatcacacgtaagagattaatatacccactatggtttggatgtggttcgtccccgccaaaactcatgttgaagttgaaatgccagcacagcagtgttgggaggtgggcctagtagggagtgtttgggtcatgggggcagatccctcatgaatagattaatgccattaatgccatctctcaggagtgagttctcgctcatgcaggaatgaagttatcaaaagagcaggttgttataaagttagggcacccctcaggctttgcctcttcacacatgtccccttctcctttgaccttttctgccatgttttgacttcacacatggccctcaacagaagtcaagcggatgccagtgccatgtttcttgtaattcccagcctacagacccataagctaaatcaacttctttcctttataaattacccattctcgggtattctgttatagaggcacaaaatggactacaacagtacctgatatgtaaacagacaaatagttcacacaaaaaagaaatggaaatggccctgaattaaaacaatgaaaaatgcccaatactgaacataataaatggctcctacaactcaacagcaaaaaaaaaaaaaaaaaaaaacactagtaatccaattaaaaaatgagctagggacttgaatagaaatttctccaaacaagaaaagcaaatgaccgacaggtatataaaaagacgcccaatgccactagtcatcagggaaatgcaaatcaaaaccacaatgaagtatcatttcacctttgtcaggatgaaaattatcaaaaaaaagacaacaagtgttggcaaggatgtagagaaactggaacccttgtacactgttgattacaatgaaaaatggtgcagccactatggaaaacatttaaatattaaaaatttaaatttttaatgattaaatattaaaaatttaaatttttaatttttaatgattaaatattaaaaatgtaatcaaaaaattaaaaatagaactaccatatatgatctagcaatctcacttccgggtatttatccaaatgaactgaagacaagaccctgaagacctattagcactcccacgttcatcaccacactatttacaataaccaacatgtggaaaaaacataaatgttcatcaacaggtgaatggataaagaaaatttagtacatataaacaatggaacactattcagtcttaaaagagagggaaattctgcaatatgtgacaacatggacgaactctgaggatgttacactgagtgaaataagccagtcatagaaggacaaatattatatatttgcatggagtatctaaaatagtcaaattcataaaatcaaagagtagaatgatagttgaaagaggggaagaagaaatgggaatttgcttaccaatagtttcagttaagcaagaagaatcagctctaaagatgtgctgtacaacactgcacctatagtcaacgataatgtattatacacttaaaaatgtgttaagaaggtagatctgatgctgtggtcttaccacaataaaataaaatttaaaaaataaaaattaaaactaagagaccatttctcatcccctggagtatgcccacaaactccactggcaaggctgaagagaaacaggcaatctcatacattgcttatgggaatacaaaatgaggtaacacctatggagaatttgacaagaccttgcaaaattctgtatgcatgtatcatttactgcagtaatcccatttgttaagcctttttctcaaactatcctggcaaaaatataaaaagatttacgtaacaaaactattcacttaagcattatctacagtaaaaaaaaaacaatccaaatagaggaaactggctgaaaaacagccagaaaatggagtactatgtagccgtaaagacaaatgagatgtatttctctacaccatggtggagaaatctccaagatatattttaaatgtaaaaagcaaggtggaggctggacacagtggctcacatctgtaatcccagcactttgggaagccaaggtgggaggatcagtagatcccatgagttcaagaccagcccaggcaatgtggtgagaccctgtctctacaaaaaaataaaaaattagccgggctggtggctcatgcctttagtcccatctactcaggaggctgaggtgagatgatcccttgagcccgggtggttgaagctgcagtgagctgtgattgcatcactacattccagcctgggtgacagcaagaccttgtctcaaaaaaaaaaaaaaaaaaaaaaaaaaccaaggtggagaaaaagatatatacatactatgacttaatctaagacatgaagaggggtgtgtgtgtatatatctgtgtgtatctgcatatatatacttaaatgttcaactggttatttatagtaaaagggagagaacagaatgaaggtcacaggaatggaaagttagacttttccgtgcatgcctgtcttatagatctaactttggaattacaaaaaggttttagtaaatatgtaatagaattaaaccaaaaaggtaaaaatgccaatcctccaaaactgagagcaaaataagacaatgaacctaactctctatcaaatctgtggcataaccaaaagagaaataatctcaaatgattttaagatacagtaatttgacggaaactccctgctgggatatgccctaaagacacaaagaattaacacacaaaaaatcttaaactgttttcagcaatcatattgttgataacaacttggctaatattcttaaatgttgtgtctgtgctgtaaaatgaagcaaatagttatgttgatactgattggagccatgatattcccccacttttttttaagagatcttgctctgtcatcccaggctggattgcagtgtcatgatcatagctcactgcagcctcaaactcctaggttccagagatcttcttacctctgcctcctgagtaactaggactacaggcatgcaccactatgcccagctaatttttttttttttttttttttttgcagagactgggtctcactatgttgcccaagctggtctcgaatccctgggctcatgtgatcctcccacctcagcatcgcaaagtgctgggattacaagtgtaaactaccgtgcccaacctgaagccatgattttcaatgtgagagagaagaggcgcagtaataaaatcgaagagcctatattcataaatctgaatggtaaatagtatgaactcatattttctcattgaaaaaaaaaattcctagctctacgcattgaaaaggcctaaaaacaataatcaacccagtagcaatgaacatctttagtggtcagaccatgatctctaaataccatttctcatgtaaaagaaccaggactcgagagaaatggctggttccatatgaagactgggaaatgtaccagataagcctgaaacatttcatcatacaagaaaacaaagaaccaaccaaattaatgggaccatgtccaaaggtaactgtatccaacctaaagagacttccattgcccacagactggaaaatctagccgtaaaaggccgggcgcagtagctcacacctgtaatcccagcactttgggaggctgaggcgggcagatcacgagctcaggagatcgagaccatcctggctaacacggtgaaaccctgtctctactgaaaatacaaaaaattagccgggcttggtggcgggcgcctgtagtcccagctactcgggaggctgaggcaggagaatggcatgaacccgggaggcggaggttgcagtgagccgagattgcaccactgcactccagcctgggcgacagagcgagactccgtctcgaaaaaaaaaaaaaaaactagccataaaaattaataataacagatataaattgaaacacattaaatatgttcaaatacatgagtatgtaaggacttaaaaatctcattggtcacctagtgcatgctggagatcaacacattattttaaagctgataaagaaactgtctttcctgtacaaactgtacctcagggaaccaaataattcattaattcatgagggaacattatttttcatagaagtatttcaactaatatatgaagaaaagaataacagaattagaatatcactattttgcaaaccccaaaagaaataatgaatctaggcaatgatcatcaatggctgataatatcataaaaagaaacaatcaaaaattgcatgcttcctcatggaagtaaacaacactactcacgaagtattcttgccaaaatttgaaattgaatctaatcaagcctccagatctaccattatctttctatacaggggacagaagaataatactaaacattaccacaaggataccaccagcaaaatccaaaatggcaccccacaggagaaggagagaagagactgagtgggcaagcaaaagtgtggattaaaagattaaacgatttccaaccaaatccaatgtatggactttgatctggattttgatttgagcaagccaacttaaaacacacatgtccacatttataagacaactgggaacatctaaacagatgaggtatttgtaatattaagcaattattgtaaatttttctaagtgtgatatggcattgtgatttttatacagacgtgtgtatatatgtgtgtgtgtgtgtgtgtgtgtgtatatatatgtatatatatatatatgatattgaaaggccctttgtctgaaatagttgtggctagaattacacaatgtccaaaatttgcctcaaaattatctagtgcctgggagggaaagagggtgagtgtagagatgaaaaaagatcagtctttagttgataactgttgaagttgggtgggtggtatatatgaaatcattatatttaagtacttctgtatgtgtttgaaattttcaacaatacaattattttaaaaaccatttacctctgagcaaaaccattataattatttgccaataattcaggcgtctcaggaaaaaacacaagcagcactctgagtgaactcttgcccctaatatatacacataaatttcatctataatttgttaactattttactgaatttttttcagtacattttattggcaaggtaaatttggcatcctagcaagcaccaaggaagacctgtactgtacatacttaacttttttattgtaaaatgttacatattcagaaaaattcagaatatttaatgaagttaaacaagacttcagacaggaagtttcccaatgtgttttttctgaacataatccctccttctctaggagaaaatactatcttatatgataatctcttccctgaatttatatttttatttattgcatgtttcccaaactatagtttactcttttctctaactatacacacggatacattttatagtcttttaagtctgtcttctttcagtgtccattatgcttatcagatttttccttgctcttatgtgtcatggagattcatgtgctctcactgctgtgtagtattccattgcatgaatatatcacaattcatccactgtcgctacactgttcatgctaatttggattgtttccattttgagatttttataaacaatgcctttacaaatattcttatataaatatcctggtttataagcatacatataactaagctgtaactttccctaagctataaaccaggaatagaattgctgggtcatagaggacatgcattttcaactttactgataatgccaagttattttccaaagtcactgtaacaatttatacttctattggtaacatctgagagttgctattccatactgctcacatttttaaccctgcacctgtactaaccatgacaaatactcacatgtccctcatcagacgagcatcctcagctccgaccagcaaacttcggatcaaattagaatgatcagccatatcagcactgagcttctgatgcactgaatgatattcatccacctggagaccatgaacactcaggaatgaaaaaggcctcacaaacttcttgaacccagacaaatgaaaagacactatttaccagatacagagacccccttctttcccctgttcgcttataccaattaagctacttcccgttatttcatctctgtctcaacaagttaactcatctgtgctgcctccaatttcaacacgacactccatgtgaatcttccccatgctttagcaccaggagcccccacaacacacatattaatattttagggatttgcagtgggaatattgtatactttggggccaatcagaatcatctttattttgctcttttatcttgaatttgggtttttggaaagacccaaactgaagaagaccaaagcagatactacaaataagatgaagagctaacaaaggaaaatgttaatatttaaatgcatcactttaaaccaaacaaagcaagcatggtgctcaggagctaaacacttccttttataaaataaatccttaagtagtaaactctccaatactagttcaatttttacttcaagaattgcaaaaattcttgaaaacatcactataacataagtacatttgtagtaccattaatctcctcaaatattattagactaccacattctcacaaatgcatctaccgcattccctcaccttaactagcacctttcgtaattcctcaaaatagacaggaaaatccgcttctacttgaaggtcttcaatagcaaaaaatgatgccattgactggatgatatcaccagccaaatcaatatcatcagtatttatagtgatctacccagagaaaaaatagacaagtttagcatcctcagatgttagacaaacttagctaaaatagtacctgaatttccccatactcaacaaaattattgtgcatatatatatatatgcagtgttgaaaaaggaaagtttagctctcaaagaaattacaaactgcattatttccagcagctagctaaaaggtaaatcctctggccttagaaattaaatgacaaaatcatccaaacattgaaaatgtttttgttgacctctgtattcccaattctttccaaattagacaaggaagagatgaagggaaggaggcagaaaacagctattccaaattataccccagtgtctaaaatggtaacactaacagactaagttaaaccatgtgaaaaaaataaaacaaaacgtggttttatgaccttgacattgatgtcccccacctcactttggactgaatggtaaacaccacatgagaaatctatgcccctctcattccatggtctaagtgtttgaataaataaattcaaaaaagaaatctatgccccgtgatattaaacattacctctccactaagttttatttttatatgcaggtggccgccattccgtaaagatgtgaaacacacttgaaatggagcattctgaatgtgagtgtcttctggtaacagaaagttctgaccgagccatacaacaaccttgaaaatgaacacaatgaaatgacctccatttttaaggtacagacgttcttttttttaatgtgcctctagatatgaaggtacagccattcttgagggaagagttctccttctttctagttttactgctttgttgagaaaaaaaaaaaagaattatacttcatcccacaccaagaaaatactaaaacactagtcacattcccttttctcacctcacctatgctcttaagtaacattcataattatgcctggccccacagcagacatgatttcatagcatcttctacttagacatagtcttatatgcaatgtacaaatgattcaggtatgatgctgattctgttacacaacagctcttctgtgggtataacctggacaatgtagcgtgcttaaaaccattccattctattctttaagaaatgtaaaatgaagtatacatgggcaaacaccacagatatatccacacaataaggaaaatataagttttaatgttaatagcagtaacaccatgcagtggcttgcaacacaggttccacatgagaaccacccatgaggccttctggaagggcccacctatagagtctgtggttccacaggccaggcaggggcctgagaatctacatgattaaaaagtcccaccaagaattccaaagcccagccaaggttaaagtccactggtattagtcctttcaaatgtacaaggtgctactgttacaccaatcatgtaatcctcgggcccccgcaataaggtgggtaagattatccttacttattagataagaaaactgaggctcacactggtgaggggacttccccaagatcactaagaatttaatgagttaacgtagcacttaaagccaaaaacgttcttagctccaagtcccactctcttttcatcttgctgcaggttcctcttgaaatactacaccaggacaaccacactaagaccataacggaaagagaggaattaaacactggtaagaattcaccaataactgaggattgctcagatgctttttcaaagtgagagaaggtattttagcaatatttttattacaggttacaagccacccccaagttaga

SEQ ID NO: 44 - DNA, 171843 bp, Homo sapiens
tctcatccaaattaaaatagatttaaactttaagtgttttttaaatatccagaaacactcataaaataccgttaatactatttgctagggaactctcagaattcttcagaagataagattttcacttaatcaaatccattcaaatggagattgttaaatatggtatgtggggacagagttggagcagaaccagtgatatagcaagagaaccaaagaactgatgttaatcccttaagtacaaataaccttcctaaaaatttattgaactgaagctggactcagtggctcatgcctataatcccagcacttggggaagccaaggtgggcagatcacttgaggccaggagtttgaggccagcctggccaacatggcggaaacctgtctcaactaaaaatacaaaaaaattatcctggcatgatggtgcatgtctataatcccagctacttgggaggctgaggcatgagaattgcttgagcctggaaggcagaggttacagtgagctgacatcatgccactgtattccagcctgggcgacagagtgagactccgtctcaaaatataaaatagaatttactgaactgagatgatttacttacttgatttacttgagtgtttactaaggaagtttagtcttaagatgtctaagataacttaattctatgataattacaactgtcttgttcatattctctgctttaatagttaagcatctctttctaataattactatataacaagtctttgacactgttattttaacaattatttggttgatgggggtctcactatgctacccaggctggagtgttatggctattcacaggcacagtcagtgtactacagccttcatcagactcttgggctcaagtgatccttttccctcagcctcccaagtagctggaactacagacgtgcaccatcaagcctggctaatattatatttatattgaaggatttttattgtttatcttagagttgtatatgtgtatctctaatggggtccatttgtggggagttaacttgttcacatgtacaagtgatgagaaaagttttaaaagaaaataaagtactcttagagaaatagaatgatcagtgagttatttagtaggtaaagtggtgaactgaattttcaaattctcaagttctgatcgtaactctaacgtgaaatttttggctttagcgggaggtaagccatttaatgtcactgggtttttcttttttctttctttcttttgagacggccttgctctgttgtctaggctggagtgcagtgatgtgatcactgcagcctcaaactcctgggctcaagcgatcctcccacctcagcctcccaagtagctgggaccacaggcgcatgccaccatgtctggctgatttttctgtgtgtgtgtgtgtgtgttttgtttgttttgttttgtttgtttgttttttttgtagagacggggtttcacctgtgtgtgtgtgttttgtttgtttgtttgttttggtttttttgtagagacggggtttcaccatgttgcccaggctggtctggaacttgtctgagctcaagcagtctgcccacctggcctctgaaagtgctggcattataggtgtgagccaccacgctcctccagttttggtttcttctccttttcttttcttttctttttttttggaggggggggggtgggacggagtcttgctctgtcgcccaggctggagtgcagtggtgcgatctcggctcactgcaagctccgcctcccaggttcatgccattcgcctgcctcagcctcccgagtagctgggactacaggcgtctgccatcacgcctggctgattttttgtgtttttagtagagacggggtttcaccatgttagccaggatggtctcgatctcctgacctcatgatctgcccgcctcagcatgccaaagtgctgggattacaggcgtgagccaccgcgcctggcctctttccttttctcttttttttttgacacgagttttgctcttgttgcccagactggagtgcaatggcacagtcttggctcactgcagcctgcgcctcctgggttcaagtgattctcctgcctcagcctcccgagtagctgggactacaagcgccggccaccacacccggctaatttttgtatttttagtagagacggggtttcaccatattggccaggctggtcttgaactcctgacctcaggtgatccacccaccttggcctcccatagtgctgggattacaggtgtgcaccaccgcacccaacagtttcttttttctttctgatgagttgaataagatactctttcaattttcttccaacctgagtattgtatcatttctcttaccttaaatcacaattctaatttgaatattttttaaaaagtactactgttacaatatattaatattttgactattttattgtctttaacagattctccttgccagttgacatttatatagtgcttacagttaaatgtttctgtgaggtaatactaagacccaggttttacaaggtttccttacttcttggcgtttttcctcctgccctatcatagacagttccttcttaacttaaatcttaactctgatttgagtactgaagcttggctgcttccaaatatccactataactttctcgctgttcttaatatggtctaacaatctcaacaaactagaattcaaaatcatgacttgagatttacagtgtaaatttttgttttgtacttgtaactgatgatggagaaacctattcattgaacacactaggcactattctaagaaacaatggagaataaatacataattcctaaccagataatttgcaggttagttgggtagataagtagtaaggtgacatattcagaaagagtggtaagtgctttggtagggcaaatataagatacgatactgtgggaacgtgttggagggatacctaacccagtttttgatcaggcaggacttaccacagaaatctgaactaacatctgaaggcatggtagttaggctaaggaggaaaatgtagcaagtccaaggaagagagaatgtactttcaagaactgggggatggtaaatagtactaaaagattcagagaaaagatttaaaaagttaatttgaaatgaaatgaaggagtgaggtaggatgggaaaccagacttcatgggctaaagagtcactgacttgaaggtgggaaaggaaatggaagcaataaatgtaatgaaattactcttttacaagaaatttcactatgcaagtgataggataagatagcaaaaggaacaacatgggttggcaagtaaggtaaggcattatggaaactgctaagtgttccgaaaagtatcatgacaaaactaggatgtcctttcctcataatttttagactcatatagaaggataattttaacctcttcagttttggaagtaaatgtcacctgaaactcttcataaagttttattattggatgagtgagttcttcacttacattgtataactcccacattttactactctccaagcatttgtacttttttattatatatatcttcagtatctttatccttccagaaagcaatttttgctttatgcagtgtcacatgcacattttaaaataagtgcttttgatagcttagtttacaaccctttggagttaactgtcctgagtggctgcttctttcaaaacaatgtcctgagacattggagcactttgtaaattcatagattccaacttaatgttttaggttaaagtagttaagataatagctgtactggcccaccactgtgctaggaaatgtagcttcgactacagcgtctctctctctctttttttttttttttttgaggcagagccttgctctgtcgcccaggctggagtgcagtggcatgttctcggctcactgcaacctccaccccgcagtttcaagcgattctcctgcctcagcctcccgagtagctgggattacagccgcccaccaccacacctgtctaatttttgtatttttagtagacatggggttccaccatgttgtccaggctggtctccaactcctgacttaaggtgatccacccaccttgacctcccaaagtgctgggattacaggagtgagccgccacggccagccagtgtctcatttttatgaagtaaataatttgtattttctaagaataagatatgtgaagtaggtaaaggcagagttgaaattgtgaggaagggtggtccaccatcccgtcccccattcctgaagcccctctgtggaatcttggtgctgctggaaactgcttgaaaatacctacgtcccaccctattttccttttaacacattacattttacacacaagggaaccgattcccaggtcatttgttcaatttttataaacaaaggggtttcaattttagaggttatatggacaacttattatggaagaaagattcttaattttcttactgctatttgacattagttgctgtgtatgtaaagtgatgcagataaatgaaacctttaagagtgtattcttaagtttctttaagtccattaatttcttttgtagataatatttcatgtatttttcgtgtactctcttgatcggatgtatttgtgatataaacagggataagtttagtgaatagataatatgatcccctgggacaggggaaagcccagggagccatgtaggtgaacctagctcaaggttatgaggaaacgaatatatcagaggagggagagggaaagggaagtaagacagacaggaagatatctgcgataataatatgttcctcgaaagcacaatgaatatgtatctttagactacagatttgtgtcttggtttttggtgtttttatttttttgctctatctttagacatccatgtatgatttatttttctaacttgtttaatcttgttatctgattagagaagttatttaaaaagaataaaaagcttttatctgtgtgctgaagttgtaacaaggttgagagaggtgcatctcacacgagtgtgattacatttatgaactatctttttatcttaaaatgagctctagactagaagtcaaaaaaggttgagacttaaagtgatcacttagtaaccattgtgaccgttgatctctgttaaggattcctacttgaaaaaagaatgaagcacatataagcatgtgtatatgtttttaagttttgaataaaacattttagagttgctgatatatttactgtatttgtgtcttttacagaataccccttcctttaacagccttaaaaatcaaagactccattagtgatgtggtaacaagttagtgccaaatctccttctctgatggggagtaatgataatagattccctttaagcttgatatttattttacatgtcattctttcagtaaacctaattgcaggactgatacacttcatatatatatatattttaatgagatgaagtctcactctgttgcccaggctggagtgcagtggtgtgatctcggcttactgcaacctccgcctcccgggttcaagtgattcttctgcctcagcttcccgagtagctgggattataggtgtgtgccaccatgcccagctaacttttgtagttttagtagagacagggtttcaccatgttggccaggttggtcttgaactcccgacctcaggtgatccgcctgcctcagcctcccaaagtgctcggattacaggcacgagccactgtacccagccctctcatagatttcttttcatgtccttgtctttgtatttaaaaaatatagttgatgtgctgtatatagaatttctgtcctaacgagatatttgtatctaatatcataagtaacatcagaaattttataagtacatgtcacataatggctaaatagaaaatctaagggaattttaaaataccctttataagagccacgaaaggaaagaataaaagagctaggaataaacttgataagaaatgtgaaagattgctatgaagaaaacttcaaatactaagataaaagaatgacttgaatatttgagatagaagaaataggaaaatattgaaaaagaagattaaattgacaggggagagctgagtgaggactagtcctgctagatacaagagtagacagagcggtggaacaggatagagtcaaatatgcatgaggagaatttagtgtattacagaggaggcatttcaaataaggtgtattatttgatacatggtagcagtggaacaggatacagtcaaatatgcataaggagaatttagtgtattatagaggaggcatttcaaataaggtggattatttgatacatggtgttagagcaacttggtagccatatggaatagaaacttaagattcctacctagcttcataaataaaagttaatgaattcacaagcggtaaatttaaacggtgataagtttcactgtgagtgaagagcttctgtatggcaacaaaatatgaacactaagaattaaagtgggggaaaagatttcccctacttataaatggccaatttcctacataagtaaaaagcctccgtaaataagtgaaaaacccacaggcaaagttggcaaaatatatcaagagagtatacagaaaaagaaatatacagtgtaaaaccttttttgaaatattataatttcatttataataaaaattcaaatcaaaactaaagaagttagtgtgtttttcacctattagattggcaaagatcaaggagttggatcatatactacattgtcatgggcatgagaaatcaagtactcttgcacggcataaatgacgacaatctctttgcaggggagcctgatgatagctattagattgtaaatgtatatatttattataatgtcacctctacagatttgtcctaagatacattcataagatcacaaagatgtatatatagtcaatgcagtagtatagtaggaaaaaaaaaggcagtgtaaaggttcattaatagtagactataaataaaattgtggtacctttctataaagaggcaaacccacaccagtgtggtaccatatgagaaatccattggatttatttttgtttttttaagacggagtcttgccctgtcatcaggctggagtgcaaaggtgcgatcttggctcactgcaacctctgcctcccgggttgaagggattcttctgcctcagtctcctgagtagctgggattacaggcatacactaccacacctggctagtttttttgtatttttgatagacacagggtttcgccatgttggcctggctggtctcaaactcctgacctcaaatgatctgcccgccttggcctcccaaagtgctgggcttacaggcgtgagccaccgtgcccagccctattggatttttttaaacaacaacaacaaaaaaaaacaaggtgcagaagagaatttgtggtactgttacagtgtgtgtgtaagtgtgtacgttagaacacctctggaagaatatgtaaaaaactggaaatagcagttgcttctgggtagaggaaacaaacaacagggatgggaatgagggaggcctgtttttttttttttttgagacagagtctcgctttgtcacccaagctggagtgcggtggtgcgatcttggcttactgcaacctccatctcctaggttcaagcgattctcctgcctcagcctgccaagtagctgggactacaggtgcctgccaccacacctgcctaatttttgtatttatagtagaggcaggattttgccattttggccaggctggtcttaaactcctgactgtaagtgatccgcccacctctgcctccagtagtgctgggattacaggtgtgagccaccgcacccggcctagggaggcttatttttcaacataaactctgaacttgtactgttaaagtaattgtttttagtaatgtctatttaacttactcaattaaaaataatttagaggtaaattatggcaaaatgttctttaaaataaggtaaccattatttgaatctttttaaaagacataatcctccagatcatctaatattatttaaagtatttacttaatgtcccattacaggatactgcttcatttaacgatcccttaactcttaagattttagaacaaagtgttagttactattatccttagctattctgaataaatcttttcataacaggtttattgagatataatttatatactatccagttcacccatttaaagtggttttagtatatgctacagagttgtgtgccatcgccataattttaaaaacattttataaccccccaggagataactttttaaattcaccccctaattcctcccaagtcccccagcccctaggcaactgctcatctgttttctttgtcaatggatatacctattctggacatttcatatgaaagaatcaaacaaggttttggtacggtggctcacgcctgtaatctcagcgctttgggaggccgaggtgggtggatcacgaggtcaggagttggaggccagcctggcaatatggtgaaaccctgtttctactaaaaatacaaaaattagctgggcgtggtggtgcgtttctgtagtcccagctatttgggagactgaggcagaagaatcacttgaacctgggaggcgaaggttgcagtgagccgagatggtgccattgcactccagcctaggtgacagagtgagactctgtctcaaaacaaaaagaatcaatatgtgatcttttatgactggcttattttcattcttttacaagaaatttcactgtgcaagtgataggagaacaaccttggaaacaaggttcatctatattgtggcatttatcagtactttatttccttttatggctgaataatattttatttatggaaatatggaaaaatatttttttcttcagttgatggacatctggattgttttcattttttggctgttacgaataatgctataatgaacacttgtgtacaagtttttgtatggatgtatgttttcatttcttttgagtatatacccaggattagaattgctgggtcctatggtaactctatgtttaatattttgaggaactgcctgattgtttccaaagttgctgtaccattttacatttccatcaacagtgtacgaaggctccaatttttctacatcctcaccaacacttgttattaatattggctttttttttccaaatagagtctcactttgttgcctggtgtggagtgcagtggcatgatgacagctcactgtagccttgacctctcaggttcaagtgatcttcccacctcagctcccctgagtagctgggattacaggcatgtgctaccacacctggctaatttcttaattttttgtggagacagagtctcactatgttgcccaggctggtcttgaactccttgcctcaagtaatcctccgctctcagccacacaaagtgctgggattacagatatgagccagtgtgctctgctttatctgtctttttattatagctgttctagtgagggtgaagtggtgtcttactgtggtgttgctttgttttgttttgttttgtttgagacagggtctcactcctttgcccaggctggagtgcagtggtgtgatctcagctcactacaacctccgcctcccaggctcaggcagtccttccacctcagcctcccaagtagctgggactacaggcgtgcgtcatgatggctgactcattttgtattttttgtagagacagggttttgccatgttgccccgccttcatggtggttttgatttgcatttccatgatgctgaatgatactgagtattctttcatatgctcatttgtctttttatatttaatacaaacattgttgcccgcctttcctaagatgtatgtgtgttcggtgtatctgcatgtctagattcaccatgaaaagttcattttaggagcccatctattgtcaaattggacattttagccacgtaagaaatgtgaccttacagagccctgttgagtcactgtttatagtgagttttctgataatacctttgttaagttcatgttttgtttttcttacagtatttcactggccttgaatgtggacataagttttgtatgcagtgctggagtgaatatttaactaccaaaataatggaagaaggcatgggtcaggtaaagatatcaagttgtttttcagtttttgttgaatttcctatagtgttaagacccttgcacaaatttgcacaaataaaaacaggtgaagctttatgtgtcatgattctagattcaaacaactaaagataataggctttttcctaaagtaatgtggcattccagttaaagagccactccaggtaacgttttctcagccggcatcaatattggtatatgttaacttaaacttgttgcacgattttgtcagattatctcgcttttgcctttaaaattgtgtgtttaaaaaccaattagtcaggttagcaagtctagttactttatggtgataaacatactctcacacacatttcctttaaggagaaagggaaggattgagatcctgtaaacattaaggtattcccagaacctagcaaagtgcctggcgatggtaagcattcattaaatatttgttgaatgaagacagtttaaatttcaatctttttcagactatttcgtgtcctgctcatggttgtgatatcttagtggatgacaacacagttatgtaagtatttttgatagattctgcatgtgaatattggttagttggttaaaccaaattaatttttacttagtacctcaaaggaagtgaaactttttaaagtctgaagaaactttttaatctgcgttccttagtagtagtacaaaagcccatttgtaacttggttaaatgcctgatcactattcttacaaacttagaaatgcatggtagctagattttgataaaccttgggattggagattagaatgtgtgtatgtgttagttgaggtgttcttggaagcagatcccaagatagaataaaaggtgaaactgacttattgtggaatagcatctgtgcaaggtaaacagcaggagcagatagacattgatataggcctgacatctgttaaaagacaaagaaggaagattcaataggaagagactttatatgatacagctatgagagtctttggcagccctgatgggggaacttcagtgcatagattgcccatagaggaatacctcaataagtagaaagagctgggcccagtacacttgatatgctcagttgttggctgggactacccagggagtcatggtctttgctgaaacactgctgctgatttcagatacactacagctggatgctttcagctaacagctcttcttgtgaaaggttctttcttttttttcttttaacttttaggttcaggtatacatgtgcaggtttgttacatgggtaaattccttgtccgtgaggtttggtgtacaaatgatcccatcacccaggtagtgagaacaatacctgatagtttttcaactcttgccgtcccaccctacccactctagtagtccccagtctaaatagtcttttattctcatcttcatgtgtactcactatttagctctcacttataaatgagaacatgtggtattgagtatttctgtgttaattcatttaggatgatgacctctagctgcatttgtattgctgcaaaggacatgattgtgctcacttttttttatgactgcatagtgtttcatggtgtccatgtgccacattttgtttatccagtccactgttgatgggcatctaggttgatttcgtgtgtttgctattgtgaataatgccacagtgaacatactagtgaatgtgtctttttggtagaatgatttattttccctgtgatctcaccaacatctgttatttttttactttttaaaattattttttgtttaatttttttttactttttaataatattccttatgactggtgtgagatgatgtggtacatcattacggttttgatttgcatttctctagtgattagtggtgttgagcatttttttgtacctgttggctgcgtatatgtcttcttgagaaatgtcttttcatgtactttgccctttttctttcttttttttaagtgaaagcaagtttattagagaagtaaagaaacaaaagaatggctacttcgttgacaaagcagcctgctcatttttaaatggggttatttgttttttgcttgtttgattaagttccttatagattctggatatgaggcttttgttgggtgtataatttttaaatattttctctcattctgtaggttgtctgtttactctgttaatagtttcttcagctgtacagaagctcattagtttaattaagtcccacttgtcaatttttgcttttgttgcagttgcgtttggggacttagtcataaattctttgccaaggctgatgtctagaatggtatttcctggattttcttttaagatttttatagattgagctcttacattaaagtatttaatcctttagttaatttttgtatatggtgaaagatataggggtcaagtttcattcttctgcatgtggctagctagttatcccaacaaccatttatgtgtgtgtggctattatcgataggattgcattattaatttggcgcttaccttgaatgttattggtatatattaaatgctactgaattttgtacattgattttgtatcctgaaattttactgactttgtcagctctaggagccttttggcagagtctttagggttatttctaggtatagaatcatcatcagtgaagattgatagtttgacttcttttcttatttagatacattttatttctttctcttgcctgattgctctggccaggacttccagtactatgttgaataggagtggtgagtgtgggcatccttttcctaagtggaatgcttccagcctttgcctgttcagtatgatgttggctatgggtttgtcatatcatagatggctcttaatgttttgaggtatgttccttcaaagcctagtttgttgatagtttttatcatgaagagatgttggactttattgaaagctttttctgtgtcatttgagatgatcgtatggtttttaattctgtttatgtggtgaattacatttattggtttgcccaggctggagtacaagtggcaccatatcggctcactgcaacctctgcctcccgggttcaagcaattctcctgcctcagcctcctgagtagctgagattacaggtgtacaccatcacgtccggataagttttgtatttttagtagagacagagtttcgtcatgttggccaggctgttctcgaactcctgacctcaggcgatctgcccgccttggccttccaaagtgctaggattacaggcgtgagccaccaagcctggccaataactattttcaatttgtgatggtaacaaatctttgtcaagagaattgtcttattaatgaccagagtgacacttgctgccaccttcttgagaatgcctattcttgaagatggatgctcactttcttttacttccttatcaatatcagataaactaagggtggaaccttgtcctaataactgttggctgatgtttgctctcacgtcctggtggtccatgccaggtttagatagctttttaggctaaggccagctatcagaaatcattagggtttgtcataccagaaaagcattatgggtaatacatgtgtaaataagatgtgtgtgtttggcaatcaaggcatctgacttttggcctgatacattccttattattatttattgatataaaatctgtaatataaaactcattttaattacagttatccttagtatactggggattggttctaggacccacgtcctccaccctgaatataccaaaatctgcgcatgctcatgtcagcccagcagaacccatgtatacaaaaatttgaccgtccatatatgcaggtttcacatcccacaaataactatttttgatccctgtttggttgaaaaatattcataaataagtggacccatgcagttcaaacctgtgttgtttaagaagcaatggggttttttttgttttttgtttttttaagatggaatctctctctgttgcccagagtggagtgcagtagtggcatgatctcggctcactgcaacctctacctcctaggttcaagtgattctcctgcctcagcctcctgagtagctgggattacaggtgcctgccaccatgctcggctaatttttttgtatttttagtagagacgaggtttcaccatgttggccaggctggttttgaactcctgaccccaagtgatcacccacctctgcctcccaaagtgctaagattacgggcgtgagcaaccgcacatggccagcaactgtatttttaagtatattatccagtggcttttagtatatacataatattattctacaaacatcacctaattgcagactattttaatcaccttatatccgttaagcagtcattcgctattcctttctccccctagaccctagcaaccactcatctgctttctgtctttgtggattagcctattctagacatttcatataaagggaatcatgtaatatgttgccttttgtgattggcttctttaatgttttcaagattcatccatgttgtatcatgaatcatcactttactccttttcattgctgaataatggttccattatatggacatttccattttttacggaaatgtcttatgtgaacatatgaacatttgtgtacaagtttttcattgaacatctgtttttaattctcttaagtatatatatttcaaaggagaattcctgggtcttgtggtaatgctatgtttaactttttgaggaaccatcaaatacacaaattatttttagaccgcaggttccacttctgtgaaatatggagatttactcatttaaaaaatattaattgaacactttctacaggcgtactggacacctggggatcctttcatggggttgggaggagaaagacagatattaaacaaatgattatacagataactgtctaattaaaattatgataatttctataaagtagatgtttaaggtgccatgagaactgagagggtatctatatccaaacgagtgtggaaactcaggaaaggcttccttgagtaatactttattgtaactgagtgaagtaatacagtaatagcgtctaatatttattgagtgcttactatctgccaggcactattctagtctcacaaccatgtttctgatatctattttacagattagtaactgagaaatggagagttcaaagaatttaccttcaattcatagctagtgagttgtgaggctggcattcaaacctaggctgtcccaccttagagctccattacaatattcttgtctttccaagggaggcagccttatgcacagcctctgaggaagggtggtacttactgttttgaggaaatacaagaatacgaatgtgataggagtgcactgaaagtgccacaggacagggtgggatcttgtggaaggagagaggcctatgaagctcaagagtcaaatgaggccagattggttcatttaaaagattttaatggggttgaactacatgcatgttcttcatgtctttctcagtgggaatacactcagaggagtatttaccatagaactaatgaaacttaaacttcaggattcctcactacgtgggatcctgtgaattctggaaattcttgtgagttatagtgttcagaagaggccaggatgcagtcagtgagcatttctggttaatttctaagagctctcagaagaagaaggctcttaaaattgtatcagctttaggtatcacaaaacctggatccatttcttaacatttctggcaacaatatctgtctcatttcgcatactgatttgggtggggtgtctgaaggaaggtggctgagaattgctgtcttaaggcatgatatgatatcagagtcaaaagaccctgaaatgcgcttatacttggcactagttggtaagtcattaggctgtaataaaaactgggtaaaagtagactatttaaaaaataagaaccatggaaaaaaagtctatgaaaataaaactatacaaactttgaaattattgttctgatcagtacagttatatttgttgatagcctatgtgcatttcagtatttacagcttagggcataaacatgtagccgtagcataaacagcttttgaaactatgttttataaatgtggaaaatactcttgactggaaactttctaatctatttttattcttggtttcaggcgcctgatcacagattcaaaagttaaattaaagtatcagcatttaataacaaatagctttgtagaggtaagtgatttgttttccttcttgtaagaaggaattctgtttattaatagaaatactattttaaaaattataatttattgacagtaaaaaacatctttaacatatttatgaagcatgccaaaatacctttattctcaaaagagtatgacaggccaggtgtggtggctcatgcctgtaatcccagcactaagggaggccgaggcgggtggatcacctgagatcaggagttcaagaccaacatggcgaaaccctgtctcttctaaaaatacaaaaattagctgggcacagtggcacaagcctgtaatccgagctactcgggaggctgaggcaggagaatcgcttgaaccctggaggcagaggttgcagtgagccgagatggcgccactgcactccagcctgggtgacagagcgagactccctcttaataaaaaataaaataaaataaaataaaagagtatgagaaaccagtaagtacatctctccatagatcttgaccttggataataaaattatttttactgtattcttcctttacttttctttatccctagctgagaattgtagtagattactaatcgtgtcatgtttaatcatgtttgagattctaaccctgctatttctctgctcgttttaggtttcattaccagtaaatcttgttaataaagaatgctatcctttattggaccatgcctttgcccatttgttctatgactccttttgtgctacagtggcagagttgagtagttgctacagagactgttctggcctgcaaaaccaaaattctttaccctcttggcttgttacagaggagtttttcagcccctgtatgacaacatcagtaacttggtcttttaattctagaaagtaattatttctgttagagattaaacctggaaacagcctattttagaaatagtgtattatttgaaatggtcaatggacttctgaattctggtgcagagtgtttttttttcataatactataaaagttatatttccttttgaggaactaaaatgcaatctttgcctgtggtttaggaactgggttttttgtttgtttttttttttccttcttacaagagctttttatgggagaagttgtatgtatatcctttagcctatcttgaactattctgtagcttctaaacaccttccttgataaagagtatatctgattttcttgtgtcttttgaaaattgttctgaaatagaactgtaaataaattagtggtttttaatggtcacatacatgatatttaattaaagttattcagtgggattttgaagatagaacaagaggtgattcatgtattttataaaaccaggtcttcagggatcagtcatctttaaaaaaaaaaaaaaaaggcacatctgaagtgttgctatagaagaccacagcaagttttcataagcttgtgtaattatcccccatttgccccttgtaccagagaagcaatataaatagcttgatgtactaggaaatcttgcatcatgacctaatttaatttgctgtctttttttgaggcagggcctcattctaacacccaggctggagtgcagcagatgatcacagctctctgcagcctctacttcctgggctcaagtgatcctcttgcctcagcctcctgtgtagtcgggactacaggcacataccaccatgcctggctaaattcttttttcttttttttaaggtagagacaaggtcttgctatgttgcccgggctggtctggagtgcttgacctcaaacagtcctcccgccttggcctccctaagttctgggattataggtgtgagccactgtgcccagccagctgtcattttttattttctaacttgtatttcagtgcaatcgactgttaaagtggtgtcctgccccagattgccaccatgttgttaaagtccaatatcctgatgctaaacctgttcgctgcaaatgtgggcgccaattttggtaagcaagtgatttcctaaattgaaatagtgcacaaagcgtttccatttctcctgtttattcttggtagtaaaatagcagaaaaaaagtgtttaccttaggcagggagatgtttgatactggtttaaaatagtatatatctctttcagaattgaatgaaaaggtcacatcttaaaaaaatttttcctctttccttgatgttctaacttttttgaatttttttttatggagaaaatatacaactctaatcatatcttcctgtatgctccactgtaacttaatgggagcaaacttgtagatctgggactatacgtttttctttactctgccaaattttaaccttacttatgcaaaggaaatgtgcaggtaaattctgctgatggtctcctttttaactaagagttttcctgtggctcctctcgcccagctttcttggtaacttgggcttttggagttctatagtatactcttcagcctctgaattctagatttgaactgccaggaagtttccagtgccacatattaggggatgtcttaatcagttcaggctcctttataggtgttctagttttttccaaagtggataggctgaaaatttttcaaatttttgacttcttatttccttttgatgaacagtttatctctaggtcattcatctcttcttgcattttctataaacattcaagagaagctaagctgcgtcttcaacactttgcttagtaatttcctcaaccagatattcagtttcatttctctaccttccacaaaacaattcagccaacttctttgccactttatagcaaggatggcctttcctctagtttctaacagcatgttcctcattttcatctgagacctcatcataatggcctttactgtccatatttctaacaacattctgttcatggccatttatttaggttttctctatgattgaggcattccctgcacttctgtctttctgaatcctcaccagaattacccttaacaattcagttcattcacagtgatctaggctttttctagcttgcacttccaagctcttccagcctctacttactacctagtttcaaatcggctttcacatttttggttttgttagaacagcaccctcacttcttggtaccattttctgtcttaatgttcaggcttttataacaaaagaccataaactgggcggcttctaaacaacataaatttatttcttacagttcttaagggtgagaagtccaagatcaaggtgccaaaagatttgttgtctggcgagggcctgcttttctggttcatagatggtgcctacttgctgggtcctcatatggtggaaaggacaaggcagctctctgggccccttttttttttaaaaaggatgccaattccattcacctcctaaaggctccacatcctaatactgtcacattggttattaagttttaacatacacattttagggggacacaaacatttatatcctgctagaagttaagatgattttctgttcctttgagggtcttgaggagtaagaagccaatcaagtcaaggggctctagacccagcaaatagattttttgttttgttttgttttgagagagggtctcactccatcacccaggctggagtgcagtggcacgatctcgcactgtaacctttgcttctcaggttcaagtgattcttgtgcctcttgagtagctgggattacaggcgtgtgccaccacgcctggctaatttttatttatttatttatttgtttatttatttatgtatttatttttaatagagacagcatttcaccttgttggccaggctggtcttgaactcctggcctcaagtaatccacctgcctcggccctccctaagtgctgggattacaggtgagaagcaccatggccagccagattttcttttttgctgcggggtggtttggagggggaaatattttattggtattccatacctttctttttttcctccaaacatctatagaattacacttaacacatcattaataataaatatttccaaaaagagcaggtaagctcacagagattaagtatgtgtaaaatacatactgtttcgataaagattaattatgtattgttattttagagaaaaggtggataatacctactttccaatgtatttttagcgtgacacatttcaaacataaaagtatagagaatacagcagtgaatacctatatagctacaatccagttaaatcaaaattagtattttgtttttcttcattaagagataaaacatgacacatatatttgaagctccttggttccctgctccttcccattccccatctttcttttcagaaataaccatttatcttaacctgatttaaatcaatagtagtttgtttctgtctttagcaaaggactttttgccattcgtaaattacttaattagctaattaatctgtcattttattatttttttcttaagcatttgtgtttgttaattatacttcttttacaagtgtatatgtcatgaacttagaaaacaaaagtgaattactgattaacacatgtttagtgagtatttagtctttttgttttataccttgcccagtaccatttccctctacagggcggaggttcatttgtttaaataatgcaaagatgtgacctatttgcttcccatatattgtttactgtgtattagtactaaattatataagtaacctacaaagtcagccttttattcttcatttagggtgttaagtaaaagattaaaaatgcactgatgaagcatgggttgaaacttctcaatatagtctgaggcaccttagcaacaattattatgaaattgtcatcaaagcgtgtcttcatgcttatagtcattcttcacacatattgagtacccactatgtgctagttctactactaaattctaggtaattaactgtaaagcagacatgggttctctccttgtatttgccagtcactagaaactagtgacaatactgtggaactataaggcatgaaatgattggcttatttacttgcttacagtaggtaggccttaattctattaactctttgtgtcacttaacagctttaactgtggagaaaattggcatgatcctgttaaatgtaaggtgagtttgtctgacatttcaatttttaaataatggcacacttctaagacttagtgactaaaaatcatagctgatgattttgttatctatctattgatagatttttttttatccttttaatttcagatgatcattacatgtattcagaggtaattccttaggataagccaagtcagctcctgattgttattaggataaccatggctaaggcacctctttgtcaggctttgtaattaggggaatacacaccttgcagttgggcttctcttcaagctctaggttccccactcagcttctgccaaagaaaatcctgctttggttgattttatatatactggacattgtagctatgggatttccctggcttaagaggatgtgagcctagtgataatcttattcattggcttttacatttaagcttgactatagttaagtgctaaagtaatttgctatttttaaaagtcttttgttgtatcctaaccgttgttattttcaaacagtggttaaagaaatggattaaaaagtgtgatgatgacagtgaaacctccaattggattgcagccaacacaaaggttggtgttttccttcagtaactcttggtaataaaaatgataaggattggtactttggcattagcaaaagcaatgaggtgacctacttacaggctttgtttcatctttttctccattgagtctttttttttttttcccagaatgtttgcctgttatttcctttttctctttgagtttattttagagtattgagtactgtagtacagcatccacagttctctgccttaggtttcttctactggaaaaaaaattagtgttctgtagaggaaaaagctgataatttttcaagtgtgggatttgtgcttggctgccatttagtatacaaatgcattggagtttactccgcctagcttggttctgttaggctaatttacatttttgtttctaattttttgttttgaagtacattgctcttgatactagtttcaaaattcaatttcaaaattcactttcttaaccccagacaaatgtcttagaagtgtttaaatcttgagtacccttctcctcgatcactaatctaatgagcaagcatttgaatgccaaccgtgtacccagctagtcttttaatacaaagtcgtattatccatcctttatgtaattcagtcctatcctatccccatagtgagtgacttgggtaatgaatggtaggttggttcatgggctattcatttttagtattattttgtacatgtaaagatgatgctttaaagaatgctgagttgtttgacccatagtatataaagctatctttgaactgttgcctcagtcatcacaggacaatgagattaagaagtgtgtaaacaatgaaggccgacgcaggttgtctgtgtgtgtttaaatatacatcttacatacttatatataaaacatgaatttatatttctgtctcccagaaagtagtgaaacagtgaatcttgccacataaaacaaatgcccaagtctttaaggaatatatggtagaaattaatattttttgttccctccaaaaccatcacgataagcataactcacgtcaatcaaagaaaaccttactataaatatactgtaatgtcagaaagtggttacttgttttgttattaaaaaaaaattcttagccaagcattctttttttgaaaattgaagattttcccacaagaaatgttccttaagtcccagaattctttaatatgctctgaaaaactaatatttagaataaggcaattatattttcactaaattgtttaattaaatggtagccttttttctacatctagagaaattcctacttgtaagccccaaagatgtttaaaatagggagtacaggcttgaatatgtttggcttagtttagattgtagattaccaaggaagaatggcaatttgtaaaacaaatttagctgctcagtatttttgagagaaaactgaagagtttttctcttgaggttttagaagcttttaagattattagctccctaaacagatatgcatattgtcagtgatatcctaacattttggaggtttaatactattaggttaattataaccaagaaatgtagaatgtagaatgacgcatattttatgcctgaaatttgcttgtttggaaaaaatgtaaaatttcttatgtgggtgatttcaaaaatttgatttgaaatatataattaaaaagttgctatattggcctattttaaattgctatcattgatgggcagcatagtcaatttcacaaagaaggccaaattgtgcaaatactaatatagtgggtgatccctccttgggagagttacaaacctcaatcacaaatgcaaaaacaaaaaatccataggcctacagagcagtaattttggcttactagcaaccaagaatatgatatgaggccaggtgcagtggctcacacctgtaatcctaacactttgggaggccgaggtaggcagattgcttgagcttgagagattgagaccaacctgggcaacatggtgaaaccccacctcaacaaaaaattcaaaaattagccgagcatggtggcatgcacctgtagtcccactacttgggagactgaggcaggaggatgacttgaacccttgaggtcaaagctgcagtgagccatgattgcactgctgcactccagcctggtcgacggtgagaccctgtctcaaaaagaaaaagaaaatgatttggacttggaaaaaaacaatctaacacgatctctgtagcatacttgttaaggagtacaatgaaaagaatttaaaacatggttatttggtaggagaaagttggaaaatccagtagccacaaaatgaatttaccaatcaaggtctgatttcctagttacctgacactgaagtcagattgcttggatttggatcctgacttgacttatgtgaccttggactagcttctttataatttttctctcccttagtttattcatctgacaaatggaaataggaatagcaccactataagaattatgagttgatgcatataaaacactgagaacggtacatgggatatgggaagtactcaattatttctagatgacactagagagtatagtatatttatatgaatagaatgcttttatctcctatagtactgttattactatatatatgactaaaagtacttaaaatgatttgtctctcagccctacttaaaaagaaatcctaggaaggctgaagtggaaagatcacttgactccagaagtttaaggctttagtgacctatgattgggcctctgaatagccactgcactacagcctaggcaatgtagtgagactctgtttctaagtttaaaaaaacaagtccttaaattgttgtatgtcttaaaagccagtggtaataatggtaacagctcattttaaatagtgcttaagtgttcaacactgttctaagtgctttatatgtattaaccacaataaataaaatgtttaaaaacaaaccaaatctagaactggcttttccttaatgttagtaatgcaacctagtgtagcattgacaccaactttatagtttctcttcataggaatgtcccaaatgccatgtcacaattgagaaggatggtggttgtaatcacatggtctgtcgtaaccagaattgtaaagcagagttttgctgggtgtgtcttggcccatgggaaccacatggatctgcctggtaggttggggaaattaagggaagaatgtgtttacataagtatgtgccatgtattatgaataacatttctacctcatagatatcaccatctaacttgcaagctaaataaatacatagtgtgtgattaatgttataagtctatgcaagacatagagggattagttagatatatttcataaaggaggtaacaatttagatgaactttaaggggaccaagagttcattagttataaaagtagtaggaaaaacatttagggcaaaagttgcaacatgagcaaaggtagaatgttgtgaaaatacatgactttttcagagaataactgtattatcaaatgtgcctctctaggccaaaattgaaaactcagatgctgttggcaaaacccaacctgcaggtggttttactctgcatatcattagacattgtggaatgctttaaagccttgctaaaaggctttgtcatattttttctttaaataagcatatatatgttgctttccttgttttattgatgacttacttgaactaatataagaatcttgggccaggcacggtggctcacacctgtaatcccggcaatttgggaggccgaggtgggtggatcacctgaggtcgggagttcaagaccagccctgaccaacatggagaaaccccgtctctactaaaaatacaaaattagccaggcgtggtggcgcatgcctgtaatcccagctactcgggaggctgaggcaggagaatcacttgaactcgggaggtggaggttgcactgaaccaagatcgccccattgcactccagcctgggcaacaagagtgaaactgtgtctcaaaaaaaaaaaaaaaaaaaaaaaaaaaaagaatcttacacagcatatgaagcagttttctcactggttaagggcataagcctccactgggtgacaggcaaaagtttaagctctgaaactctgtagttatgtgaccttaagtatgtttcccatcctctgtaaattttattcttcatcttctcaatgaagaaaataatgcatatttcataaaatgtttaagggattaaatgtgttagtacatttaaagtcattagccaagtgcatggtatatagtaagcactcatgaaatagctgctcccataatgtaggctcccataactgatgtatagtaaccactccaggggaagtgcaagtcttactcatctatgctctgagctgacctctctgggtatgttttccccttcccaccattctgtatatcatgcagttttaaatgactctgaaaaactgtaatagcaaagcacatagcacagcatctgttacatggtaggctgtcaactgttggttctctgtggtttataaaagagcagataaggtgaataatcctggaaaattagaaatatttggcttaagtaacagatggcctaagagataagattatctctttctcaaaaagttgagttaggaattcagacagtcaataaaggttctagaaggacagtgttttctaataatgataggtgagctgatttgaaatggactgcctcaggaggtggggaatttcctatcactggatagagaactaatttattatagagagaattcaaacactagatagggttagaacagttcctttcagcctgctaattctgtcattatagcagtagaaccctgggtgttttaacatctcaatttctctgttataaaagataacgttggtgttagataatctgtaaatccaggttaaaattctgattttttttttttccttttcattgattttttttttctttatggaatcctctttatttacttgaaggtacaactgtaaccgctataatgaggatgatgcaaaggcagcaagagatgcacaggaggtaagtatatgtataacaggacaatagttgactaagaatgcacgttgtatattcatattcattagagaataattttttttttttttttttgagacagtgtctcgctttgtcgcccaggctggagtatagtggcatgatctcagctcactgcaacctccacctcctgggttcaagtgattctcctgcctcagcctcctgagtagctgggattacaggtgcgcgccaccacaccctgctaatttttgtatttttagtagtcagtctagtctcgaactcctgacctcgtgatccactggcctcggcctcccaaagtgctgggattacaggcgtgagccaccacgcccagcccagggaataattgagtagaacttttcaattctgaaggatttgtgaaagacattccagtaaatattggatatctatttacatttagaaagggaatcttatccaaaatatttatcaagaacattcttatagtaagtttattttcttttcattaatgtagttacatagcacattttagcttttggtagagtcttgctttcaagatccctcctaccccaagaagaacagtagtgaacagcatttgttaaatggccctggtgctatttataggcaatatcttacttacttaaattttttttaaacctttttgttcatcaagaagcgctgatgattataggtgagctgatttggtatggagtgtctcaggaactgagaaattccctattgctaggtagggaaatgacccactgttatagaagggatccaaacactaggtgtggattagattctaaagcacttttcattcctttcagtctggtgattttattgtaattgtggaaccctggaatttaatagttcctacattcacccattccatattgaaattccccagttgtcccagaaatattcttttcaaatgattttcctagccagggtacaatctaaaatatggtttgcatctgtttcttatttacttgttaacatatcttcaaaatgtatttctaataaaaatatcatatatagaaatgagtatatatgtaacctagtctgtcatattgctagaagtgaaagttttgtctttccctttttaaaaagactgggaaatacggccgggcttggtggctcacacctgtaatccctgcactttgggaggccgaggcaggcggatcacctgaggtcgggagttccagaccagcctggccactatggtgaaacactgtctctactaaaaatacaaaaattagctgggcatggtggcttgcacttgtaatcccagctactcgggaggctgaggcaagagaatcgcttgaacccaggaggtggaggttgcagtgagccaagatttcaccactgtactccagagtgagactctgtcgctaaataaataaataaataaataataaaatgactgggaaattatattttgtaactataaatgatgtttcacagaccttcacaatgtttgggtccatttaaggggaaaaaatccctacaaattccaatattgatttaaattatatttattataatattatttaaatatgtataaacaaaaaccagctataaattcttgtgctcttgcacaattctacagccaaaccaagagagccacaaaatcagtgaaactcaagtaaatgttaatttggtagatactgttgttggggttttaaaaatgtattattactgtactgttaaatatcatgagataacttgttctcccaccaattttcttttctttcttaaatgatgtcccttaagtcatatcccactaactttctatatatttctatatttccaacattaatttttatgatgcattacttgatttgcccagaatgtattatggatatatgttcttatcacctttttttctccattaacctgatgtatttatttagccagatatgctgtttatcaacaaagaaaatatatgtggtttatccttgacctcacctggtctttatttggatgccggtagaatccctttctgagatctatagggagggtgggttatgtgcatagcttttgagccagagtctaatgtttagattctagatactaaaatagattatttttctgtttcacatctgttggactaaactagaatcttctataactgtgggagtacaaagaaagatttcctatcactccattggttgtttggttgattgactaattgattgggagccacgcctccctgaaaggatcacaccattgcatgcctatctggcctcctcatctttccccactcccaagctcttggcctagcatttactgggagttgtagtctgaaaaattactagaaggttgacacatattcaaaagatccttgatggtaccttgactgccctgcaaaagatgtacctgtgttatagaaaattgttgactcattatattgtaccacagtgccgacagttgtggatatttgaatcttcttgtcctctagactagggtcagcaaactttttctgtgaagaatcagatggtgtatatttttagctttgcgtactacataatctctgttgtgacggctcaactctgcctctgcccttataatgcaaaagcagccatagacttaaatgagtaggtataactgttccaagtaaattttatttactggctgggcatgatggctcaaacctgtaatgttagtgctttgggaggccaaggccaaggatcacttgaggccaggagttcaagaccagcctgagcaacatagtaagacccccccgccgcccccgcccatctctacaaaaaaaaaacaaagaaggtttttaaattagccatgcatgttggtgtgtgcctatagtctcagctatttgggagctgaggtgggaggattgcttgagctcaggagttccaggctgcagtgagccatgatgacgccacccctctttagcctggatggcagagaccctatctcagaacaaaaaaacaacaaagaaagcaaaacagttttatttacaaagacaggtggcagctggatttgtcatgcaggccagagtttgtatacccctgttctaagcagtcaagtttgttgtcttttccacgctccccaaactgctttcaggtcgctgattacatttctcattccagattctggcatttgattggagaatttgtcttgatcaggctcagtggctcacgcctgcaatcctagcactttgggatgctgaggcgagaggattgagtgcgggagtttgagatcagactgggcaacaactgagaccctgtctctacaaaaaatttattaaaaattagccaggtatggtagtgcacgctggctgaggtgggaggatcacttgagcctgggaagacttcagtgagccatggttgtgccactgcactctagctcaagcaacagagcaagaccctgtctccaaaaaaaaaaaaaaaaaaaaaaaaagtcttattagcagtgatggtatgggtgttcttttttcatgttgaattttagtgagaagcagtttcagaattcttagattaagtcaagtcccataacatcatacatgtcaatatggtaagggagggttttcatttcatttggggaacttgacaggcttggaaatattagtactttaggggaagataaaatgccaagcagattttccacatattttcagattggcataattttcctgttcataagcattggtttgatacttacctgactcttgaaataacatggctgtggttttgttgttttttcattgagatgagggtctcgcagtggcatgatcatagctcactgtagccttgaactcctgggcccaagtggtcctcctgcctcaacctctgcattagctggaactagaggcagcttgaggtgtgcaccaccgcgcccaacttgtgttggttttttgaagtgtttcgttgtataatgctggatcatgtggttagctaattatgtggctcagaattagtatttctaagcaagggaccaaccatagggccaagtagtatctgttatgtaggctttaaaacatggggagagaaagaggaggtaaggataaaggaaaagaacatacgtgtgttaggaacccctttgataggggccgggcgcggtggctcatgcctgtaatcccagcactttgggaggccgaggcgggcggatcacaaggtcaggagatggagaccatcctggctaacacagtgaaaccccatctctactaaaaatacaaaaaaattagctgggcgtggtggcgggcacctgtagtcccacctactccagaggctgaggcaggagaatggcatgaacccgggaggtggagcttgtggtgagccgagattgtgccactgcactccagcctgggtgacagagcaagactctgtctcaaaaaaaaaaaaaaaaaaaaaaaaaccctttgatagtggttgcatttagtaagcatttattaatggttttctgcaaatcaggtattggaaatactttatctttttaaaagtccattccctctagagatttatggtataatggtagaggcctcatatgaataattatatattataatgtaataatacaaaacaaatctaaactagatacattgttgctttgataacaatatactttacatatctctaaagacagactctctttacataactgtaataccattacagttgactcttgaacaattcaggggttagggacactaacccgccctacctccgcaatggaaaatccacataccacttttgattttcccaaaacttacctgttttaatagcctactgatgaccagaagccttaccgataacatagtcaattaacacatattttgtatgttacatgttttattatactgtgtgcttttttttttttctttttttgagacggagtttgctcttgttactcaggctggagtgccagtggcaggtctcagctccctgcaacctccacctcccgaattcaagcgattctcctgcctcagcctcccaagtagttgggattacagacatgcgccaccatgcctggctaatttttttgtatttttagtagagacgggatttcatcatgttggtcaggctggtcttgaactcctgacctcaggtgatccacccacctcagcctcccataatgctgggattacaggcgtgagccactcactgtgcctggcatatactgtgttcttaacaatgaagtatgctaggaaaaaagttattttaaaaaattgtgaagaagagaaaatgtgtttactttttattaagtagaagtggatcagccgggcccagtggctcacgcctgtaatctcagcactttgggaagctgaggtgggcagattgcctgaggttgggagtttgagaccagcctggccaacatggtgaaaccctatctctactaaaaatacaaaaattagctgggcgtggtagcaggcgcctgtaatccgagctacttgggaagataaggcaggagaatcacttgaaccctggaggtggaggtcgtggagagccgagatcgcaccattgcactctagcctgtgcgacagagtgagactccatctcaaaacaaaaaacaaacaaacaaaaaaacggatcatcataaaggtcttcaagttgagtaggctgaggaggaaagaaaatacaggagggcttggttttgctatatctcaggtggcagaggtagaggaagtcgaatgggattcaggagatgcaggcacacttggtgtaactttacaggaaaaccttacgaaccgttttgcattttcatttctctaaaaatgtttctgtatagtaacaatcctctttccatttgctttagtttcagtgctggtataatagaagggtccattcataaaggaagtccaaagcagtcttaagtaatcagaacccttctgccaaattgtctaatgtcaatttattttctggcactgcttctttagtgtcttcttcctcatcatctggcactggtttggaagcagctcatctccatcaagtggtcttttaattcctctggtgtggtgtctgttagctaacccttcaccttccacgttttctttgccatatccacagtctctttcgtgatttccttgatgggctctgttgtagatactgcgaagtcacgcgcaacatctggacacagttttctctaccaggagtttattgtttcagtcttgatgatgccatggttttttctataacaacgatgacatcttcagtggtgctctccttccagacttccatgatgttctgtgggggttctcttcgatagcattgacagtcccttccagagtaccgtgtgcatctttacgtttgtttacatttctctcaatgtgaatggtaccatatacggtctgtaagagtttgtgtgcataagttttgataaatctcaactttttattaatagatttatgtatattttatcgtagtaaatcataagataggctacatatgtcttatgcattcatgacaactctttttcttaattttggtttgtccgcaagtgttttcaaattgttggcaaacctccaaaaaatatttcaatatatttattgaaaaaaatccacatataaagtagacttacagtttaatcctgtgttgttcaagggtcaactgtatatgttttaaagcaatactctgttggtatcaactatctattgttcaaatatccccaattatcttaaattttgcttttttttgttttttggtgttttgtttttttttttcagaggtagagtctcgttctctccccaaggctggagtgcagtggtgcaactcggcaattctcctgcctcagcctcccaagtagatgggattacaggcacatgccaccacgcccagctaattttttgtattttagtagatacagggtttcactgtgttgcccaggctggctcaaactcctgagctcaggcaatccacccgcctcagcctcccaaagtgctaggattacaggcatgagccaccacacccagcctatcttaaattttcttttatagttggttcaaattgggatccacataggtccacaaattggatttaattgatatctcttgagtctcctctacctgttgttccttctcttcccccctccttgcttttttttctttgttgaagaaactagatcgtgttgtcctgtagagtttcccacattatggattttgctggttgcaactgcatggtgtcatttaataggttcttctatccctgcattttctgcactggtgattaattcaagaaacttgatcaaattcagattcagtggttggggggggagcccagaatacttaattgattatactttctattgtattatatcaggagttacatggtatgtagttgccactgtagttttctacttaaaaatatctctgctttttgcttgttttacatcttgtggcatactgtagaacagtgccatccagtagaacatttttgtaatgatgtaaatgttctttatcaccagtgtctaatttggtagtcactaagcacatgtgactattgagcgatgaggaactgaatttttagtttcttaaattgaattttaagtagtcaggtgtggcttgtggctactgtattggaaagtacaattaataggacatttttcaagagtattaaataacaaaagtagcagtagatgtctattcctgattttagcctagatcacagtactgtttcatcagtaaatcagctttttaaattattaatatttttaatggacaaatcataattatacacatttatggagtacagtggaatgttttgaaatatgtaaacaatgcaatgattaaatcaaactaattgttgtattgccttgccttaacatttttatggtgagacatttgaaatgatacttattttgaaatatatattattattgactatattcaccctgttgtgcaataaatctcaaaacttactcatccagtctatctgaaactttgtactctttggtcaccaactccccattccctcccttcctacccctctatccccgcaagcctctggtaaccgtcattatactctgtatgtctgtgagttcaacttttttagtttctacatataagcgagatcatgtagtatttcttttctgtgcctggcttatttcacttagtgtaatgtcctccaggttcatccatgttgtcacaacagaattccttttttgaggctgagtactcgtgtgtgtgtgtacatacatgacgttttctttctgtgttcatccattgatggacactttacatggattccatgtcttggctattgtgaataatgctgtagtgaatgtgagagtacagagatacctttgacatactgatttcaattccttttcatatatacacagtagtgggattgctggattctgtggtggttttgttttcagttttttaaggaacctccccataccattttccataatggctatactaatttacattcccatcaacagtgtatcaagagtctccttctttctttatctttgccaagacttatctttcatctttttgataaaaaccattctaacaggtgtgaagtgagacttcattatggttttaatttgataatcagcttttatgtacagtttatgtgttataattatatcacccaatttttcttaatgggacagcgatctagggcagccctgcagaggtacctgttctactgtaatcgctatatgaaccacatgcagagcctgcgctttgagcacaaactatatgctcaggtgaaacagaaaatggaggagatgcagcagcacaacatgtcctggattgaggtgcagttcctgaagaaggcagttgatgtcctctgccagtgtcgtgccacactcatgtacacttatgtcttcgctttctacctcaaaaagaataaccagtccattatctttgaggtaggagtagttctgggtgaggaaaaagcccaccttgtatcataggtctacctgatctttcatatataagatacagagttttcagggttcttgtttgttcagaacatgtaggtagacgaatgtatttattacaaagatacaagaaatttctatttcttgtcctaaattatattcagatcgatgtggtttagccagctagtgattaggtatgcaggttctggagtcagccctagattttaatctttacttcattatgttttagctctgttgatttggagcaaattccttaacctcttatttgtccattttaaagtgaggatagtacctttctaggttgttatgaggtttaagtgagacaatttgtgttttatgtgagacaatttgtgttaattgctatacggcacctggaacatcataagttctcaataaaagcctttattcaggctaaactaaccctgcaatattagaagttaatgtggtggttatctttagtggagaaataatgactaaaaagccagcttttagcagtaaaggttttctcaagtaaagatgttcatttaaaattgatgcataaaacattgatatctgtatatgactagacaataagactgactagcagatgggacttcagttgggtaacaggtacaaaactagccatagtggtaaaggatgatacaatttgaatcttccatacagtgttttcttataagaaataagtatagccagatgtaagcaataataggtttctattttttctcatttacctttgagttttcagcaaagagcagctctcagaacgagaagattccaaaagacattttaaatcctttcaaatggtcttcagtattcttccaaaagtaatgggtgaaatctttcgttcttttaacatttaaaaaattgttctggaaaagaacaaacaagttattagagatgaaagcccatagagctttacaggtgcagttaaaccacctatgaaagttacagaatgagtgttgagagcagtctgtagtcaacaaaacagtgaaaatggtttatcttttagctttattttgaagccaaaatttactttcattcttcttacagaataaccaagcagatctagagaatgccacagaggtgctctcgggctaccttgaacgagatatttcccaagattctctgcaggatataaagcagaaagtacaagacaagtacaggtaatttttttttaagctgttgaataaaactttctgccagtgatgatccttactggtaaagttcagtgatagtgaaactgggtttagcatatccagcaactgagcttttgccatgtttctcacagattgcttctgtccgttgggcactaaattgcaggtaatagtattggtgaagcatacatagagaaggaattcagccatttattctattggctaattccacttctgttcagttatttagttgctaccttgcaaggaagaaagaatccaaaaaggccaagtggcctttaggatgagagtgagaattgaatgttggtcttagcctgagaatcctatgtatgggtcatggctattcacaaatgagctatggaaacttactttttagagtttttattacatatatatatatatatttttttaatctaaggagatacttgtcctaggagtcgatttttcaagatgtgccgcctcttaagctagagatgcaaaatgttttatttctcaacatgaagctctttctcccaaagtgacaaatgctagtgtcttttgaaagttgtaggaaacttggggagtttggaagacttggagatttagtcctaaccaatatcttcccttcccttagccaattttagctaccatattttgtttacagtacttttacagttgacagagattttaaggacgtgaataaagaacccatgaaattatttctgaacctgtttatctgcagaactgtgggattgaattatgatttctaaggtccatcagaacttgtaacactttattgctttaaaattaattcccatggaatcatggctttcagaaaataccattttaatattagaagcagtttgatgtgtctgtacatctagacctgaacatgtgcctattaaaataaaaaataggtgcttggttccgagtctggataaactatagggatgccttaaaaataagtaaatgcctctttttttattattagaggctgacaacaagtttttttttttttctctttgattacagatactgtgagagtcgacgaagggttttgttacagcatgtgcatgaaggctatgaaaaagatctgtgggagtacattgaggactgagaatggccctgcataaaatgaactctgaaaactttaccatctagagtgctcatgcaattaaaacaaaacaaacacaaacaaggaggcactaagcctattctgacaccactggtctgtagtaccagaattgttttgttaatggaaagtttaagtaaattatattgtaataaaaaggtagataaaccattgtacaacagtattctaggccaccaacaaaagtgtgacagacacactaaaagccctccaactttaacttgtaacgtagcttcattctcaaagctgactccttttttttctttttccttttcctgagtgtagtacagttaaaatttcaaacagctccttgacactgcttttcatgttcaaaccagccattttgttgtactttggtaaaggacctcttccccttcctcccctacacatacagatacacccacacacagactgactctctttctctcataccccaaggtcatgagtgaatgatgcttagttccttgtaaagaaaatcttgggatggggaaaggggtaggcagcaagaggattcaacaaacgaaaaacataaaaactttgtatatgacttttaaaacaagaggacaacacagtatttttcaaaattgtatatagcgcatatgcatggacaaagcaagcgtggcacgtgtttgcataatgtttaattacaaaaaaatatttattctttaaaaatcttcaagattatgtctatttgctgtgcattttctttcagtttgcttatctttcccgggttggggttgggataaaggtgtgtcggtttagcacctctggaagacctatctagagctctttcactttcctgaggttattttgccctttctggtgttggtatgtctgttgccggccatgggcctcatgccttgaattcctgctcttgatcagggacaagggaggtcaagctctgactaatgccatgacctgattaaggggtacagcagggagttttgttgctacagctcatgaattaacctgtcccaacctaatccccctccatggcatcatgcctctacccaagcctttgtgtgcccatgttatgcacacagctgtaggcattcttaagtcccctgtcgcatccagtggaagcattttaaaatttcttttactttttggttttcccttaattgctgcttttcagattttagttatggctcgtctgctcaccccttctctacattagggtgtcaaagagaatgttttgctttaaatataaatagccattcatttagtctcagattgtgaatttaaaatggtggataccgaaattgcttgtgtgtgttgctgtgggtttggtttgaaggcaaacacccctagaacatgatattcccatctagtgcatttaaatagaaatcactgagtttgctgcttttttattgtcagcagataggagaattaataatgcattttagctgtgatgtccatttttatgaaattcctactaagagctatgttaaaagtaaaggatggtggtggttgtattaactatatacctgtttaggccattctggctgtggtatttttcaataggtcagcatctgtaaatctgtcagttttatacaggagtgcagagtgaactaggcaactagattaagaggtctaaatatgaaataccagttgaggctgaggacctcttcgtcttcctttaaatgtcttttgcctagggagtgtttaccatttgtgaggcagctttgtctgctcttacactgtacatcctattactccattgggaagtaggttcactttcctctggccttttgcctaagttaggctttgctgaatcaaccctacttttccttttagaaaaggttgttacaggagatttactggcaactgttcttttcccatcaaaaatcagtgaatgtttgctgagtataaatgctgcttccttaaaccacttgtcgctttaggatcaactttacctgtaccttttctcctttcctcccttgccacctcaggtgcaaatctgaactcagtgtctgcttcttccattttctcgtctctctcccctcttcccccattatccatatgacattattttacttcaaatgacagcatcaatcttaaaaagatatacattaaaactaaggagtttttttaaagaaagcctgaataagttcctttccctggtaactttgaaaagcagtcagagttgctatatagatatatgtggctcctttaaaatgctttgtgtatgtgtggtgtttaaaaaaaaaaaatcttaccagttaactttgcagtgtctaggtttgagtgtcataaatccacgtgttcctgttgcaacaaatacccaaaaattgtgtgtgcacttcctaataccagtcttcacccatggaggaacagtgctttttagagatgctttctatttcaatgttggcatactgcctgagggtattgcagttgtgggtgcattccctaatttgtatgatcaagatgaactggcccttttctacttccaagcttttaacagataccaccatatttgacagaattcccagagtgaattgcttgtgttattagtagattcagtgcccccagctgggataggcaagccatgacagcttccctgtttcacctacagaagtcttatctgagggatctattcacagtaagcaccaaggtctccatgtcttgaggtcagtttcattgtcttttgaaaagtgcatgcttcatttgaacaattcattcagcagcagatggactttcagtgatttaaaataaaattttgatccaaagctcaggacacaaaccacagtggtaaaattgagtagcatataatatcagactaaattatctgtaattttccacaacccagattgtatgtgttttatgtgtgtttaaataaatatgttagatacacgtgtatacatacacccatatacaacagatccaagactggctgacttcatttgaaatggttgaatctgctgtgtaataaagtggttcaaccatgattaggaactgaaatttagtagaagagggaaaaggagttaatgtaacaaattattttagctacaaaccccggtaatagagcacttgggggatgggatggggtgggttggtgagacaatcagaatggtaaattgattaaatgctcctaaccctgtaattttgtgcatagagcaccctatgctgtggaaataactgttcttagatttcattgtaactggactgttcaggttgcccagagggaaagaacattcctaattctaataaaataaacttttattttgttattccattagttacttatgtttatttttatagttaaaaaatgactaaaggtggctaatagccacccgtattatgtgccttattcactgttcccacttaatataaaatgtcaaaaattggttgtttctttgcagggaactgtgaatgagcccattcccccaacatttaacttggttaatgaagctttcagagcattttctgaaagatttccaatttctgcatctcagatattgaatttaaattgtttgtgttgtaacagtgatacaaaaatgttcaatagctctttgaatgccactttttttaaagaaaatactttaaaagtcattcttagctaacctcaaaactcctttacattactttcattttagctcactcttaaagctgatactgttatatagggatgaagggagagttttcttaaagaaggtcccaaagttgaagatcgtttgtcattgatactctggccaagtccaggttttaggacaatttaatttactcttatttggatctgtaattatgggagtttatcacttttcctcttcaaagcacttcaacttactgtctaaaacaagtggagaagaaattgccattttttataaaggaggaagataaggctcactgaggttaaataactccctcaatttttcatttccttctacctgaaacttaacatcatgctacctctttgtatcatattttgttattctggtcacagaatgacctagtattctgtaccagggaaggtagttcttaactatattgtacttttaaaccacattaaagactattataaatgcctatcactgctactgttagaggttgctctatactatctctgatctttcatttgttgcagtttgcaacacagtagttgagaataagtggtttagtatgatttgcttaatagtacccaagtaatttgcagttgttggtttagttattcaaatgaatttccattgtaaagaattttggatagtctgcaggaaattgttacaggatgcacagaacatcccatatccattggatctcagcctttgaggctttaaaaagatgataagcagtgagttttatgagaaaattttggctccttcagaaacaggaagataagtgggcccctcagatttttcatatatctttggggataaagttggttatatctggtttattttagggattttgcttctgtagttacccaagatcaaatagccaactcagaaatactcagttggatatcaatcaaatagtgcctaccaggggagtaaacagacaacttttaggtttttagtttttgcttttgtgtggagttgagtccaatttttaaggcaactattgttgacctttctctaggcggtagcatttaggatgggaaaaaataatatgagttatgtgcgaaaagcagttttcaggctatcatttagggccacagatatgcttatttaggactattttcagggtaggagccagttaaagtttgtatatcagtcacacattgatatgtagcagctctatcaataccacaacaaccttattaccatagtaattcaggggtctcaagtaatccaggagtctcaaactgaaatgtcaacaagagccaagtaaatattttagaaatagagtaccctggagtagatgggctctgagaggagcctgtgaaatccagacttcatgtgaattctcttaattaaatgtgggccaaagaaaacccggccatgggcagtttttttttcccagcttctactagtcttggcttgcaacaatgccactgtccatctggcattacctagaccagtgatacttaaacttgactgcgaattggaatcactgagaagctttaaaaaatattagtgcctgagtgttactttatggagattatgatttaattgctttgggtaggcatcagtaatttttgtaaagccctttacgcattctcacccctaattccagccggtgattctcacatgcagactaggttgagatccttgatctagactgccttctatagttgcaaaaagagaatataggcgagcaactccagatcataagggacaaaatgattcaaggcaaattgactggctcagaatagggcctcactggaggccctagttgagtgggttttgtggaatggtgcctcccaagggtctggtgtgcagtgcccaatttggttttttgttggttttctggtaagtggtccaccttggagaaaatcacaaaactaaaagtcttaccaagaagtagaactgacaagcagccatgttgattggcagtacattctcttaccaagggggagaaatctatctagggaaaataatacagagtctgagcaaaggaagttgagtggttataagcaaaactgtcattaaagctagttgcgtcaagtctgcacaattccacgagcacttaagagtttacaagtttctcatgtctatcattcttttgataatcttgtatttttatttcaagtgtggtatagtagtaagaatattggtatttctcagccatagatttcccttttgtaaaatgggaatactaataggaactgtaatttgttgagtgctttttgccagatgccttacttttgtctgtatcttccaagcagccctaaagcaaaatgggcattgttaccctatttttatgaggaaagacactcatatactactaacttactcaaaagttacacattgagtgtataacagggccatgcttgtctgattccatatgttcattctattatgctgctgttgtctgttacataggaatattgtgaggatcaaagaacatgtgaaaacaaaacctagttacaataataagcacaccagtgctaacttgggcaaaagataaggatacagagctgtctcagagactcccaaaggcaggatgagattgggaactagaaaaccattttggacccctaaagtggtattgtctactatctgtacatcattctcttacagctcttactgctgcttttcctgtcagttaccccatagctccaggtattacatgttaactgttcctgacacatgtagacagaaccaatcagatccatggggcaggatcatcaatacaaacatgggtgttgagagcttaacttaatcgggaaggagatcttggagatcatagttcgctgggttcacatcatggaaatcgtctttgacaaaactgaaatgccctgaagttttaattttttaaatacatgtaatgaattggtatatggtagatactcgtggctacttagtatttaccaaatgctttgtttccatctcgtttatttttattttttatttttttaagagacagtcttgctatgttgcccaggctggacttgaactcctagtctcagccaaccccttctgcctcagcctcctgagtagctgggatcataggcatgtgccactgctcctagctcttccatctcagtcttatgatgtagttactattttcattttataaataagaaaatagaagctcaaataaaatgggtagtttccttgaggtcatcctgttagtaagtggtggaatgaagttacaaacctaggttttattggtcagcacacacagtgccgggcactggcagtacagcagtgaacaaaaggtctgttggtttgtctgaagctctcaaccttgattctgcatagactcggtggattgcccaaggccactcaaccagttaatatcagagccagctctgctgtttgaccagtatattattttcaccatgctgtatctgcttctcagtcaccaaaagcaccagctaaaattgtatatagactgattaggggacttccaacctaagattgtcctggaaacttaattcttatcttggctcatctcttcaaaacagatgcctctttcgttggtgacctcagatacactgttcagaagtactcaaagtattccttttttctcacatttgagagtcactctagcattttaatgagttaagcaagccagccctgcatttccaaacccttcccagaagtctaaccttactttgatctgatgacatgggctttttaaaagattactatttttttagaggtggggtctcactatgttgcccaggctggaatataatggctattcacaggcacagttagggtgcactactgccgtgaactccaggactcaagccatcttcctgccacagcctcctgagtaacctaggactataggtgcatgccaccatgcccagctgacaatggctttatatacataatatttcctcagcaacaatttatgtcttatttggcacctgtaaaaccctcttcactgattatgcctgtttaaaggtttggtatttactccaagtcacctgcctttagccatggagtattcaagtttctttcagaatgagaatttggagggtgctcatagaaatataaaacaaggctgggcatggcggcttacaccttgtaatcccagcactttaggaggctgaggcaggtggatcacgaggtcgggagttcgagaccagcctggccaacacagtgaaacctcatctctactaaaaatacaaaaattagccaggcatggtggtgcatgcctgtaattccagctgctcggaaggctgaggcaggagaatcgcttgaacgcgggaggtggagtttgcagtgagccaggatcacaccactgcactccagcctgggcgacagagagactctgtctcaaaaaaaaaaaaaaaaaaaaaaaagaagaagaagaagaaatacaaaaccaactctttatagtagacagtttatcccccagaaagctttttaggctgaaaacgtttctatagattttggatttccttctgatagctaaaatttgtttctgtataacagagtagtgccctataagccagttcagtgcacattaaatggctgttcttagaattatgaatctgaggcttatgcagtgaggctctagctctctggagtcagttggtcaagtgggattcctgaggactgagcaaacacacacagagcaggattttgtcctaagttttcttagggatcctatccaaaaacaccattacttgaatttcccagcttccttttacagggagacttccttgctatgtgtactcccacctcggtatgtcaaatcattttctcagaggaagtacagcataaaataataaccagcatttgtagagcacttcttgtgggccttcttgggcaaatagacattctcatggaatgctctaaaattgttaagttcttgcacttgctctcaagtcatttataatctaattgctggtcttcctggtatgaacaaagatgtttgcttgttaataaattcctaccacatacccagacttgtggtttatttctatctaactagggaaagcactaaagagttttccaataaggaagaatgatctgagtgtctacctgctttggaaaagatgtctgccatggataggaaatgattttgtatcccaaaatcctagtactaatttggagtgttgtaaaggtcagggcagcaaatgctagagagtgggattaatgaaaagttatagtgttctgcatgcctttgaataattaatttttactccatttttactcgcttgcaataaagtaggttaagtgctgtactttaaggaagtccatgtacaagccagtgccttaacaatggtcaaatggttgctcactaaccaatggaaataaatgactgttgtttccacaaaattgctttacagattctaaatgctatctctgggacactggattgtgtgctctttaagataaattccataatcaagggcctggccctgaatagattggagcccaaaaatctcactgaagcaaagagataataggccagtaaagagtgggagacaaacactcctggaataggaagccactactcacctttattttaaattgatatatagaaattaatattacaaaatgcacacatcttaagtgtgaagtttgatgttttgacagttgtatacgtctgtgtaataactaccaaaagaagacataatatgttacaattaacccagaaaattctcaagtacttttaaatcacccctgagcacctccccactccagtgatcacttcttgatttttatcactaaagatttgttgtacctgcttttggattacatataagtggaatcatataataatgtactcttttgcatctggcttctttcactgataatgctttaaagacacgcatactgtatgtattaggacattgttctttattgctgagtagtatttcattctataaatataccacaatttgtttattcattctcctattgaaggacctttaggttgtttccagtttggggcaattatgaataaggatgctatcgatattcttacacagccttttgtttttgttttttgtggatatacatcttcacttgtcttggataaataagagtagaaaattactgggtcatatggtaagtgcatgtttataagaaactgccctcttattctccaaagtggttttaccattttgtactcctatcagtgatgtatgagagttacagttgcttcacatgtctgtcaacatttacactgtcactgttttttatattagccattttagcatatatgaaataactgattttaatttacattacatttccctgattaatgagttgagcactttttcatatgcttatttttcatttgtatatctttcaagaagtgtctttcatgtcttttctcattttaaagttgggtgtctttttattgtaggtgttattctttgtattttgaatataaatcctttgatagatatgctatgattttttaaagactctatgtattcacttattgggatctttcgatgaacaaattttttttataaaatccactttatcagttttttattttatggttttatgacctcaaagtcacaaagaatatattttcttctagaagttttatggtttgggattttatgtttaggtctgtgatccatctcaaattaatttttgtgaacagaatgaggtttggtttttttccaacatggatatacagttgttccagcaacatttacttaaaaagacttttctttacccattagattgacttggtagcttggttaaaaattgatcacgtgtgtgtgtatttctacattttctgttctgttccattaatctatttgtgtatccttacatcagtaccacactttggattattgaaactttctagtaagtctttaaattagtaaatccttcctttttgttatttttcaagatcgctttggttattgtcgattctttggattgtcataaaagttttacaattagctcatcttgtttttcaaacgtagatgtgctgggttagctgtgttcatgccactgcattccagcttgggtgacagcaagaccctgtcaaaaaaaaaaaagaaaagaaaaaactgctagaatcttgatatggggttttgttgagtctataggtcaatttagaatgaacattttaatagtattgagtcagctaattcatgaacatattaagtcttgtcatttatttaggtattaaatttttttctcagcaatgttttgtagcttcccttgcgtaacacttgcttatcttacattagactttttcttaagcatttgatttttaaaatatttttgattttcttttctttttctttttttctttttttttttttgagacggagttttgctcttgttggctaggctggagtgcagtggcgcgatcttggctcactgcaacctccgcctcccgggttcaagcaattctcctgcctcagccttttgagtagctgggattataggcacacaccatcatgcctggctaatttttgtatttttagtacagacggggtttcaccatgttggtcagcctggtctcgagctcctgacctcgtgatccaaccaccttggcctcccaaagtgctgccattacaggcgtgagccaccgcgcctggctaattttcatttttaagttgtttgctgctagtatctagaaatacaattgattttttgtttgtttctttagagatgggtctcactatgttgcccaggttggtcttaaactcctgagctcaagggattctcatgcctcagccacccaagtagctgggactttattcacgtgccagtgtgcctggctgatttttgtatgctgatcttgaatcgtgccaccttgctaaattcatttattctagaaatagttcttgtagactccgtagagttttatattaaatagatacacaacagtgtagtctgcaaataatgtttttacttctttttctgattttatgccttttcttctttttttttttttttttttttttttttgtctttctccactggctacaatatctagtgcaatgtttaacgtgtggtgagagcagacaccttgccttgttttcttaatcttagggataaagattttaatgtttcatcactaagtataatgttaactgtaagtttttcacagaccagcccaaagaagttcctttctattcctaatttgttgataatttttattaggaagggttattaaattttgtgagatgcgtttttagcttttaataagattattatgtatttctctttttattttgttaagatggtatgttacaggggttggcaaactgtggcccatgggccagatccagcccatggacagttttgttgttgctgttttagagacagtctcactcttttgctcaggctgccaggctggagtgcaatgacatgatcatagctcactgcagccttgagctcctggactcaagcgaccctcctgcctcagcctcctgagtagctaggaatacaggtgcatgtcaccacaccaggcaaatttaagaaattttttgtagatcttgccgtgttgcccatgatggtctcaaactcctggcctcaagcaatcctcctgccttggcctcctacagtgctgggattagaggtgtgagccaccacacttggctctcatggactgtttttgtttttgttttgagacagggtctctgtcacgcaggctggagtgtggtggcatgaacgtggctcactgcagcctcaactttcttggctccagcaatcatcctgcctcagcctcccgagtagctgggaccacaggtgtgcgctaccacagctggctaatttttctttttcatttttgtagacatggagtcttgatatgttgcccagattgatctggaactgctaggctcaagtgatcttcctgccttgcactcccgaagtgttggcattacaggcatgagacacagtgcccagcctattgcagtgttttttgttttttctgttttttttttttttttttcatctttgtttttgtttttttgagactgagtcttgctctatctcccaggctgtggtgcagtggtgcaatctgcaacctccgcctcccaggtttaagcgattctcctgcctcagcctcccaagtaagtgggattataggcacatgtcaccaagctcagctaacttttatatttttagtagaaacggggtttcaccatattggccaggctggtcttgaactcctggcctcaggtgatctgcccaccttggcctcccaaagtgctgggattacaggtcactaggcgtagtagggctactacgcctggccctactgcagtttttaataagagatgagttctctcagcttttgtctataagagaatgtccttacttttatttttgaggggtattttagttggatataggactctatgttgaccttttatttcttctttcagtactttaaagaagttattttattgtactcaggcctcatttgtttctggtgagaagtcattcatcattttaatttttatttcctttccgtaatgtgtggttgttctcaatggctgcatctgtgcattatatttacttttcagtagattgactagggaatgtctaggtatgtttttctttgtatagagtttactgaacttcttggatctgtgttgatgtctttcattaatattggttctttcttggccgttatccgtttacatttttctcttgtctcatactctcttgcttctcctcttctttggagattctagttacatgtatattagatgatttgatataaacctacagatctcagatgatttttcccctgccctgttttctttttgttttcagtttggatactttccatttaaccatctttaagttttttgatgctttccaatgttaacctgttaaacttgtttattgaattctccatttaaaaatttttatttttagttatttatggatacatagttgtactgaattattcatttctaatatttttatttctagcatttcattatatttgtatagttacaattttctgctgaaatttcctatttcttcatgcatgttttccacattttccattctactttttagcattttaatcagttattttattgggttttttctgttttttctttcatttttaatcagttattttaaggatccaaactgataattcaacatctgggtcttttctagttctgcttctattgagcccttcctctcccttaccatgaatcttattttcttgcttttgcacgtcttgtatatttgattggatgatggacgttttatgttgaaaaaaaaaagaaattgaagaaaatgtttacttccaaaacagagcatgccctttgtttttttttcaggccacttgaatggtggctcaatctgatgtatatgaattctagactggggcttcactgcagttttagtttgattcagtttgcctctagcttcaaatatttgaaggaacgtagaatcagaactctcatatcaccagggcctgagttttgggcattggcaagattccagagatctgactttgcttcatagctaagccaccagcttttatcaatgtgggagatctttccctactttacaaccttgctgccaggatttttttttttaatcaatgggctggggataggaggatctttctcagctctcatgtgtgccctgcccttttgtagaggaatgcccacaatgcctaggggatgggtttctcagcatttctgaccccatttaggctccaagagtgcctctgttggatttcacaacaatcctgcctcccctttcatttttaaagggtattttgcccttgggagaagtcaagctctctcagcgttccttctattatccacacctttagtgtactacaccttcctgtacctggttatcatctaaggggtaagattggtgggaagccttcctctgtggatttgggtcatctaggttctaatgtcaaaccagcctccaaggggttgtgaaaatgttgttaaatttcagcaggtttctcttttctcccccctgtagtattcctcttcctaccatagttcaactaggaataacaacagctagggggtctcttctctcctatgaaggacttggcactttctggagtttggatcatttaggtttctttggtttttgtttttattttgagacagggtctcactcttacccagcctggagtacagcctgtagtgatctcagctcactacaacctctgccttcctggctcagttgatcctcccacctcagcctcctgagcagctgggactacaggcgtgtaccaccacacccggctaatttttgtattttttgttgagatagggttttaccatgttgcccaggctgatctcaaacttctgagctcaagcgatctgcctgcctcagcaccccaaagtcctggggttacaggcataaaccactgcacccaacctagatttctttgtgtccttagctttctgatgaattaaacatatgttttattttctagctcatctggccttttgttgttgtttgctagagtgggaggtatattccttgtgactttgttcatatcactagtgaatttcagaagtaggagtttatttttttaataaaaaatttttttaggtcaggcacagtgtctcatgcctgtaatcccagcactttgggaggccgaggcaggtggatcacctgagatcaggagtttgagaccagcctggccaacatagtgaaaccccaactctactaaaaatactaaaattagccaggtgtggtggtgggcgcctgtaatcccagctacttgagagactgagtcaggagatttgcttgaacctgggaggcggaggttgcagtgagccgagattgtgccactgcactccagcctgggtgacagagcaagactccctctcaaaaaaaaaaaaaaaaatttttttttaaacacgtctcactgccacccaggcttgagtgccatgacatgatcatagctcactgctggcttgaccttctgggctcaagtgatcctcttgcctcagcctcttgagtagctgggaccacagtcatgtgccaccatgcctggcttttttttttttgtagagtttgggtctcgctatgttgcctgtgatcctcccaccttggttttccaaagtgctgggattaaaggcatgagccaccatgcctggttaggaatgggagtttaaacaatggttttatttacatatttcattagctagtatttttttcttttttgagacagagtctggctctgttgcccaggctggagtgcagtggcacgatctaggctcattgcaacctctgcctcgtgattctcgtgactcagcctcctgagtagctgggattacaggcgcccgccaccacacccagctaatttttgtatttttagtagagacagggtttcaccatgttggccaggttggtctccaactcctgacctcagttgatccacccgcctcagcctcccaaagtgctgggattacaggtgtgagccatcgctcctggcctcattaactgttttcaaaagtaaaagtacatggataatacaaagttaaattttgtagaatcataaagaaaagcaacaccttcccatcttaactcccctagtgcctctactccctccacagagacaaatatcttaccagttggttgtgttttcttttccaaactgtatttctaaaatgtgtcaatatctcttccttttattttttattttttgtagagacaggggtctcactgtgctgcctaggctggtctcaaactcctggcctcctacctcgacttctcatagttctggcgtgagctactgcacctggcctcccccttattatttttttaaacatgaatggaagcatactatattttctacactttatttgttttatgtaactattttaacaacctgaggacttttacaggctgcataatatgtcttaatatggatgtatcttagtttatttaaacagttactggtgatggacatttccatgtttccagtattttttctcacaaacaatgcagtattatgcctttgtccacattcaccattgattgctattgagtatatctgtagcatcaagaataggcatactgaaaatcctccatgaagtccagtgaagcttcatattattttgaagtgatatttcccagtgttggctggactctcaagcgtttgtggtataggttttgggaggactggacacttccaaagagaaataagatgttacagacttgtccagcaggtggcatcagaacaaagctggctatggaccttgtcagtacaaatgataaaacattaaaaatgtaaaaactcaactgtagctccttgtttatacatatattgggggtgttgaaaagttaccgatgcctgattcctcttctatgtcctcagcccccaccataaaaatagataaatgccattttttttgtatgcccagcacagctatatgatttgaataatcttgataagcagggtcacatttgaggagatttgctaagggaaatgaagatccatctgtgacacaagaaacatgttctatgtgatttctgggattttcctgtgaacatacttcttgtttgtttgttttacagtggatctcactctgtcacccaggctggagttcagtggtgcaatcatagctcactgcaaccttgagctcctgggctcaggagagcctctctcctcagtctcccaagtagctaggactacagacacatgccatcatgccaggctcattttaaaattttttgtagagacgggtctcactatgttgctcaggctggtattgaactcctgggctcaagcaatcctcctgcctcagcatctcaaagtgttgggattacaggtgtgaaccatagtatccaacctattatgtttttttaaaaagagattgttctaattatgtatataattaaagtacattaggtttagtgattgcaatttgagaaaccaatgtcctttcttattgaaaaaggccctggtacagaaagtgttctatcttcctcacaagatctgaggtcaaaggagagattttgaaacattatagcaatggcttctagttattgaataaagaatgtcatttgctcctcacaggacccctttcagggagatttcacatattgggaaacagcctcatgagctttctacaaacatctttgtccttaagtcttcccatttcagtaattggctgtaccactcatccagcagctttcaaagtaagaaacctggcaatcttcctttaacatccatttccctttccctcattcccccatatccaatcatgtgtattggaggtttttccacctctaaacttgagaacccatttactttttctccatctcctttgccatcacactagtccaagtgaagtgtttcatcatctcatttgcagcatcctttagtttaccctagattatcaatttttgtccccctcccaattcagtctctactcatgagctaacatgagtttattaagtgttcattctgaccatgccattccttgctcaaaattctctagtgccttcccaatgcccttaaaataaaattcctcatatggcctttgtggatctgcactcctacctcttctcctattgcaaccaaccctgttacctttttctcttttcacactggtcttcattctgtgctgcaaactggctgagattcttccatcctcagggcctttgcacaagttcttcctttgccttagaattctttcctggcctgcacatgtcttcatcccctttccctaagctaatgccttaccctttaggtctcattttaaacatctcttacccaggaaaaatttccctgtccaaacaagtctagattggctccccattgtttgttctaactgttctatatttctccttcttagcatttatcacaattcttggtatgttgtgcttttcactttcttagtcgctattattggagtaggtaatacatccatatagtacaaaattcaaaatgtattaaaggtatagagtaaaaagtcttctcttccctgtccccccgctacccagttctcctctttagaaccacttttagcattttgaatatccttccagaaatattttctaagtatacaagcaattatgtatataatattcctctttatttttgcctttttattaatacagatactatatgcattttctgcactttatctgttaataatatatcttggcaattattcaatattaatatgtaaatagttgcctctttctttttcatgcgccatataatatggacttataatttatttaacctctatctaggttggttttaggcattggttattacaaataatgctgcattgaatacctttgtatgtaaagtcatttcccacatctatgcctatagaataaattactagaattgaaataattcagttaaagattatgtgcatttttaattttggtagttattgccaaactgctctcaatggaagttttatgaattcccactagtgaatgcatttgtcctcacaattatgtcagtgaaatttttgttctttgccaatgcaagaaatggaaagtatctcttggaaactaatttgcatgttttttttccttgcacagttatattttcatatgttaaagagccatttgtatttcttggtgaattgttcataaactttgcttacttattatctaatgtctgactaatttgctacactctaaattcccaattcatacttaagtctcgcccttgcaatttagatgtacaatctgcctcttcagtggtttccacaccaaaaaatccacaggctcctgaattttatatgggcctaagagtcttactgaaaattggaagtcttaaggtgtagtctattttatgcagtgtgaggcctttcatgctctgaaatgtaccactcttgactgactttttcttcttcaccctgtccggcactgtgcccttattagccagagaaatgttccccctttctcccaggaaacgttctgaccttaccctggtccctcaaggactctccttctcccccaaattaactttcaaggagtttctccaacccaaaatggcacccttcctgaaaagatttctagtggatactgttttctgtacctcactacggatgtattttgctgcttggctccccgtctccattttgctatggcaaacatttttttccagaaatatatcagataaaatgaacatgtggtcccttttgttgatttttgttgggatccatggtattgatttcttctagtttagataattccaccgtggcaagcttttattcctagcatagcgctcatgaggagaatgttagtcacttggtgttattaatgctaaaatagtaaacaagaacacaaaatttgctagattagaagtggattttttttccaggctgggcacagtggctcatgcctgtaatcccagcagtttgggaggctgaggcaggcagattgctttgagctcacgaattcgagaccagcctgggcaacatggagaaaccccgtctgtactggggctaattttaccaaaaaaactagccaggtgtggtggcacacacctgtggtcccagctactggggaggctgaggtggaaggatggcttgagcctgggaggcagaggttgcagtgagcctagttagtgccattgcactccagcctgggtgacatgtctcaaaaaaaaaaaaaaaaaaaaaaggtaaggaatgaattaacatgaatgaaaaaggcatgatctgcagtcagtcacccatggtcaaagatagcagataccaattcattctcagagcgaaacgaaatcagcccaatgcttttggcaaactgtggttgcctccctgtcatcatcatctgggctcactgtggctcgcccttctggccttgcttctgaccttgccatctctggggaggcttctttgcaagcccaagcttgggctccccttctcagaaccatgtgcatacttgtcctggaactgtttttttttttttttttttttttttttttttttttttgcctgtgcctcttggagggcaggggccatctggcacaaacctgcatccccgcagttgctaaattaatgaacaaacaaataccaagtctttcacaatgtaacttgagagtggaggtagtggtagtggcaactccatctgggggatgagagaaggtggaggctgagttttggggatggcttgcaacagaagaggagagattattagcagctaaaggagtggccagggtgaacaccaagcattttcctgactggggagctgtgggtttgtttatggctgggtaaggggtgaaaccagtgagcaggagagatagctagtactggactggagtgaaaggcatctgtagaggcaggagacaggatggggaggtagaggagttggcctaggacaggacagcacttatttgaagactggtgggcaggaggaaaggaaggagagggattgagaaatgacctggaggtcctcagtcagctgggagaagacctggaagagggggattggctgctgttgggatggagaggagggccaggggaggcagtgactcacacggagggaggctcggggatggggactttggcagtggggggtgggaaagacatactcgcaggggatcggaaggccccgtggcaactttgtgtaagtcctggttcagtcaaggagaggaatccgagggaaatgcctgattggacccatggcccactctgagagaaaggggtactgtgggtgtgcaggaggaagagcagctgggaagtaggagtgcctaggactggatccaactggaaagggggcagatatgctcccaggatcagggtagggaccctctaggaagggggcgttctgagagggaggttgtggggagcactgtatgggggtccttggaggtgatttctgggaaggggaagtctggggcagggctgtgaggagtcaggaaagaaactgtggagtccgttcctcacccacctcctgagccctggggtctgaggcccccaggaaagagggttcagtggcacaggagggtccagggcaggagagagaaagcagcctctcaggtcttcttggaaaggaactctgaccaccagtgtgaatagtcttgcagaaagctaagcggacaccaagtgaaagctggcccctcccctctcccagagtgggaggggccagcggttgcatgggcagctttccttgtgatgccacagtcctctggacacactgctgccttgccacacctcctttccctttcatctttctcatcaaccaatgggcttggcagcattgaggccatgcccctattctgtgttctagtgtggccctggttatccctcctctgactcagttgcacagctacctggcaggtgaccggaggtgtttagcagtcttgcctggattgcgctgatgtggccccaaccccgcctccctccccacaccaccatgtaggaagaaactcaacagagcaaattggctgcagccaagaaaaaggtaaaaaccaccaggtcatagcccctgacccacctgcagacttcctctgacggcaggactactgccagagtctgtgccactcctgaggcacaccgggttaggcccccctggtgcctctgcactccccctaccaaaatattgttagccagcgctgttccctcagcagcccagcccctgccctcaacagtcaccccagggtgactactggggcaggtgactcctggggctccctgctccagactaggccctgacctcctgccccctcccaagcctgacctccctgggctctttggcctggcatctccaaggactaagacaaccacttctggtggttgccactcacctggggatgtgagttttggctggccaggctcctggggacagggggcccaaggggcagtagagggtaattgttaagattgctgggtactggttaaaaattctgggtttgaatcctgcctctctgtctgctggggatatgatttagggcaagttacttgagctctttgggcctctcttttcatatctgtataatagaggtggtattgtttgacttccatttgtgaagtttaaatgaaatttgttgttgtttttatgtgaatccctagtacatagcctgctgtaaacacacaggacacccaggaaatggtcattgctgtttgattttcctcgccccagtctcaaggggaagccaggccaatgagaaaagccacttgccatcagcctatccctttagaagtcactgaaagggccccacgtgtggtgtaagagaagatcttacttgccaccagcttgctgggtgaccacagaaaaatcactatttcccctgagcctcagttttctcctctataacatgatactggataagatcagtgtctttcaaacttgtttttcacctggagtcaccttagctcaactgaacccttactcagaagtctggttttttttttaacagaagtggaggtctggagctctaccacattcatcgcccatgtcctgggcctgaggagaggggtccagtgagcgtattgagaggtgcattggtcagctgactccactctgtgactgcgtcactcaggggacttttccatctatttgttcctgcccctggcaaggcagcaggtggccatttggaagaatggcacaggccatggttttaatctcctctgctcttcttcagcgtttcctttccctgaatccacatctttctcctaccctgactttcttgcttctctctaagccacttctgtctttctccccctgcccttgtttttcccttttcatctcctgtagattcaggacattccgaaggtgctggtgtccaaccttaactactccaatggggtagcactcctcgactggacaagtggaaggtgaggcagtgcccagacccctctctggcttgctgtctccagctatgcatgttcctgaggcttctctggtttgggggatactttgcctctggcttattttatgttgctgccattaaccttcagcctgtttatgtctgcttcttcacttgcttgattgattgagtttttttcctttccagcatcttttatcatcttggaaatggtgagacataccttaaagtttaaaagtaatttgggaataatgtacaaagcaggaatatgggatttggggctttttttttttttttgagacagagtctcactctgtcacccagactggagtgcagtggtgtggcacaatctctgctcactgcaacctctgcctcccaggttcaagcgattctcttgccttagcctcctcagtagctggcattacagacacctgccaccatgcccagctaatctttgtatttttagtagagacgaggtttcaccatgttggacagactggtcttgaactccttacctcaagtgatccaccagcctcagcctcccaaagtgctggagttacatgcgcaagccaccgtgcccagtcccttgctgtttttatactttctctatatccataactgtttcccatggaagtttttgtttctttgaatttctcatttttattacccctgcatcatctgctaccctaaaggatctggaggtaagaggccctaggctgaggtgcagtgaccctgcaggccagccctccaacctcctctcacagtgggggctgggtgcccctctgccagctgagacagcccacacacaccccagccctaatgattgttctctctacctctccctgcagtcctcctccaactcctcctctctgtatgcacctcagagccggtaccaagaactagcagtagccctggacttgagctctgcaacaatcagtcaactcattgaaaacatagtcattggtaagagtccagtagagtcccctgattccactctgccaatcctgggctccagtttccccttggggccctgaataaaggggctgggggcccctggtgccaaggacaaatggagagctggggtgcccatgcctcacctagagggaccccagagcaaggagcatgcagcatggctcttccattgctgccctctttgctgactctctcttcttcaggtacccctgctccagtccttgccacacacgccctggggttgtcacctctcagggaagcgctagcctgattggttgtcaggggccccatatttctgccctgactcagtctctaatttgcccttgagtctggacaagccacctctcctccttgggcttgtgtttccagaggaggtagagagtatcaaaggtctctgttagctctgagagtctgagatttaaagtcccctagaatggaaacctcagggcgaaggcctcctgtctgtccttttctgtcctgtatctctgttgtgaagaactgtacctggcctgtgtgtgctcagtaaatgttcattgaatgaacgcacctttctaaatcacaagctggcagaagggtgggcctttctcagactccgtctctggaggtttatgttactgtccttttgagagaatccagattcagactttgagttctgtggctgtgggcaaaaaccaacaaagacccacatcctgtgtccttgggagcttgaggagagttgaccagtttgtgttgccattgggtctgagaactttgcctttaaaatccattcctggcccctgcctaccgcttcctggtctggggaatagagctgagggggccaccctcagtcacctgaatttgactctccccacagaaacagcagaagaaacaagtggaacatcagctggaagaagtaacatgatttctttctttgctcacgacataaatgctgggtttgggggacaatcagatgtagaggtgccagtctcgtgtcgcccacttccagcctggggaagaaggctcacccctcagattccaccccatcctcccaggttatcccgataacctggtcccatgggtgggcctgtcctggggcattggtggcattctgggggcatgtctcttgctgtgccatctctgcctccccctggtaagagctctgtcttcctcttcctgtaggaaaagaaaaccaacaatgaaatacacaaagcacaaatggagcagttagaggtgagtggagggtggggagttttctcctgtcctctggagaatgtttctttccttctctttcagcacttgcttggcttttctcccaaaggttcaattccagacaatcaacatcctcatgttggaaaaagcagacttgaagaccaccctttaccatactaaacgtgctgcccggcactttgaaggtgggaatctgggcaccccatcatccttcaacctggcactttgacaggtctttagggggagtcctttgggccccatctcaacctctttcattacagcagaatctaaggatctggccagccacctgcaatattccttgcagtgtattggagagttggagtgggctctctgtgctgtgtctccatgcagcagcaggaggaggacagggtgagtccaaccagctgccccatcccctggcagcctggcttcccagatagaggagtgagcctaaaggtcccttctgcaggatggagtgtcctgcccagaaggcagcatggtcatttctcgctgcttttgtgtatggttgttagaggcagcctggggctgagtcagctgctgtgggtgagttggggggcactgtggggagcgagcactggatgcagagctcagaggccacacagcagctccagaactggatggtgaagatgagaagtttatatctggggagcccaggccattctacacagtgccccttaaaagggcaaggggtaggctcaatatacaactcggtcggtaaagatcaagtcatttccaagcctgtggtctggtttttaaaagaactgttccacacagtcctgaaacaggagaggctgcgggagcaggaggagaggctgcgggagtaggaggagagactgctggagcaggagagactgctggagcaggaggggctgcaggaacagggggagaggctgagaaagcaggaggagaggctgctacagaaggagaggctgctggagcaggaggagaggctgcaaaggcaggaggagaggctgagggaagaggaagagaggctgtgggagcaggagcagaggctgagggagcaggaggagaggctgctggaactggagcagaaagccaagctctgggacgagcaggcagagacacacatgcaaaccatgcggaatgactgcaccaccatcagccacatgctctcgcagaaccacgagcttgataagcagctgggcgagccacagtacgacttccaggagctggtgggttgccccacctggggagcctgccttcctccctagccctccaggcctttgtttccccacctgtaaaatgggcatatgtagccctcacgtgaaatggtacttctaaaggaacctgtgagccagagccctgctctgatggctgtgagagagagggaatgatttttctaacttgcctccacccttcccggtgacatgggaggcagacatcaagttctggggtctccagctgcagtgggtgaccgctgattgcttctctttgtccagaacaaagagagcaagggcgcactgcagttggagcagcaagtaaagttgctgcaggagaagctgggtgacctgaaggagacggtaacctccgccccatccaagaagggctgggaggcgggcaccagtctctggagaagggaagtgtgaggccaaaggcagctccagcctggaggcaggtgacgccagcacccttcagggcagtcctgtgactgtttcttgcttcctgccctctgacttttagaggtaggtagccctgggctcctcccaggtctggacatcatcatcccagctagaggcatggagcccccaatcataggggaagagacagtggtataagaggctcctttgctgggggcagtagctcacgcctataatcccagcactttgggaggctgaggcagtagaatcacttgaggtcaggagtttgagaccagcctggccaacgtggtgaaacctcatctctactaaaattacaacaacaacaaaaaaaaattagccaggcatggtggcgcatgcctgtaatcccagctactcaggaggctgaggcacgagaatcgcttgagcccacgtggtggaggttgcagtgagctgagattgcaccactgcactccagcctgggccacagagtgacactgtctcaaaacaaaacaataaagcctccttagattcaaactggattctggcctgggttcctctggtcaccgttcaactacttttcatctctaagtctctgtttctttaacttcaaaaggaagttagcattttccttgcagaggtgctgaggattgaatgagagaatacctggaaagcattaggcatgtagcacacttagcagatggtggttggctccctctgcttttccaccagtctgtggcctacagtttaaatggtgggaagaaggacatgagatttgaggctgaggaaggaggcatggagttctaggcaagggaggaattctctaaggcctggagcaagcggccaggggcctgggcaggtgacagagccccacggtgccctcgctaccctattaatgggcccagaatctggaagccagccaccatgtgccctcacgcccagggtcttcctgcaagtggagctgaagagccaagagtctcagagtctgcagcagcagcgagactagtacctgggtcacctgcagcagtacgtggccacctgtcagcagctgacctctgagaaggaggcgctgcacaggcagttactgctgcagacccagctcgtggaccagctgcagcagcaggaagcttggggcaaaccgatggctgagatggcccaccaaaaactgcaggagactcaggggagggagttgctgaggacggggccccaagagggatgacctgcatcttctgtgccttctcactctctttcctggccccttaggagtgcctagaagctgccagccagcagaaacagcagctagaggcccagttgagcctcatggctctccctggagaaagtacaggagatcacttagaggaagaagagagagccccaggaggaaggaggggggattgttagcagcataggactgaggagttggaacagacctttagaacagctagtcattatgccgaccgggtgtctgcactaagtttggtatcaatatggtgacctcctggggagcagggggccaccaggttgcctaaggatgggtgaactggcccagatcagaaagggagcaggtcagaactcccacactgactggtagtgggactgtgcctgggaaatataacaagatcttggttcttaaaagtaaaaataaaagtaaaaaaatagtaaaaaaaaaaaaaaaaaaaaaaaaaagaacagcagctcatttccctctggggaggggctggctcagggttacacagtgagggtgggggcagaggtggccccacagtacctcccttgttgggttgtctgaagacccctttggccaaaccctacagatggaggaggacatctggacagtgaggaggaggaggtgccttagccccttccgagcatcctggaggacctggagagccgggaggccatggtgagctgactccccctgcacctcctttgccaccttcctctgtggtccctcccagacccccttatgctcttcatctccccaccgtctgatttctctggaccctcaccccttccgggagccagtgatcagacaccatttcacctgtgaccaacaggtgcactctctgaggccccaagggaaggggctgcactccaccaccctgccctgtttgttctgtgtatgcccctacaagaagggcatcagggtggccaggccatgcagccaggctccagacatccccaggatctcagcccctccaagggtacctggaacattgaggcacagggagaagcaactggccagaacacacatccagctccccacatgctctagagggtttcaggtctctgcctctcgggaccttgggctcccccgattcagcctcgtcttagttctgactctagtacccataatttgcctccatttcccaatccagaaattggaaaggaacatctccatgtcccttgcttgaagacctggccagagctggtgccaggctacagatgcctggcaggaggcaagaagggcacactcactttccctttgtcctgggaggcccacataccaacattgccaccactgctgccacctggaagcacaaccaaactagacacaggaaaaggggaagggttgagtgaacctgggacactgcaccccaactttaatgtgttgttggattcaatttgctaatattttgtggaggatttttgcatcaatattcatcagtgatattggcctgtagttctctgttttggatgtatctttggttttagtatcaaggtaatactagccttgtagaatgagtttggaatagtttgggtaaggtctctagttttggaatagtttgagtaaggttgatatgagtttttctttaaacgtttggtagaattcagcagtgaagcaccaggtcccaggcttttctttgctgggagactttttattaccatttcgatctcattgtttgtcactcgtctgttcaggttttggatttcatcatggttcaatcttgataggctggatgtgtctagaaattgatccatttttagttggttttcctatttctttgtatatagttgcttataatagccactagtgatcctttgaatttttgcagtatcagttgtaatgtttccttcttcatctttgattttattcacttgggtcttctctttttcttaggctaaaagtttgtcaatgttgtttatcttttccaaaaaccaactattcttttcattgatgctttgttttcttcatttcaatttcatttatttctgctctgatctttattatttcttttcttctagtaattttgcatttgctttgctcttgcttttctatttctttaaggtgcattgttaagttgtttatttgatgcttttcaactttttaaaagtgggtgtttatagccataaagttccctcttagtactgcttttgtcgtatcccataggttctggcatgttgtgtttccattatcatttaagaaatgtttcaatttccttcttaatttcttcattgacccactcgtcattccagagcatattatttgatctccatgtgtttgtatagtttccaacatttctgttgttactaatttctagttttagtccattgtgatcagagaagatgtttgatattatttcactcttttgtaatgttttaagacctgttgtttgacctaagatatggtgtatccttgagaatgatccatatgctgaggaaaaaaatatgtattctgtagcccaagggagaagacacctgcccccactctgctgcaacacacagcgctctgctcagggatggggcagtggagtgctgttgttacacaaggggctctctgtcggggagggaacagaaatctgttctgtagtgtttgccatttttggtggtgcaaatattccatggctgatttcaaactgccaccgtcttctcagcctgggcttgtttgtacccacccttgggaaggctatccaagtatttgaaaggatgtgggtgttgtgatctaaagtgtatctttattagatacactccagcccagttatgctatggttcttgcagactcatagaggaactgccttgttggtctcagataagatctggaagaattctctgggctaccaggtagtagagacccttattctgtacctgtagtttctctccaaaaaacagtctctctctctccctctctctctctctctctctctgctgagccacttggagctgggtgtgggctgacacaacatccctatggccaccaccaccactgggactgcactgggtcagacctaaagccagcaaagcactgggtctcactcagggcccgctgtcaacactacctggctgtcgcctatgttcactcaaagccaagtaactggggctctacagtcagcaggtggcaaagccagcctggcttatgtctttcccttcagggcaacgagttctctcaggccctggtgggtccagagatgctgtctgggagtcagggactacagtcaaaaaccttagaaacttacctggtgctttattctaaggcggctgggctgacactgaaaccatgagacaaagtccttcccactctgcctttcccttttcacaggcagaggagcctcaccctgtggccaccaccacaggcccacagggagtgctgccaggctactgtcgatgttcacttagggcccaagggctcttaagtcacttgtggtgaatgcttccaggcctggggctcacccttcagggcagtgggcccccctctgtctcagggcaggcccagaaatgctgtttaagagccaaggcctaaaatcagtgaccacaagagcccatttagtgctctaccccattgtggccaggcaggtacctaagctgcaagacaaagtcccttttacctttccctctgcttttctcaagcagaagaaatctctcaccacagccaccaaagctgtgaatgtgctgggtctcacctgaagccagcatgtcgcagagccttactccaggcctatagcacattacctgggtatcactgttggctattcagggcccaagggctcttgagtcagcaggtgatgaatcctgccaggactagaatcttttctttaaagcagcagattcccttctggcccagggtgtatctagaaaggtaattcaggagctaggtcctggaatgggggtctctcaactctgactggggctgtatcctactgtggctatccaagacgtaagacaaagtcctctttactcttccccctcctctcctcaagcaaaaggaaagagccacttttgttgctgcaagctgcactgcctggggttgggggaggggtggtacaaacactcccttggctgtcctggctggtgtctctctaggtcgtgtgcctcttgagtccactggctctgagcccagcatggcattaggatgtgcctaggagttgaagtccttatggactagactgctttcaagtttatttaggaccctggggcataatagcctgccatgccaaggcttgtcaaaacccaagcctcaagcctcctaactactgggatgggtgaacccctctgggtagggctggtctaaatgctccctccatgggcaggtgtcacgtgagttccacctggtttcgctttctgctgtgacagggcagcactgagttcaaggcagagtcccacagttgctgcattctccctcccccaggtgcacagattctcagcaccacagcgaccactgctgggggagggggaggggtgatattggtgtttcaaggctgtctctcctaccttttcagtgcctctttcagcgacatgaagttaaacccaggtactgtgagtcctcgcctaatttttggttcttatgatgatggttttctggtggaaacagttgttaaatttgattttcctgcagggggaatgattggtagagactactattcagccatcttgctctgctcctcctccctcccttcactttaattacctcctaatagccctatttttaaatacaatcatatagggggttagggctccaagtatgaattttgaggagacacaattcagtctatagcatttggacttgggaagagggaggaaaagaacacgcacaggaaagtcacagtgtaagcaacagtatggaggtgggaaagttcagctcatggataggaaaaattgatccaagttggcagggcccacagggagatgtggtggggtggtgagtggcggccacatcaaaagaaccttgaatgccaggctgaggtgggaggcatttcctgttgtgtggaatgtgccatgaggtggtggggagggtaacgtgatgaaaggacatttgggaggatggatctggcatcagtgatgggtgggggtaaggagtgaacaaagctggaggccaggaaaccggacacatggcccagagttcaggcataggctgttcaaaggcagtttccacactgagttccaatgtggatccaagcatgcagcggatatatttggaaaagcaaaagcattcccttcccattaccacacagtttcccagctgagttcatcaccagagtcctacacatcagacagtcaacctgccccaaactctgtccctagaagctgtggcccagagggagcccttgtccagctgtagcccggggacgctgcagcctgagcaggactgcacctgttccctcccaggagcctcatctctgtccggcctggctttggcttcagatgccctcagctttggcttcgaaatctgttgggtcagattcacgagagctctggccttctttgggttgggaattttaaatagttttttcaagcaggcagtagatcaactctacttgcttacttctgggtgcatctcctgttccccggccccagatcttctttttccttggtttatcctctcattgtgttgcagcacatcttccagtggcttccagagaaacagtgaatggaagccaagctttctgaccctcacatattttagaatgtcattgttctaccccaattcctgattactagtttggctggatgtaatgctctaatttaaacataacttctcttcacattgggaaatattgctctattattttctagttcccagtgttgttgggaagaagtcagtgtcatgcggagtcttggctctttacatatgacctgtcttttctctctggaagattttaggattttctatctttgggttcttggaatttctcagtgatgtaccttgttataggtctttctacctatactgtgctagtcacttggtagactcttgaactagaaaattatgtgcttctgtggggggaagccaccagcatgtttgggtcctggtttgggtcccaatggggcacatgtgggaaagaccatgaatgcccatgtctccgactagtttccccatcagaagtgttgttgcaccaatcatcctcctccattaaaactggacagactaagggccactttcctaatggatgggtcttcttggttcatctcatgctcccaacagagctccctcccggggatgggaacgcgccatgccaggagagccctcttgatccagcctccagccaaagccagtccccctgccaaacaggccctagagttacactggagggtgacaggcctaacctggaaatttcttgctgaaaattgtcagtttcccacacaagtacagcctggcagttaattcaaattcaaaccagaagactgctgcttcagtctcgactgcttgaaaattaggttgtgtagagctttcatttgctggaaattgtgcagccagacattgtgcagattgacccagtagctacagcaagtacacacatagggcgccaagcaaggacaagtgtgcacatgtgcgcacgcacacacacacacagcagaaaatctagaaataaactattttaatgtcagctgtcatggaagttttgtgtcatttccccaaaaaaacacaaattttattttatgatttagtctagtatttatttagaattacttaaggaaaaggagacgtgagtgcagtggctcatatctgtaatcctagcactttgggaggctgaggcaggaggatcacttgagcctgggagttcaagaccagcctgggcaacatgatgaaacgccatctctataaaaaatatgaaaattagccagatgtggtagcatgtgcctgtggtcccagctacccaggagactgaggtgggaggatcccttgggcccgggaggcggaggttgcagtgagccaagatcacatcactgcattgcagcctgggtgacagagtgagatcccatctcaaaaacaaagagaaagaaagaagaagacagagaaagagaagagaaaagaaaaagaagagaggagaaaagaaagaagagaaaagagaggaaagaagagataagagaggagagaaaagaggggaggggagggaaggggagaggggaggagagaaggggaaaggagcaatgggatcctgatatctggtatgggaaaacttaagtggatacatctgagaactttgaacctccagtttccactaaatgctctgatctaaaagaagaaatgctctttccttgctaagagaagggcagctgccccttgcctggaaactaggcaaagagcctccaacaaggccttacagcaggatgaagtgtgtcgtcattgctgccccacattgacaccaggctatggtcattcctcatcatggcctaaggtcacaagcacaatctgctctgggagaataatatttttgccaaaaatgtcacaaagtatgtactggcagaatctgagagaggaggtggaggagtggacataagggtgttggaccagggggagactaaaggctgtatacacgagaatacagtgacctgggagcactctcaggatttaatggcttggcaaagacacctggggctccaacacactgctgagtggctccttgaaatgtggacagaacagttgcttcagtgaattaggaggagattatagaactgcattcgcaaagcatcaaagaagcaggaaagtacagggaggtaggaatgttggaatggttcattatatgccagcagattcggaatccaccacttgactgtgtgcccttggagggctcacaggaactcccctctctaggctaacaaggaaggcactagtgagaagggcacctgaatctttaagagactcagtggcactatccttggtaggccaggatcgacaagaggagatgctgccatgagaccaggcttcgtggtgtcagtgggaacggtggaaggtgagaacagcggatgccaggtggtggcccttcaccatcatccacaaggtggatgtaattaacttaattggtaggaaggctagagtgacagccaggatgccttgacctccagggagctgttgtgttagctacaaactgatggcattccaggggagagttacataggcagttgattagggtattttgggtttttttgagacaggatcttactctgtagcccagtctggagtgcagtggcacaatcatagctctctgcagcctcaacctcctgggctcaagcgatcctcccacctcagcctcccaggtagctgggattacaggcatgcaccaccatgcctggctatatttttttctaatttttagtgaagatgaggtcttgctatgttgcctagactggtctcaaactcctgagctcaagcaatcctcctgccttggactcccaaattgttgggattacaggtgtgagccctaggatatttcctgatttgtgtattcaggaaacaacaacaacaagatctggcacatggaaggctgcaacaaaaaattacaatttcctagccagttttcagactgagacaattgagacctatagctcatggattgtaggggaggctgggtattcttggaaaaagatcctgcaacattaccacatggtattcattaattattctccaaagggatctggggtcattgatgaaagtaactgtagctgatgaaaagggaatacccagactgtttgagggccatttatataggattagagctgaccctgacaccataagatccacaatgccaccatgtcccctccccaacaagactgaggacatgtgaaatctaggtaataaatggatccctggatgaagaggccacagccccatccggttgtcatttctctgtccctaaatatgcaattgatatgagtatgcttagaagctaacagagctctcactttactccctgacctgtgggtatgagccactatagtaggaagagcccaggggaagtctctgaaactacctcttcccacttccgggagcaatgcagtattccaggtggaatcacagagatttatcacctccctcaactgtgaccgccaccttataatgatggtattcttacatttccccacctgtcccttgtgccattctcatcatcattttacttccacacgttataaaccccacaatgttattacttttgcctcagtcaattatttctagacatcaaaaaatgagaaaataggatcttttctatttatccatgtatttattatgtcagtggtcttcattcctttgtgtagaaccaaatttctatccagtgtcatttttcttctgaccaaagaactgcttttaacacttcacagagtgcaggcctgctggtgattatcctggcttttgtctgtgtgaaaaagtctttattttgtcttcattaaattttttaaaaattttttattctgttttttgttttttgttttttgtagagatgaggcctcactgtgttgcccaggctggtctcaaactcctggcctcaggcaatcctcctgcctctgcctctcaaagtgctgggatgattacaggcatgaactaccacacctggcctcactgactttttaaaactgcttttaatcccttatctgcagagttaactttttcatgtccagtaattcttttttgttttattttgagacaaggtctcactgtgttgccaaggctgcagtccagtggcacaatcacagctcactgcaacctcgacctcctgtgttcaggtgatcctcctgcctcagcctcgtgagtagctgggactacaggttcatgccaccatgcctggctaatttttaaattatttatagagatatctcttcttatgttgcccaggctggtcttaaactcctgggctcaagcaatccttgtgtctaagcctcccaaagcactgggattacaggtgtgagccaccacacccagcctgtgttttttttttttttaatacatcttccatttctctcttctcatcatgttcagatttttctagccttcttgaacatatggagcatatttataatatgttttttaatgtctttatctgctaattacatcatctttgtcatttctgggcctatttccattgatttatttctctcctggttataggccctattttgcctgtgtttttcttttgttttgtttgtttgtttgtttgtttgtttttggagacagggtcttactctgtcacccaggctggagttcagtgatgtgatctcgcctcactgcaatctccatctcccaggttcaagtgattctcgtgtctcagcctcccaagtagctgggactacagttgcataccaccacgcctggctaatttttgtatttttagtggagacagcatttagccatgttggccaggctggccttgaactcctggccttaggcaatctgcacgccttggcctcccaaagtgttgggattacaggcatgagccactgtgcctggccattgcctggtaattttttattgactgtgtttttgtgttgtgactgctggattttgttttgctttaaatagtgtgggactgtgttccagcactagttaagttatttgaaataagttggatctacaaaggtttgctttcaatctttgttaggacagtttcagagaagtctttactccagtgctcatttagccccactattaaggcaatagttttttaaagcttctcttccatttcctaagtattatgaggtattttcattctgactagtgagaatatgaattctctctagcctgttgtgagctctggggattcttctgtctgctttctggcagttctttccctgggtactttcttctcacatatgtccctatcagccctttgccaaaggcttgagggcatcttccatagctctccagagttcacgcgctctcttctcccacctcctccctggtactctacctcacaaattctaccggccttgaagatcttcccaagctctgatctctgtctcctcaatccaccaagaccaccggactttggattcccctccctgtgttggagcctgtaattgcttccggcagtaaaccgaggacactctagggttcaccttcttttagggatcatagttctgctcgacctgttctccgatgtctgaaaactattgttttatattttgttccatttttctagttattaaaggtgggaggcaaatctggtccctgttatcagtcatggccacatgtagaggttgcaggatgttgtttacatctgtatctttttttttttttttgagacaggatctcactctgtcaccccaagtggcaccatctcggctcactgccacctccactttgtggcctcaaatgatcctcccacctcagcttcccaaagtgctgggattacaggtgtgagccactgtgcctggcctgaaactgtatctttcttattaccagagaagttaaacattttttcctgtgtgtcagcagcatttgtgtttctttttctttgaattttcatttttccagtttgaactttccatttttcttagaatttttggtctttgtcttctctacttttagaatagaatgaatatgatattaatcatacttcgaattgtggccatgatggagtacctgtattgatgatggtctcccagcataaacaactacaaagctggacaaagtacatgaagaaattgtcttcagccattgggcaataggcagttccaggtacaatctgagagaagggaatcacatgaagttactgctacatttttctggtggggaaagtttcaaaaccctcaatgacagcacgaggaagcagagtccaggcaaaggatcagtcttgtttggtggaggaaacggagactgctgctcagggctgctaaaatgtgtgtggcagggtatcagaaaggatggagttgcagagaaggagccccagaaatcttatagaggttgctgcaggtccttggccaaatcccaaactatgaatgtgtggattgagactctgcaaggcctagcacagaacagccgatggggagctgagagctaaacagcgatttcagtggtcacagagtgctggaaacacatctgaattctggctcagccagcatctccactcttggaatctcaggacttgatgaatatcccagacattcacaggagggcctagaaggccatgccttgggattaaggaagattctctaggaataaggtcaaaactaaaaaccagctcacgctaacaaaacctaaaatgtagccttgacacacgtgatcaagttaacccatcagtaatttaattccctgccaaaataaaactcaacactggagtaggataacataacccacatctctacaatgaaggttcacaatgtccaacagctcaagaaatacttagaagacatgagaaaaagtgagaaaatatatcctacaattaagagaaaaccagtcaatacgaactgacccactgtgcatggtggctcacgcctgtaatcccagcaatttgggaggccaaggcaggtagatcacttgagctcaagactttgagatcagcctgggctacatggcaaaaccccatctctactaaaaattcaaaactgagttgggtgtgggggtgtgcaggggcccataacccccaggctgtggactgtacccgtcggtgacctggtaggaaccaggctgcgcagcaggaagtgagtggtggacagcgagcattactgcctgagctccgccccccgtcagatcagcaggcattagattctcatagaagcgtgaatcctaatgtgaactgcacatgcaagggatctaggtttcacactctttatgagactctaatgcctgatgatctgaagtggaacagtttcataccaaaaccaccacccctgaccctgtctgtggtaaaattgtcttccacaaaaccagtcaggactgctggtggcacatgcctgtggtcccagctacttggaaggctgaggtgaaaggatggcttgagcctgggaggtggaggttgcagtgagttgagatcatgccgctgcactccagcctggacaacagagtgaaatcttatctcaaagaaacaaacaaacaaaagggccgggcatggtggctcccatctgtaatcccagcactttgggaggctgaggcaggcagatcacctgaggtcagaaattcaagaccagccaggtgaggtggaggttgcagtgagccgagatggcagcattttactccagcctgggctacaagagtgaaactccatctcaaaaaaaaaaaaaaaaaaaaaaaaaaaaaaaaagggggcccataaatggctcacacattggaattagcaggcaagagctttaaagtaactgcatacatacatcaaagattttagagaaatatcaacacctgtgaagatggtgaaaaaagaatttagagaaataatttttagtataagtatgtcctaaatatgcatggtacatacttactaaaatatagtttattttttaatcagaaatctaaatttaactgggcatcctatattttatctggcatctctaccccaaagccaagaaagagagaatccagagtcctatcttttagcaggtgacctagcctaggacagggcctggccaggggcaattgtgcattggatggattagagatgccagtcattcaaaggtttgccagacctgcatacaatcaacattatttttatttaatatttttgtctaaagcaactttaaaaatgttaaccctttatttggaaatatagattcagaggaaatttcaaagatggtacagagaggtttcatgtactttttactcagtttcctccaaaggttctattttgtataaatgtaggacaatatctaacaatgtcacatgactatgtctatgccattttatcacatatgtagactcctttaaccaccgctacgatcaagatagagaactgttccgacaccacgaaaattccactcctgctattactctgcactcattcctggctcttcccctccactattcctactcctggcaaccactaatctgctttctgtctttataatcttctcacttcaagaacattataaaatgcaaaaattagccaggcgtgatggcgttagcttgtagttccagctacatggaggctgaggcaggagaatcacttgaacctgggaggtggaggctacagtgatcctgccattgcaatccagcctgagagacagggtgagactctcaatgaatgaatgaatgaatgaaagaagatctggcatggtggctcacacctataatcccagtgctttgggaggccgaggcaggtggaaccgctgaggcctggagtttgagtccagcctggccaacatgacaaaacgctgtctctactaaaaatacaaaaattagccagcatgatggtgcgcgcctgtactcccagctacttgggaggctgaggcatgagaatcacttgaacccaggaggcggaggctgcagtgagccgagattgtgccactgcactccagtctgggccacagagtgagactttgtctaaaaaaaacaaacaaaaaaaacaaaaccaaacaaagaaaaaaagaacattatataaatggaatcacacagtatgtggccttttgagactggctttttattttttgtactcagcaaatgccctttgagatccgtccaagttgtgcatgttcctttttattgtttttttttctgtttgagatggagtctcgctctgtcacccaggctggaatgcagtggcatgatctcagctcactgcaaccctccacctcctgggttcaggcaattctcctgcctcagcctcctgagtagctggaattataggcacccaccatcatgtctggccttttttttttttttttagatgaagttttgctcttattgcccagtacataggcatgatctcagctcactgcaacctctgcctcccgagtttaagcaattttactgccccagcctcctgagcagctgggattacgggtgccccccaccatgtccagctattttttttgtatttttagtagagatgggattacaccatgttggccaggctggtctcaaactcctgacctcaggcaatccacctgccttggcctcccaaagtgctgtgtttataggcatgagccatcgtgtctggccccctttttattgttgaatagtatttcatagaatggatgtatcagtttgcttaaccattcacctatgggggagtatttggttgtttccaatttggggctatcacaaataaacctgccataaacaatcatgtatgagtttttgtgcagacatcagtttatttattttctggtacaaatgcccagaagcaattgctaggtcatatattgaggtgtatgtttaattaaaaaagctgccaaactattttctagagagtctgtaccattttatattcccatcagtgatgtatgagttagttttgtctgcatcctcgccaatatttgatattatcactatgtttgatttgagctgttctaatagatatgcagtgatatcttactgtggttttaattgcatttccccagtggttagtgttgaagatctattcatgtgctttaagtcaactcatttttaaaacctaaataaatgtatttaaaaaggaaactttcgctttgggaggccaaagcgggtgaattgcttgagcccaggagttcaagaccagcctgagcaacatggcgaaactctgtctctacaaaaattacaaaaatatccaggcatggtgacgtgagcctatagtttcagctacttgggaagtgaggcaggaggattgcttgagcctgggaggttgaggctgccgtgagctgtgatcgcaccattatactccagcctgggagacagagcaaaaccctgccttaaataaataaatgaataaaaggaaatttgtgattagtggttctcaaagtgtggtccctgagccagcagcatcagcatccccatcagctgagaacttgttagaaatgcagattctcaggcgccaccccagacctcctgaatcagaacctctgaggcgtgggttcagcgacctgtggtttaacaagccctcccggtgagaatcggtctcattcactacagatagaaggaaatggtaaaaatcaattcatccccgtatcgcctaaaatcctcctgtgggccccaggttggcacagcacacttttgggcaggagccccactcacagaggccgtgacaagaatgctcctgcccctggggttgtgcagtgacagctcacacagctccacgtggcggttctgagtttgggaagcgctgatgtagtcctactacagcccttcctgcccttcactggactgagaaaatccaggctctgaggagggagagacttgcccaaggtcacccagcaacatggtcagtctcctttcccagggccctcacaatgcgtggcctgtttaaagcctgcctctattcactgctgagtgaaaaatccagctccaaaacagaatatggggaaggatactatcttgtgcagcttatgtttatagctgcagatacgtgggaaaaaaagtcagaaaatactgttgaagcagttacttagggagaaaaggtgtttgctggtcttttgtgtttttaacttttctatatttcataatttttatcacaataatgtttagttacataatcaaaatgtattaaatgttaaaaattgacatgaagcctgatccagccacggcctattgttggcagagtcaggaagccttccagatagagcagccccgcacctgccccaggtcacaccctgggcctgggcacatgctaggtcctctgtctggacaccctcaccctgtggtggcctccacgtccgtacccaccagcacctcctgtgggcgaggccctacattacatccagccctgggcacccactagcccagagggcacctcatggtctgagagcccgcctgtctgtctctaaagagaggaaaactccttgggacatgtgttccacttgacccatcacccctggcctggtacagaaaggtagacagtgggtatttggtgaataaatgaatggatgattagaatgaattcccaaaatggcaatttcctgaggcccttctccagctggcccaggtggaaccagttccacttttcacaggaaagccaggtgggaggagtggggcaggtgtgtgtgaggggccagattcttgagggctgcatggacatggggctttggcgggtctgggggcggcagtgcttctgtgggagcctcagggagggctcatccttggaatccaccagggtatcctggtacccccagctgctgcgtggcgtgagaagtcctggctggtggggacacacaggtacttgtttggattggccacctggtccagcccaaggagctgtgcctccagccccttggggaaaaactcacttctgatgtgtgacaacagctgcaggcaaggggagggagaggtgtgctgggcctcggccttagaagccagaagccctaccttggtctatatgggaaaggcatgcggcctcagctagatctagggtcctgggttatggtcagaaccctcccttatggactcagtgacttgggctgaccccgcccctccctgagcctcatcagtgaaaccaggatggggccagggctctcgacacctcccagctcagacctctgactttctcccaggagggcaggagatcagacagaggtgacccgggctctcctgtttacctcaacctccttgtgaagcctccctctttctgcctgtgaggtgggtggggccggaaggaggggcattcacctgtaggcctctgacttctctgcccaggtgtacctggagagcctggtctatacccggtgctctgctacaccccatggcctggccatgacctccctgcctccagagcagccctggcccagggaagaagctgtctctgcatcgaatgataggtggaaaatggaagtggggatgatagctctgaaaaggagtcaaggaggaggtgccttcccaaggatgctgagggtttttccagaatggaacttgactggtgcgggcaaacatcaggaggtgggaagggtggctccctctgtgggagccagggtgacttgcctggatcgaacagtggtaggcagtgggtagggcaggcagagctggggtgcccagagcctggggtccctgtccttgcagaggactggattgcaaaacaagtgtcccctgccttctggctgggggacatcctctacttccaagcccagacatacacctgctgccacaagcccctgaggttcttcagaggaccaatgggcagccacacccatgctgggccagcctgctgggcccacctgcaccatggtcagagcccatgactgaggggactctctggggacaatgggggcagtctcatgctgccctcttacaggtggatcagtccctgggatctggtgttgggccggggtaggctgagtatgttctctgatggggtgccttgtggacagcaggtagagcaacttcttcttggctttcttggacctcaggacatagctgaacactgcgctttaccctggatgccttcagattctcaggggaccctgggaaggaagaggggctgcccctgcaaagggccagggccctggcccatggttgcttcccccagcaggtacctcctctccagattgacatcacctgattcctgaaggcctgagctacagaccagagccccaacaccctcaccaaggcctgttcttaatcagagcagctagtatatgattccggagctgaagcgggcagagagagaatgcggggctctgtaagacttcttggctccctgctgcggtgggccctgtagaaggccccccagaaatctgcagctgctgtaagtcactgggaggaagctgcagcagacatgtgtttcccagcctggtagatggagaagggtttccgggtctccgagtgggaggcccaaacgtggccttggttgtagcagtgcaggaattctagccagctctggggcccagggcaagtcatttaacctctcagaaccccactcctggtcaccatgtggctcttgtgtggttgtaaagaacacccctggccacttatgtcccatcagtggaagcctagcatgggtggagacccccgagactgaactcagtggcaggatccagcctttccagctctcctacatagagcccagagccagcagggtgggtttcctgaagaagcaggcactcctgtgggctggagagcatgattaaaggtccctttgggaaggtggaagaggctgcggtcagtggaggccataatgaggcagagcttgggcagaaggggcatgattgggggatctgagacccaatagagactggactgaggacactgtgccactcaggtggtggaaactgagctagggctgggccccctggtcccgagtgaggcctcaccagtcttggaagctgtgccaaaggtggcttcatgtaagggtgcatctgaacactttttttttttttaagagatggggtcttgctctgtcatccaggctggaatgcagtggcatgatcatagctcactgcagcctcaaactcctgggctcaagcgatcctcccacctcagcctcccaaagtactggaattacaggcctgagctacagagcctcgttttaaatcttaataaatatctccccctggtctgcttccctggctgacacacatgctggcaacttgcccctagacagacatgtttctggacttggttccatttgttctgatgggctcctctctctcaatgaccgcacgttatattatgtggccattcttacacgtttctgtatagacctgagggttagtgtattaatgtcaaagttctactggtttttcgaggctgggtggaatgtttgggttaatttaggagtgggcatcttgacaatataggcttttcctccgggaatggtgattctgggacgcaggttttgcacattctggtttattgcttggctcgctgccacagagggatggcactgctccacatgccatgcccaagagatgtcccaccttatctttctaaatcaagctgaatgttctcagctgacaggatatcctatcagtgctgcggggactcacaccttccaaactgagatgaagtgaggtggagactatggagcagatccgtgctgactgcattcgcccttcctgacccacactgctgctggccggggctatgtctgagccatcagagggcattgatttggggacggggcggggggcggtcctggagagatgcccctcacctccctcagctcctcctgtccacctaacacttggccaccaaggtccctgacttccaggccccagtcaccactaatggggtgctgcatgggaacaaagtgtaggcccagaacctggagctcaggtcactcctccttccattcgaagcctctgcccctcccaggtgattccaccctcattcctccatgggccaaatatcctaaacaaaggcctggacaggggtctttatccgagtactcagaaaacacacacggaaatgctttgcatgccccctgtggcctgccaggggtaagagcctgcccgtcaaaatgcacagtcctggttcttgcagggaggtgaggagcggaggaagaaaagatccatctcattctttcagcaggatcctaaacttgggaaagccagatgcagtacatttcttaatcctgatacttttataactggttatagcggggtcacatgcgcaactgttttccaacatctttcaacgggccacataacatcctgtaacttctttttttaatttttattttgtaaggccaggggcagtggctcacgcctgtaatctcaacgctttcggaggctgaggcaggaagactgattgaggccaggagtttgagaacagcctgggcaacatagcaagaccccatatgcaacagagaaaaaaaattttttttttttgagtacagtggcatgatcacagctcaccatagcctccaactcctgggctcaagcgatactcccacctcagcagctgggactatcagagcgcagcaccacatctggctgatgttttaatttttagtagagatgcggtctcactatgttgcccaggctggtcttgaactcctggcctcaagagatcctcccaatgtgacctcacaatgcactggggttacaggcatgagccaccatgcagcccctgcaaaatctaactgtccttcaggtgctccttttggacctcctagctagactgccattggcaaatgccagttgattatccacccacatttatgttaatggatttcccatgttttatttgtctagaccaggctttctccacagcagcactgttgatgtttagggctggacagttctctgttctggagctgtttgcgcctcgcaggatgtttagcagcatccccagcctccgcctgccacatgccagcagcactcctcagtgtgacagccaaagtgatttcagatactgtcaaatatccccagggcggcaaaatcacctccagttgagaactgctgacctaaaaccctctggaacaatgttagatcatggtaatgatagcgcatactgctcctgaccttaatgggaatacctctagcatcaaagtatagtagtacctgtatactactgtctgggctgttattagtacactgtattagtccattctcatgctgctatgaagaaatacccaagactgggtaatttataaataaaagaggtttaagttgactcacagttctgcatggccggggaggcctcaggaaacttacaattatggcagaagacacctcttcacagggcagcaggagagagaaggagagccgagcaaaggggaaagcctgtaataaaatcatcagatctggtgagaactcacttactatcatgagaacagcatgggagaaaccacccccatgattcaattatctccacctggtcccacccttgacatgtggggattattgcaattcaaggtgagatttggatggggacacagaaccaagccatatcatatcctttatattagcatactgtatcaaagtataattttctttcttttttttctttgggacagagtctcactctggctctggctggagtgcagtggcacaatatcagctcatggcaaccttggctcactgcagcctcagcctcctgggttcaagcaattcttgtgcctcagcctcccgagcagctggaactacaggtgtgtgccaccaatgcccagctaattttgattttgtttttagtacacatggggttcgacatgttggctaggctggtgtcaaactcctggcctcgagtgatccagccacttcggcctccagaagtcctgggattataggcgtcagccactgcacccagcctgaagtataattttcacaatatgaaaagcttgactttcatacaaataatgaaggaatacgtataagatattttctttaatttacaagggagtcagcaacacggtgaagctagttcaaggagcgttttgagagacagtgtctgtagtgctccaggaagggcattccgaaatgcattctgagatagagacaaaacttgttaatatcctaaagggaggccgggcgtggtggctcaggcctgtaatcccagcactttgggaggctgaggtgggtggatcacctgaggtcaggagttcaagaccagcctggccaacatggtgaaaccctgtctctactaaaaatacaaaaattagccaggctcaatggtgggtgcttgtagtcccagctactcagaaggctgaggcaggagaattgcttgaactgggaggtgaaggctgtagtgagccaagatcatgccactgcactccagcctggacaacagagcaagattctgactcaaaaaaaaaaatcctattgggaaataaaactgtcatctttgggagttatcttttctactgtactgaaatctgtaagttaacatatatacatattctcacatatattcataacatattctctagtatatttccctacattagtggttttcaaaccatggtctcaaattggaagcaccagcgtcacctgggaacacagacatgcaatgcttaggccccacctcagtcctattgagttagaaactctggtgtggggcccagcagcccatttcacaagccttgcaagtgattaggatgcactctaatgtttgagaaacactgctctaaatagtcaatctttaatagtaaaacaagtatctatgaaacaatgctcagtatgacattaaaagggcgcaccacccaccttttaactttatttctgaatttaaatattttgtctgtctaatgttaaatttgctgttttgtttttcaaatactcttaagataagacagttttcatctgttcctaattttctttttaaataaaaaatggtcccaaaactatccatttttctcttctttaacctactgacagcatgaaataaaagttgaaccattcctacatctttttttttttttctcaccttgttgctcaagttgactgaaatgcagtggtgcaatctcggctcactgcaacccccacctcccgggttcaagcgattcttgtgactcagtctcctgaggctgggattacaggcacccagcaccatgcccagctaatttgtatttatttatttatttacagtagagacgggttttgccatgttggccacactggtctccaactcctgacctcaggtgatctgcctgcctcggcctcccaaagtgctaggattacaggcatgagccaccgcacccagctttttttcttttcctttttttgttttgagatggtctcattctgttgctcaggctggatggagtacagtggcgccatcatggctcactgcagcctccacctcccatgctcaagagatcctcccatctcagcctcttaggtagatgggatgacacgtgtgcaccagcacaagcagctaattttttgtagagactggggtctccctatgttgcccaagctggtctagaactcctgggctcaagcgatccactggccttggcctcccaaagtgctatgattacaggtcttatgttcttaaaatttttctttgacatggtataggatagtctagtaacttaacacactgttgctttcaagaggatagtgcttatgatttgtaaaataactcttcagaaatgagttcaattttaccatgaattgggacactttctatttctattctatagagcagtttacttgtcatgaggtctgtcttttgaaaacttgaaagcctgcaacaataaaaccagctgcacctggtgcatgggataggcatggaattgaggagagagctcaaactatggtcagccttctgtatcctcgggttctgggtccttggatttaaccaactgtgcatcaaaaatatttggaaaaagtaaaacaataaaaaaacacaaaaatttaaaaatactttatatcagctatttacaaagcatttatgttgtattaggtattatagcaatctagagatgatttaaagtatacggaaggatgtgcataggttatatgcaaatactatgccacattatatcaggaacttgagcatctgtgaattttggtatctctggggtcctggaaccagtatcttgaggttactaagcgacgactgtattcaatttcttctttggttattagtttattctttaatgtatttttgttgttgttttgtctttttgtttttgcctcttcaagtcaacgtcggaaacttagttgttctagactacccattagctcaaagctaccagtaatcagactaccactgcaatctaagcaaccgattttttttttacccatcagactggcaaaaattaagataagatctattgatgttgaagctgtggggagttttcctgagcatgttaattatgacagccctttttactaggcacctagacgattcatcaaaatgaaataaaatacccatgcacttgaagaagttacctggttatttccttatctgggtgctggttatgtgaggtctacagttgatgaaaacttattaagctttatatttctaataggtacaattttctgtatgtgtaatatatttgaaaagtttttaaaatgttttttgccacagcccgcagctgtgtataatgctattcgcttaacagtggaaaacatggcaatgacctgaatctccctggctcccgggatcctacccccttaagttaacgaaaataaaagtaaaagaaataacttccactgtctttcgtaatgccttaaatccgtcctcagttaaaccggcggttggcgctggttttttccagggcaggattctgggagacggaggagcagacgccagcatttcgcccccggcacctccagcgggctgcggtccgctcccggcctcactcgagcaggccccgccccgccagaggccgttagtccaagtcacgtgatcgtcgactcagctgacctggcgggaccggaaaaagaaattcccgggcgatgatgaggcaccaggggtgaagcggacatgggctgctggagcgggaatgagggggcgccagtggctccggaaacgggttgaggttgtctgcactggccgctccgcaaacacagtgtgtgcgggcgtcagggcagcaggtctggtagagaaaagtccaccgccatccctctcccgagtggggcgggtaagacagagcaggccggccggcttagagttccctgcttccctggcggaaggaagggcccctgactcctggggcaggaactagggcttgtctggagctgggagtcctttcaggtcttctctagctccaaaaggacctcccaaggacacccccttccccagccctgctgtgggacttggacaggaaagtgctagaatcaggctcactcttgcacactgttaggaagccactccgctcttttcagatccagaaagtagtagttttggggctgatacttatccatccattcatccaatccatccatccataggttcaaagtgcctagtctataccatgaattgtactaggcactgggaggacttgagctgccgcgggaaggggaaatcagaggcttgaattggcagtcatagttaaggctccaggggcagagacctaactgcgccttgtgtgtagtgctaagggggcttcctgaggatgccttcaaccttaaaggcgatggcaggagttggctggctgaagtacagtttgtgtaccaggggttgggaggcaacggtgggaggcgtgtgtcttcagacagggaacagcatgtgcagagacttcaggtgagagagagcatggctccccaggaatgaatgcatttcccgtagctgggagagtatcatctggaggttagggaaagatgagtctggacaagtaaaggccaaatcttcctgactgttggatcaccacaatcaagataacgaatatatccaccggcccccaaaatttccttgtgttaggggctattttaggaagtatgatcaagaagggctggcctgccagggtggagtggctcacgcctgtaatcccagcactttgagaggccaaagtgtgcagatgacctgaggtcaggagttcgagattagcatggccaacacggtgaaaccctgtctttaccaaaaatacaaaaaagttgggtgtggtgacgcatgcctgtagtcccagctacttgggaggctgaggcaggagaattgcttgaacccgggaggtggaggttgcagtgagccgagattgtgccattgcactccagcctgggcaacagagcgagactccgtctttaaaaaaaaaaaaaaaaagaagggctggtctgatgaggtgtcacttgagcagagagtggaatgaaataaaggatagcaagccacatagagagtgcagcggaagcaaggctggtgtccctgagctgcagcagggaagctggagtggctggagttgtgtgggtatggggaagaagggagagagttcactcgtctctgtgaggcccaggactttgttttatcccatgctgtacccccagcacttagagtgggagctagcacagagaaggtgctcaattgatgtttgctgagcagatgaatgcctggagtagacctcagagcagggtttggtggcagggtgggtcaggtagagtttactcaacagcctggtgataggggagaacaagtggccagagggtatccatctatgtcggggaccaggggtccctgctgggcagcagtgtgggagacacagggatcctggccacacctcagtcttctttccagcctgattacctgcctccctcccttgcagaggtttcggttctgtggtgatctggactgtcctgaccgggtcctggcagagatcagcacgctggccaagatggttgagtgcacagggtctacactgggtggaggaggggtgttgggctggggattgtggctgtagaggatggtgaggtttctctggggctagggcctcagtgctctcagcctgtgctaccatgctttgtgaccttgatcagtggctggcctgctttgagccagtccccaggaagaaggggtgaggtttgccagcctggctgatgtaaggacttcctttccagtcctctgtgaagttgcagctgctctgcagccaggtactaaaggagctgctgggacagggaattgatgtgagtacaagatccagcaccccattgtcccatgaccttatgaccaccactgccctgaaactctgcactaggcccggggagacgggtgagccagcctctcaacctctctgggcacctcccttccttctttccagcctgtctgttccttattgcaggatccaggctgggggtgaggggctggtgagcagggacctggcaccccctgaaggtctcctttccccatagtataagaagatcctgaaactcacagctgatgccaagtttggtgagcaccccgctgagttcacaggccccaggcaaccctgggacctcggcctggtgcctggtacagagcccgccccccacccccccgccaacacacacatcccagcagtatccttaacctgccttccctagtggaggagcatgagggaaagaaagacattgacagtcccaccttcctgtcctctgccagctcctggtggagcagtagcagtgcctatggctccaggaggcctgggggctttgagctgaagttaatagggcaacagggaggtggctgggcccacagtgacaccccctgtcccatgcatgggtccctgagagtcaggcgatgtgaaggccacagtggcagtgctgagtttcatcctctccggtgcggccaagcacagtgtcgatggcaaatccttggccagtgaactgcagcagctggggctgcccaaaggtacgggttgtgggtgggcagctgggcagcctgtgggccaagggctgctagagagtgggccaggccctgtgaccctgaggtgtaccctgccctgtctgggccaggagcccaagcccagcccccacctgctacctccagagcttctccattctacccccagagcacgcggccagcccgtgctgctgttatgaggagaagcaaagccccttgcagaagcacttgcgggtctgcagcctacgcagtaagtatgaggccagccagggtccgggctcatcctagaaggtgcacgcagcacacaaagtgcgtggagagtccagggagacaatttaaccgcagtcacataccgagcagccgcagagccgggacgtggccctcggtctcctgaccccgcgcgctctgtgatgtgtacgtacaggatcagaccttgccctttcctcctggctgacccttccttagtcccccgtgccccatgtgtgagcacccagctcactctcattcctccctctccaaagcgtggtccctggcagcacgagtggcagaagggacagcagagactgtggacccctcagctgcacctaagacctctgtgtggtctagccgtgtgtgctgggggaggcttttggccaccatttccccctctgtaaatgagaccgatacctgtggcatggaggacaggaggctggtgtgagtgccaagcacttggagcagggccctgagtgagcatggacatgggaacaggggtgtttctcgactttgtgcaccttggggatgggagtggggctccctgcatgggttgacaaggcattgctttcccccaccccacctctgtcccagccctgcaagtccagtccttgggggtctaggaaggaagaagcccctggctgtttggcctcaggctggtgcctggccctctctggctctgagttcctgggaaagtcagcacccaaggcatgccctcaagtttagcaccttgacaagaagggcggggacactgggatcaggcccaactctttggccccaaatcccacggccccagctggaggatgaggagacgctgggcttggatggggaaatcaggggtgtaaaggggcctgctcacccctcagcttggctcaaaggctcaaggcgtcaaaggctcagcctgccactcaggaaggagccctggccaagccagacactcaccaggacaagggcaactgtgatgagcaggaggcccaggatgaggagagccatggcatagctggagataaaggcatccagcaggctggaggctttggggctaggactgcctagagcagagcaagaaggctatggccaggcggggctctgcctctcagacttctgagaagacagaatctgggcccagaagttgctgcgggaccagagagctggggctaggagcaccttagagggctccatgaggaggggaggcaggcttcagatcagggcatgtggaggcagcgagcccaagggaggaggcagagggacagagggaggcagcctgcagagggaaggaggtactgaccgaggtctaggatgaccatgtctaccaagacgcccgctgcctcccacagggtgtgcaggccctggcgtgcacagtgccacatgacggcctgggctggcgccaccctgaagaaggtggcacccactctggcggtcagtgggtccagcctgctgagaggattatcacagacttcaggggtctgtgcagccttgggggactaggggaggtcatctcttccagcctcctgtcctcaaccccagaaccccggtatgagccctgggtcacccagggccaccccggacccactggaattcctccaccaccgcttggtcaaagttctgcagagatctgaggacaagggtcagctggggggtcagaagaggatgaagagggtcacagctctaccaaacaaagcttcattccttgtggcccctggcccacccctctgctgccaacctcaggctggcccagccctgcagagtaggtgcccaaaggcatcgtagcagttcctgtcatgctggtctccccccggggccccctctggagcctggtaccacagatctcagggtagggggtacagctcagtctcccttccctctcatccccctcataggggcttagtccaccaaggcccctgactgctaggggacccacacccacggcctccttctttctgactgctggcccttccccagcctggatacttgagccctgggcagaggggtaacaatcccaggactgtcttcataagcagagaggccacttggcaccaggctcttactccttgggctgagctcagcagcaggtgtgtcaccaaggtcccctgggcagaaggggctcagccctgagggcccatcactcgccatgcctgcacgttcctgctaggcatccaccctggggacccagctttcccccttcccccagctgctggcaggcctgtcttgattcatccagggtccttcaggccatgccgggaagcagccagcagctgggaggagcacttggggtttctgcatctttttttatggagctgacttgggtgggaggggctacagactcaagggagactgcaggccaccccttccccactccctggctgggtaggcttccagctcaggagtctgattggaaggatgggaccgtcctgtcacagaggcaggtctgagtagtccaggcccagttttaccctccagcagggcccctttcattcatttgtccagctggctttgcccaaagcacaagtaatgtctatgtgtactgtgtcccctgtccccaaggggagtatggctccagtcctggcctggaactcagagaccttagaattagaggccacatctggcagggtggaccagcatggtctgcccacggccagggcaggtaccatgttggcagccccagacctgacaccacggctcccgtctcccctctccacttccatcctgcacatcacctacactacgcgctgtccctgatgaatccaagctgtcagcttctgtcagcttggctgggaagtcatgctgaccgtaaggggaatggtgcagcctgagttgggggctgagtgggaatgggcctggtgtggggtgggggaggtgggggtgaggcgggtgtctggcgcctctctgcttatcttcctttctcctttgtccacaaaggaggcatcttttccatgtccctctgccaccctggggacataaaatactgccccacttctgtcttcccttggacatagcccacctatcttcctgtgggactcagggctttgttttgtcctgtggcccacatgagaagcaattatccctgctctgctcagctgagagaggacaaactgaggcagagcaggggaacaactctgtcatagtctggctgttaatggcagagtaaagaccagcccttccctgagtgtcaggtccagtagacattatattagtccgctttgcattgctctagaggaatacttgagactggcttatttatttatttttgagatgaagtctagctctgtcgcccaggctagagtacagtggcacaatctcagggcactgcaacctctgcctcctgggttcaggctactctcctgcctcagcctcctgagtagctggaattacagccatgcaccaccatgcctggctaattttttgtatctttagtagagacagggttttgaaatggagtttcgctgttgtggcccaggctagagtgcaatgttgtgatctcaactcattgcaacctctgcctcccagttcaagcaattttcatgcctcagcctcccaagtagcttggattacaggcacgcaccaccatgcccgcctaattttgtatttttagtagacagggtttcaccaggttggtcaggctggccttgaactcctgacctcaagtgattcacccgcctcagcctcccaaaatattgggattacaggcatgagccaccactcctggcactgagactggttatttataaaagaggtttatttgcctcacagttctgtaggctgtacaagcatctgctaggcttctggtgaagcctcaggaagcttttacttctagtgcgaggcaaagagggagcagacatgtcgcatggtgagagaataagcaagagagaggaggcatcaagctctcctgtgaactaatagaaaactcactcattgaatcacttgaacctgggaagtggaggttgcagtgagccaagatcatgccactgcactccagcctgggctatgagcgagactctgcctcaaaaaataaaaaaataaaaaataagaaaactcactcattaccatggggagggcactaagccattcatgagggatcccccaccatgacccaaacacctcacactataggccccatctccagcactggggatcacatttcaacacgagatgtggatgggacaagtatccaaactatgtcagaggcctccccctccctctcatcagaatcttctgtcctcagttcaggtgcatgctggcctccatgcctggcttcctagaaagtcatcttggcgccaaggggttgggcagggccactaggctgagggttggagccctatctctcctagtcccagcctgggtctccatcactgggtaacccgtactgctcgctgcattctctccacacctgctccctacagcccaggggtcagtctgggtgcaggcctgggtagaggtccaggagcagattctgccccccagctcatacttcctgtgcaccatggcagaaaatgcaccagcatggccaggagcactggcttgtccctgtagtctcagtgttttgggaggctgaggtggaaagatcgcttcagaccagcctgggcaacatagtcagaccctgtctcgaaaaaaataaaattaggcatggtggcatgcacctgtagtcccagctactcaggaggctgaggtgggaagattgcatgaacccaggaggtccaggctgcagtgaggtgtgattgcaccaccacaatccagcctgggcaacagagcaagaccctgcctctgaaacaagaaacaaagtgcaccagtgtgtggattccagcttctcctggtgtgtggacctgacctcactcagccccatcagtgagtaggaggcttcctgctgtcttccagaacactctcaccactacacctgtgttcctcctgcattctctggcaggctttgtgaggagacctgtcacctgcctctctggctgccctaaggcccagctcaaaccttccctgaccctgagaacctttttctgaagagtctttcccccacccataggccccctcatttcagagcttttggtggggtgagtacaaggatcgactctctgctaccagcctgggtagggtccctagggttgggtctctggatggcatatgagggtctagaccaggatccagatgcctgtaacctgaagggcaggccctcagctgccccaacttcatggagcccctcgtccagcctgaccttctgggataggcccagcccctgcatcctttggtcttggtccctgcagggaactctggttaccctggcttacctactttgactccaaaagtaatgctgacatcccccgtgagacacagtgacagactgagactaacgtagggttacgtggctcagagtcaccatggccaggcagagctcaggtcctagcactgttcagccctgcctcccgggttcaagtgattctcctgcctcagcctcccaagtaggtggaactacaggtgcatgccaccacacccggctaattttttgtagttttagtagagatggggtttcactgtgttagccagcgtggtcttgatctcctgacctcgtgatccgcccacctcaggctttcaaagtgttgagattacaggcctgagccactgcacccagcctccctaacactcttctagctctggtgccctgcagggtctcccttggagcacctggagcccaagaagctgtccctcacctttgcaatcccagggactcgccccctgatcatgatgaaggtggacccaaacccgctgaggggcctgaaggagcaaaggtcagcctctgcctcccacggcctctctgatgggggggatgttatcccagcagcatgagctgggagcagaattgggaggatggggggttttctctgtgggtagctctgggctccaaggtggagccctcttaacctggccgctcccctgtgactctccttagccccaggcaaagaaagcagcttgccggaggtcacctgtcagatagggaaagagtgggacctgggttctttctcacccagctgcagctctcccttcccccagccccttcccccaggtgatagagaacctggcaggctgtgtcccatagaagagttcactttccttctggtaagggatgggaaccagcttgggatgggagggatgaggggtctgggggctctcccagccctgcctcacatttgaaggatggcatctgggtgtcagcatggtttaggctagacggggcggccccgaggtttatagcctggcctcgggcaggatgctgccatgccaccttctcttctgcacgtcctgacctggcatcctacctaaaggtcctcaggtctcctgccccctgggcattgcccccactccctgcccagacacagctgtccttgtcctggactaatcttcagagattcttgtccagcccacagctttgctggacatcgcaggctgggccaggccccctgcccagcactaacatctctgtgtgtctcaaccagactgagctgcagcttcagggtcagggtaggctctgacttaattgacgtgacccaggacaaggggatttattgatggtgtcacatatgcttaagctcttggcctctatgatttctttggggcatgatacccctctgtcccatgcttaggtgcccacctgtggccacaagtacctttcttaccaccatccctacttgagatcggtgtccaggcacctgtggctccacgcagaacgctgagcacagagccaggcctgggcggatgttctgcaggggctgcaggagctgacagtcctgaccacccagcccgtggccatccattccctttcaccgtggctggctcttcatccaccatccttccaggggccaggcctgaacccaaactgacttttacctgccctggtcccccttgtgcctatcaggttcttggctgagcatgatgttcttgcccatttccttgattatcctcaaaaggtttatagaaccacttggggacatcacatctgtctaccaggtcctcaccagagacatgactgccttgggccgggcctgggatagtcaggggtcacactcacctgttgggacctagcttcagtggcttcaatctgggcaatggcctgatgggcggctgccccttctcctctgcttgggggaggcaggagaggaaggtcagggaggagatctgcttcctgcccacctgacactggttggaagcagggcgcccacctgtgcctgtctcaccttgctgcaggtgcatcggaggccgaacccctctcccgatctcctgcaggtgcagattccaggtttccagtgggtgtcagtgtgggctccagagctctcctggtcctagggaaccctgggctccatgaggccttcgcctagccagattgtttcccacactgtcacctccccaccctgtcacctccccaaacatggggctgcatgctctgtgccctgggtgggacattggaaggagtgccaccttccaggtttggatcacagtaaagcctctgccatggggatgtgctggccgagacagatggggttgaaccagtcatgatatgttggccttgggcaagtcatctgtgccttgcttccctttccccagcagccagaagggataatagcacctatttcacccatactcaagtgttcatttgttagcaggaactgagtcccggaggaggtgcaggtggagccattgaggcagcactgcagctggacctgggtctgagtcccagctcctggctgtgatatgcatcactctctccatttatttatctgaaagacagggctgtgctgttctggggtcactgtgagaatgcaactggcctgtgtgagttggtggtggcctcctgtgatagcttgaggtgggctggaggtgtgtcttgaatgccccctcacccccatggggaagacccacttagggaagactcaagtgtctgtatggaggaacccacattccctgcccctcagctgtcctctgtcccttcctagccccctctgctgtcctgcaggctctggcggtggccatccagcttggtggccatctggctgatccactcctccaggtggaccctctgtcctcatgtggtgcaggtcccattgtgccacctccagacaggccatgctagccccagggcctccgttccctgttacccagcccccacccccaggtacgtgccacctccctaaagcccactgtgtccaccagctgtgtttcaactctgtctctgagcaaggcctaacgcaaagcctgaaacagcctggcttgtagagggccaggagaccaaagcttgaagagagagtgacggtctcccagagcccacttagcctcagccccagggctgtgtccatgctgttcctggctccagtgagccaattctctcccctgacgcccgtaagggctccagtggtgatggaggtagctggagagaacaaggctgtcttaaccctccctccctgagaaggcccaacggggaacgttttaggcatcagggcattctggggggcatcttccagggacccctcctataccctgccctgccctggctctctagtgagaaattgcagttgcttggacagtggggctgacccaggacaaatgcatatattgggctggtcttcagggtgctggggtaggggcaggggcacttcagggataggaaggaggggcctgtgtgttccagaagtacagaggaacctggtgccggccgccgtcaacccctatgtgatgatctttctacccgccctctttcgtgtcttggtgctggctgctgtctttggccaggtaagctcatggtctgggctcctggggtccactcactgggcctccacactgcctgcaggtaggggagcctttgggccaggactatccttggctccccttccaggtggtgggttcaaagaccattcctgggttccaccaccgccaagcctcaatggtgtctcgatggtcacaggaactgctggggctttctaggttaagacccttgcctatcccggtgttcctccctgcagtagggggctgcaggggtcagcctcagtctctgccttgggagcctgccttaccttgcctgaactcaagcgatctgcctgccttggactcccaaagtgctgcaattataggcgtgagccactgcacccagcccagccttgactttgaaatatatgttgtacatccagacagcagtgaactctgggggaacaccaaagatgaggagaatgagagaagagatacctccaattaaaggagttaggaagagatgcttgaacttatgttttaaaaagtcaatgcaggttgggcacagtggctcgcacctgtacacacagcaccttgggaggctgaagtgggtgaacggctggagcctagaagtctgagaccaccctgggcaacatggcaaaaccccgtctgtacacaaaatacaataattagccaggcacggtggtgcctgtggtcccagctactcgggaggctgaggtgggaggtcgaggctgcagtgagctgagatccaccactccactgcagcctgggcgacagagtgacaccctgtcttaaaaaaaaaaaagtcactgttttggggttttctgggtgaaacctctgtttccataaaaaaagaaaaaggtcgagacagtgtgtattactgattcaaaatcataacctgatgcttagagtaaatcattgtatctattgtttcaaaaaccaacgtcaggattattaaaagttaattttattgggtttttctttaagcttggctgattcactcaggtctgtcacttccaagcccatgttttactactttgtaaccctatttggaaggaaagctgcagctcacattatgatccatcctgagatgaagagtttcacacatatacaccacatataccccccaccacagtatgacgacacagcaacccaaccttgggcaaatggtaccactgccagcaaatttttttctttattttaaatatttttactgtatttcttctaacagcagcaaatgcatttaacactttattgagattctcaacagctgccatttggtttgtatagcaaattgtttacaaagtaacttttttccatttttgatattttaatgaaaattatgttcttcagttttaaagctctgtccctctcccaaagaaaggttaataactaactaccaagtaatgattatttgggaaaagaagaaaagcaaaaccagcttgtaaacacttctggaacgtgggtaaggggccaaagtcaagaccttctgggcccagtgcaggtgctaggcttgcctcgggacaccatcagcacttccccatccacaacatcctcaacagctgggagccatgtgcagaccccagggggcttcctgttccacaagctcccctctctttttcctctccacccttgctgttgggcctcccttccaaatctgcctaacaaaggcagcaggatctttaatactgttcagctttgtcaatggagacaggatactctagaaagttgagagattccctggtccagtctgggggaggaaaaaatatgcagtgtagcatagatggttttacttgtccactcagacacatgctcatacttattagatggatgtatcagatgcttcaaaagtcctgatgtgtagtagcacaaaagctgcttgtaaaaaggaagttgcaaaatgataaaaatttctgcagcagttcaggctcctgatgacaaagctggttctgataagtagttcttttgacatgcacagcagctttcactgttaagtcctgtgttccagcggtttcatttagaccataggaagttgaaagcaaagtttaaatgttctctgctgacaaaatgtggtatatatccatcaatggacttctactcagtaatgaaaggaacaaactaccaaaacctgttatatgtcatggaccaacctcaaaaaccttagctaagtaaaaagccagacatgtgaccacatattgtataattctgttgatttgaaatgtccaaaaaaggcaagttgatagagacagaaatggtctgatttacctcaagaagtagggattcaagctcttagggtacatgtgatacatacattagaagaaataaggaaaagaaaagaaatttatatgtaaataaatgaaaataatacttctccctgattataaagaaaattgcattctttttgtaataatttggaagacaaaatatgaagaaaagtctttaattttgccactgaaagcattctggtttgttgctttttatatttttttatgcatatgaacattttaaaaagtagaatcgtaatatatagtcttttgtcactatgttttgggcatatttctatggcagtaaatatatccttggcatcatctttttaaaagctcgatgtgtattaagttaatcattgccaccccagaagtaaattttcttatatatatattttaatggacgcaagcaagcattttggggctgaagtcatagaagtagaatttctggagaaaaataacataaaatagttttaagatttttaatagaaattttcaaattatcctgcagaaaaattggttcagtttatactcccaacaggggcagagctccagtatcccgtttccatttgtcctctttgctgatatttaaggagaaaatctcattgttttcattgtatttctttggtttctagtgcttttgaaacttttttttttttttgagatggagtcttgctctatggcccaggctggtgtgcaacagtgcaatctcggataactgcaacctctgcctcctgggttcaagcgattctcctgcctcagcttcccgagtagctgggattacaggtgcccaccgccatgcctggctaatttttgtattttttagtagagatgggatttcaccatgttggtcaggcccgtctcaaactcttgacctcaggtgatccacccacctcggcctcctaaagtgctgggattacaggcgtgagccacggccctggccttgaatcatttttatgtgcttattggccatttttattcttgtgggaagtgcctgtttctccattgcctattttctggccaagctcccaagtcacatttcacttaatttttatcctgctgattgaaagcattttaacataaacaggagcaggacagactgtaattatctagatcttgctctgtcacccaggctggagtgcagtggcatgatcatagctaccacagcgtcgtactcctgagctgaagcagttttcatacatcagccttccaagtagctaggactacaggtgtgtgccaccacccccagctaatttttaagattttttgtagagatgcgaattcactatgctgcccaggctggtcttgaactcctgacttaaagtgatcctcccaccttggcttgccaaagtgttgggattacaggtgtgaactactgctcctggccgagggctcattttgtttgctagtggtgatattggtatctgtttatatttgaggctttggtgctagtgctgatgtattacactcaccatccgaggtttgcaggacttttgttttaatattgaatagatggaactgtttacttctgcatctttgcaggcatacaaaatgtgcctaccaggactctgctttatatctatcgaaagcaagaagtaatacagtaaaactttgcctggctagaggctttggaagaatggagtattctgatttaatgctattgaagtgtgaaggtgaaaagaatgaaaaacttacatttcctgttgaatgcaacttgaaaatacagccagtgattccacttttcttctctagtaagtttggacattctgatctacttggtgttttattatagaactgctagtgtgcccgagacttacattgtgaagacactttttaaaaaacttgagaggtaagagggtgtaaatggtattgtgtgagatcaggctggatgagaactgacacttgtaaacatactttttaggctgaatctctgattgccgtttgttttcttatttaactcataaaaataaaacacattggatggagggtgggagcaggaaggagatttatgtcttttaattgcatgccattgtttcatatcaagacagaacatatggtatccctggctttggacctacagaaggaaacacatttttctgcctgctgtatgccagaggttcttgaacacctggagggatgactgcagcacagattgctgagccctactccagagtttctgattcaccatgtccagggtggggcctgagaatttgcacttacaaaaggttctcaggttctgctgctgctgctagtccagagactacatttttgagaaccactcttgtctactaactgtaaattgtagaactctagaacaaagcttagtttggtgtaggaaaagaagctcacaggttatggagcaaatcatgaaagattcaacccttgatcccagcctagtgtggaattcaggtaacaatcaatacacagtgacataacacaattcttggttttcatgattgcaagtcatagccaagtatcaagtgagaaattcagtttcatttgcaaggcttagagaggccaggtgattctagaaaaataggccttgtatttgctttaaaccagtaaagagctttgagtgcttattaaatggaaagctttgtgtttttatttatttttgactattttattttatttttttgagatggagtctcagtctgtcacccaggctggagtgcagtggcgtgaccttggctcactgcaacttccgcctcccgggttcaagtgattctcctgcctcagcctccccagtagctgggattacgggtacccaccaccacacctggctagtttttgtatttcgagtagagacagggtttcaccatgttggccaggctggtcttgaactcctgacctaaggtgatccacccacctaggcctcccaaagtgctgggattacaggtgtgagccaccacacccggcccaaaagctttgtgtttttaaagatattagacatgtttcttgttttttaaaaaatcttaataatgtaggagaataagagaaatgttttttccaaagccgagaaatcattgtgattattttaccttattgggatgttggataatatagtccacttcattcattaatcatcaaacatgctatggattttccatttttataggatttgtgtcttaactggggtaatactggtaattcttatactccctctgaagatgaaaaatgtaggccaaaatcatagaccatgcatagaagctggataatgaagacagctctggaggaacatgtagacacacacacactgacacacatatatataaagtataaatacatatttttttaaagtttatttttaacattttaaagcaaaaaccagccctcccctctcccggagtaggcaggccccgcccctctccccaagtgggcagggacagcagtcgcatgggcagctttccttgtgatgtcacaggttcctctgggcacactgctgcctggccacgcctcctttccctttcatctttctcattgaccaatgggattggagcattaaggccacacccctattctgcattctagtgtggccctggttacgcctcctctggctcagtcacacagcagccttgtaggtgactggaggtgttcgctgatgtggccccaaccctacctccctccccaccccatgatgttagaagaatctcgacagaataaattggcagcagccaagaaaaaggtaaaaagccaagaaaaaggtcatggccccccaacctagccagagatcccctctgatgacaagaccactcccagagtccataccactcctgaggcacaccgggctgggcccccctaccccggcgcctctggactccccccaccaacgtcttgtcagtcagccccgccccttcagcaagcagcccagcctctgccctcgccaatcaccctgcggtgactttgggcggatgactactggggatacctgctccatattcagccctcacgtcctgccaccccaagcccaacctccctgggttctttgggctcacctctccaaggacctgggtcccccagccccaaccccccagcatcgccagtcatcccggggtgactttgggctggtgactcctggggttccctgagcagactctgctctcccctcctgctgacccaagcccgacctccctgggctctctggactggcatctccaaggacctgggtcccagccccacgtcccccctcccccatcgtggatcggcaactcagccattgcactgatgaggtttcccccacccccaggaggagtggaatgtagtgatgtcacagtcctcctaggaactgtcattactgctgcaagaccggcctttgatcttataacccagtcccctaagcattctcaccccatttctggttcctctggtcacagcacaaatttccagctagaagggaaatggggaccatgggacctaggagcaagaggtttcaggctgccttactcccttcacatagacatcgacagtgtgaaaagcctacacttcccctgtgagctcaaaacgttgacagtatctctgggtggtaatgggagaatgggtttggtttggttttctcccaggcttctactctccagagagactttaacatttttttccgagttctccacctcatattctaattctccacggttctgggaccagactgcccttcagtcagtggtctctgaagtgagatttgctcatcttctgtggaataggtcttgggaaactgaacttgacagcttgaatcttcctcatatcatctcaacttagggtacattgagtgccacaggataaatgtgggagatctttctgaagcatcagtttcccttgagtctcttgagagagaaaaaacattaatgtacttaggggtgaccctcacataggtttctaagagtataccagacttctctctgaaatgagacttgggttgtcctctttctgataaattcccagatttaacaaaaaagctgccttctgccatgaggacacattgatataaaagtttgagagatactggtgcacttcttcacactaacagacatttgaggatgtatgactctaaaccacacagcgtgtagttcatgcctatgtaatgtttacttttctacctctgcgtctggttttggtccccggcagctgctgattcatggcaaaaccccagagcttggagtcagaagactgagtttaagttccattattgcccccccacacttttttttttagccataatatccatccctctcagtcacttaagtgattgtgacaacaccttgtacagttgttggtggcattaaatcagatggtgtataagagtattttgcaaaaactgtaaggagggtgtggctgtaagggctggtagttctcatgagtattactgctcttctttcccacagctaaaagaatatcagcaaaggaagagccctggtattccagcaggagcaaagacaaaaaagaaaaaaactgacagtagccctgagacaaccacttccggtggtggccactcacctggggatgtgagtcttggctggccaggctcctggggacagggggcccaaggggcagtagagggtaattgttgagattgctgggtactggttaagaattctgggtttgaatcctgcttcttcatctgctagcgatctgatttatggcaagttgcttgagctctttgggcctctcttttcacatctgtaaaataggggtagtattgtttgacttccatttgtgaagtttaaatgagattccttattgttgttgttttcatgttaacccctagtacgtggcctgctgtaaacacccgggatacccaggaaatggtcattgctgtttgattttcctgatccccactcgcaaggggaagctgggctaatgagtacagccacttgccatcaggctgtccctctaggagtcactgaagggggcccagggtgtggtgaggagagcccaaggcactaggagcaagagaaggtctaacttgccaccagcttgctgggtgaccacagaaaaatcacttcttctgctgggcctcagtttcctcctctgtaagatgatactggataagatcagtgtctttcaaacttgttttttagctgaagtccccttagttcaagtgaactcttactcaggagtctgtttttttttaatggaggtggaggtctggagctctaccagattcatcgcccatgtcctgggcctgaggagaggggtccagtgagcgtattaagatctgcattggtcagctgactccactctgtgactgcgtcactcgggggacttttccatctatttttttcctgcccctggcaaggcagcaggtggccatttggaagaatggcacaggccatggttttaatctcctctgctcttcttcagcgtttccttttcctgaacccacatcttcctcctaccctgactttcttgcttctctctaagccacttctgtctttcaccccctgcccttgtttttcccttgtcacctcctgtagattcaggacattctgaaggtgcgggtgtccaaccttaaccactccaatggggtagtgctcccccattggacaagtggaaggtgaggcagtgccaagacccctctctggcttgctgtctacagctgtgcatggccctgaggcttctctggcttgggggatgcttggcctctgccttgttttatgttgctgccattaaccttcagcctgtttctgtctgcttcttcacctgcttgattgattgggttttttccttccccgcgtcttttattatcttggaaatggtgacgcctaaaagtttaaaagtaatctgggaataacgtacagagcaggcatgtgggatttgggctctttttttttttttttttttttttttttttgagacagagtctcactctgtcactcagactggagtggagtggtgcgatctcggctcactacaacctctgcctcccgggttcaagtgattctcttgccttagcctcctgagtagctgggattacaggcacctgccactacgcctggctactctttgtatttttagtagagatgcagtttcaccatgtcggccaggctgatcttgatctcctgacctcaagtgatccacttgtctcagcctcctgaactgctgggattacatgtgtgagccactgtgcccggctccttgctgtttttatactttctccatatacataactatttcccatgtaagtttttttttaatttctcatttttattactcctgcatcatctgttaccctgaaggatctggaagtaagaggccctgggctgaggtgcagtgactttgcaggccagccctccaacctcctctcacagtgggggctgggtgaccctctgccagctgagacagcccacacacaccccagccctaatgattgttctctctacctctccccacaatcctcttccaactcctcctctctgcatgtgcctcagagccagtaccaagaactagcagtagccctggagtcaagctcagtgacaatcagtcaactcaatgaaaacatagaatcattggtaagtccagtggggtcccctgattccatgctgccaatcctgggctttagtttccccttggggccctgaagaaaggggctgggggcccctggtgccaagggcaaatggggagctggagcacccaggcctcacctggagggaccccagagcaaggagcacgcagcatggctcttctgtcactgccctctttgccgactctctcttctccagacacccctgctccagtccttgccacacacgccctgaggttgtcacctctcagggaagcgctagcctgactggttgtcaggggccctgtatttctgccctgactcagtccctaatttgctttgagtctggacaagccacctgtcctccttgggcttgtgtttctggaggaggtagagcatcagagttctctgttagctctgagagcctgagatttaaaggcccctagaatggaaacctgagggccaagggctcctgtctgtccttttccatcctatatctgctgtgaagaaccgtagctggcccgtatgtgttcagtaaatgtttgttgaatgaaggcacctttctaaatcacaagctggcagaagggtgggccttcctgagactccctctctaggggtttatgttactgtcctttcaagagaatccagattcagacttcgagttctgtggctgtgggcaaaaaccaacaaagacccaagtcctctgtccttgggagcttgaagagggttgaccagtttgtgttgccattggttctgagaatgttgcctttaaaatccattcctggaccctgcctaccgcttccaggtctggggaatagagttgagggggccactctcagtcacctgaatttgactctccccacagaaacagcagaagaaacaagtggaacatcagctggaagaagtaacgtgatttctttgctcacaacatgactgctgggtttgggggacactcagatgcagaggcgccagtctcatcttgcccactcccagcctggggaagaaggctcacccatcagattccaccccatccccacagggtccctgataacctggtcccatgggtgggcctgtcctggggcattggtggcattctgggggcatgtctcttgctgtgccatctctgcctccctgtgataagagctctgtcttcctcttcctacaggcaaagaaaacaaacaatgaaatacacaaagcacaaatggagcggttagaggtgagtggagggtggggagctttctcctgtcctctggagaatgtttctttccttctctttcagcatttccttggcttttctcccaaacgttcaattccagacaatcaacatcctcacattggaaaaggcagacttgaagaccaccctttaccatactaaacgtgctgcccgacacttcgaaggtgggaatctgggcatcccgtcatccttcaacctggcactttgacaggtctttagggggagtcttttgggccccatctcaacctctctcattacagaagagtccaaggatctggctggccgcctgcaatactccttacagcgtattcaagaattggagcgggctctctgtgctgtgtctacacagcagcaggaagaggacagggtgagtccaaccagctgccccatcccctggcagcctggcttcccagatagaggagtgagcctaaaggtcccttctgcaggatggagtgtcctgcccagaaggcagcatggtcatttctcactacttttgtgtatggttgttagaggcagcctggggctgagtcagctgctgtgggtgagttggggggcactgtggggagtgagcactggatgcagagctcagaggccaagtgcctgccctgccctttcctggctgtggccttggccaagtcctaggtggggtattgggtagttgttctgtgaaggtacagaagagcacctttagtatgttaccatttctgtagagagaggaaaggggtgtgtgtgtgtgtgtgtgtgtgtgtgtgtgtgtactatgataatatacaaaaacatgtctgcaagcattcataaaaaactcaggagagagtaacagggtgcctggagacacctcccttctgtaccttctgagttttggactatatgaatgtatcatcctttcaaaaagtgaacaaaagattaatttcccccttcctatctgtgtccccacccccagcaagaaaaatgggcttagagaataggatagacctgggtgttcaaatcccagctctgtctaagtgatcttaggcaatcacttaaccttgaacactcgatgtttttcatctacacaatagaggtaatcctagtaactgtctcatatggtggttgtgaggattaaatgggatcgctagcatggaacctggtgaagcactccataacggttcaaacagtggtagtaataacagtaataacaatagcaatattatctgatctctctgggcctctgttagccagctgtaaattctatctctttccctctcccttccaactttactgagttcttttaataaccaggccacgggcttggaaatgccttgacctttactgaccgagttgtatattgagcctagccctagcccttttaaggggcactgcctgagctccccagatcaaaacttctcactcttcaccatccagtcctcgagctgcagagaagcggtcctccaccggcggttacagcagaccataaaggagcgggcgctgctgaacgcacacgtgacacaggtgaggctttgcagagggagggatgtggaaggaagatgaccccaggtggccaggagcaggtgaggaccagtgacagcccttcctaacttctgtgcccatttcttgcaggtgacagagtcactaaaacaagtccagctagagcgagacgaatatgctaaacacataaaaggagagagggcccggtggcaggagaggatgtggaaaatgtcggtggaggtgaggtctgacccttcagcccccactttagataggtcactggatctttctgggcatctgtaaaatgggaatagtacagccagaggtggtcatgggtctgggctttgtggagatggggacagagaatgagatggtagcctgtccagccaccagcccctctctccagggccctttcccctgtgctttgggcaggctcgaacattgaaggaagagaagaagcgtgacatacatcggatacaggagctggagaggagcttgtccgaactcaaaaaccagatgggtaagatggggctggtgtgacctcggagcaggactggcatcagaggtctgtgggggtggcttagaatgccccagggaggtgggtgggtggaagggctttgaggcagagggaaagaggtctgtgccaggagacggcaagttttgtcatctccatgagcctcagggtccccatcagcaaagagggaggagtgcccgttgtcagccacccacagtgctctctatgtgaaagtggcttggaaattggctaccattgggtgcgaggaatgattagcagtgaggccaagtttgggaagcctgagaggagctgtgcatcaagaggaggttttttttttttttttttttgagggggatgtgggtagaggggttggggaatccagaggcccttattgtctgcttcatttctcagctaagcccccatccctggcgcccccagcagtgacctctgtggtggaacagctacaagatgaggccaaacacctgaggcaggaggtggaaggtctggagggaaagctccaatcccaggtggaaaacaatcaggccttgagtctccttagcaaggaacaaaagcagagactccaggagcaggaggagatgctccgagagcaggaggtgcagagagtgcgggagcaggagagactgtgtgaacaaaacgagaggcttcgggagcagcagaagacgctacaggagcagggtgagaggctgcgaaagcaggagcagaggctacgcaaacaggaggagaggctgcgaaaggaggaggagaggctgcaaaagcaggaaaagaggctgtgggaccaggaggagaggctgtggaagaaggaggagaggctacaaaagcaggaggagaggctcgcgctctcccagaaccacaagctcgacaagcagctggccgagccacagtgcagcttcgaggatctggtgggttgccccacctggggagcctgccctcatccctatccctccaggcctttgtttccccacctgtaaaatgggccagtgtagccctcacatgaaatggtacttctaaaggcacctgtgagctacagctcatcgggctctgctctgatggctgtgggggagaagggatgatttttctaacctgcctccacccttcctggtgatatgggaggcagacaccaaggtctggtgtctccagctgcagtggatggccactgattgcttctctctgtccagaacaacgagaaaaagagcgcactgcagttggagcagcaagtaaaggagctgcaggagaagctagacgaggtgaaggagatggtaacctccaccccatccaagaagggctgggaggcgggcaccagcctctggggaggggaggtgccaggccaaaggcagctccagctgggaggcaggtgaccccagcaccctccagtgcagctctatgactgtttcttgcttcctgccctctgacttttagaggtgggtagccctgggctcctcccaggtctggacatcatcatcccagctagagacatggagcccccaatcataggggaagagacagtggtacaagaggctccttatccaggcacggtggctcgcacctgtaatcccagcactttgggaggctgaggcaggagaatcacttgaggtcaggagtttgagaccagcctggccaacgtggcgaaacctcacccctactaaaattacaacaacaacaacaaaaaattagccaggcatggtggcgcatgcctgtaatcccagctactcaggaggctgaggcacgagaatcgcttgagcccacgtggtggaggttgcagtgagctgagattgcaccactgcactccagcctgggccacagagtgacactgtctcaaaacaaaacaaaaaagcctccttagattcaaactggattctggcctgggttccactggtcaccattcaactactgttcatctctaagtctctgtttctgtgacttcaaaaggaagttagcattttccttgcagaggtgctgaggattgaatgagagaatacctggaaagcattaggcatgtagcacacttagcagatggtggttggctccctctgcttttccgccagtctgtggcctacagtttaaatggtgggaagaaggacatgagatttgaggctggggaaggaggtatggggttctaggcaagagaggaagcctcttaggcctggagcaagggaccagggtcctgggcaggtgacagagccccacggtgccctcgctaccctattaatgggcccagaatctggaagccagccaccatgtgccctcatgcccagggtcttcctgcaggtggagctgaagagccaagggtctcagagtctgcagcagcagcgagactagtacctgggtcacctgcagcagtacgtggccacctatcagcagctgacctctgagaaggaggcgctgcacaggcagttactgctgcagacccagctcgtggaccagctgcagcagcaggaagcttggggcaaagcggtggctgagatggccggccaaaagttgcaggagacccaggggaggcagttgctgaggacggggccccgagggggatgacctggcaacctccgtgccttctcactctgtttcccgtccccttaggagcacctagaagctgccagccagcagaaccaacagctagagacccagctaagcctcgtggctctcccgggagaaggtacaggagaccactcagaggaagaggagagagccccaggaggaaggggggactgttagcagcataggattgaggggttggaagagacctttagaacagctggtcgttatgccaaccgggtgtccgcactaagttcagcatcaatatggtgacctcctgggagcagggggccaccaggttgcctaaggatgaatgaactggaccagatcagaaagggagcaggtcaggactcccgcaccgaccggtagtgggactgtgcctgggcaatatagcaagatcttggttcttaaaaggaaaaataaagaacagcagctcactcccctctggggagaggctggctcagggttacacagtcagggtggggacagaggtaggcccacaggaccttccttgttgggttgtctgaggacccctctggccacctccctacaggagatggaggacaacatctggacagtgaggaggaggaggcgcctcggcccacgccaaacatcccagaggacctggagagccgggaggccacggtgagcctgactttccctgccccgctttgccaccttcctctgtggtccctcccagacccccttatgctcttggtttcccaccttctgattgctctggcccctcaccccttccgggagccagtggtcagacactttgtcacctgtgaccaacaggtgcactctctgaggccccaagggaaggggttgttctccacctccctgcctcatttgttctgtctatgcccctacaagaatactcacctcttgccttcaagtggcatttttcacctctgctggagccagttcccaggaggagcaggcacggctatgtgggcagcggaaggtgtgaaggctgtgctgcctgcacctggctcatctgttggccttggcctggaaggagccagaggcagaggccccagccccagggagtgggggtgagtttgtgtgtggggagagctaccgggccctgaaggaggccatggtgaagctgaaagggagtgagtcctggcatgggccaagaaaagtgggggcggggcagaacaggtcactcccgagatgtgaccccattattttggctccagagcagctttatggacctcccgaaggagaaggcggacgggacggagcagtggagagacgagagcttggattcgtccagccttctggagtgacagacggcatgagtgagcgggaggccagggcacgggcacggggagctgcagggccgtcggagggaccctagtgtctgagctgtgtcctctcacaggagagtccttcaccgtatatgaaagccagggggcagtgccaaacacgcggcaccaggagatggaggatgtcatcaggctggcccagaaggaggaggagatgaaggtagggcgtgcaacatctctgcgggggtgggggtgggcatgggcgctggtgcaggctccagggtgggagctgagcacccctcccttcaggtgaagctgctggagctgcaagagttggtgttgccccttgtgggcaaccatgaggggcatggcaaattcctcatcgctgcccagaaccctgctgatgagcccactccaggggccccagccccccaggaacttggggctgccggtgagcaggatggtgagtagagctctcaggcggggtgggcaggcaggggcaggggaggctcgcactgtgctcagacccccgcctccctctctctgaagatttttatgaagtgagcctggacaacaacgtggagcctgcaccaggagcggccagggagggttctccccatgacaaccccactgtacagcagatcgtgcagctgtctcctgtcatgcaggacacctaggagcacccaggcttgcccagcaaaccctgcgtgccattcttctaccaggcagccgagaacagggagataaacatcatcatcttctaagagctgatcaagaaatttaaaacaacaacaacaacaaaaagttacggggttcatctcctacacaattcatttactccatttgaatgctagagccactcacatttatttgtgtttctaatttaccgtttaaatttatttgtaaaaagttaagggagagttggtctttccctgatgttctttctggcatcctttagcatttttatttttaatttgataattgtaggtcattagtatgcatatcgagtttgcccttaggtggtgggaattcaaacacacaaagacccactaatttgcacaaaactattctggctggtttggaacaggctgccatgcttttttaatgttattgcagcatgtatattcattccagaattcagataaaatgtgcttatgttctgctatgacgtttgatcgaatcctaaccacagtgagctcttcattagctcaatatgtggtttgccctcaattgagcactgtttattactttgtaatatgccactgtgagtactgacatttagagttgtttaaaggccaagaactggaaacagccttttccctattttctgtgtattggggatgggagtaataacattttggggagctttttaaatctcacagaagaggaaagtggcctgctctggcaggtgtgtgcaggatagagtgtgtttcatttgttctggtgccaagaatgagcgctgtactatggtagttcccttaggatttgtatgtgctctgggctcatgaagatattgcatcatgagctgcagcagttgtaccctttcttgatgacctaaaaagggattatttctgaggaatgaaaggctcccatcattgactgtggatgtggaaaaccttttctagcttagagcatttatatctacaatacattttaaagtcagagttcatgttacctgttttaatcacatgagtatatgtcccagtacacaaaagggcactggttggcattcttcttaaggtatttagtgaagatcataagaaatcctttaagagtttaaatgtccctggaagaggcatacaggctctagtcaagaatgaattcgagtgaaggaaagctgtgtgacacctggccttcctctatgttcatggagcttctttgaggctagaagattgattttatcatctagacctctctggctaatacctattcttcagccacattagttactctgacgtaggaatttacttcttttctttgaatggaaaacactttaaaaataataacaaccattattataaaccaatatatgtgagagtacttagttgaaacaaaaaggagttttagtagacagtattatactacacatgaaaatcaaggcgaagtttatgcaacttaaaatgtttacaagctgcagtgcaatctaatgtttgcgaatgtccaagtattatgagaaaaagtgtctatacaatgacagacttacgtttcctcacaaagttcttcacaaagagtgaaatatgtttttatacctctcagtttcagttagaggcatattttgtgccatatttatgttaatgtgcctatacgtgatgagtgaattatttcagtcatacattgcctaaatcataactttaagatgcttgggaaagaatcaacagctaaaagttcatgaagttctaatgtctgtgttccaaaatacgtcacagtattaggatgcagggagagatgtgtgtgcgctccctggggtgggcatttctagttactagaccatctccatttttagcatttggcatcctcatgatacttttatacatatgacgttaataggagagcaataatacgattttacagatggaataacagatgtgcctgcattcagtgaaagagtgcaaatattaagtccttgtgacttcaactgactcttccaaattgtatgaatttatcaatgtattagataaactcagttccagaattataaagaaaaactgttagaccaacgaatgtggctaattaacagtaggacgatttctagcccgagggtttaaaatggacttcaagtcctgttcttgccttttattttctgaacttgccacttttgcattctttgagttcagtttaaagacagtttgagtccaatttagaccctcgggctagaaatcataccactgttaattagccaccttatttggtctaacagtttttctttataattctgaaactgggtttacctaatacattgataaattatttcaaaggtatttttatagttcaaatcacttcacttttaccctgataaatataaatgactaggaatgatcttcagctagcctttagcacctgcaaccaatcggacaataatgtgttcatcaggtacctgtggattaaatcacacaccggcatatttaagctgaatgtcagtctggaaaatgaatgtactatattaactgaaataccactctttgtgtaggtattctgtcatatatttaagaaaaattaaatagcatgtaaatcatataacaacaacttaagtctttcttcaaagtgcatgtggtcctttgcaatacctcattcagccaagtatttgttctcttcctcattcagtttaaggcagctttcaatttgcttagaaggcaacattagaagggtagagtttaatcagaaacatagaattttaaagtgtgggttcaactgaataaatttgaatttctgtaggaagtaaagaattaaaaatctatttaaagattgcaatatataatcatttttaaagtatttgtttaacctgatgggttttccagaaatgaaaacaagtcagttctaaaaccaaagctgatatttagaaaatgtgaaaatgtaaatcagccctatccataatatagtttctctaaaactttatcttaaagagtcattttaaaagaatataactattcataagtgtaactgctatcttaatgttttgaaataagttaaaacactttaaaatatgaatactgtagtttgaaagaaagaaactgggggaaggaaaagtagagaaagaaatgccaattccaatgcaaggctttatttgccaagttttcttagaatgacttttaccagtttatgaattcttgtaaacagaatgtataatagaaatactgaaacactgttgcctaaagtggcattgttgactgctactgtgatgctactgtaatgtaataaattattaaatggttgcaaagtgctgtttttgccttaaaattttgtgtgtcttgaaaactatagtattacaggtattgagactgtgcaaatgctgggcacgcttggcatgagataatcagtttttatttttacaaaattgtaattaactatgcaagtgtgtttattaaaagaatacaaactaaaaagaagttatgggatttagaaaatgttgtaggatgaaaaagttatgggataaaaaatgtggaaaagtcgtggcaaaaaaagttgtgaaaaaagtatttaaagttttatgaaaagtttaaaaaaagtattatgaaaaagaagttacgggattaaaaaataagtcatgggatataaataaaaataaataaaagcaggcctctgtcagcataagcctggagaagtggggctggagtctctgccgccatcgtgtccctaccatcccttcctacccctttatcattagggtagcaagacaagacccctgtctaatggggggagacaaacagaccctttgccaccttgaccagggctgagtccttaaatttctggatgatgatgattgttatttaagagccagaggctggtggagtcggtttgtttggaggcggcctgatggcctccctaccctcaccaaagcaacttttccctcagggggctcccatcttcttattcagagaggcagctgaggcagggacaatggggctaactgtagagcaggtgagggcacgggctgctgggaaggccccagtgtacatatagtatctgtgtaacattttgtatattccagggggtagggccaccccctgtatcgtacctagcagaggttggagctggcatatgaggaggaggttctaatcattatttgtggctgggaaacttatttattgatagcatggggcagaggaaggaggcggggatggggttgtggctccctggtgatgcgactcctgtttattttgcctttcattttggaataaatggatttagccatactgctcagcctggtgtgttcctttttccctcactgggtcctggagtttgtgccactgaatgaggagccccagagttgtctgagcatgtccagctgggctgttggtgaccttccaggcctgttacctttatgctgcctagtgacacctggtggatttcattgggactgccatggcgcctatggggcacagtccagccctgacagccaacaggctcagaagcctgatctagcggtggccgggaagacagatactagcacccaagggcactgacttccattcaccccaggagtcttccattccgtccccctccctccttctcctgtctgcactgggtggcctgttctgtctgtccctccagtgcacctggtgacctgttctgtctgtccctccagagtgccagctgccctgcaggctcctcgaggctgagttcatggccctgcccctagtggccagagccggcttcacaggataacagccagctaagctccaggggctttccaggaaaagtgtcccttgaaaagggtgtggctttttcactgctcccaacagcaccctagaaatggcttggccttttccctcccctgagttccaaaaagaacacagccagcagaggacacattccctgacatacgagggactggaagactggtagagatgtcaggtcacaggctgccagcacagcacccccatgattggccacgggagtgctggaggaatggtgggggttggctgtccactggctgggcatgacagggagactcactggaggtggtgcactttggaggggcgatgtcagggatgtatttgggtctcagtaaagagatctgttctttttaaatttctgcatctagttgcctatacgcgatgatgacacatagcaacttattttttactttctaaagacaggatatcatgcaaagagatcaagctgcccttctataaatataactcaattgccttccagccataggctgcatgcttcaagttgttttcagaaataagaaatgggttgagctgaaccacttatagccttacatggagagttcccactgtgacctgtagcacatgtgaattgacttgcttaatgtatgaaaccaatggaaatgagatgaaaagtcctattctcatgcaagcccgttgggttatgcagagacacagtagcagagacacagccctaactacagcctgccctccggaaaacatgtgtctgttcatatggaaatgacacaagtctagtgcttgtctgaaagtcatgcagcaaaacaaaaaaagtctctgcaaaaccggggagagttttttacaatgactttaactttgagggtgctctttagcagaggcttttgataaaggaagaattctatcaaccaggatcactgaggaggaatgaatttataactactctttttaaggctagaagagaccttaattaaattccttctatttacaaaggagggaactgaagtccagaaatgacaaaaggtttggcagctttagaaataaggcaacattgagtttcagtattctaaacttttggaaagtggtaaaaatgaaggatattgaacaaaaaatactagttgttttttttctatcttgttcagttagtgtcaacatgctgtaagttttcataatttttttttttttgagatggagtttgactcttgttgcccaggctggagtacaatggtgcgatctcagctcactgcaacctccgcctcctgggttcaagcgattctcatgcctcagcctcctgagtagctaggattacaggcatgcaccaccacgcctggctaattttgtattttttaaatagatagggtttcttcatgttgatcaggctggtcttgaactctcaacctcaggtgatccacctgcctcagcctcccaaagtgctgggattacaggcgtgagccactgtgcccagcctatttttttttttttttttgagacggagtcttgctctgttgcccaggctggagtgcagtgacgcaatcttggctcactgcaacctctgcctcacaggttcaagaaattctcctgcctcagcctcccgagtagctgggactacaggcgtacactgccacgcccggctaatttttttttgtattttagtagagacggggtttgactgtgtggcccaggctggtctcaaactcctgagtttaggcaatccacccacctcagcctcgcaaagtgctaggattacaggcatgagccaccgcaccctgcctggttaatttttatgataataaaaatattctcataaaatttgggaaattccaaaacctatggagaagaaaatttaaattattcatcatcccacaatttattcatttgcttatttgagcaacaaataaaagtgcacaccttattaagagcagggcatgttccaagactgactatccagaaatgattgatagcctctaactgattcccttccaacccatttctcagtgcactactactaataattttaaaatcagattatttagttttgaaatctccttttcacctaatatatcataagccttttcccaggttatcaaataatattccaagctatgattttaacagctgcataacgtcacatcatataaatttacactgatttattaaaccattgtacttgggacataataagatgatcaatttttcaatattataaataatgttgcatgtaacattctttggccacatgcctgattatctttgaaaacttccctagaattcagattgttagatcaaagccttaaatatttttaaggtcttaaatacacaatactcaactgctttcttgaaagactgtaatagttttacttctaccagctacaagagtgtctttcagtcatgcaacaaagcccacacctcaaaacaatgagtattagctttaaaaaagtcattgtcaactgagttcaaatggtttttcctttaatttgcagttcttacttggcaatggttaagtcaaactttccaaaaaaaactttgttctcttttttcataaattatatatgcatgctttttgtcattttctatggaactgttaacatttcttcttagcattctagtcttaatatttctcagtgagggatttttctgactgcattctgagatctaggctcctggctggggcagcaagaggtgggatggagaaagggcggggagtcagagtcaggcttgttctcttagtccttccacaatcaccaaggtgtgacctgggccaactcttggtatctctgggcttcagtttcctcctctgtaaatagaagggtcttaattaaggtcccttccagtcgtataaaagggagttagagatccgtagtttcaaagcttctttcactatcatgatttgtgatcagctttgaaggaggtagtgctagtgggtaaacatcaaaccataagcttgtttgccagttctaacctaccactaccacctaccactgagaaaatcatttcaaggctcttagtttcctgatctgtaaatggaaacctcgttttacagatttgttgtaaaaattatgtgaaataatagaaatcaggccaggtgcggtggctcacacctgtaatcccagcactttgggaggctgaggcgggtggatcacctgaggttgggagtttgagaccagcctgaccaacatggagaaaccctatgtgtactaaaaatgcaaaattagccgggcatggtggcgcatgcctgtaattccatctacttgggaggctgaggcaggagaattgcttgaactcaggaggtggaggttgcagtgagccgagatcatgccattgcactccatcctgggcaataaaagtaaactccatctcaaaaataataataataatagaaatcaaagtgtatagagcataatataccacagacaggcaggatgcagtggctcctgcctgtaatcccagcactttgggaggccgaggcgggtggatcatctgaggtcagcagttcgagaccagcctggccaacatggtgaaaccccgtctctactaaaaatacaaaaattagctgggcatggtggtgagtgactgtaatcccagctacttgggaggctgaggcaggagaatagcttgaacctgggaggtggaggctgcagtgagctgagatcgtgccattgcactccagcctgggcgacaagaacaaaactctgtctgaaaaaggaagaaagaaaggaaggaaggaaggaaggaaggaaggaaggaaagaaggaaggaaggaaggagagagagagagagagaaagaaagaaacaaagaaagaaagaaagaaacaaagaaagagggaaggaaggaaggagaccatattcatactagtagctgcttatgactaatagaagtaaggatgaggattagaagggatttcaactttataatacattctttcctttatataataataatgaaaaagacagccagtcacagtagctcatgcctgtaaccctagtgctttggctaaggtgggaggatcatttgagctcaggaatttgagaccagcctgggccaccgagcaagactccatctctacaaaaactttaaaacaattagccatgtatggtagcctgtgcctctagtcccagctactagggaggctaaggcaagaaaatcatgtcagcccaggatgtcgaggctgcagtgagctatgctagtgccactgcacctgcactccagcctgggtgacagagtgagaccttgtctcccttttaaaaaaaaatgaagcaaatataacaaaatattaacaacagtcagtgttgattctgtggtaggaacatagttgtttgcaagatcatgctctgtacttttccgtatcttaaaaaatttcctggccaggtgcggtggctcatgcctgtaatcccagcacttagggaggccaaggcaggctaatcacgaggtcaggagtttgagatcatcctggccaacatggtgaaaccccgtctctactaaagatacaaaaaattagccgggcgtgatggcgcgtatctgtaatcccagctactcgggagactgaggcaggagaattgcttgaatctgggaggcagaggttgcagtgagccgacattgtgccattgcacttcggcctgggcaacagggccgaagttgcactccagcctgggcgacaagtgcagcccatctcaaaaaagaaaaaaaaaattcccccttcccatacaaatatgcctagctcataaaagcaatcctaaaagattacatacagtatgtgtgtaattttttacttttttcttatttttagagtttattaagcaggggagtggagggaagatgtggcacaaatagaaatatgtaacattcaaacaacagaatctgggatttttgaaaaaatctttcagttatggttacaggaagggtcacttcctcccccaacgacacagggacctctcaaaggagaggagagagtaagtcccatggtagggccagtggttgctcctgggttttggaatgatttctgcagagttttcaagaccctgggctcagggtggagacttcatagcggtggcagctagacccagcaagatggctgcaatggtgaagccctgggcggcgatctgggtgtgcatcataagccgtgaacattggctgttgccctggtggaagcagtagaggccgttggtgaggacggccgccgtgcacaggaaacctatgggtaccaccggattctcgcgggtcttgcgaaggaacttttccttgaaaccctctggattgctgtaaacagtggggctaagcccctcaaagatggggggcttcgatgattcaaagggggcctccggagtcacaaagccgagagtcgccatgcctaggccacagctgcaggagaaaatcctttgtttttttttttttttgagaaggagtcttgctctgtagcccaggctggagtgcagtggtgcaaccttggctcactgaaacctctgcctccctggtcccagttaaagcaattctcctgcttcagccttccaagtagctgggattacaggaacatgccaccatgccaggctaattttcatatttgtatttttagtagagacggggtttcaccatattggccaggctggtctcgaactcctgacctcatgatctgcctgccttagcctgccaaagtgctgggattacaggtgtgagccaccatgcccagcctacatgttttatataatgttatttgatataacaacttggaaaggacaaaattatagaaatggagaatagattagtggctgcaggggttaggaatggggaggtggtgggaaggaggtatatgtttattaaagggtaatgacagggaggcttatggtgatggaactcttcgtatgttgactatggtgacagataggaaaacctacacgcgtgacaaaactgcacagaactaaatacacacaaatgaagtaaaagtggggaagtctaaatcagattggtggactgtatcaatgttaacattctggctgtgatattacacaatagttttggaagatgttaccatgggataactgtagaaagggtatatgtgatctgtctattatttcttatgactgcaggtgaatctacaattatctcataagaaaaagtaagaagaggccaggggtggtggctcacacctataatcccagcactttgggaggccgaggcaagcagatcacttgaggccaggagtttgagaccagcctgggcaacatggtgaaagcccatctctactaaaaatacaaaaattagccgggcatggtggcacactactcaggagctacacaagaggctgaggcaggagaatcgcttgaaccccggaggcggaggttgcagtgagctgagatcacaccactgccctccagcctgggtgggcaacaacagcaagactgcaagggaataatgttctgtttgggaaagagactgcatgtaaatagggggtctggtaggtgggcatggtggctaacacctataatcccagcaccttggaaagctgaggcaagaggatcacttgaacctaggagttcaagaccagcctgggcaatatagcgagattctgtatctataaaaaatgaaaaaattagccaggcatggtaatgcatgcctgtgatctcaactactcaagaggctgaggcaagaggatcaattgagcatccagaagttgaggctgcagtgagccatgatcatgccactgcactccagcctgggcaacagggcaagactgtatctctaaaaattaaaaaaaaataaaataataaatagaacatataaaagtaaataaaaattaaaaatagggatctggagctggtagggaagaaacagagctgtatgggagaaaagaatacttttccttgttgatatatggtctgtgtcccctttttctcctcttattttcttttgcattcttgctctgattgacttctttctcaagtgcctcttctctctgactttccctgtgtcattattttcctcaactcattattttccctctttgctttgctaaaagactctatccctgcatcttattcagagcacactgactgcactggacaggagttacaagagggaagaggtactcatagaatcctggatttctaaaacacttaagctacaaaggttggtgaatatcagagtccaatagtcacatattacacagaggaaaactgaagtgctgagaaaggaaataacttgtgtcactcacagagggaatttttggtaaagttggaatataagcctgggatccactagaacagcttccctaattttcttttcttttttttttagacaggttctcactctgtcacccaggctggagtttggtggcatgatcaaaactcactgtggtcttgacgtcctgggctcaagtgatcctcctgccttagcctcccaagtagctaggaatgcaggagtgtgccaccatgcctggctaatttttttgtattttaagtttgtagagatggggtctggatatattgcccatgctggtctcaaactcctggacacaagtgatcctcctaccttgtgctcccaaagtgctggaattagaggcgtgagccactacgcctagccctagtttctataattttcaacagacggagctcactagttggagaaaaagagattcctgggggcagccaattaaaacatagagaaattagagcaacatggtgagagaaataatctgatcaggtgcagtggttcgcgcctgtaatcccaacactttgggaggtcaaggcaggaggatcacttaagccttggagtttgagaccagcctgggcaatatggcaaaaccccatctctacaaaaaataaaaaattagctgagcatggtggcgcatgcctgtagtcccagctactcaggagtctgaggtaggaggatcgtttgagcctaggaattcgaggctacaatgagccatgattgtgccactgcatttcagcctgggtgacagagcaagagactttgtctcaaaaatagaaaagaaaagaaagaaaaagaaaaggaaggaaggaaggagggaaaagaaaaaagaaaaaaaaaagaaggaaagaaagagggcagccaggcgtagtggctcacgcctgtaatcctaggactttcgaggtgggcagatcacctaaaatcaggagtttgagagcagcctcgttaacatggtgaaacctcatctttactaaaaatacaaaaaattagccgggcatggtggcacactcctgtagccccagctactagggaggctgaggcaggagaatcgcttgaaccaaggaggcagaggttgcagtgagctgagattctgccattgcactccagcctgggcaacaagcacaaaactgtgtctcaaaaaaaaaaaaaagagagagagagaaagaaagaagaaaaagatgcagagaggggaagaggaaagaaggaagggaaggaaggaaggaaggatatagttattaagtagttatgagccagaattataaactagccagatggttttgtgataggatttgggtagaatgaaaatctcaagaggttaaattcctaagaggcaactcttctctcttactaactatggattattttaaatgcaccagatacccctcctcaagatgtaatattataccataaatgttatggggagaaactgcccaaatgaacagaccagcgctcacactgagaacaggaatagggagtagcctattttgagcctacctttttaaaaaacacttgcattttgggaaaatataaaaaaaaatgtccaacagggttgtcctgttggtaccaaaaaccttcagaaatttcagagtataggatgttggtaagaagcaccaaagcagaaagtacctctttctgcatgcgagaaaccatcatttatctgagagtgatgttccctaacacaagaaagggtctctgttaagcaagtgaggggtggaaggagctgttgccagagcccgccagaagcatcctggtaaccaactgctggtccaaacatttcctacttacatggaacagtggaaagtgccaacagagttctcccgacgaatgtcttcatattcctcatagattccctgcttttgcctgggcaaaatagtccatcaaccaaagtttaggttttctgatcttcttcccattcttacccagctggtggagtctacagcctatttcaggtttgacctcagtagctagaggaaaagtggttaaacaaaataaagaagttagaagctgatttacctttaaaaataacaaacttaagttcttgtctacagtaagttttatggatcaaaaactattctgacttcttatctcaacagatatcctacacatatctcacatcagcatatatatatgccttttagaaaattctgttattaaaactcgaaggaaaaatgagatcatgaataaactgaacatttttaaaaaattatctttcataacttttcaatctaatatctgtgtattataatcatttattgtttcatgtactaattcatctatgtatttaccaatcaataaatataatctgatatgcactatgataaatgaggtcaaaaaaaaaggagataccctgatccacacaggatataaagatgaagggctgggtgcgttggctcacgcctgtaattccagcactttgggaggctgaggtgggcagaccacctgagctcaggagttcaagaccagccaggcaaacatggcaaaaacctgtctctactaaaaatacaaaaaattagctggccgtggtggcagatgcctgtaattccagctactcaggaggctgagcctgaggcacgagaattgcctgaactcaggtggtggaggttgcagtgagatcgtgcactccagcctgggtgacagagtgaaattctgtctcaaaaaaaaacaaaagtgctgtattgaggactgagacctgagatagtgagagacagggatgtacaacttgagtcatactgtggactgacaggatgggaatagctaagggactgtctgaggtggggatgcctgtctggttcacttgttactgccttgtttatgtgacttagatagtacttagcttccgctgttgatactcagtgggagatacacctaaaccacacagacagcattattctgaaaaggagaagttgccagggagtgtggaccagtagtctccgtggccctgtactctccaagcagaagtgtagacttcttcttccctgtgactagccttcaggtgtaatttccagtacatagttccttataaattctatagctcaggagaataaataagaggctccttttccagaaaatccagtattggttttcctcctttggaggcgtagagtcagaactctcatggcatggcaggatccatggaggtggccacatctcccttttttcagtgagtattagatcccacaagacaaccgcacagctaaacataattaaaacttaggttttatgatatttgttcctttcctaaaaccttcagtgactccttattatccatagggaacatataagctaaataaatgtgaacttttttctccaagcaaaacattctccccagtgaatagaaaatcttgttttcctgtgttaccttgaaccaaaattttttttttttttttttttttgaggcaaagtcttgctctgtcgcccaggctggagtgcagtggtggcgcgatctcatctcactgcaacctccacctcccgggttcaagtgattctcctgcctcagcctcccgagtagctgggattacaggcgcctgccaccacaccttgctaatttttgtatttttagtagacatgaggttttgccaggttggccaggctggtctcaaactccggacctgaagggatccatctgcctaccttggcctctcaaagtgctgggattacaggcatgagccaccgcacttggactcctttaaaattattattattattgagacagagtttcgtgctgttgcccaggcaggagtgtggcactaccttgattatagacgcaagtcactgggccttgggattatagacgcgagtcactgggcccagctttctttccagttttaaagtattatttttaattatccaaactaaatgtgtagtaaatactcttcttataaatctttgttttcttgattgcttccttagcatataatttcagaaatagaactgatcaaagggtatgcacatttttaaggatttataatgccagatgccttccaaaagatgttaacaacttattgaactgacagtatataagggtgctatagagtaatttatttatttgaaaaacaaatctttattgtgtagaaatatgtattttaaaaatcccccagaaaagatgctcttctctcatttccccatcctcttccttttcttccacacctctgatatgaaggacattattataccttattaaaacttcatccacactaggcatggtggctcatgcctgtaatcctggcattttgggaggccaaggcaggcagatcacttgaggtcaggagtttgagaccagcctggccaacatggtgaaatcctgtctctactaaaaatacaacaattagccaggtgtggtggctgacgcttgtaatcccagctacttgggaggccaaggcacgagaatcacttgaacctggaggttgcagtgagctgagatcgcaccactgcactccagcctgggtgatagagcgagactctgtctaaaaataagataaaataaaataaaatgaaaacttcatccagatgtctagacaacactttaactatgtattcttctgtatttgcaagttacatgttcatatagccatctacagataccagttagcctttgtaatccattccccacttaagtttcaccatctactggcttttctgttaatcccttgaggaaaggtttggaattgaggagtaaatcctttataaggagaatgctgcagtctattcgctattcaccgctgaccaagctgccacctggccctcctgactgcagcaggcacccccagacagtcatgtaaatggactaggcctgagtctgtagttctttgctctgaaaaaggagacgtaatggcttctactttttatcatttggtggaaataatagaggagtttttctagaatgttttttgatctggtggttaaagggaacttggacatttagtccctgaaataaattgttgcatctttgaaggaaaagatgaaagtagtttcttacactttagtgaagaagcctttggaaaattttgttctggatgttgtatattctctgtagaggagtgttggggattccccacatcagcagaactaaagggtaactgaagagaacagggagtgacatgtcagattgagaatcagtcttttgaaagtggcaaaaagaatatgtgttaaaagaaaaaatagggtagaagataaaaagaatagggcagaagatattagcttcaattcctccttttttttttttttttttgatcctttggaatgatttcttcctagactgccagtgttgcgtagtaaccccgcccatgaagaggactggaatactgaaaaactgcatgaaactaagcgctgtgggttgggcggggtggctcacgcctgtaattccacactttgggaggccaagttggctggattgcttgagctcaggagcttgagaccagcctaggtaacatgatgaaaccccatctttacaaaagatacaaaaattagctgggtgtggtggcatgaagctgtagtcccagctactcaggaggctgaggtgggaggatcacttgagcctgggaggtagaggctgcagtgagccgtgattgtcccactgcacttccgcctgggcaacagagcgagatcctgtcccaaaaacaaaaaaactaagcactgtggattagaaattaataatttttcatctttatatctttttttttttttttgagacagtcttgctctgtctcccaggctggagtgcagtggcacgatctcggctcacttaggcaaggtgtttaattaatctctgaaaagtggagaatttagcaccaggcatggtgactggtgcctgtaatcctagctacttgagaggatgaggtggaagtgttaaaggtggagggtgtccaggttcttggtgtcttgaaaaaagaattggacaaaatgcacaaacaaagcaaggaagggacaaggaatttactgaacatgaaagtacactccagtgtgggagcgggcctgagcttagaagttcagtggctccgttacagaattttggggagtttaaataaccccagaggattccatggttacttcgggtatgccttatgtaaatagagaagatgaagtaaagttacaaagacatttatggcctatgccctatggacagaatattacctgttatagctgaagtgtgaattggccttatgttccctacctccagaccctattttcctgcctcaggaggattacttgagcctaggagttcaagtccagtctggacatcaatagtgagacccctgcctctgaaaaaaaatttttttgagacagagttttgctcttgttgcccaggctggagtgcaatgggatgatctcagctcactgtaacttccacctcctggattcaagcaattctcctgcctcagcttccctagtagctgggattacaggagccggccaccacgcccggataattttttgtatttttagtagagacagggttacaccatgttggccaggctggtcttgaactcctgacctcaggtgatctgcccacctcagcctcacaaagtcctgggattacaggcgtgagccaccgagcccagcaaatttttgttttttagacggagtctccctctatcgcccaggctggagcacagaaatgcgatctcggctcactgcaacctctgccgcttgggttcaagtgattctcctgactcagcctcccgagtagctgcgattacaggcgggcaccaccatgcccgactaattttttgtatttttagtagagacggggtttcaccatgctggccaagctggaaaattttatttttaataaatgaaaggcagagtatttatctgaaaaaagtgggagaccaacagtctcatgggattgttataaagattaaaagagagagtgttactgaaatacttagaagagctgttattctattgctgtcctttccccttgtatttggatagattaccgtacttgtttcttctatgtaactctaattgtcagtggggttctccctctcttagaggcctggagaaacttgtcttaaatgctttcccagttaatgaattgggagaggcagattttatgtctaaattacaagggcgagacttaaaagtatgaattggggctaatgtcagtgctcaggtgcagggatcctccgttttgttcatcacacagctcccggcactttaataaatgaggctcaaagaaacgacgggcttaggtcatgcagtagtcaaattcagaactcatgtttgattccaaagcccacacgttttcctagtttagaaacactaaacatttaattcaccgcaccgggggccagacaggtaatggagaacgccttaagtatgttaggaagggaagttatctacagtcgcagccgctattcagatctatttcactgccttgcagaaaacgccgactgtcgtctctttatcccatggccgatttcttgtgaaatctcctaacttttaaatatttccaatcaaaagactgccgttcaaatgcagcccaccaggagcatgtttgcaaactctggagtaaacaagagtgggaagctgataaggtgagtacctcagttcgatagtgacagccaagaaacggggagttttgtacctaaggcgagaaagaaattctccgccgaaatctcccggaagaaggactgaattaaatgcagattagagtcagggcagggtaaggtggcgggagaactaggctgccatcccaggtggctggcctaccagccagcgcggccggaggtacagaccatgtacagaccacggcgaggggtgttaggggcttctcgggataaaggcagcgagtggctgcgcattccctccccgactctttcagaggtaagccttctgtggagcagaccctaatcctccccctgattccttaggtcactcggcgatttacttccttcccccgcttcctcacagtcctccacagccctacgacttccgcttgcctcgtcgtctgggaaaccgccgacttccggccgcgcagcggtgggctgagctaaaatggctgaggagagagtcgcgacggtgagcgccgagattctctttagttgcccggccgcagggcaaggcaagctggcgggtggcttttgtcccatgcagcggttcctggagagaggcggagctgggtgccgagcgtctcagggtgggcggggcgacacggtcccctttttactgtcccgggaactggtcgcctggggcaagtctggatacttagcagcacaggtcctgttctaggactgtagtccctcttggggtgcgctggacggagaagggagacttttcaccagtaatggctcttaccgtagtgccatctttttctgtctcgggggtttggaaggtaatgactagcacttgtgtagacagttcctgttaatcccgtgaattgggaatttaacatgcctggaagcttgcagcgtcactgccttctgccagtggagcgggactgtgttttttctgtggtgattaagtttaggaaagtacggttttggaattcatctgaaggctgagttgggcgttcactccacagaactgctaatatagaggaacccgatgaattcaggatgacctagtcgctattttttgaggcatatatctataattggatctaatttcggtaaagtgccaagtgtgaagctttgtttaccttgctttagtgttgggtttgaaagcctgttctgtccatttgttagaatgattttaggtattcggaatttattgtctttcgaaaaacgccctggaaaacagtacaaatagcagcctttggctgttttacaacttagttttggctaagcagcaaggttagtgttattgttagagggccttttgtttgttttctactctcatttgcagagtagtcatattattctagtctaattagaaaactctgaagacagaaacttttttttttgagacggagtgtcgctgttgtcggcccgggctggagtgcaatggcgcgatctcggctcactgcaacctccgcctcccaggttccagcaattctcctgcctcagcctccggattagctgagaatacaggcgcctgccaccacgcccggccgaaacatttttattaagctaagaaatttaaaatagctaggccggacgcggtgcatcacgcctgtaatcccagcactttgggaggccgagacgggtggatcacttgaggtcatgagtttgagaccatcctggccaacatggtgaaaccccgtctctactaaaaatacaaaaattagcggggcatcgtggcgctcgcctgtaatcccaggtacctggaaggctgaggcaggagaatcgcttgaaccccggaggcggaggttgcagtgagccgagatcatgccattgcactccagcatgagcgacagagacagactccttctcaaaaaaaaagaaagaaaaaacagattttaaaataattaaataggccaggctcagtggctcacgcctgtaatcctagcaccttgggaggctgaggtgggtggatcgcctgaggtcaggagttcgagaccagcctggccaacgtagtgaaaccctgtccctactaaaaaaatacaaaaaattagctggacgtggtggcgggcgctggtaatcccagctactagggaggctgaggcaggagaatcgcttagaacccaggaggcagaggttgcagtgagccgagatcgtgccatttcactgcagcctgggcatccagagcaaaactccgtctcagaaaaaaaaaaaaagtaaatagcatggttaatgttactgggttttaaatattaaaaacataggaaagaaaatacttccactccagcctgggtgacagagcaagactccgtctcaaaaaaaaaaaaaaaaaaaaaaagaaaatacttctaagtaatcttaaagtgtaaaagataatgggtaacataacattgctacaaatatagcttatcctctagtgctcatcacaagtgtttgtgtaatagaatatgaacttgagtctgtgacggcagaattgtcatgtacatttgaatgtctaatactgttttaaagagaatagcttttgtttcgatatgacttagcaattaagcctgaagttaactgttttcattgttgtcaaatttattgctagtagtgttacgtttatagtaattttcatcttttcaagttaccaatgcatggaaatgtgaatttctgtccttttaggaagtggtattttatcttttttttttttttttttttgagacggagtctcactttgtcgccctgtctggagtgcagtggcgtgatctcagctcagtggaacctctgcctcccgggttcaagtgatttttctgcctcagcctcccgagtagctggggttacaggccctcaccaccatgcctggcttatttttgtggagatggggtttcaccacgttggccaggctggtcttgaactcctgaccttgtgatctgcacgcctcggtctcccaaagtgttgggattacaggcgtgagccatggccccctgccttattttttaatacaattaaaagaacccagtaatcctactcctagacctgtgtcccacagaaaaaagtgttaaacatgagcgtgtagtactagggcattcgttgtagtactatccgtagtggcaaaacgctggaagcaaattaaatgcccattaatagggtaattgatgacttcagatatttccatactgtggaatattatgcagtcattaaaaagaatgttacaactaattgcttttcctctcagaagcccctctctctcactagagaaagctgttctcctttctttcttctgcctattaaacctccattcctaaactcagaaagaaaaaaaaaaaaagagaatgttacgactaattgacttggagggacttccatggtgtacatttaaataaaaggtagatgtgaagtggggtatattatgtgatcttaatttcataacacaaaggaaaacatatagatccgtagataaggatatatggatatggaggagagaaaaggaaaagactcaaaactcacagaatttttgaagaaatgtatagctaaaaatctaagaaggctacagtcaaggccttgaggccagaagacaccccatcaaaactgagtaaaactagcccagtgtgggacgcagaaattctagtatgctaccaaaattacttacggattgctaccagttccttagaaggaaaactgaggactaatatttgtattttcagtatagtttagaattcttaaaaaatgagcaaacaggctgtacttggtggctcatgcctgtaatgccaggacttgtggaaactgaggtgagaggataacttgagtccagaggtttgagaccagtctgggcaacatgttggagccccatttctacaaaaaacacaaaaattagccagacgtggtggcacgcgcctgtcttcccagctactggggaggatcatctgagcctgggggaagttgaggctccagtgagccatgatcatgccactggactccagcaggggcagagtgagactttgtctgaaaaaaacaaaaaatgaatgagcaactaactctggctttcatgatttgtgcttataaatctttttatttatttatttatttatttatttatttatttatttatttattttgagacggagtcttgctctgtcgcccaggctggagcgcagtggcgcgatctcggctcactgcaacctccgcctcccgggttcacgccattctccagcctgagcctccggagtagctgggactacaggcgcctgccaccacgcccagctaattttttgtatttttagtagagacggggtttcaccgtgttagccaggatggtttcaatctcctgaccttgtgatccgcccgactcagcctcccaaagtgctgggattacaggcgagccactgtacccagcctataaattttttttataatgccctgattcccattatttgatgtatttggataaatatgtcatcctgtaaattgaaggattaaactgataagagcagaaaacagaaattagtacactagttgatctggctcagatatagtgcctatgtatcaggtgctccatgaatatttgttggatgaataaatgatcataaaactatataaaaatgaagaaataacagaataaaataatttgttctatataaatcctatgaatgagattgagtgggctaatagaatcctttccatctcaaaatgttctggaaagtcttgagtaaaagactcatcaaaaaaataattctgctttgtgcagaaagaagggttgctgacctttgaaggtgctttttgagtctttaacattctttagtagtatattccccaaagttaagaaattctagttagattttaaaaaattgagttaacatttaaaaaacagttttgttgaggtataatacacgtaccataaaatttactcaatttaagtacaaagtttgatcagttttagtaaatttatatagttgcacagctgtcatcagaggctgcttttaaaacatgtccatcactccagaagggttcctgtgtcaatggaattgctgggttatattgtttaagtatttgtttaaaaaaacagaaacaaatctgcctaacttctgcaggctatatacgagttaacatttccatgagcaatgcatgagggttgtgatttttccacatccctgtcaacacttggtttgtcagtttgtttttatttagctgttgtagtggatgggtagtgatggtgtatggtggttttaatttgtatttccttcatgaataatgatattgaagattttttatatgtttattttccacccgtatctctttggtgaaatgtctttataaatttttgtgaatttttaaatcaagatcattaaccaaatgagcccctcatttgggctcaagtgatccttccacctcaacctcccgagtagctgggaccacaggtgcaggccacgcttggctaatttttgtatattttgtagaggcggggttttgccatgttgcccaggctggtcttaaactcctgaactcaagcaattggcctgcctcacataagtattctcttttattttgaggattaatttttgttgttgtgaaatatatcctacctgtaaaagagtgcttaaaatgtcgtatgtgtgctttaaaggataatataatggaaacttgtgttcctactgcccaggttaggaaatgggttattaataactttgaaacctcctaaatgcctctctcctactgcattttccttcctccacatcagatgtagtgtttcttcaattttatattaatattttgtactttttatagttttaccatatatgtttatatatatccttaatatattagtttttaaaatttgttattaaccttcagtttattcattatttcaacactgtatagtatcttattgtagtaaagtatgtcaattaacttatccattccactagatggagatcgggattatttctggtttttagttattaaaaacaatgctgctgctgggtgcagtggcttacgcctgtaatcctagcactttgggaggccgaggctgcggatcatgaggtcaagagatcgagatcatcctggccaacatggtgcaactccgtctctactaaaaatacaaaaattagcaggatgcggtgctgcgcgcctgtagtccctgctactcgggaggctgaggcgggagaatcacttgaacccaggaggcggaggttgcagtgagccgagattgtgccactgcacttcagcttggcagagcgagacttcgtctcaaaaaaaaaaaaaaaaaaagctgctataaatatggccaagactaaggaaaggtaagtgaggtgcttagggttcacattttatggagtaagagtaagtaccttcttaaggtttataccctaggttcttcacatgcctcactttagtcctagccctgagcattattatgtaggtcttctgatgcaatatctaagagtttctctaaggtatacctagaaatagattgctaggtaatggagtaactttattacttacaggaaactatatggtggttgtaacaatttatgcttctgccaccagtcatggtggatatgaaattatgtcttaatgtgataatttacattgcaatttttttttttttttttttttttttttttgagacagagtcttgctctgtcacccaggctggagtgcagtggcgtgatcttggctcactgcaacctctgcctcctgggctcaagtgatccttccacctcagcctcccgagtagctgagaccacaggcgcaggccacacttggctaatttttgtatattctgtagaggcggggtttcgtcatgttacccaggctggtcttaaactcctgaactcaagcaatcggcctgcctcagcctaccgaagtgctgggattagaggtgtgagccaccacacctggctgtttgtttgttttgagcctgttcctcaggctggagtgcagtggtccaatcatggcttgctgcaactccgcttcctgggcttaagagatcctcccacctcagccttctgagtagctaggactaagggcacctgccactatgcctggctaatttctaaagttttttttatagaggcagagtctcgctgttttgcccaagctgttctcaaatttctaggctcgtgtgatcctcctgcctcagcctcccaaagtgctgggattataggtgtgagccaccacacctggctgatctatctgtcttaaactggagaattgcatttttttctacctcctttcttttttttaaaaaaactgaatttccatctgttacccctccctttctgctcctcttatttcatgccttggaagttatactttgccttcctttaatgagtaccaaagaaattaaaaaatacatgtttactgtaagtccaggcctaaatgttgctactacagggaccatcaaatgctttactaccatctattgccatctgcaaatgtatgccattgttgtttagttttgtagttcttaatgtattttaattaaacaccacaaattatgctttttgtttgttttattcagtcagtagatgcttagaatacttgcttattttaccaattcctttgcttattccactcctttgttctgggattatttttctttttcctaatatattttcattaaaagtttatttggtgagaatctaaaaactctcaaattctgaaagttttaaaaatttgcctttgttgttgaaaattagttttgatgggtgagagaatctagatcaggtgttagcaaacctttttttgtaaagggccagatagtaaatattgtgggctttgtgggccatagagtctctctgacaactactcagcaatgctgttgtaggacaaaagcaaccatagacattatgtaaacatgagtgtgggtatgttctcacaaattttgtttatagacactgaaatttgactcaattttcatgtgttaaaaattattattttttgaatttttttaaccatataaaaatgtaaaaatcattcgtagcttgtagaccaaataaacaggatggatttgacctgtgggccatagtttgctgacctctggtctaaattaacattcattttacttagtacctgacactggagtaattattcttatgatgtcttattgtgatattgtcttccatttttaattgttgaagagccagctgtcagtcttttttgtttttctttttcttcttcttttttttttgaaatggagttttgctcttatcgcccaagctggagtgcagtggtgtgatcttggcccactgcaacctctgccttctgggttcaagcgattttcctgcctcagcctcccaagtagctgggattacaggtgcctgccaccacacccagctaatttttgtatttttagtagagatggggcttcaccatgttggccaggctggtgttgaactcctaacctcaggtgatccacctgccttggcctcccaaagtgctgcaattacaggcatgaggcacggcgtctggcctttctttcctttttttttttttttgagacgtagtcttgctctgttgcccaggccggggggcgatggtacgatcttggctcattgcaacctctgcttcccaagttcaagccattctcctgcctcagcctcccaagtagctgggactataggcacgtgccaccatgccgagctaatttttgtatatttagtagagacggggtttcaccatgttgtccaggctggtcttgaactcctgacctcaagtgatcctctcgccttggcctctcaaataactgtcctttctttgttggtaatctggtgatatgttttcttgtttggctgcttttaagagctgcttcttgtctctggtgcagttcgctatgatgtatctaagtatgtatttattttcatttaacctggtcaggatttgttgagtatccagaaactaaggattggtgtttctcattacatctggaaaaatttgagccattatttttgcttatattgtggtatgtcataggaagttgagaaaagaaaaattcatttgatggttttctatgaggttatagtggaaaataactatctcccttttagaattgagtgctagacagtttctgtgtagatgatctcataagcttccttttatcaaacagcgatcacttttttggtttggctgctgagaagtatggcatcaagtataatactcatatgaggtgtttaagaactgagtatatttcttatgcacattttactatatactataattatacattaaaaatgcacattgtaaatattataaatatgtgttatacattgttaatagtttggatagcaaaagtatgacttgacatttgttttttaaaccatatttaaagtaactctatcacaatatggatttaatggattaattgcataattggtgagctactgattattcttgttatttggatgcttctttaagttagcaagtttatattgtggtgcttcaatatagactacttatttcatttcagagaactcaatttcctgtatctactgagtctcaaaaaccccggcagaaaaaaggtctgtatgcagtttcatggtatgtgtatgtttgcacagacagatttctcttttatttatttatttatttttttttttggaggcagagtctcactgtcacccaggctggagtgcagtagcacaatcttggctcactgcaacctttgcctctggggctcaagcaattctcctgcctcagcctcccgagtagctgggattacaggtgcacgccaccacacctggctaacttttgtgttttagtagagatgaggtttcactgtgtttgccaggctggtctcgaactcctgacctcaggtgatctgcccaccttggcctcccaaagtgttgggattacaggcgtgagccgccacgcctggccagatttctctctcttgttgattcttttatctattctatattatttcaaaatgagtgttgggaaaagaagtaatagtctaaatgttctgtcacatctagcttttatttaatagagttattagatattaggaggttggtttgacctggaaattatttaaatggggtttgattattatgtaagtgtgtactaattttctgcttctggaaaaaccactttgtgaagttccaggtatctttttgctttgttggtttctagtttaattctattgtgggtagagaacattctttatatggtttgttttatggcccacaatgtggcctgtgttggtgcatgtcccatgtacacttggaaataatgtgtattctgctcttgtaggatgtagcattctgtaaatgtcaattaggtcaagttggttgatagtgttctgtatatacttacaattacagatattcatattcttactgatgtagttactgattggaagggtgatagaagagtgttgaagtgtgcaaatgtaattgtggatttgtttctactttcagttctatcaatttttgatttgtgtattttgaagatctgttgttggatgcatatacatttaggattgtctgatttcttggtaaattgacccgtttgtctttatataatattcctcttcaatttctgataatattccttgtttgaagtctactttgcctgataatattttagttttagttatttatttagctattttagttttgctttggccagtctttgaatggtatcaacatataattttcgtagagtaaaattccctttttttagtacaaattctgagtttcgacaaatgaaactagccatgtaaccactagtagcaccataatcaagttataaaagtttaattactcccccaaaagtcacctttactttgtagtaaaccacttcttccattcccaattgcgggcagccattaatctgtttctttcttcctagttttgcctttcttggaatgccaaataaatggaatcatacattattattattttgagagagagggtctcgctctgtcacccaagctagagtgcagtggtgtgattatagctcactgcaacctgaaactcctgggttcaaatggttttccccagtagctgggtctacaggtgcatgccgccatgcctggctaatttttatgtattttttttgtagaaatgggggtctggctctgttgcccaggctggttttgaactcctggcttcaagtgatactccatcttcggcctcctgaagtactggcattacaggcatgagctattgcacctgggttatgtaaatttttcagtggcttttaaacctcatataatgtttgtttgttggtttgtttttgaggcggaggctcgctctgtcacccaggctggagtgcagtggtgcagtctcagctcactgcaacctccacctcctgggttcaagtgattctgctgtctcagcctcccaagtagctgggattatcggcatgaaccaccatgcctggctaatttttttatttttagtacagatggggtttcaccacgttggccaggctggtcttgaactcctgacctcaagtgatccacctgctttggccccccaaagtactgggattacaggcatgagccactgcatccagcccaatatagggaggtattaagaaaagagaagaactatcatccttaagtattaacgggactttaacaaattaaaaaagtagtactttgaataaaaagctgtcacattttactgtgaaatccttagactttttttatacctctagttcaggttttttcagctttggcatgaatgatattttgagcaagataaatctttgttggagttgtcctgtatattgtaggatggttaacaacatccctggcttctacctggtagatgacagtagcacttaattgtaacaaccaaaagtgtctccagatgttgccagttattccttctggggcaaaattgttcccacttgagaaccactgctctggttaagtagtgtaatacttggaaatagaaggcagaaagttggtaagtgcataaagaattcacacagaagttggattagcaagctgagagacgttatttgaacaagtagcaattggaggcattttgactgagaatggatgttgtgcctctccctcactctttcctcctcagcttgagaggtccatattctctcaaagtttgactctttagttttgagggtgatgactgccaactgtggaagggataaacagatttctgtttggtatttttgtccaaatatatcaggactttttcaagaacaggcaatgaaattattgatcagaactacttggtggttctgagaaaataatatgctacatgaggctactgaagtcctcttccttttgccccatgatgtaaccttaggtgactttcttctggctttcagttgaagatcttacccatcattgaggtgagcgaactgatttactgcttgagtctattttcttccttaaaggagtcttcattgaaaactttacccattttggggtggccatagctgaggatgagttttgtccacaacctgagacaacatactcactatgtaaaaaacctgatctcagcttgatatctggttttagactaattgtttaatagaataatttattattgtaaaatatatataaaatttaccatttttaagtgtgtaagtcagtggcattaagtacatttacaaagttgtgcagccatcaccactgtccatttctagaagtgtttcatcattccaaacagaaacactgtacccattaaacaataaatctccacatccccttgcctccccagatcctggtaatctccattctattttctgtatctatgaatttgactattctaggtttttcatgtaaggtgaatcatacaatatttgcccttttctgcctggcttattccactcagcattttcaagattcattcatgttgtagcatgtgtcagaatttcattcctttttaaggctgaataatattctagtgtatgtatatatcacattttgtttatctgtctgttgatgggcatttgggttgttttccttagagtctttatatgtcagtaattcttaaagaatttaaaagttgtagaaactaggaattttgtagatattctagaaatatgtcatttcctgtactgtatataataatttattctacagactaattactgtgtatatatttggttctcagacgtgattttgattttgtagatgctgtacatgctcttcacttcattaatcttttccttttgctaattttggttcttgtgtatacagaattatagagttacaaggtaatttagttgttacctaattcaccctaaagtctacatgaaaccactgtcacagtctttgataagtagttaccaaatctcactatttctactgtgatagtgaatgactttcattgattagctttctgaaagaatagtttatcttacttgtcttggtatcctcacctctgagtctatttgtctattgtaatctggcttttgctccaccgctccactgattaaatggatgagctaagcatttttttttttttccactgcaacctctgcctcccgggttcaagtgattctcttgcctcagcttcccgtgtagctggtattacaggtgcccaccaccatgcctggctaattttttgtctttttagtagaaacggggtttcactatgttggccagactggtatcgagctcctgacttcatgatccaccccaaagcctcccaaagttctgggattacaggtgtgagccaccgtgcttggcccaattctgtttaatttttgaggaacaatgttaacttctaatttaaatggaaggtagtatatatctaatttttccctattatttttaatttcaatgctagtaaatctttaaatctgaaatacacactcttgaattttgacagatatgtatactcatgtacatatttatattcctgtaatcatcagatcaaattaaacatttttatcacttagaaagtttcctcatgcctttttccagtaagtcttctgcttcacttcgccagatgcaaccaccattctgatttctgcctgtataaattgattttgaactttcctataataagttgtgcttgaacttcacacaaagggagccatacagtatctactatttagcttttggcagctttcatacaacatgttgttttggagattcatccgtgttgttatatgtatcagtagttcttttatttaaaaaatgctgtttagtattcagttgcatgaatataccaccgtttgtccattctcctgttaatgagtatttgcaatgtttccagtttttgagtactgtgaaagtttctatgaacatttatttatttagagatggagtctcgctttattgcccaggctggagtgcagtggtgcgatctcagctcactgtaacctccgcctcctgggttcaatcgattcttcagcttcagcctcctgagtagctgggactataggtgtgtgccaccatgcccggctaatttttctatttttagtagagacgggatttcaccatattagccaggctggtcttgaattccttacctcatgatccgcccgcctcagcctcccatagtgctgggattacaggcatgagccactgcacccggcctgaacatttatttactggttttttttgtgtgtgcatgtgtgtgcaagttttcacttgaataagtgcctagggagtggaattgcttggtcatatgtgaactgtttgttttaactttataataaactgccgaagtattttccaaagtggttgtacagttttacccgaccgccagcaacgtgtgaggattctgtttggctacattcttgccaacatttgttactatcagtctttttcatattagacttgctggtgggtatattgtgttttattgtgattttaatttgcattacactaatgactagtgatgttgaacaccttttcatatacttattggtcatatcttttgtgtagtgtctgctcaagttttttgcctatttttaaatttcttttttccttattattgatttgtgagacttcttaatatattctgaatgtacgtcctttgtctgttatatatgtggtaagtatttccccccagcctgtgttttactactttcattttattaaggtatcttttgatgatcaaaagttttaattttgatgaaggccaatttactattatttttcttttgttattaatgccttctctgtcttgtctaggaaatcttgatccttaccccagactgagttgtgtgtcctctcccttttctgcattaatattgcagaaattaattttttggttttagaaaatgtctaatttggctcaatcagtaatttttgatatctttctattgaaatatatatacagaaaagtacatacataaatcataattgtactgtgcagtgaatttttacaaagtaaacatatccatgtaatcaccatctagattaaggtatagaatattatcagtgccctccaggccgcctccttattccctaccagtcattaaccacccctcccaaaggtagtaacttgtatttaacttctatcttctacatcagttttgcctgcttttgaatttaatgtaaatggaatcatgcagtgtgtactttttaatatctaacttcgttgctcagaattatgtttgtgagattcatttatgttgttgcatgtagtagtggttggttgttttcttccttgttatatatattccattgtggggctctacctaagtctattcattttatacttgatgaacatttgggatatttttattgtgatgtattatgaataatgccaccatgaagagtcttgtacatgttttttggtacacatacatacttaggagtaggattttcagggtcaccaggaaggatatatttaggctcagtgaatactagcaagcaatttttaaaatgcggtcaatataatccccatgtgtaaaataaaggtgtacaaacgcacacacacacacttgctcatatgcttatatgtgcatagaaattccttgaaaatactcaagaaatgcttcacctctggtaagggataggaatggaatgggtcttttgtttagtatcctatgtgccctttgaattttgttttactgtaagtatgtatttttaagaaaaccaactagttatttttaaaaatcatttgaaagtcttcctactttgatatatgaaaaacactggttttaaaaaaaataatagaaaagctttaaaatcattattatttttttgagacggagtcttgctctgtcgccaggctggagtgcagtggtgcgatttccgctcaccacaacctttgcctcccggattcaagcaattctcctgcctcagcctcccaagtagctgggactacaggtgtgtgccaccaggcccagctaatttttttttttttttgtatttttaatagagatggggtttcaccatgttggccaggatggtctcaatctcttgacctcgtgatctgcctgcctcggcctcccaaagtgctgggattacaggcgtgagccactgtgcctggccgctttaaaatcattaatgttgcgttgctcagttatgtctaattgacagcccaaacatttacattgtaatattagaaaatcctttatgattgggcagaaacttggtttaatgtgtcaccttggagacctgggttatagtcctgcctcttccattaactacttgttgaatgtggacaatttacttaacctttagggccttaatttcctcctttataatgtgagaatgttctctgaattgcataactcactggccttacgtgactattcagtggaataataagagagaaaaactttgagatacatgcacacacacccttaagaaggatataattgttaaattttgctttgaggaaataaaataatctaagctataaagtaaaaccataattagctaatcttttatatgacttttttcttcctcatttcaagctaatgagaagcaaacaaactggatagcagcaatataattaaaaaattataggccagcttctagcatgtattcttgagtcaatactgactcagcccagtctcttcctcttccttcatcatcatttatgtacctgaacagagtagatgtttctcttgatcctgggcctgttcgccctcagatccattccttgccttctcttctctttttggtatagtgaggagctgactctttttttttttttttttttttttgagacggagtctcgctctgtcgcccaggctggagtgcagtggcgggatctcggctcactgcaagctccgccttccgggttcacgccattctcctgcctcagcctcccaagtagctgggactacaggcgcccgccactacgcccggctaattttttttgtatttttagtagagacggggtttcacctttttttagccgggatggtctcgatctcctgacctcgtgatccgcccgcctcggcctcccaaagtgctgggattacaggcgtgagccatcgcgcccggccgaggagctgactcttgcagcctccttttcttcccaggcttccgtgtcagcagtttctggctggattagcaagtggaggaactggcaggagattagaaggcaagaggaaagagaagacagggcttccctccccgaccttcaggcctcagagtcgtagtggttttttgctcatgcagacttctgatttgtctcaccattccctgttgggcctctcatttcttccattgcctgttctctgcattaaagtccttgtgtttcaaatcctcaagtggctttttgttaggctttgactgatacagggctcaaaatgatagtaatgaaaatgtcttacatttatattcttttcaagatttgttatctcttttgataccccaaatatcctattgaggtagaaaagtgttataattcctgtttggcatgaggaaattaacatttattgaatgactattttcagattctttggattttcgggtgaaaattttaggggggataaatggaggcccagagaagtgaaataacttgccctaggccccatagaaggctggtattgaatcaagattgaaattctgcatgtgaaaacttttacgtgctacatgtctgctagtcctggaagaaatcctttctttgatgagtattttttttaaaggctttacttgcaatatatttacaaaagccttagttatttagtaaatttttcaatgaaaaatctgaaccataataattttctgcttagtacttatatagctagcatactatccctagcattaatcaaagtgtcatgtaaaggtttgatttttgagcctaagcagaatttgaaattcttctaagagaatttagcacctagggcaaactacaggggagaattcttgaggtgtcatgtttattcacttctggaattgtttaaaatatgtcaggtgcatccttaaagggagaaagaagggggaagagatgttacaaaagagtagaatggggcaagagaagtggcaagggagtattgttgctaggttgccagccttctgcccccactgtcttggtgatggtggaggggtagtgtggcagctgggatatgaatgaggtcttttttataactcactaaaagccattaccttgtcttcatctcgtcagctggctacctgacctctgtggtaacataggctcctgaaatgtagcattggagatgatcactgtgctttattgcaaaataggggagactctgctctgcatttacatgcttatgttttgtggaggatctttcaactagtaattctcataatacctgtgaaagcatataagaaccagtatctccatttttagggggagttggagtgagcaatgatttggaataccagaaattcaacttatatatttacaggtaaaattctaattgtaaattcaggattcatagattctagggatttctgaggtatccagaattccttcatctttgatgataagtagataataatggtaataaaaataacagcaacaggcccagcacagtgacccacacctgtaatcccagcactttgggagactgaggcaggtggatcacttgaggtcaggagttcaagaccagcctggcggacatggcaaaaccccatttctactaaaaatgcaaaaattagctgagcatagtggcatgtgcctgtaatcccagctactcagtaggctgagtcataagaatcatttgaatctgggaggtggagattgcggtgagctaagatcgcgccactgcactccggcctttatgacagaactcgactccatctcaaaaaaacaaaacaaaacaaaacaaaacaaaaacaaaatgcaaaaaaacagcaacaataataggtaacatttctttaaggcctactatgtaccaggcactatttgaacctctttatatattaggtaatacgatacaactctatgagaatgagtattttatttcctgacccttctatttaaaagtaaaaccccccacccggcactgtttctctttcctgctttatttttctccatagaaaaatatcactcataagtgtaacatactttattatctgtcctgtgtggtagtagcccctgccctcaattataaactccatgaaatcagggagtcagttttgttcactgctgtattcccagtgcctagaacagtgcctggaatcatggtaggtacccagcgaatattggttgaatgaatgagtcttggttttacagatgaggaaactataaatttcccaggtcacacatttggtaataggacagttgtgtacactgaaatgttctctaaaatatttgatggaacgaaaattagcttttggacagctacatctccaagagtgtgaaatgaccttcagcactggatttggtggattttcctttttctaatccctagagttccatttaatgagcgtttgggttcttgagctaccttacaaattgaacacttttttctccagctttcactcaagaaacacaaaacatggcttgtcctttttttttttttttttttttttgagactgggtctcactctgtcacccaggttggagtgcagtgcacaatcatggttcattgcaacctctgcctcccaggctcaagcaatcctcctaactcagcctcctgagtagctgggactacaggcttgtgcctccactcctggctaatttttttgtattttttgtagagatggggtttgtccaggctggccttgaagtgctggactcaagtgatccgtccacctgggcctcccaaagtgctggggttacaggcgtaaaccactatagctagccctgattgtcttttattgtgagattttaataacagctaagacttgaaaattaacattttataaattttcttttagactacttagtgatatactaagtatctaaggtttgtaatacttagtataaactcaaaagggttcagtgcctcattctcttttactctttccctttagtagataggtgacagaggactgggtcatgcagttgagacttggtccaagatgacttagtaagctacttgtcccagaactatttatttatttacttatttttgagatggagtctcgctctgtcgcccaggctggagtgcagtggtgtgatcttggctcactgcaacccccgtctcctgggttcaagcgattcttttgcctcagcctcccgagtagctgggattataggtgcccgccaccactcccggctaattttttgtatttttagtagagacttggtttcattgtgttagccaggattgtttcgatctcctgacctcatgatccacctgcgtggacctcccaaaatgctaggattacaggcgtgagtcaccacccccggaccctggaactatttatgacggtgcactttatgcacttaacacactcacatgtctttaagcttggtgactcgtgtggctttttcgaaggagatttgattctggaagtggttaagtaggatgtgaatggctaaggtctggtcattggtgaagcctaggggaagaaaagaaaggaaacacaagtcttagaagaatttcagatcggccccaacgactagaagggtggttctactaagaaaatgtgtgtagtcagaaaatgaagagtcagttgcttaaaattttactttttttcttgttcctggcatgtaaagtcatatccatactttctgttataatttcttcttacaaattccattgataatccctattcttggatagcaatgagcagcattacttcttttttatttttttaaaaaaattaaattttttgttgaaatgagggtcctgctgtattgcccaggctggtatcaaatttctgggctcaactgatcctcctgcctcagcctcccaaagcgctgggattacagttgtgagccagtgtgtctggttgtaccttttaatttttgtgttcaggcaacattaactctgagtcacagtaagctttttttttcttcctgtcatattatggacatagaagttttttggttttctttagattgtttctccttaggttgcagaacatcaagaaatggattacagtcattttcctctcttccccatgctcttccctttcttttccttttttcttttctttttttttttttggagacagaatcttgctctttggccgaggctggagtacagtgtcatgatcttggctcactgtaacctccccgcaccaggttcaagtgattctggtgcccaagcctccctagtagctgggatgtcaggatgcgccaccacaccctgctaatttttgtatttttttgtagagatggggtttcaccatgttgtccaggctgacctcaaactcctggactcaaatgatctgccctcctcggtctcccaaagtgctgggattataggcatgagccaccacatctggcctcttttccatttttaaaaaggactgtctccaacatattaaaattcacaaaaaataatataaacacacatgtactcactggctaggcttaataaaaaacatttagtcatgtttactttaaagctttttatttttttgagaaataggcattaaagagttgaagtctcctttctgtcttttcataattctgttcttccctcttccttccttgagatcttcactattcttgggttaatttggatctttctactccttgttaccacagaaaagtaattcttaatgaatttgaccatattttaaacttctgatttcagtgggcaggtaactcattttatggtttctgtattgtgagccattttcaatgactcaactagatttttttcatcgttgacttctcatttctgggcaacagcataatgttctcatttgagctatttctaaagattgtgtttaactatttaaaatatttgtggtactctgatcatcagatgtgatttttttttttttttgagacggagtctcactctttcaccaggctggagtgcagtggcgcgatctcggctcactgtaacctccttctcccaggttcaagtgatgctcctgcctcagcctcccaagtagctgggactattggtgcgggttaccacacccggctaattttttgtatttttagtagagacagggtttcaccatgtttgctaggatggtctcgatcttctgacctcgtgatctgcctgccttggcctcccaaagtgctgggattacaggcgtgagccactgcacctggccagaagtgatattaactatcttatatgtatatttctgttgcgggaagtcaggggccccaaacggagggaccggctggagctgtggcagaggaacgtaaattgtgattatttcatggacacttaccagttcccaaataatattcttataatttcttacacctgtctttaatctcttaatcctgttatcttcgtaagctgaggatgtacctcacctcagggccactatgataattgtgttaactgtacaaattgattgtaaaacgtgtgtttgaacaatatgaaatcagtgcaccttgaacagaataacagcaattttagggaacaagggaagacaaccataaggtctgactgcctgtggggttgggcaaaatagagccatatttttcttctttgcagagagcctataaacggacatgcaagtagggaagatatcgctaaattcttttcctagcaaggaattttaataatactctggagaaggaatgcattccttggaggaggtctatagggcatgtctgtcttatgctgttgacataaggactgaaatacaccctggtctcctgcagtaccctcaggcttattagggtggggaaaaaaccccaccctggtaaatttgaggtcagatcagttttctgctctcaaaccctgttttctgttgtttaagatgtttatcaagacaatttgtgcaccgctgaacatagactcttatcagtaattttgcttttgccttttgccttgtgatctttgttggacccttatcaggagtttctgattttgcccttgtcctgtttcctcagaagcatgtgatctttgttctcctttttgccctttgaggcatgtgatctttgtgacctactcactgttcttaggccccctccccttttgaaatccttaataaacacttgcttattttgcagctcaggtgggcatcacggtcctaccgatatatgtgaggcccagctgtgaaattcctctcttcgtactcttatttcttagccggctgacgcttatagaaaatagaaagaacctacattgaaatattgggggcaggttcccctgatatatttccttagtgacattcctgcaatctcctttagaaagtctttctgttcaccttctataaccagggaaggagagattgagaagagacgaaggatgattttatgtttttcagtcccagtcattatttgatgagaaactgatattacaagctttaaaaactcaagatatgtattcaacatgtagtagtagaacaagtatcttagtttaatagtctataaatttttgatgcactataatatattattgtagtcagtagcatcaaaattttaatgtgatattgcagtatgtttatggttagtttagacatgaggacagtgctaaaggagaaaatctaatgactgtgttgtttgttttgtcaaaatatgctgcctagctccagagtttcctattttggagaagcagaactggttgattcatcttcattatatccggaaagattatgaagcctgcaaggtaagagattgccataataataaaaatgagaggcaggatgttgggtaggcaactaacagtgcctgctaaacagagtgtggcagtttatatctcagtgataaaacatgaattccttcttccccatacttcatacactggttatcttttgctatggtagtgatgtttaacatacaacctcaatatttcagtggcccccaacaaacaaatattaattgctcatgggctttcagatcagctgtgggttggctgggtttgactgcaggctgtgggtcaggtttaggtgtgttccatgtgtcttctcatgtcaagagcaaacaactctcttggacatgttggtcttctggtggaggcagatgttcaactcagcatattaacttttttatctttggatagatgaaaaatggtattttgtcgagtttttttttttttttttttttttttgagatggagtctcactgtcacctaggctggagtgcagtggcatgatcttggctcattgcagcctttgtctcccaggttcaagcaattcttctgcctcagcctccccagtagatgggactacagatgagtgtcaccatgcccagctaattttttgtatttttagtagagatggggtttcaccatattggccaggctggtctcgaactcctgaccttgtgatctgcccgccttggcctcccaaagtgctgggattacaggcgtgagccaccgtgcccagccctgagttttattttttaatttctctcttactgcaaggttgatcatcatgtgtatatttaaaaaccatttgtatttccctttctctgtatctttggtgacataccatatgtgttacaaacttgcaggcagacagtggtagtactaacatgcagaatgtatccttggtgtcatcttttttggtatccagagctttgtgacccatctaaggtttttaatttatacccatggcatttatacctatggcaatgcacagaactaattcatactggtatgacaaagattcataccagtttttttttttctttttttaagtggagttttgctcttattgcccaggctagagtgcagtggcgcaatctcggctcactgcaacccccgctttccagtttcaagcaattctcctgcctcagcctcccaagtcgctgggattacaggtgcccgccaccatgcccagctaatttttttttttttttttgtatttctagtagaggtggagtttcaccatgttggtcaggctggtctcaaactgctgacctcgtaatccacctgcctcagcctcccaaagtgctgggattacaggcgtgagccaccgcacccggcccataccagttttttttgacaccgctgatccgaaggcagataccagtatgaatctttttttttttgagatggagttttgctcttgtcgccaagggtggagtgcaatggcgtgacctcggctcaccacaacctccgcctcctgggttcaagcgattgtcctgcctcagcctcctgagtagctgggattacaggcatgtgccaccacgcctggctaattttttgtgtttttagtagagatggggtttttccatgttggtcaggctggtctcaaactcccgacctcaggtgatctgcccgcttcggccacccaaagtgctgggattacatgcgtgagccaccgcgcctggccaccagtatgaatcttgaaaggttctctttctttttcatctgtgataatacttggaaatcttatcacacttttcttagcttgcctagttagattttagacaggggttggcaaactttttctgtaatgggccaacaatattttagggtttgtaggccacatacagtctctacatcatatttgttatcttattttttataaccctttagaaataaaaaaaccactgttagcttgagagctgtacaaaaatatacagggcctgtaagccctgtagtttgcaaatccctgttctagaagaagtaatcacaacaagggagttgaaattttaagaaactgaatgaactaatactttactaggcattattaatactctaggtttttttacatatgattcttgtccacgtctgctttttcattactatttgttttcttttttttttcagacagagtctcactctgttgcccaggctggagtgcagtggcgctatcttggctcactgcaacctccgcctcctgggttcaagcgattctccttcctcagcctcctgagtagctgggattacagacacgcaccactactgcccggctaatttttgtatttttagtagagatggggtttcaccatattggttaggctgatcttgaactcctgacctcataatctgcctgccttggtctcccaaagttttgggattacaagcatgagccaccgcacctggcctgtccatgtccactttttcttaaagacacctgaagaaacttaaccactgctcagaagcatttttctccctctttcaggctgttatcaaagaacagcttcaagagactcagggattgtgtgaatatgctatctatgtccaaggtaagacacatacttcttgtcttcttgctagagaaatacacttttcctaggttcttgaaaaagatcaggcaattgaagaaacaagttcaagtacagtcatgcaccacttaacaatggagatatgttctaagaaatgtgttgttaggcaattttgtcattgtgtgaacattacatggagtgtacttacacaaacatagatggatgatatagtgtactatacacatgatatagtctgttgctcccaggctacaaacctgtatgagcaggtgttataccgaatactgtaggcagttgtaaaacagtggtaagtgtatctaaacatagaaaaggtactgtaaaaatatggtataaaagataaaaaatagtatacctgtatagagtacttaccatggatggactggaagttgctctgggtgagttagtggtgagtgaatgtgaaggtctaggacattattgtatactaatgtagactttatgttgtatactaatgtagactttataaacactgtacacttagcctacactaaatttatttaaaaatattttttctacaatgataaattaactttagcttactataactttttactttataaactttaaaactttttggctcttttggggtaatacttaaaacacacaacaacattgtacatttgtacaaaaatagtttctttaggtccttattctataagcttttttctttttctttcttttttttttttggtagagagacagagtctcactttgttgcccaggctggtcttgaactcctgggctcaagcagttctcctgcctcagcctctcaaagtgctgggattataggcatgagctacgacacctggccctttatgctattcttaaaactttttatttttttacttttaaacttttttgttaaaaactacgatacacacactactacagtggtggtactaacatgtggaatgtgtccttgctgtcttttttggcattcagagctttgtgacccatctaaggtctttgtgacacacacacacacacacacacacacacacacacacgcacacgcacgcacgcactggtctaggcctacactgagtcaagattataaatatcactgtcttccacctccttatggaaggtcttcagtggcaataacatacatggagctgtcatctcctataacaataggaataccttctggaatacctcctgaaggatctgcctgaggcagttattcttttttttagtaagtggaaggagtacactctaaaataaagattaaaatgtatagcgtagtaaatacataaaccagtaatgtagtcatttattatcaagtattaagttctatatatatgtaattgtatatgctgtacttctatgtgactggcagcacagtaggtttgtttataccagcatcactacagataggtaagtaatgcattgcactgttttgattgctatgacgtcactgggcaataggaatttttcctcttcattataatcttaagtgatcatcatcatttatacagctgtcgaccaaaatgtcattacaggtgcatgagtttaaatgttccagaaaggttttattcagtattaatctttttatggaatctgaatataattactgtgttggatttgacttcagaaatgactagtaatgttaaaaaattgctatgattacccattttttagtttctggctagtgttttttggaatggatgcttaggattcctgcctaatgcagtgatttcagggccaaaagatgcttttggaaggattgcttgtaatcaagctaaaagagatgaagaagagcttgaggatttctgtaaggtgaatcaggatgaggggaagaagcctggaaataaacaagataaagcagagcataaattcagctcattagaaaccaaagataaggaccactcacttactttttttttttttttttttttttgagacagagtcttgctctgttgcccaggctggagtgcagtggtgcgatcccagctcactgcaacctctgccttccaggttcaagcgatcctcctgcctcagcccccctattagctgggattacaggcacatgccaccatgtccagctagtttttgtatttttagtagagacaaggttttgccatattggccaggctggtctcgaactcctgacctcaggtgatccacctgccttggcctaccaaagtgctgggattacaggcatgaaccactgcacctggcccactgacttaaattttcctctttagtggcataagtagcattcttagtttttccaggaactttctttttgactcttgggtgtaaataaatggttttgtttaccattcattgcatttgtagtcttcagattaacatataattttctgacataattgttaagatattgacaaatttaggacatcatggcaaaaaatgctcttattcccagtgtcacaagtatcagactttcagtgcctgataaattcttctggaaacataggcctaggaaaaacctctggttctaattggttgttacactgacaactgaagtcttaaatgttactttatcctttgccagaatctccatgttgaatttgaggtattgattccatttgccccatttgggggttcgctctgaaaactatcagttggaagtaaattatgataaatgaagcatctgatggggaagccccaaaatgttgttaatgtgaagagtttgtgtgataatttgcaaaggaactgattatctatgtgatggatcctgggagtagagagagaagtaggtaggtttgagctaccttgctaaaagacagttgagcttgtcagcagttttggttgttgtttcagcctgtccaaagccatatctgattgttttaaggatacagttgtccaaaggatttacttgatgtggtttcccagttttctcttctccaatttttctgaccccaggctccattcttcccagaacatggttttacttttttttgtattttctgtttcttggcagcattgatatttcgcctagaaggaaatatccaagaatccctagaactcttccagacatgtgcagttcttagtcctcagagtgctgataacctcaagcaggtggccagatctttgtgagtattggcaacctggaggccctagggcactcacagagaacagtgtaaaatgcattcctaggtccagcctgctgctggcagctgcatcagcctgatacacaagtgggggaatggtttaataggtacagtgggattcactctgaagagcatggattaagtttgaaatttgagaaaatgagataactagtgttaaggaactaagcattttaaacactgtgcattctagtttgatgggggaccaatattgtttatcatgtaaatagagacaccttgtaccctaagtcttctaaacttattggcaatccttggaatttttctcatctactcttctaacacttagtatttgtcacacagtaagtttttagtaaggacagagagttcctgacttctgatggttcaacttacataatttttcaactttacaatgatgtaaaattgttatgtattcagtagaaactgtacttcaagtatccatacagccattccgtttttcattttcagtatagtattcagtaaattacatgagatattcagcattttattataaagttggcattgtgttagatggttttgcctaactgtcagcaaatgtagttaagaaagtggagataggaactccatggaacagagtaagtgttctgagcatgcttaagataggctaggctatctatgatgtctggtagagtagatgtattacatgcatttttgaattacagtgttttcaatttacaatgggtttactgggatgtaaccccatcataagttgaggagcatctctatttgttgagtgaatgtcctaaagattcctagatggaaagaatctcaagtgtttataaactactaggtactcccttttcagtcctttgttccatggagttcctatctcccctttcttagccacattgccattcatacctgtgttgtttttgcatagagcttggttttccctgtttctctctaaactcaggatccaatatcaaggaaagagacttagtcttggaaggaaaggatgtgtccctaatgggtgatgataaatgatggtagttactgcttaacatggtatatcattaggcttatttcttttttggtctgcatttatagtacattgtagaagaaaaattccacaagactctcactaaaattggtatagaatgagaccaaggccttggaacagctgccagtgcaatccctactaagagagcttctgctgttagtgtatagcagcttcactgaccaaaccagcacaaccacctcatagagaaaaggcttctagaattctctgctggatgaaatatgattaaaatgtgggactagtagggttagtcttctaagaattttgaggtaataattatggaaaatatatcttttacagatttcttttgggaaaacataaagctgccattgaagtatataatgaagcagctaaactcaaccagaaagattgggtaagtagagaactttcagttctttcttattagtaaacttgctaatggttccatttatcatctggctgtcttatttctgaattcttacattccaaaaatgtcttgattttaacctcatacttaattcatgatttgtataagtataggatcaaaaaccatgtttcctcataactttgcaggcattgctgcatgattttctagcagtttgctgacgagcagtctcttaccagtctgattcttgttgatgacccctagaagctttgggtat

SEQ ID NO: 45 - DNA, 188169 bp, Homo sapiens
gcttggaagtttgttgggaatgggcattacatagatgactacatgttctaggcatcaagcaccatattagaaatgatacgaaaaaaatagtagttttgaagcacatgaattagtttgtgggaaagagtaggtggaaaggagatcaggcagaggcaacagcagttacaaaggcaggacgcataagaaagtctagcaattatgcttttgtagaatatgccagtctagtgacttctatctttttttccctagctaggatttgaacctatctttttttataacttttttttttttttttgagatcgggacttgctatgttgctcaggctagtcttgaacaccttggttcaagcaaccctcctgtcacagcctctcaagtaactgggattacaggcacatggcaccatgaccaagaactcctttagcactaccatttgtgccagtcttcttggcttgtgacatctcttcaactgtgcacttatcattttttaaattaaccttttaatttatctccttccctaaattataatctctctttgtttctccagaatgccaagaaaggtgctttgcattgagtagacactaataagtaactattgattgcctgaccaaaaaaatcatggcttatgtactgtaagtcttcattaagaatgctaagattaagtcaggtgcagtggctcacgcctgtagtcccaacactttgggaggccaaggtggatcacctcaggtcaagagtttgagagcagcctggccaacatggtgaaaccctgtgtctactaaaaatacataaaattagtcgggcgtggtggtgggtgcctgtaatcccaactacttgagaggctgaggcaagagaattgcttgaacctgagaagtggaggttgcaatgagccgagattgcgcaattgcgctccagcctgggcgacagggcgagcctctgtctcaaacaacaacaacaacaacaaaaaaaagaatgctaagattatatttataagaataaagtagaacgttgtgaacagaagataacacgtctattcgctacgctacttttattacctatttccaggaggaacaaatactacatacagtcaatgtttatggctgtcaatctagaaagcagtaggattgacagcaattactcccttataaaaatacaaagacaaattttagaataagaataagatcttattataatcactgagaattaatatggaaaaaaactggacttgaactctgaaaacttggatctgaatcaaggttctgccacttgttgtgtactttggtaaattacttccacctttgagcttttttctcatctataaaatgaagttaagacttccaacttcacaggatcataaagaagaaattaaaaatgcatatgcagccgggggcggtggctcacacctgtaatcccagcactttgggaggccgaggcgggtggatcacgaggtcaggagatcaagaccatactaaacatacaaaaggtcacgaggtcaggagatcgagaccatactaaacatacaaaaaattagccgggtgtggtggcgggtgcctgtagttccagctactcgggaggctgaggcaggagaatggtgtgaacctgggaggcggagcttgcagtaagccaagatccgccactgcactccagcctgggcgacagagcaagtctcaaaaaaaaaaaaaaaaaaaatgcatatgcatctagtgtggcatctagtatagactcaataatatatttgctcactttttgcccattcatccatttaaatacatccataaagcaacaaaataaactagagatattgtgaactacagagaaatgtttgttttgcaaactttagctacaaaaatacttttccttcaagtccttaagtcattacgataaatatacgttcactttttggaaggtcatcatatgttactttttgttgtagtgtaagcacacatttaaggccaaataaatgtatattgcaatcatggggcacatagacactatggttttgtacatttgtccaattgtatgatagtatatactctagtttcagcattatcttttttttttcttttttgagatggagtcttgctctgtcgcccaggctggagtgcagtggcatgatctcggctcactgcaacctctgcctcctgggttcaagcaattctcctgcctcagcctcccgagtagctgggattacaggtgtctaccaccacgcccgactaattttttggtatttttagtagagacggggtttcaccattttggccaggctggtttcaaactcctgacctcaagtggtctgcccgctttggccacccaaagtgctaggattacaggcatgagccactgtgcctgccctctagttccagcattatcttatcacacattagataattacttgtataaaagctcaggctcaataataaagtctatagaccctgtacaataggcccctttgtatctgcagtttccacatccacagattcaaccaaccatggagtgaaaatattaaaaaaaaaaaaaaacataaaaagtaagaatacggcaattaaaaaaatcaaatgtaacaatacaatataaccaccatttacaaagcatttacattgcactaggggttacaagtaatctagagatgatttaaagtgcttgagaggatgtacgtaggttatatgcaaatagcatgccattttatataaggaacttgagcaaccatggattttcttatctgttggggtactggaaccaatctcctgcagatatcaagggacaactgtatttctagaataaaggtgaggtagcgaatatcttttatttttattattattttttgaaacagggccttgctctgtcacccaggctggagtacagtggcatgatcatagctcactgcagcctcaaattcctggaggatcaatggatcctcctaccttagcctcctgagtagctgggagtacatgcatgcaccaccatgcttggctcattttttcttttttttttttttgagatagggtcttgctatgttgcccaggttggccttgaactcctacgctcaagtgattctcccatcttggcctcccatagtgctaggattacaggcatgagccactgcactcagccctcgctaatttgcttattttttattcttttgtagaggcagggtgtcactatgttgcccaagctggtctaaaactcctagcctcacgtaattgtcccaccttggtcttccaaagtgctgggattacaggcatgagtcactgtaccaggatggggagatcgtaaagaaatggctgcagttaagaatcttgggttctacttttggttgtcactatctctaccagacgtctaatgtggcaggtaacttcagtttctctataccttattattattattaacacttagaactggtgtgatatgatctctcaataatgctgtaatacttcattggtatctatagcaaaatttgaaatacatagatgtttttacagaaatgcaaagtactcagcttatcagtgtctctttttgtgctttgataaaaatttaatttctttacctccttcctggtaaaacacaggaacacctaaaacattaaaaaacaaaaaacaggccaggtgtggtggctcacgcctgtaatctcagcactttgggaggctgaggcgggcggatcacaaggtcaggagatttagaccatcctggctacatggtgaaactctgtctctactaaaaatacaaaaaattagctgggcgtggtggcacgcacctgtagtcccagctacttgggaggctgaagcaggagaatcacttgaacccaggaggtggaggttgcagtgagccgagattgcaccactgcactccagtctgggcgacagagcgagactccgtctcaaaacgaacaaacaaacgaaacaatagaaaaacaggccaggcgcagtggctcacgcctgtaatcccagcacttcgggaggccaaggcaagtggatcacttgaggtcaggagttcgagaacagcctggccaacatggtgaaaccccatctctactaagaatacaaaaaattggccgggcgtagtggcgcatgcctgtaatcccagctatgcggaaggctcagacagaagaatcacttgaactgggaggcagaggttgcagtgggccgagatcatgccagtgcactccagcttgggcaatagagtgagactttgtttccaccccccccccaccaaaaaaagacaaaacaaaacaaacaaaaacaaaaagtgctgcattaaaactgattttataaacaaaatgacaaaaagcaatttcttctcacttgattttagagacaattgcttacatataagaatttttggtcagatgccctgtagggtgaccaaaccatcccagcttgcctgggacttcccagtttgggtactgaaaactccatgtcccaggaaacccctgtcctgagccaactggaacagttggtacagttggcttttccatagcttacacttctattatctgcccttagaaaaattccagtgctactgtaatttatatttatctgaaaagcacctgcatagtcttcctgttggtattcagtacataatcatttggttagcatataaatatttatggaattttgtcccatgagtagatattttataaatgtatacgaatatttttttaccttactaggacttggggacaatgggagtgccaaattaccaacaatgattatctcggcaccaaaaaggtattaatttgtgtattttctttttcaagaaccttttcctgttgttgtttagagactactgtgcttctagctagtaatcaccatcgctgggaaaacaataacacaggcaatacctttaagaacaagtcattaaaaaacaatacaaaataatgtatgtgggtcatcccttggccaatgtggggccagagagaagttgttctactggttttccttaaatagcaccataacctaacctgaatctaagatggtttccaaaatatgtatagaacgaatgttaactaattaattctataaaaatatgtatagaatgaaagctaattaaccatcaaaccatggttataatggtttatccatggataggagacccagaaattcagaagcactgtaatacttttcatgatattaataaaaaatgaagtcatgagatcatggaaaaggtttctgagaaaaaaatcagaccaattttcttccctagaaaatggggatgacacaggctgtgtacatataagcataattaaaataaaactgattaggctgggtgtggtggctcacgactataatcccagcactttgggtggccgaggtgggaggatcatgaggtcaggaggtcgagaccagcctgccaacatggtaaaacccgtctctactaaaaatacaaaaattagccaggcatggtggtgcgtgcctgtagtcccagctactcaggaggttgaggtaggagaattgcctgaacccgggaggcagaggttgcagtgagccgaaattgctccactgtgctccagcctgggcgacagagtgagactccgtctcaaaacaaacaaacaaacaaataaacaaaactgattaaaagattataaaggtgacttatgacactttttaaaagctctgattttgtgagtacttagctatgtgccaggtactgtgtcaaatgctttaaatacataatttcatttgatactcacaaataatcctatgagaacaggaattatgatcctccaaagtaaacctctaaaagagaggcttagtaatttgcttaaggttacagacagcaacggggcaggggggtgcataggcaaattcagatccatctgcttcaataacttttatcctcttcacctttatcctatgccgcttctaaacattgctggtgtaaactctggtaaaattgtatctccagctctaatttttcctgaccttcagtcttgtatcttagtttatggaactgcctactcaacacctctaccctgatgtctaacgagcacctcaaataacatgtttcagtgagtgatgccaccattcacccagtcgctcaagctccaaatacagtaggcatccttgtttcctccatcaaacccactgtcaagccaccagcaaatattttggctcttctttcaaattctatctcaatctgaccacttcttatcacctccactgccacaaccctagttcaggctattatctacttacctggactactgagatagcctcataattgctttgttttcgtagtccattcaccataaagcagtcagttatctttttaaaaacacagatcatatagtttcactcttctgcttaaaactcgttaataattgccactggaataatgtaaacttcttaagatgacctacaaggcccctactggccccctaccttgatctgctttctctgactttatcccttaacaccctcttctttgctcagcatgtctcaagtcacattggtcctgatattttcaaattcctctgtgactaaaagtcacatgttttgagaagatgtgaaagggcagggctgaagtttgaggaaactgcaaaggtgtgaaagagttgtcgagagtgggagaacaatccagaaaaatttaataggattgctgggaattattgaaggttgagttgtgcttggtgattgaaattaagtaggctgggtgtagtggctcacacctgtaatcctagcattttgggaggccaaggtgggaggattgcttgaggccaggagttccagaccagtctgagcaacatagtgagatgtatctgtaaaaaaaaataaaaaattagccaggtatggtggtgtgcacctgtagtaccagcaactcaggaggctgaagtgggaggatcacttgagcccgggacattgagccttcagtggtgatcgcaccactgcattccagcctgggtgccagagcaagagtgtctccaaaaaaaaaaaaaaaaagaagaaatgtagtaatagaatacagatggctatgcacatttctctaatagtggtcagctgctccatttatcaaagtggagactatggatggtagggttcattcaagataggggtacaatgaaaagaaaggtgaggcaaaggagtttagggtactgacgagtgttactgaatttttctgtaggtaatatcacaatggagacggggtggacagaagtgttccttgtgtccatggcttgccttagttgtggcagcaatctagaattgctaaatagaaacactgaatcaaagaacctagacctggctgggcgctgtggcttatgcctgttatcacagcactttgggaggccgaggcaggtggatcacctgaagtcaggaattcgagaccagcctggccaatatggtgaaaccccatctctactaaaaatacaaaaattagcctggggtggtggcatgcgcctgtagtcccagctactcaggaggctgagacaggagaatcgcttgaacctgggaggcagaggctgcagtgagctgagatcaccactgtactccaatctgggcaacagagcgagactccgtctcaagaaaaaaacaaacaacaacaacaacaacaaaaacctagactaccagtattgaggttaaatgctttactttgtaaatcctgaggttaagaaatataattatcggtattttaaaacttacaaaatggacaaattggaagaggctttttaacattataatggaatttttcacttttcaaaatcaatttccaaagggaacctataggttgaacagtaagatttatcaacaaatcaggggttttgattttaaaaggttttcaatctggccaattcttcagattatctcaagagggagccttcttatgcctcttcttccttcataacacttctctggctcgcatgtcctgtttgcaaagatttaagcccactcttaggcataaaatgctcttaactgacatgacccctgactaacttgcctaatattttgccatgtaccctccatgcactttaagctccccaaactattacttacttgacaccttctgcgcttttgcttgttctctgcggctagaccatcttccctaccttctctgttgaactcctagccattcatcaacactcagctcacatagcacactttcagatgagattcaagcattatctctctggctacatttggcccttgtagatatttctattattgcctgtattttgttgaagcattcatgtcttttatgtactacatagtacataatatatctacattacaaagcatttttatgattcatgttttggggcatccagcggttaaaatagggcaagggttatgtggtcttggccaggtcccttttcctttctgagcttcaggttcctcaggtataaaatgggtactatggctccgtgaagatgagacagaatatatgtaaagcccttacacagtgctcaattcatgaaaatcatcgctgtttacattgtttagggccctcaagaggcgctcttgtcagcggggtggaggaaatgcctctttaaaatgacgtcattataggagacttaaaaaccactgcacgtctgtacaagtggacagaatcacacagctacctaaagtgggttcacctgtcatacagtttagaggttccacttacaacaggtttccatcagtagccaaagcaacagaaattttagcttaacggctgagggcttccgggattaccgcagggcgggcgggaagcgcctttccgctccggagggaaggccgcgtccccaagggactgcctaagtgggctggatccctatggcctgcggcagacaccaccacgtaggcggtccaggggtccctctctcggtgactggtgaccaggaggccgcaatctcttcacataaaaggtctacgggtttccgctcggccctcacagcggcagcggatcgaaccaggaaagcaattcccgctcggctcccctcgggtcccaggcccaggaaggccgggccgtggggtctccccgggctccacgcaggggcggtggggcggggcgcagtgacgcaaagaggagtgacgcgacgacgcagcgcgacgcggtgacgcacgcccctttgttggctcagtagcgatagcagcggccgtggaggtggcgttggggactgttttctctcggaggccggagcggagccgcgtctgactgaggcgggcagcaagcggccccctcgctccctccctccctcctccgcgccctccccgccgccaccagccgtcaaacgccaaccgccgctcctggggaggagccgcggctcgcggggccggagccaggcctgcgtccggacatcagccggagccggagcgagagccggggcctcggcgtccccgccctctccccgcctcggccagcgtccgccgggcccccgcgcgtcgcgccatggactcggacgagggctacaactacgagttcgacgaggacgaggagtgcagtgaggaggacagcggcgccgaggaggaggaggacgaagacgacgacgagccggacgatgataccctggatctgggcgaggtggagctggtggagcccgggctgggcgtcggcggggagcgggacggactgctgtgcggggagacgggcggtggcggcggcagcgctctggggcccggcggtggcggcggcggcggcggcggcggtggtggtggcgggccggggcatgagcaggaggaggattaccgctacgaggtgctcacggccgagcagattctacaacacatggtggaatgtatccgggaggtcaacgaggtcatccaggtgagggtggccgccgcgccagctggaccgggcccgacgggggagcggattcaggcggcacgcgcggtcccgagggacaggcctgggcctggtgcgcagcctagcccggtgcctcccggccttgtcttctccgctgcctctgctggggatagagggtgtcgaaagcagaggttcgccgattagccgggtgtggggaggtgcgctgggggcggtgcttcccaagtcctgctatggcggaggccttcggtcgcctaagccttctcttgcgggcaatttctgccagtccctgggccgggtgtcctttctctggccgggcgatcgcctactggggcggggcggaggaggtggggtggagaagaggagtcaggaagaattgggccctgacgggacttaccccggccgtagcctcatttgagcacttttggaagggattagagtaggcctaagagcagcttggtgtacagttgccccaagtgggcaccagttaataaagaaatggatcttggcagtctcaagtgcctacttaaaggtgggggaagggaagtatttctcggaagaggtgctgatgggccttcttttcagatggtgaggcttctgcttacatcttttttatgtctttgctgtttgggacctaattgctactttttctagtcgtagcagatgacttgcttgaagctgttggaatagttactgcatattgcatacccttccttgtagctaaaacaacaacaaaacgcagtgttgtctaatattggacaagactctattgtgagttagaaagcagaggttttctgcttgtgaactcctttctctgatattttctattttgtggtaagttaggcttggtgtaagttgataaccacatctcatttaaccatgtgcgtcagattttgcatttttgagctttagaaactcaaaagttttcatttggggaaaaaaaaaacctcagttctcctgaggagtcagggatatggctgaagaataaaaatgaagcttgattcagtgcaatttttagaaaacctggaaggaaacatatatgagcagcaagttactattgcctcttttatcagtattatttcttttttgtttaacttaaattggttggctaaatattcattgacaaattagaagtatgtcactgtcaactcgttgactttctattattaactgatttttatagtattataagtaacagttttaaaaattgaagcatctattcaggcactgtttcaatacagtgttttgcataatagaaaaatctctgatatctagtgccattactaaatagtggaagtcttcatttttaatctagagaacacagtctaagaaggaagttgaggattgtagaagataattttttgtttgtttgagacggagtcttgctttgtcgcccaggctggagtgcaatggcgcaatctctgctcactgcaacctccgcctgccgggttcatgcaattctcctgcctcggcctcccaagtagctggtactacaggcgcgctccaccatgctcagctaattttttgtatttttagtagagacgggtttcaccatgctggccaggctggtttcgaactcctgaccttgtgatccgcctgcctcggcctcccaaagcgctggattacaggcgtcagccaccgtgcccggcctgtagaagatgcacatgtaagaaaaatctgattaggtaagaaaaaataaaaagacaaaacaagcctgccacccagagacgtacaacaaaatgcgaactgtagttatttttctagacctttggatagccattaatatggttccacgttaataacagtggaaccatactgtatgttctgtttgtgttttcagtggaaaaacattacagaaatactctgaacaaccttctgtcaagtaaatttttcgagaacttatatgattatagatctgaactaatttatttaatcaatctgttatttgccttcctttttattttctagtttctggcttttataaatattgaaaatatcctcataggtcagtctttgagtgttcttattttcttgggataaagtgaattgctgagtcaaaagaatttgctcattttcaatgcatttgatacatactaccacattgctttcagaaaagttatgctagttttcccaaccagtgtttgatgggcaaaaaaaacctggtgagattgaatttatgtttattgggcttggtatttcttttttaaattgcccctcgctttttgctcattttattctcttttgcccattgcccctctttgggatatttatctcttactggtttgtaagacttctttctattaatagaggttggaaatagcagttatctaggtttttaatgttggtttgataaacactgaattttacttagtttgcattagagagcttactgttaactcttaaacatttaaattccctgttctcagttctaattttcagtgtgaaatcaggtaagatacatttgcaggtgaaaaagtttgaaatgtaaaaagataaccaaattaatttaatatttccttgggaatttgattactttttctgggagaggagttctgggcaacaacataaatactgttatttgtggatatttgcaggttaggtttggtcttcaaataagtcaacattattttctttcagaaaacttggttttctggctttctataatttcccaattaacatttaaataaaagaccaaattaaacaattaaactttatttaatttggtcttttgtttaaatgctttgtggctacctagcttaccttttcagcttttaaggaaaaaaaaaatcagagttttttattttgttttgtttggagacagcctcactctgtcacccaggctgtagtgcagtcgcgtgatctcagcttactgcaacctctccctcccaggttcaagagattccccttgcctcagcttccccccctaccccagtatctgggattacaggcacctgccaccaggcccagctaattcttgtgttacagggtttccccatgttcatcatgctggtactgaactcctggcctcaagtgatctgcccttctcggcctcccaaagtgctgggattacaggtgtgagccaccatgcctggccagggtgttttttgttatttgtttattttgagacagagtttcattctgctgcccaggttggagtgcagtggcgtgatctcagctcactgcaacctccgcctcttgggttcaagcaattctcctgcctgagcctcccgagtagctgggattacaggtgtgcaccaccacacccagctactttttgtattttttagtagagagggggtttcaccatgttggccaggctggtcttgaactcctgaacccaggtgatccacacagctgggcctcccaaagtgctgggattacagtcttgagccaccgcgcccagcctaaaaagtagttttctaatgtaactatataagtagctaggtaatttattaaaagaaccctgttcaattctgcagttgggagtatttaaacttgccattttgtttttccacaacagtgttcagcaaatgttgattgtgctttctaagtatgccaggcattatgttaagcagaggatatgctccttgcctaaggagcatatagggatagggaatatggaggtccttgaactccacttccagagattcttactcattaatgaagtctgaggtgaaaccttagcatctctgtattttagccttctagtgataaccaaaccactggaatagtgatagttaatccactgtcacgattttgactcaggcagggtgagtagagtgagaagagcagcagctcttaggggcacagattgggtatacctaatcaaaaaatcagaaatgctctgaaatcactttgtgttgttgcccagactgaagtgcaatggcaagatcatagctcactgcaacctcaacttcctgagctaaagtgattctcccgcctcagcctcctgagtagctaggactataggtgtgtggcaccactcctagctaattttttttcttttttgtagagacacagggtcttgctctgttgcccaggccagtctcaaactcctggcctcaagcgctccttgaacctcagcctctcaaaatggtaggcctggaaatccaaaactttttgagcaccgttgtgatgctcaaaggaaatgctcactgcagcattttggatttcggattttcagattagggatgttgattgtaagtataattaaatattccaaatctgaaaaacttctggtctcaagtattttggataaggaatactcaacctgtaccatatttagagtgtgtgccgagaggaatatggacctgggactattgaatgtgagtggtcagaggaggtataaaaaacagtggataggtatcttgcttttataagatctgttatgctaaataactttttttttttttggagacggagtcttgctctgttgccaggctggagagcagtggtggcgtgatcttggctcagtgcaacctctgcctcctgggttcaagcgattctcctgcctcagcctcctgagaagctgggactacaggtgcgcgccaccacacccaactaatttttgtatttttagtagagactgggtttcaccatgttggtcagatggtctcaacctcttgacctcgtgatccgcctgccttggcctcccaaagtgctgggattacaggcgtgagccaccgtgcccagccaaataactcattttaaagaaaaaaatatctaagccttactgaagaaattttctgttggctgttggttcgaaagctgtatttcacttatttaattaagagatttaattaaagaacctcaagttgaggttgcaagcctaaactaaggaagacagtgtactattctttttttttttttcgtttgagacggagtctcgctttgttgcccaggctggagtgcggtggtgcgatctcggctcaccgcaagctccgcctcctgggttcacgccattcttctgcctcagcctcccgagtagctgggactacaggcagccgctaccatgcctggctaatttttttgtattttttagtagagatggggtttcaccatgttagccaggatgatctggatctcctgacctcgtgatccgcccacctcggcctgccaaagtgctgggattacaggcatgagccaccgtgcccggtcaacagtgtactattctagcatattgtttactgattggggagtcagttatagccctggtttttactctgtctagttaatatctcagaaccttcaaattttttttttttttttttatacatgtctcactgtgtcacccaggctggagtgcagtggcctgatcttggctcactgcaacctccacttccagggttcaagcgattctcctgcttcagcctctcaagtaactgggattacaggcacgcgccaccacacccagctattttttgtattttattagagatgaggtttcaccatgttggccaggctggtctcgaactcctgacctcaaatgatcgacctaccttggcctcccagagtgttgggattataggcatgagccacggtgcccagccacactttttgttgttgttgttgagatggagtttctctcttgttgcccaggctggagtgcaatgacgcgatctcagctcactgcaacctctgcctcccaggttcaagcgattctcctgcctcagcctcctgagtagctaggattacaggcgtatgccaccacgcctggctaattttgtatttttagtagagatgggggtttctccatgttggtcaggctggtctcaaactcccgacctcaggtgatctgcccgcctcggcctcccaaagttctgggatcacagtgagccaccttgcccggccttgttttgtttttaatctgggactgaaaatgagggagttgaaatactaggttggtccttttttacattaagtgttttattcgtttaacatcattttaaaaacctcagttaattggagatgttcattttttccaagaaattgaattcaggtgtgcatattgtggttatgttcattaattgggagaggaggaagagggtgtacaagcctgtgcatgatgtgtgcaggcacatgtgttttgaagttattaaagtgtttgatatagtttagatttatttcttttggacttttatattttcccagctgatctccttgagctgtaagtttaaattacactgacttgttgaattgctatggcagtagtcctatgaatcaaactctggggatggggtctggctgtctgttttaacaagccttctaggtgatggtgatgcaagctaaagtttgagaactgctgatgtagttgaaatttaatagcagtgtttctctatgtgttacgtgtagtgatagattactacagaggtgggttaatgagggaagataaattgtttaagaaactaataataggggaccagtcacggtggctcacacctgtaatcccagcactttggggactgtgccaggcagatcacttgaggtcaggagtttgagaccagcctggccaatatggtgaaacactagctgggcgtggtggcctgtgcctgtaatcccagctacttgggagacttgaggcaggagaattgcttgaacctgggaattggaggttgcagtgagctgagatagtgtcactgcactctagcctgggtgacagagggagactctacttcaaaaaaaaggtaataatgggaaaatttccagaacctaggcaacgtttactaggctaatcatagggttggaagatgtttgtcatcgtagatgctatccttcatgctatgctatccttcagctaaggtggtctttactcagtattttcttttcttttcttttcttttttggagacagagtcttttctctcttgcccaggctggggtgcagtggcgccatctcggctcactgcaaccttcgcctgctgggttcaagcgattctcctccttcagcctcccgagtagctgggattacaggcgcccaccactacgcccggctaattttgtatttttggtagagacggggtttcaccatgttggccaggctgatctcgaactcctgacctcaggtgatccacccgacttggcctcccaaagtgctgggattacaggcatgagccactgcacccggccagtattttcaaatagacaaactaaactagtgacatctgacattctagattggagttcttgatttcccttccagtcctagatttttttaatatagaatgttgagttttctaatttattagtatgctggaagagatataaagtcctggatagatataaagtcctgtttaaaggaatatgagaagacttattcttaaggagttgagaatctcttagagttaaagctgttaggttagtgagtaatttaaataagtggatagtaatagatactcatggaagagacctctgtaggtgttgtcaaagatggctaggatttgggtggataaaaaagaggaagtcattctaaggaactgaatgaggtgagaatgaggagagtttttgggtaatggtgaaatcagctaaagtagaatggagcttataaatgctggataataatgtagaacctgggagattaaatactgtgatgaaaggtaagcagaagtcatcacattagattcttttggggttgacctgtggtaactatgtagattggttatcttttgccttatgttaccccaaaacttagtggcttaaaaaaacaaggatctgttatatcatagtttctgtgagtcacaattctggatgcagcttacctgggggcctctggcttatggtctcttacaaggctgcaaccaaggtgacggcttggtagcagttctctctctctcttttttttttttttttttaaagacagaggcttgctgtggtgcccaggctggagtgcaatggcataatctcggctcattgcaaccctcacctcttgagtccaagtgatcctcttacctcagcctcctgagtagttgggactatagatgtgcaccaccacaccccagcttatttttttgtttttgtgggttttttggtagagaccagtatttttttgttttgccatgttgcctaggctgctcttgaacaccttaattcaagggatctgcccgccttagcctcctaaagtgctgggattacaggcatgagccaccgtgtctggcctgggtagcagtcctcaaggcttgactggggaagcttccccttccgagctcactcatttggctgtgaccaggccagattttcactggctggttgttgcccagagatatcagttccttgccatgtgggcctctccataaagtggctgacaacacagtagcttgtttcctccagagtgagggatcttagagaaaaggcccatacgatggaagccacaaagtttttataacttaatttcagaagtaacgtcgcatcactttgcaatattctatttgttgtaagtgaataaccaaatccagcccatactcaatcggaggggattatacaaagatgtgaagaccaggaggcaggggtctttgggggctatcttagaggccggctgtttgtctctgtctctctctgttaagaggtaaattacagctattgtataatgcctttctatccaatctttttgtatgctattgggagaacatagtgttttggattttttattttggattaaccgtaaattaattacttttggctttgcaaaacattatacctgtaaatgataaacattcctaataacctttcagtggcttaagtttaaaatagcttgtagtctcagaattggtaggaatttgagattctccagtttactgattttttttttttttaactctagctacgtaatggaatcacctggggatttttttcattactgtttttaaaatagaaaattgtagattcacagccgggcatggtggctcacgcctgtaatcccagcactttgggaggccgaggcaggcggatcacctgaagtcaggagttcgagaccagcctggccaaatggcgaaaccccgtctctactaaaaaaatacaaaaattagccgggcatggtggtgggcgcctgtaatcccagctactcgggaggctgaggcaggagaatcacttgaacccaggagacagaggttgcagtgagccaagattatgccattgcactccagcctgggcaacaagagtgaaactccatcaaaaaaaaaaaaaaaaaagaagaaaagaaaagaaaattgtagattcacatgcagttacaagaaataatgcaaaaatcccacatattcttttttccaaaaaattttatttccctaggttattggggaagaggtggtatttggttacataagtaaattctttagtggtgatttgtgagattttggtgcacccatcatctgagcaatatacactgaacccagtttgtagtgttttatctctcacccccttctcacctttttcccccgagtccccagagttcattatatcaatcttaggcttttgcatgctgatagcttagctcccacttatgagtgagaacatataatgtttggttttctgttcttgatttacttctcttagaataataagtctccaatcccatccaggttgatgcaaatgccattaactcattcccttttatggctgagtagtattccatcatatatatatatatatgtgtatatatatatgtgtgtgtatacatatatatacgtatatgtatgcgtgtgtatacgtatatacgtatatgtatgtgtgtgtatatatgtatatatatatgtgtgcatacatatatatgtgtatatatatacatatatatacacacacacacacacaccacagtttctttatccacttgttgattgatgggcatttgggctggttccccatttttgcagttgcgaattgtactgctacaaatggcgtgtgcaagtatctttttcgtataatgacttttcctctgggtggatacccagtagtgtgattgctgaatcaaatagtagttctacttttagttctttaaggaatctccacactgttttctatagtggttgtactagtttacattcccaccagcagcgtagaagtgttcccttctcaccacatccatgacaacatctattattttttaattttttgattatagccattcttggcgtgactgaagttgtatagcattgaatcccacgtactctaccgattttttctacagtggtaacatcttataaaaacagtatcttgcaaaacatcttgcacagtatcaccatgagggtaatgacattgatgtgatcttactcagattttcttacctggggattttaaaaaatacaggcaggcaggccctaccccataccaagtaagtgggtctctggggggtttggaccaggcattgccgttaaacaagaatctttcctggattattttaatgcacatccaggatcgagagctcctgcttttgtaagaaatctttctaaaacactgccgtctctgcttaactacaaataaataacagtgagctatttttgtgatgcatctcaatacagtgtttgcctattgatttttttttttaatggaaagaaaatctacttccgtattagctttcactcattgttcttagtacctgtagcaccctgaatggttttgttttttatataactatcattttggaatcctgaaggaaaaatttttcttcctgaggttaatcaacccccctttcctcagtcattcctgccttctaggtaattgctgtctttcttataataggcatagtatcataggccataactttgctaaattattgactgtatatacacaactcatcgtttgatcttgacactatattactatgtaactttgtataaatagcttaattattttcattaaatgatgggataaatagaagaatgagaatttatttaggttgacattattggatgagatagtaatcaggctgtttctaacctggagtgactggatcctttggggcccatggagatagtagtggtggtccttgcattattttcagtgttttaaaaagcctcatgtatatttttttaaaaagctgtcaagccacttttataaagtcagtagatttctataatcacttatgatttaagtttctttctaaatttttaatttttttttccctaaattgtcattcacctagtgataggaggtcatctggcttgaccatacaatggtttccccttatctacagtttcagtttccaaggtttcagttacctgaggtgtgcagcagtctgaaaatattaaatagaaaatttcagaaaaaaacaatttgtaagttttaaattgtacaccattctgagtagtgtgatgaaatctctcaccatcccacccaggacgtgaatcatccctttatccagtatatagcagtatatagactacctacctgctactggcctcggctggtcacttcactgttaccagattgaaaaaacatagcatgtataagttcggtattacctacactttcaagcttccactgagggtcttgggacatgttccctgaggatgaaggggactgctgtaatgtctcatttgatacagcttggggtatagttgatgcccagttagtgtttaagtgatggatagtatgctatctcagaaggtggcttaaaaaattcttaatgctctctaacatctgctctggcaaatcagctttccagagccctactttttttttttttcatttttaaaaatgactttttttttttttttttttttgagacagagtctctgtggcccaggctggagtgcagtggcatgatcttggctcactgcaacctctacctcctgggttcaagtgattatcgtgcctcagcctcccaattagctgagattacaggcatgcatcaccacacctggctaatttttgtattttttggtagagacagggtttcaccatgttggccaggctggtctcgaactcctgtcttcaggtgatccgccctcctcagcctcccaaagtgctgagatacaggcatgaaccactgtgcccagcctgacaattttggttttaaggccaaaagtttgaagatttaaatgaaaaatgccaaatattcaggaattttctcctattattattattatttttttttgtatgtaaatattgttgtgtagtattgttctttccttttttgctctgttccatttaaaagtgtcagaagtgccctgacaatacattttggcaaaaaacagagcaggtaatgaagtattaggtaacattttcttgttactgagacatttgcttagacaatgctaagaatagctatcatcctagacacttctccccaggcttgctttgccattgcctttgaaactgtcatacttataactcagatattaactggctctaattacctggtaatatgtcctctctcctaatcacaattgtacagtgtttttagggataaagtgtaaactagaaaccgagaagtattacctgattcttagcaagtatttataagtgaaagcctctaatgtggacatttatcttggaatttgtgacatttggacagatatttatctgaaacttacttgaaactcaaatttaataccttctctctttgaggcttttcccccttttattggcttatctgagaaccattcttgggatttgagtcatccttttttttttccttcattttccacatccagttatccctgatcaagttacctctgaaatttgtttcatgttgttgctatcctttttactaactaatcctagtttaggacctttttattttgcctccttgtctctgggcttccagtgtatcattctgttaccaaacacaaatttaatagtcatcctcctgctaaaaagagactttctgtcaaaagtctatcccagactccttactatggcattcatggcttccccatcttaacatagctaatttttttcaatctcatctgcagttgttcctcatcccttatcacccccagttgcactgtttgtaattctttactgtgtaacacatatttgtgttttcatgcttttgttcatacttgtccctcttcttttgataccttttcttttctttctgtctctcttttttcttgagacagggtttttgctctgttgctcaggctggagtgcagtggcacgatcacggctcactacagccttgaactcctgggctcaagcgatcctcccacctcagcctcctgagtagctgggactacagttgcatgccactacacctggctaattttttgtattattatttttatttatttattttttgtttgtttgttttgtttttggtagagacaattttttgccatgttgcctagactggtctcgacctcctggactcaaacgatcttcccacctcagcctcccaaagtgttgggattacaggcatgagccaccgtgcccagctctctttctcttcttaactgcctgatatattcctattgagaatctgccaggctggctgcggtggctcatctcctttcaggttcttctctacctttcctgtgcttccttatctatgtttgaatagtgcttcatatggatatttggtatagcctataagaggttatgatatagctatccctatatccaagcctctagctatatatgagggttttgaaggtgagaactaaaactccttcatctttgtgttcatagcagagtttcttctctgacagaagaaactcagtaaatatttgttgaagtttgtccttgcctagtaaatgcttgctttctcagtttccttgtggtaaaccaaagggatccagacaagattttcttctggcactaacaaattattttatgatttctagataatgccaaagtggtagtgtaagaagatggcaaggaagaaatgtttgaattccaagaggacaagcttcttaaggtccctgaatattcaaccttttaggtgaagctttattatttgcgtatagttccctggcgctgggtgtgaactgacacagtgatgatgttaaagacagtggaatcacccaggtgcagtggctcacgcctgcaatcccacaactttgggaggttgaggccagaggattacttgagtccaggagtttgagaccagcctgggctacatagactttttctctacaaaaaaaataaataaaattagctgggcttggtggcatgtgcctgtagtcagttacttgggaggctgaagtgggagaagaggattgctgagctcaggaggtcaatcaaggctgtagtaagccgagattgtgctactgcactccagcctaggcaacagggtgagaccatgtctcaaaaaaaaaaaaaaaaaaaaaagacagttgaatcagtttaatacagtacttctcaaagtatggtccataagaacaaaactatttaataataacagaaagacactatttgcctcttaaaatgttctggcatttgtgctgatgttgcagggcaatgaggaggtaaaaccactggcaccttagtacagaaggtatcagtggcaccaaagtatgctagtagtcattgtgttcttcactatcacacactcagagtaaaaaaatacgtttcacttaatcctaaatgaataagtaaaaattactagttttctaagtctttattccttaaggacacatcttaattgcttgtgtgacaaaatgggaggtatgcctaaagcacttctgcatactgaagtatggtggtcgtcccaaaatgaaaacatttgtgtgtgcttttgacttgtgagcttgtttctgtttctggacctaccctgggcaggtttccacagttgagaatcttagcgtattgctgttacctcaaatttccacacactaccagtttgtcttttgaaatgttatttttataagatgtcaaccctggtatggttcacttttgttatatgttggcacctctgtgggttacggaaagctttgccctccaaagcaaccagttggtttttaggaaagggaaatattgatctttgtggataagtagagtcttgttaaaagctattagaaggctctctttggaaaaaaatcagaaaaatcaaaagaactgtgaaaaggatgataataatggaaaagaggcctttgtagccttgtgaatgtaatacgtatagtcaccacagatttttcagggaggccagtcacggtggttcaagcgtgtaatcccagcactttgggaggctgaggcaggaggattgatagaaccaaggagtttgagaccagcctgggcaacatagtgagaccccatctctagcaaaaaaaatgtttttcagggaatgctgaaatgtctccttctcaaaaaaaaaaaaaaagtctccttctcttacaagttagtcaccttactcagtttattacagcaggagttcccaatcctcaggctgtggcctgttgtgaactgggcagcacagcaggaggcgagcagccagggagcgttaccacctgagctctgcctcgtgtcagattggcagcggcattagattctcataggagtgcaaaccctattgtaaattgtgcattcaagggatctaggttggcactccttatgagaatctaatgcctgataatctgaggtggaatattcattgttattgtctgactccactcccctcccgctcctttcatggaaaaattgtcttccatgaaaccagtccctagtgccaaaaagttggggaccactgtactgtagtttcaaaaatgttcatatttggcctaaatctatagtctgaggaagcatatcacatctttatcattcatgacaagcagggatgggagaggaagcagggataggagtggttatgtgggcagccaatagcataggaaacttaaaaggaacctacttagccaaacatgttttgagcctttgagtcccagtgactaaacaatgcagattaggataaaagatttgctcacacctgtaatccctgcactttgggaggccgaggtgggcagatcatgaggtcaggagttcgagaccagcctggccaacatggtgaaaccccgtgtctactaaaaatataaaaattagcccggtgtggtggtgtgctcctgtaatcccagctactcgggaggctgaggcaggagaattgcttgaacctgggaggcagaggttgcagtgagccgagatcgtgccactgcactccaggctggatgacagagtaagactcttgtctcgaaaaaaataaaaataaaaaataaaagatttattagcatgataaatcaggcttttcataatgtgcccctatctaccttagctgccatttctttatgcttattcgtattatagcataataatcacattccctgtggaaattttctgtatgcctttgtaaggtttttttcctatgcttcaaatgcttccccccacccccccataaacccattcatacttcatgacccactgtaaatattgtttcttccttgaatctttccctgtgagcctcagaattttgtatatacttttataataaaaagctcttatctcattatttccttactagatagactctgaaattcttggttgtttgatcagtgtattaattttggtattcacgttgtacccacaaagttcctggaacatagctgttagacattgagtgaaaagtcagatatgaatgaattttctaattgattttattattgataaaaataagtcttggtactatccccatttttttcctttgtgaattgttcacatttctcttctaccaaattcactgaattaacccttccctcattctctaacatactactttttgctcttaaccagttatcttacggaactttagttatcacaactgttatgtgaaataggtgacatttttactgttttgtggttaaggaattagaggcatagaggaattaaataaccagcttttcatagctggagttggaactcagtattttatatcattaaatatacacaaacgtgtgaatgttattgttgtgtgtgctgggtattttctgtttgcctctgcggaactcttctacctttttccatcctgctgtgctccagaagactgacttatacaggctgagtcaatgggctctgacttgtgacttcattgctgtggcctctgaatccaaataaatgactaagagtggaatagagtcagaagtctactacataccccatttaagactttacagcttacatatgtaccatcctcaagaaaatatcaagccaaaattgctgttatatttactgttttctactctaagcatttaaaaacacaaagtttaataaaaaataattctcgaccaaagtaatagaatacatatatattatataaaatttgttcgttatttatgtatgaagttacaaacttagactagtggtccaaaaagcccagcattcttctgaaagaagcaccaagagattctggaagaatagcaccgtgaaactgttatggaggcactagataacaaatgcttgctttaaagggagaagagccagtttattttgctcggtaatgagaaaatagttctttagtaaagttctcaggtgagcttattactaatgccgtttaacttcaaatgtgagaaaatatgtttactttttaacctgttcaccacttcacctcttatgaaggggaaaacttagggagtgggcctcaaattacttgtcatttaatttggaaatgttcctttgaaatttggaaacgtatgtacataattttagtcactgatttgttacagaatttttaaatgtagtaattacatttcattggccctaaaaatgttgtctgtttttaataatcatctctaattgtattgcattaatataatagctgggtccttaggatatatgataatgtatgaagcttgattataatgttgcattccacccagctataaagccaaagtggtgaaaataggacttttaaatatacagaagtattctagtcacccttaggaatgaaagtataacattaagcaatatttgaagatttaaggatggcagtaagcttgcctaatctttgattcataccactgtcaacacagtttttgattcatgtagagtcaaattaacaaggttggaaggatcctaatggttatcctagccaaccacatatcaagtactacctccctggtaagtggtcctgtagactattcttaaatgtctactctggctaaaccttcacagccacttccagaagacctctgatttagagttctttcatactctgattttgtcttcctgtagctttttacctgaacctacctggttctaacccttctcatgatagcgattctataattttaaagacttatttaacatattggagactagcagtgcaataacctaatccagactaacactttttggggggggaggtcagaacccagaataaagctgctgcttattctgggtttacttcttatggattgttgattagaaagattattctgcactggtattttggattgaggcctgtgcatgtctgttcaggcaaagtttacataaggtagaacactacagcagcacatgtgcaccctgctcaattaaataaatatcaggcagatctgtttgttcataccctcattgcagatactgaagggttggtgggttttgcagtaacgaatgaataattcatcttgatattactatattaatagttttgggttctgtatatttcctccgactcagaatttacaaaaataaaagcactttctagacagttaactagttagctctgagtagaatgttttctactacctttttaaagattctagatcattttgagcaaagaatattgaaattgcattgcaaacttatctttgtgaatcaggtttttcttcattctatgtacaaaacaaaatatagaaataagatgtatactgagcttttctccataacctcagattttttttaaaaagttaaaacagtcttagtatgctaagagtgactgtttataaacttttttaaaggattttaaattttttattgtttgtgcatacatatattttcttggttcaaattcaaaaagcacaaaagatttaaaaaaaacatatatatctgcctttatacctcaactacgtggttccctccctcacagtattattgatgtcttagtacttttctcataaatgcagaacccttccctaacctgatttttatatttcttataagatcctaaataatcgtgttatagtttatgaatttctgaggttagtgggtccctaaatataatgcttcagtttaattgggaaccatttgtaaattgagtacttgatttatttttatcagctgagatttctttagctgccacactgctgggggaatacagataatggacaactctttaagaaataatgtataaataaattataatgcgacgctttgtttcatagtagaagcataaggtcgagaaggaatatttaatgctcttctctgggaggaccgacttgctggtaggaatggaagctgaattttgaaaaatgaatggtagcttactaggcagatggggttagaggtggcattccagacaaaggaggaagaggaatggaagaagttgtggtatgttgaatgaacaataaggaattgaatattgctgaaattactgggaagtagagtggtaggagctggggctagacaggcagtgtgatcagattatgaaagcttttagcgtagtgctgttgagatggacttaattcactaggactacgtgaaacaactttaaacttttaaattaataaggaattagagtttaaaaggccactctgttggtactataggaaataaatgagaacaggacgggattaggaaactgggagagtagtgagtaatccattagaataacctgtgaaagaaatgggttagcaaggctggaatggaggagggaaggcattcaagataccgtgagaaatgatgaattattaggaaaaaaaaaaaaaacttagtgattaagtctttggtgtcatttagaaccacattcagttccagctttgccttttaccagctctgtgacttcgtatgtaaatttgattttaataaattctgtttcatcatctgtgagtattgtaattgtgtagttgaagctttaagcaactttcatttaactaacttggtgaatagttaatagttgctctccattccctcagtaaaagagacctagggcagtgttcatgacaggctctcagcttgtcggcctaagtggcaaaattaaccagtcacgatagcccttatactgtgtggtatcatttatacaaaatgtcctgaattggcaaatctatagagatagaaagtagatcagtggttgtcagaggctgagtgggggaaatggggcgtgactgctaatgagtatagggtttctttttagggtgatgaaatgttctaaaattaatggttgacacaactgtcacaattctgtgaatataatcaaaaccactgaactacttttgagagttaatttcatggtatatctcaagttgtcacagaaaaaaagtctaattcagtattccccatttgtccaatacgtcttttatagcttttcttcttttggtcaaggatcatggattgcatttggttatcatgtctctttatttgtccatgttcttgatgggttaaaataataaagaatatacaaatggttagatctcctataaacaaaagaatatacaaatggttagatctcctataaacaaaagtttcctgaaacttccttaaacatgtagcatggatctagtttattttagttgcatgcaaaataaaacaattgattaaattaaaattgttctttcatggctgtaagctcttggtgaagacaggtcagacaggtatttgggttaatgtcaggcaaaaatttctgtatcaaaacacaatatttatactggcttgagctagaatgttgagacattgttttaaggtttgtttttttaaaatagcttttagaagcttattgaggtgtaactatatatgctatataaactatgatatacaaatatatatactatacaaaaatatatcttacaatttttttcctcaagagatactgtttttctgtcacccaagctggagtgcagtggtgtaatcacagctcaccgcagccttcaactcctgggctcgagcaatccttccgcctcagcctcctgagcagctgggactacaggcacacaccaccacacctaattaaaaaaaatttttttttggagatggggtctgttgcccaggctagtctcaaactcctggcttcaggcagtcctcccacttcagcctaccaaagtgttgggattacaagcttgagccactgtgcctggccatagttttgtatataaatgtcttactattatagtttggtaatcgacctaaataatactgttacatattgttttaagcccccaaagttgtcttacctagatgtggtgctagcaaacgtttttataaaggcaggaatgtagaatggcaaaatgctgaaatacaaacatactctaagcacacagaccttagtgtcacagtagaaacttcctgcttgcaataattgccattttaattttggtgcagaaagccttctatggatgtgatagtttatgtaccaaagagcaatctctatttgaagaaactgtgtggcctggttacaaaagtgcctgctgtatctgtaactgtcagtggtattaaaaatactgatttattttgcctgttgtgataatcaagaatagcttatttggatatatgcatgggatggttgcaaataccaagttcaggtattttactatggaatatagataggggtgttttcttctggttttccccacccctttatatataccttgattttaatttttatcaagtgtgtctctttggcctttgccgctgtggcccattgatctgtccatctgtctgttacagtgcatattgggtacttccagaagtatgaattcagtgatgcaaaggacaggcgggctgcagcagcaaaggtaggacagaatcattccaaagacaagtcattaaaagaccattaaacacacatacttacacacagacattggcaaccagtacctcattatttaagggcacatcatttatcctataaatctttgtgggaaagtttgttttgacatgacaaatgtgatgtacttgtaaagggcacaattttattattatgttttaaaccagaagcctacttggcacttaggcaacaaagtaaatggcatttgccactgtctttaagatgccgaataatagaagagataattaaatggaggatattaatggtattaattgattcatggagctggctgattttcagaaactatgataaaggatcctattttgtaaactgggaggagaaacagagaagatagattgagctatgtgtgtatatttatgtgttaatgtttatttatattcctgactctggaatattttgatgaaaataatctaaatcttcctgttatttcgctgacatcactatgaggaagattaagaaattctatttaaatgtttgtaccatttacttaagtatttgtatcagtttacttgctaaatgatagcagttataatagcaatttctggcttaaaaaaaaaacagggttaggatggaagggcaatagcatttttatactgaatcctaaaacatcagttataggcaagttttaaaacttaatcatacgttgcaaacacttgaagatgaaatggaaggcttataaggttaagtgttaggttttatgtgtcattctagtattggctgaaaagtgagtgctatagggatggtggaatgatgcagatatttgcatcattttctatgctgttatgcttctaaaaagaagaggctatgttttcctaaataggttagtagagtgcttctcaaggcttcccaaatgaaaagtcagacaaaaatatgtatttgttcttcagtgaagattgttgggttttcaaaccagcaatcttagctgtaaaacctaagatcttaccacagcctaaattgtgactcaaatgctgatgttagttaatacttttataaactccatatactatattgaggagatctagtttcttgaatgtggaagtgaagcttcataatataccatagtagggatgtttcgaatcaatagtgttaaaatgttttgggttttttaaagattttttttcagctggtcttggaaaccttttcagttatctgtttttgattctaccaaaggtattaggtatttaatgctccactaaatagatcacaaaaggggagtcttaaggaggtgaagatgtgaacttcttgactagatgtaaatcactgctcagaaagatttgacttttttaaatgatgcattcttatgtcaatagactttaatctgcaaccaaaatgttttttttttaaataaaaatgaggcacatttgtgctttctcacttctgctccaattctaccttattctgcaagttgctattttttcctttagcagtacactatagatttaaaaattgtatggtattttctaatataaccatatcaatttatcagttttcctattgttggacatctaattcactcatatttgtgtcttcttcctttcccttacagagtttttgtaaagaaggctgagtgttttcaaaagttatgtttatatttacatgtgtgtgaactaccattttctgtatacccttgctgataactattaagaatcttggtctggcgtggtggctcacgcctgtgatcccagcacttagggaggctgaggcggtggatcacccgaggtcaggaattggagaccagcctgaccaacatggcgaaaccccgtctctactaaaaatacattagctgggtgtggtggtgcatgcctgtaatcccagctacctgggaggctgaggcaggagaatggcttgaacccaggaggcggaggttgcagggagccaagatcgtgccactgcattccagcctgggcaacaagagtgaaacactccatctcaaaaataaaaaaaaaaaagaactcttcaaatttttattaatctggtaaagaaaatactagttgttttaatttacatttttctgaattgcctttttatgtcgtttgcaccttttcataaatttttttttttttttttttttttttttttttttttttgagacaaagtcttgctctgtcacccaggctggagtgcagtagtgtgatctcggctcactgcgacctctgcctcccgggttcaagccattctcccgcctcatcctcctgagtagctgggaggcgcacgccaccacacttggctaatttttgtatttttagtagagacggggtttcaccatgttggtcaggctggcctcgaacttctgatctcaaatgatccacctgccttggcctcccaaagtgttggcgtgagccactgagcccagccagtaatggtatttaatgtataattattgtagctctttctccagtttgttatttgtaagaaaaaaaaaaagcaatacatgcatgtggtaacaaatgtaaatgttatatcttacaatgattacatttatagctttaatatgtctcttccttttgacattatctctttcctttttcttcctccatccttgagaaccccactttatgccagctatagttatatgttatcaaaatatttttgtcttgtgattataaccaaatgttattagttcgcttatagcttgatttttgaagtgacatcattgaatgtttgtttttatggtttataaatatcaatgacattctaagtagtgtattatgattactgttgctttttgtttttaacaggtctaatttcaaatgctgtgaaccttcctaagaacagtactctggtagcaagatggtttgggtttatttatactccttggagcccttcattctgctcttgtaatcaggatggctttccctgtaagcctcttacatatagctctcaaccatggactttgcatcattctcctgtgttggagcctctgattcttagatacatgtctttttcttgactgaatctcattgtgctggactgcatccttaatttaactctcacaacacttttttcccccctgcaacactcttaggctgttacttattgtggctctgataatgtgcttaattttccttcaaacttgattgctagattggctaggttggaaactctagattagaatatttgtgcaagacattgccttctgcattcactgttggtgataagactgatagtagtctggttgtcatttctctcttttttttttttgagttggagtcttgctctgttgccaggctggagtgtagtggcacaatctcgtctcactgcaacctccacctcctgtgttcaagcgatttctcctgcctcagcctcccgagtagctgggactacaggcgcacaccaccacgcccagctaatttttgtatttttaatagagacggggtttcactgtgttggccaggatgatgtcgatctcttgacctcgtgatctgcccgcctcggcctcccaaagtgctgggattacaggtgtgagccactttatgactttatttatttatttattttttaagtttcagccttttctctgaagagatatgtaagtgtgaatcttctaatccattgtgctggatcttcagtggaccctttcaactggaagacttgtgtccttataaagctttggggaattaacttctgttactgctttgctaatttcattccctctcttcttcttttggaattcctatcagttgaatgtgaaaaacaatggatataacttaaaataatgataagttatggaagaaagattgagaggtgcatgtagcgtgccagatcctcatctttcacattaggaaggtgacagataatatctaaaatagaaaaataataactccttgagcataagcatattatttagcataaaagtaaatactagaagacacagaagagtttaaaatggttacctcagaggattagaaatcagtagtgactgaagtatggcaaagaacactgttaaatcttgcagtaccattaacttctaaaactatgtatgtatattaaataaaataacttaaaagtgatttaatgtaatccttaaggtctacatttaatgataccttcattctttaaaatatcgtcaggaagtttatgtagacgtgttcttagaccaaatatacactatcagccttcatgggaggaggtacacactatgtattcctttgtcatgattcgtaattattgagctgtgtattttgagaataattgatagagaatgtactggagatttacatggcctgttattgcttggttttaaaacttaaaggatacaggggtatatttttgtctaattcaagatcatttggatttatgacttttattagctttaaagaagcctacaatggcttttttcaaaaatagaatttttcttagaaaacagtttttaagagacaaatttatttaaatgcccactcttttaaaataaagttagatgtatggttttcaaataatcttatgtttgttattgaacaaaatcttatttactgtatatacaaatatatagtatggatgagtaagaagcagtgaattgctaatcagaatcccaccacttatcagtaagtgttttgagttgcacggtttgagaaagtactggttcaaatgctgttaaaaatcaaatttttgtatgctgtctctagatggtttgttgatgacctagtggttgtgttaaagaagtggagttacattgaagtcacgcgaatgttttgcttgtgtgtttggtggaacatttttagtatatgccacagcagatacgtggaatgctgatacttagggcttaacagttggaacccagaagtgagtatgtgaacaaataactgaaaggttacaaaataactttaatcatctcacaattctaatcaccacaaaaataataaagtagcatgaggtggtctatatttatggtttacattagccccactgtgccagggcagtttggaatttaagttacctggttcttggctctacctttagtttgtaccctttttatcaatagggcttttttgcccctataaggaatagccagttaagagactgcaacccaagaaaatcttgcctgaatggagtttcaggtaacgataaaagtttaaaaactagggtgttatatatattagaagtgacttgtctcttgatgcaaagtcatagactgctattttaagtcttgagtatttttttttgatataacattgaaggataccttacctattgtttctattgttcatgtaaatatacccttccattatctctccccactttggtttgccgctgaatttttatggaagaaatcaaatgattatacatagtgataacatccttctacttacagaaacattgtattaaaacactgattaaactcttgatgttttctagaggtgaaatctttatatttgggatgacatagaaggaagtaatttccctcataaaataaatgtgcaaagaacagcaaagcccagatgtgtcattggctaggcacatttattaacaagtttggatgcatcaggattacatatttaaatcaaatgcatatctcagcaaaatttcaaattgttatgtatttataggattgccaacagttaattgaaacttgtcattgttaaattttgctttaaataatctccaagagtaatgagtggctgggcactcactcatggctgtaatcccagcactttgggaggctaagacaggctgattgcttcagcccaagagtttcagaccagccagggcaacatggcgaaaccctgtctctacaaaaaaataaaaaaattagcctggcatcgtggcacgtgcctgtagtcccagttacttgggaagctgaggtgagaggattgcctgagcctgggaggcagaagttgcagtgagccaagatctcgccactgtactccagcctgagcgacagagccagaccctgtcttaaataaaataaaattaaaaaaaagagtgatgaaggtatgacattcctgcctgctgaagtaatctgagaagcctctttaagggggagttctctcaagaatattatcctcaacatttttaccttttaccttccttctcctgtggtagcttagaagtaaatattcataactgggaagtttgatgatcagtgtttagttgtaaattcttttaaaatgcacatacttttaagccatctagagattgtgtggattgtctcccttagccccactaggtgcttctctgtcctaagtagtctagaaggccaaaaactatttctcagactattttgcatttagggttctagatataaaatagttgtgacaattataatatatatgtgggagatttgaagggagtttatgttttcttcgtttttgtggtctgggtcatgaagaagtgagattttgccaacagtagcagaaatgcagcatagcattatttattctccagcatcttgagttatcaagaggcttttgtggttaaggcagcagctagactgttttattgtgtacatcccctagctgggtatttagaggcagttgtgacagtggcaacttcctgattcaagctttccaatccttggatcacagttatctgccatgtgttcttggatttagtggtcccattggtagcttcttatgatttcagttctgtagtgttctggtagtcactcctggagacatattcctatagccccattcctccattctttcccgtaactaagcatctaattcctttttaactcccctttgctcagaatatctagtggtttctattccctccaccaaatactgattgatcaaagtcaagagcatcctttggtgacaaaatgctactcttacatttagtagatggtactgtatgtgatgcaggatttttcttgaccccttctttggacttgtgatggaggtgccccatttactctgcttgcagccctcaaccccttgcaggagggagcacgtgagcaagtgaatgcgggatctggctggctgctttgggtgctggcaggagcaagtttcatgtgggccctgcgatggcacccaggttggggtgcctgcaacccctgaagccctagagggcatgttacaatgctgtcttagctccaccgtctgtggacagcggtgtgttaccagctcagtaggctccttgccttgttgcgtggggcagccgccctccactagtgagggcaaagggccagtgtgatagcctttatttatttatttattttttagatggagtttcgcccttgtcgcccaggctggagtgcagtggcacgatcttggctcactgcaacctctgcctcctgggttcaagcgattctcctgcctcagtctcttgaatagctgggattacaggtacccgccaccatgccccactaatttttgtatttttagtagagatggcgttttgccatgttggccaggctggactcgagcttctgacctcaggttaatctgccgtctcagcctcccagagtactgggattacagtgtgagccaccgcacccagccagacagccttttttgggtacctgcacttggtgggtcccaagttcttgtctggtgtccaagaaaaatgaggtcctgccagacgcttgaaggatggtggaggcggataattttctttagtgatgaaaatggctcttagcagagaggggagctagagaagagacaggttgggcaggtaatctttcctgaagtcaagctgcccctctgaagtccagggacctctctccagtcaagccgcttctctcgttcgtctttatctgcacaggatgaggggtgggttggccatcagtagttttggaaaaagcaacattcgattggtaaaaagacattattcggaaagaaccaactgggagagaatcggcagacggaagttctcattttgggccacaggtttcaggctttttggtttgaagttggggtttcactgggaacccacccctgtctgcctagaatgtctctgcttcctgcctctatcattgaacttcagatatataaagaagttattctatgatatgtcattgactaagcattaattatgttgacccttttagtgactctaaataaagagctctcaacaaacctatacctttaaagggaagaaaaactatacctgaattacacatgataatttcttagaaggcattaagtatttaatcatatctgaggagaatttggaaatgaaaccatttacagttgcaatttaaccagctctcaagagcattacttcctgtagcttatatcagtgctcctcaaactttaacatgcatacagatcacctcaggaacacttgagggtctgttcaaagtgaagattcagtagatggctgttgggacctgggattctacatttctcacaaactcaggtgattgtaattttgtgaaccacactttaagtagcaaagcctatagtatttacagttataaataaaggtaatattttacatttctatttatttgaaatttctttttgaatattaccatatcatagaaatttacttttttaacacaaaaatggaatattgtgcactactcagtagcttgttttttttcgctcagtggtatctcatgaataaccttccatatttttttaatggctgcataatatttcaagtatgaatatagcataatttataggcagtctcctcttgaaaaaatgtataaatgggaaaatgctttcccaaataatgtggatgtgaaaattcttatacttctatacttggtatttctgttgagcaggttcctataatgggtatttctaggtcctagttcatgtgcattttaaattttgatcacttctgccaaactaccctcagaaaaggtttgaccaaagttgccatctcattaacaaattatgacctgtttctcttgccgttgtcactggatagtgtcttttttttctccctgagacggggtcttgctttgttgcccagaggtggagtgcagtggtgcgatcttggttcactgcaccctctgcctcccgagttcaagcagttctccttcttcagcctcccgaggagctgggattacaggctcgtgccaccatagcgggtaattttttgtgtttttagtagagatggggtttcaccatgttggccaggctggtcttgaactcctgacctcatgatccaccctccttggccttccaaagtactgggattacaggtgtgagccactgtgcccagccaatagtatcagcttttaaaaacttagtcattgtgggccaggcgcgtggctcacgcctataataccagcacttggggaggccgaggcgggcggatcatgaggtcaggagatcgagaccatcctggctaacacggtgaaactctttctctactaaaaaatacaaaaatattagccaggcgtggtggtgggcacctgtaatcccagctactcaggaggctgaggcaggggaatggcgtgcacccgggaggtggagcttgcaatgaggcgagattgcgccactgcactccagcctgggcgacagagcaagactccgtctcacaaaaaaaaaaaaaagaaaaaaaaaaagaacttagtcattgtggaagatttaaagcattcattgtattaaggagattggatattttcgtgtgtttttcagccaattgtaatatgggaattgatgaactgtccatttttgttggattattttcttttttgagtgggtatgcttgctcatttttgttgtagcatttataaatattccttagaatacagatgtttttatactttgtgacttttgagtttctaatattgtttaaaaagtattaaaaaattctctttaaattttggacccataagcagctcatttgaggagcttgtagattttatgcaaacatgagcccatgcttctgtaggaaaatcttaaaactgaggtttaaggtggtgcctctaacctgtttaattctcgttcagatcaaattctgaaataataaaaaggtgggttttggaggttttctgtgtatgtaaactggaataaaaaagtggtttttttttgttttttttgtttgtttttttacttagctttatcctaaaataagaaagttgtctcttgagatttttgaaaaagtagttgcctcccactctgctaaatataggaatgtcattcagcaatttggttgtgattatttttatgtatgtatgtatgtatgtatgtatgtatgtatgtatgtatttatttatttattttttgaaacgcagtcgtgccctgtcgcccaggctggagtgcagtggcatgatctcagctcaccgcaacctctgcctcctgggttcaagtgtttctcttgcctcagcctcccaagtagctaggactataggcgcacaccaccgtgcccggctaatatttgtatatttttggtagagacggggtttcaccatgttggccaggctggtctcgaactctgacctcaagtgatccgcctgccttggcctcccaaagtgctgggattacaggcgtgagccaccatgcctggctttggttgtgattctacctggagagtttgtcatactcttgaatatgggcctgtctgcacacatgtgtgcatccagattatgattctccactgtgactgcttattggaatctcttgggagtttttgaaaatggtaatgcccaggtgtccccctcagtcctcttcctcactccccccatattctgatatatttggcctggggtttgtggcttgtttaaaagcttcctagatggctgtgcacagtggctcattcctataatccctgtgttttgggaggctgaagctggaggattgcatgagcccaggaatttgagaccagcctgggcaacatagcaagatcctgtctttaaataaaaataaataaataaataacagtcaattaagagcttatgtgctactaaaattgagaactacttgatcaaaggataggggatgatggtgcaattgatgttaaagcttcagctaggacagttgacataatcagacttactaatcaactttttcaaaatgcaaaactttaaagtaaatacagctgctctgagcctggaatgttattttctttagattactaaaatactatactgccacattcatgggagttctacagatgtactttttcggagcctgtgtagtgggaaattgtttagagcagtagttcccagttctgtctgcatgttaggatcatctggggaccttcagataaaaatgttggatgaaaatatatatattcatattctacccttgacagttgaatcagaattgctgggggcaaagcccaattaatggtattttttaagttcctcaggagattcttatatgtagccagaatggacaggggtgggtggtactgatttagagttataactagacaagatgtaaggttttaggttgttctattgtcctaaaagttaaatgtactgctgctagtattagtactagttttctgattatagtgattttactcaaactgtttttgtttggtttgtttatatcctttaaaaaggatgaagagctctttatttcagccaagagcttgaattggcttttcactgaactatcagttttggtggcacaccgaagtgaatttctctcctttgacaagtccttgtagggagtggtgctataatcataaattaaaaaataatttctccatgtattcaaatcctactagcctattttatcctggaccaagacacttaacctctgtaacctcatctgtaaaatgtaaatcatatctaacttgcataaaatattgatgtgagtattaaatgaaataatgtatataaagtatctagcattgtgcccggcactaaataatttcaaatctatgttctccttttcagcattcccttttactctcattgttctttctttcttttttttttttttttgagacggagtctctctctatcacccaggctggagtgtagtggtgcagtctcggctcactgcaacctccacgtcccgggttcaagcaattctcctgtctcagactcccgagtagctgggactacaggcatacgccaccatgcccggctaatttttgtatttttagtagagatgaggtttcaccatattggtcaggctggtctcaaactcctgactttaggtgatctacccgccttagcttcccaaagtgctgggattacaggtgtgagccactgtgcctggccctttttttttttttttgagactgagtcttgctctgttgcccaggctgggtgcagtggcctgatctcagctcactgcaacctccgcttcctgggttcaggtgattctcatgcctcagccacccaagtagctgggactacaggcgtgcatcaccactcccagctaatgtttatatttttagtagagacaaggtttcatcatgttggtcagcctggccttgaagtcctgaccttaagtgatcacctgcctcggtctcccaaagtggtgggattacaggtgtgagccaccacacctggcccacattgttctttttaaaagaacttcactacaggtgctccagtgcaggctagattacgtttatagttgaatactttaagtttcatacaataaaatttacactggagcatacagttctctgagttttgataaatgcctagagttgtgtaaaccaccaccatagttaatttacagaacagtttcccctcaccatcacccctcaaatttctttctaccccattgtttagtcaaaccctcccccacctttaatatttggcagctctggatttgtaccctatccttacttatttatttctatttattttcactcattcatttaagacagggtcttactctttcgcccaggctggaatgcagtgatgcgatcataggtcactacagccttgtgctactggactcaagggatcctactcacctcagtctctagagtagctgggactacaggcatgtgtgtcatcatgcctggctaattttttaaaaatttttagtagaggtcttgctttgttgcccaggctagtctgaaactcttgggctcaagcagtcctcccgccttggcccctcaaagtgttgggattacaggtgtgacaccaatcgcccactccagccccacctttttttttttttttccccaaagagagatggggcctcactgtgttgtccaggctagagtgcagtgactgttcacagatgggatcctagcacactacatctttgaactccttagctcaagtgatcctcctgcctcagcctcctgagtacctgggactacagggatctcccacctcttctggcctgagccctgtaattttgccttttccactgtgtcatttaaatagaattgtaaatcaatttttaaaatgggcttttattttcttgttaggtttttagatttttaaaaaattattctaggtacaaattcttcatcagaaatgtaatttgcaggtatcttctcctagtctgtggtatatcttgtattttcttaacagtatcttttactttcgatggatttcagtgtatccgttttctctaatggattgtgcttttgatgtatgtacgaactatttgtgtaactcaaggtcacaaacattttctttaagttttacagtctgatttacatttgggtctgatccattattaattttgtattaaatgtgagctaaagtacattttaaaaatatgtacatcttaattattccagtactacccagcactttgggaggccgaggcgggtggatcacgaggtcaggagatcgagaccatcctggctaacatggtgaaagcccatctctactaaaaaaattaggcgggcttggtggtgggcgcctgtattcccagctactggggaggctgaggcagcagaatgatgtgaatccgggaggcggagcttgcagtgagccgagatcacgccactgcactccagcctgggcaacagagcaagactctgactcaaaaaaaaaaaaaaaaaaaaaaaaaaaaaaaaaagactttttccccgttgaattgttttatcacttttgtaaaagatcacttttgctgtatttatgtgggtctatttctggtctccattccattcttttgatctgtatatctttttgccagtactgtaacttcatagttatgttttgaaatcaggtgttctgttttaaaatttttcaaaatttggccactctagtttccttggtattccatataaaatttagaatcactttgatgtttatccaaaaaatatttggagtttgattggcattgagtggaatctataggtcagtttgggaagaattaacattttaattatgttgttttccaatccatgaagatggcatctctctccattatttaggtcttattaaaatttctttcatcaatattttgcagttttccgtgtacacgttcttcacatattaaatttatacctatgtatttcacgttttggtgctattgtaagtggcactttaaatttttttgatcttcagttattcattactagtatgtaaaaatatagctgatcttttctttctttctttcttttttgagatggagttttgctcttgttgtccaggctggagtgcagtggcgccatcttggctcacttgtaacctccgcttcccgggttcaagtgattgtcctgcctcagtctcctgagtagctgagattacaggcgtctgccaccatgccctgctaattttttgtatttttagtagaaatggggtttcatcatgttggccaggctggtcttgaactcctcacctcaggtgatccacacaccttggcctctcaaagtgctaggattacaggcatgaaccaccgtgcctggcccagctgatctttttatattggccttggacttcgctaaactcatttcttctaggaattttttgtagattaatgggattttctgcatagccacatacatagtcatctgattagaaacagcttttttcctttccaatttcttttatttctttttcttgccatattgtatttgtaagactccgtccagtacagagttgactgagagtgactgggcagctggcctagaagtgcctcttctaggcacttctttttcgtttcctagtttgctgagagatttttatagtagtggatgttgaattttgtcaaatgctttatttatatcctatcctgtgacttttcttcattaggcttttagtgtggtaattaaattgaattttgaatatttaaaactatccgtgcaatcccaggacgaaccccacttgattgtggtgtaattatcctttttatatattgctagattgtatttcctaatatttcattgaggatttttgcatctttgttcatgtagtaattttcttgaaatgtctttgtcggattttgatatcagtgtgatcttatggaaattgggaagtggtccctcctattctagtttttggaagagtggtgtagaatttttttttttcttccttgaatgattagtagaattttccagtgacaccatttttggtccatgagttttctttgtgcaagagagttaattacatactcagtttgcttaatagatataggatcattcgtgttgtgtcttctttagtgaggtttagtaatttgtgtctttaagaagttggcctgttttattgagttgatgaatttaatgggcaaagagtttgtagtatttgcttatcatcctaggtagagttttattagtttcattgatctttagcactagcttttggttttgtttctcggtttttttctttttttttttcctttttaatttcattgacttctgctgtttattattccctttcttctgcttgctttgggtttttctttttcttttttttcctgaagtgtttgagatctttctgattttcttacataagcatttaatatgataaattttcctgtaaacactgttatgtcccacaactttgatatgttgtattttcatttttgtctagttcaagatatttctaattttctttgagatttcctctttcaagcttggatttagcaaaagatggtttaatttggaagtaggctgtctacatattcagtggattactgagagaggagtgttgaaatctcttaagtataattgtggaatcatctatttgatttctatcagttttttctttattttgaagttactgctgctaatttttcttgttctggagtttgctttgtctgatagaaatatggccactgtagccttcatgtgattagtgtttgcgtgatatatcttttcccatctttttacttttaatctgtatatatcaatcattacattgaaaactgagctgttatggacagcatagagttttgccctttttaaaaaaaagatctgagcggttgccctgccttttaaatggtttgttttgaacatttacacttgatgtaattatttacgtggttagatttaggtcttttaaaattacttttctctttgttcctcctttttctgccttttggattacttgaaatttttaaaatattctacttgatatatttattggctttttaaaagcttttctcttggtcttactattttagtggttgctctagggagtataatctaactcttgacattctagttaaggtaaatattttaccttctcaaagtaaaacaggtttttttcctagcctctttatattacagttgtcgtatgtgttatgtctagaaacatttaactcttcctaccaagcatgatgttacagttttttatttcaacagttttataagttttcaagaatttaagtggagaaaaatagtgtataatatttacccaggtatttaccatttctgtcgcttttccttctttcctgtagttccaagtttacccccatatcatttcccttccacccaaagaatttcttatagcttttcttttagagcaggtttcaatctctctctctccctctccctccctccccctctccctccctccctccccctgtccctccttccctccctccccctccctccctccccctctccctccctccctccccctctccctccctccccctctccctccttccctccctccccctctccctccccctctccctccctccctctctgtctctctccctccttccctctaccccccgccccgcctccgccaaagacagagtcttgtctgaggctggaaggctggagtgcagtggtgtgatcacagctcattgcaacctcagcctcctcagctactgggactaatacgccaccacgcccagctaattttttgtagtttttgtagagatggggtctcaccatgttgctcagactggtctcgaactcctgggctcaagtgatcctcctgccttagcctcccaaagcactgaaattagaggcatgagccactgcacctagcctgttttttgcttttttgtctgataatgtgtttgtcttcatttctgaactatacttttagtgaatacagaattctagcttgataccttttgatatcctataggggcctgagagattgtttgtttttaaaaaatatttcttctctcttttgttaagattggataatttgtgttgccatatcttcaagttcactgactcttctgtcatcttctttctgatagtgagccggtccagtgagtgagttctaaaattttcatttttttaaaaaatagtaaactctttcttttttgagaatttcagaccgggctctgtaatcccagcactttgggaggtcaaggtgggaggatcatttgagtctgggagttcgagaccagcttgggcggtatacaaaaccctgtcgctactgaaaatacaaaatattagctgggcacggtggtgcatgcctgtagttcagctgctcaggaggctgaggtgggagaatcacctgaaccaagaggttgaggctgcagcaagctgagattgcaccactgcactccatcctggacgacaaagcaagaccttgtcttaaaaaaaaaaagaggattttggccaggcgcagtggctcatgcctgtaatcccagcactttgggaggccaaggtgggtggatcatttgaggtcaggagtttgagaccagtagagggggtttcaccctctctactaaaaataaagaaaattagctgagtgtggtggcatgcccctgtaatcccagccactcaggagaattgcttgaatccaggaggcagagggtgcagtgagcctagatcacgccactgcactccagcctgaatgacagaacaagactccatcaaaaaaacaacaaaaaagataatttcacatttcatttgttttaaggtgttctttttttacctaatggatcatggttgtaataactgctggcctgtaatccgagcactttgggaggccgaggtgggcagatcacctgaggtcgggagttcgagacctgcctgaccaacatggagaaaccctgtctctactaaaaatacaaaaaattagacgggcatggtggcgcatgcctgtaatcccagctacttgggaggctgaggcaggagaattgcttgaacccgggaggtggaggttgtgggagccgagatcgtgccattgcactccagcctggtcagcaagagtggaactacgtctcgaaaaataaaaaataaaaataaaaaaatataaaataactgctttaaaagtctttgataattgtaatatctgggtcatctaggagtcagcatctgttgattatcttctgctttaagaattggtcagttttttgttttttgtatttgctgtgtttggtagtttagattctatcgcggacattttgaatattgtattgtgagattctgagtcctgttgaagtgctgtagagaaagtttaagatttgttttagtagacaaattgacctatttagtttatacctgcaaattctttctcatcttacataggcagtggttccattatctcttcagttttcaaagtctttgccatgttgtttgcatttgcccctcccattcccactttggttgatctagcacttgagcagtgatttatatcctaattttattgtgaaagcctcccttacacttctttggatctgttccatatatatatagatagcttgcagctgggcccacagacttagggatctacttttctgtctcttaatcatcagtgatttcacctatattcttcagctcccaggggccttctttattcccctagccagaagcatggaattatagtttgagtctcctacctgtcatgcctcacatggcagtgagcacatttagggagcccttgccctaaccatattaaataaaaacatggtggtggaaactaggaatctgttttaacaaaacttaccatagttacttttgataaaccaataacagatttgggaacttgtggctagaaacaatatttggcactagcaacatcaagttatactccctcccctctgttttttccctttttgcaagttgaggctcttaacaattcctgaaatagtttaccccaagcaccctatccagtggtagaaaatacagtgtactggatgccacaaagttatagtcatgcaattttagttaataacaggagacttaagtctcttgattgatggagagacttaagatttagcttattttacatatagctaaatctaaattagtgactttatttcagttgtaggcaaatcctcttgttaaaacttgtttttaatttctgagttcttttaaaaaaaaagttttacatcacatttctaagagctggagatgacagtgtctctgttttctgttttctctacaaataaacgtataacttaggatcagttaaaatatttcttttcacatcttaactcttatagatgggtggtgtctatcagcagtgctctgttaaagacagattcttaggggagtgtgggtccagagaagtaaggagtacctagattagcaaaatgtactaaggtgagtaagtgagtgtctgtatctttggcttttggaggggagtatgcatgtgtgtaaatttttctgtaacaaatggtactgtcgaaaacaattgacatacatttctttcatgacactatttttatacaagattactttaaatctgtagctaactacggtctgcttgtggtgaagtaaagtggttttagtccacagagatcttttttggaaggttatttgatgtagtaaaattatatatgagataaaaataagcagacacatgtttgagttccacttctgctattgtaactagctcttgtatctttgaatgagtcaggccttgctgacttcttaggccccgttgcattttgagttaaaattttgtgcacaaatagtgagctcactagtttcatgggaaatggagatatttgtgacagcattgaatgataaggcagtaaactttggttttatttcatagtggtaacttttctttcttgaaatagcagcctaaaagtatgccctgtaaactactatgtggtacagtattttttcattttggttaaatatctctgaagtatccttctaacttaaaagtgatttgaactcatttgaactattcagtgtataaggtattaaattatttttttaaaagagactgggtctaactatgttgtccaggcttcactcgaactctggggcctgagatcctcctgcctcaacctcctgagtggttaggactataggcacatgcgatcgtgcctgagtgttggaaattttccttttttaaaacaaatttttttttttttgagtcagagtcttgccctgttgcccaggctggagtgcagtggtgggatcttggctcactgcaacctccatctcccaggttcaggtgattctcgtgcctcagcctcccaagtagctgggactacaggtgtgtaccactacacctggctaatttttgtatttttattagggacgggttttgccttgttgcccaggctggtcacaaactcctgagctcaagcagtcagcctgccttggcctctctaagtgctgggattacaggtgtgagcaccctgcctggctgaaattttgattacatttagtgtgctgatgtggcagtctgctgaaattattttttttttgcaattaagacagcgccggatttactatagtaacttactttctgtttaatttctttttggcttatttttaatcctaaagaaacctgacatagtagtgtggcagactatgtttaaatagtcttgatcttatcattcaaatatatttccttagaggaataaagaaataactctagggatggaaatttgggtggagtattgtggaaatttaacttcaacctaggagttcactaaatgtccatgaagtgctattaccttaaaatgactttttttcccctccttctttagaatccagcaactatcacaagaatactccttagccacttcaattgggataaagagaagctaatggaaaggtaaggaactatattgtcagctttgtacttagaagtaacacagaaagcctattgaaccgaatttacaagaatcaagtaagggaattgatgaatataccagtatgtggacaacccagtgtgcaactagtgactgctttaatttcttgtattccccttttgtaaattttgcagtaaatttaatgttagggagttcagtcttagtgtttctttttatttgggagtatgtgtgtttgggggtgtgcttcagtatcttctacatatatcctcttgggtaccaagaactgaaagcaggtagagaaaaaaagcacctgataacattcttggagtacatgagtaagatcctcctttaattacttaaaaagatttcttgctcatccgggcatggtggctcacgcctgtgatcccagcactttgggaggctgaggcaggtggaacacgaggtcaggagattgagaccaccctggccaacatgctgaagccccgtctctactaaaaatacaaaaattagctgggtgtggtggcgtatgcctgtagttccagctactcaggaggctgaggcaggagaatcactttaacctgggaggcggaggttgcagtgagcagagatggcgctactacactccagcctggcaacagagcgagactctatctcaaaaaaaaaaaaaaaaaaaattcttgctcacaaacctttaacctgttattagtagcatttattcagtagaaacaaaattgagaagttgcttaggcttttctggccaccagaccaggtgcttggactggttctctggtttcagggcaggattctattccattgggtttttaaaaatattttctttctgaaaatctttatagttttaaaagagaagaaattagtgggactggagaatgacagtattaatgtcattcttaatcttgttctgctctttggtttggaaatttgtttgaatggaaatttgggacacttgttaatggtgaggttgacaacttatgtttatttcattatcaattctaaatttaataaaaaattaaacctagttgttgggaactgacaacccatatattatagaaataaatggaaagtatttcccatttgattttaaaattcagagagtactttataaaacataaataataccgagaatatcaccccatttcatacaccttgtatctattaaattacattgtaaataatatctattgttactattaaattacaatttaatagtaacaactatctcaaaacaaacacatactgtataaagctttcccatggttcatgaaggataacatgttcaactagtttgatttttctttttatgcattctgaccatgttttttttgtttttttttttttttttttttttttgagacggagtttcgctcttgttgcccaggctggagtgcaatggcgtgacctcggctcactgcaacctccacctcctgggttcaagcgattctcctgtctcagcctcccaagtaactgggattacaggcgccctccaccatgcctggctaatttttgtatttttattagaaatgaggtttctcagtgttggtcaggctggtctcgaactcccaacctcaggtgatctgcccgcctcagcctcccaaagtgctgggattacagttgtgagccactgtgcccagccctgaccgtattttttgacatcagtggtgtttcttaattttggtaacatttactttcaggtttttttatttgatgacacctctactaggagaaagagtttttatcgtttacttgtgaaactctaatgaattaacactgatttactcagagtttctctcatattaatgtatttctccaagacattctgaattttatcctataacactgctgaaaatatttttccattaaatattgtacttaatatttgtgtactattggatttaatgttgtactaaattttgtactttatatgggaactgtagcttctgctcagtttttctgggaaccttaaactgtctaaaaaaataggtggtaagtgtgaatttaaattaaaaggaggtttctgggaaacttctgagtatgtgaacgtttcagtttctccttgtagtttctgtagagaagctattggatacctaaaagatttataattcagtctttaaatagtgtctttaaaatcaatatgcaatatctttttgtctcatttaatgattttcacattatattttatgttgtctgctattagcactgccacactttttttttttttaaagcatttgactgatgtatcttttccattttttaaatattcaacctttctgggttttaggagtgtcttttgtaaataccatgtaggtgccgtttaaaaaaatctgaatgaaaaaactattatcttttaatatcagagattaacatattcatgttttataattaatgtttagattaaattactgtcattttaagttgtgctttatatttgttatgttttctgttcgcttattctgttggcctcatcagattttcctttttctcgaataatttcaaatttatatatgtattctatttcagtttttctagtcacttttacaatttgtacatgcctacttacaactatataaaagtttctaacaatatttacttgaagttttaatccatcctctgtacaagacaaaaactgtagcataaatttttttctttgtcctttccttgtccctatcagcttgataagttgatgtttgaatttttttttttcttttctttttgaaacagggtctcactctgtcacccaggctggagtgcagtggtgagatcatggctcactatagccttgacctcctggactcaagcaatccttccatttcagcacccccagtagctgggaccacaggcacgcatcaccatacctagttagtttttatatttttttgtagagatggggtttcaccatgttgcccaggctggtctcaaactcctggacccaagcaaccctttcaccttgaactcccaaaatgctggaattacagacatgagccactgtgcccagtcgatatttgaattttttatttgattgtaagcatttttactatgtatgtatttaatgccccccccccccccttttctggctaattcgctttttgcataccactattttttttctaaatacactgtttttcttagaatatatcctgtaatataaattgtttcacatgtgacaaactttaagtcctataatagaaactcttaatatactgaaacttactgtaatatttctggatgtgagttttgaaaacataaactgttgggccctttaagtctgacaattcatatttttggttttggaaattctcagctgttatttgttcagcataccttttctccattctcttgatgctttctggaattcctggatccatgttgaaacttggggatctctttccatgtcttctaacttttttttttttaagatggagtcttgcctctgtcagccaggctggagggagtgcaagtggtgccatctcggctcactgcaacctccgccttgtgagttcaagggatcctcctgccttagcctcctgagtagctggggttacaggcacccaccaccatgcctggctaatttttgtatttttagtagagagagggtttcaccatgttggccaggctggtctcaaactcctgacttcaggtgatcttcccctctctacctcccaaagtgctggggttacaggcatgagtcattgcatccagcatgtcttctaactttctaaaaaatacttcttctgtattcatctccccacccccagcacttgggcaagtgccagtgactgtactcatctttgtttttgactttgttctgtgaaaattcctcagtttatcttgcttttcttcctgcatccattctgctttatagtcgtattgaattgtttattcaacagtatccatcttattccttttaataactttgttcttgttttgtgggtacaatttttgctttatctctcggtttattcttacattaaaataattagaattaaataatgagaatacaaagatgagatgtggctgaaaaggtccagggcaatttacagtcttaagggtttttattagaaaaagaaaatgaggtaaaaaactgggctgcgcaccatggctcacacctgtaatcccagcacattgtgaggccagggaaggcagctcacatgaggccaggagtttgagaccagcctggcctacatggtgaaaccccatctttactaaaaacacaaaagttagccaggcgtggtgatggacacctgttattccagctatgcaggacgtggaagctgaggcacgaaaatggcttgaacccgggaggctgaggttgtggtgagctgagattgtgccattgcactacagcctgggcaacagagtgagactctgtctcgaaaaaaagaaaaataaaaacaagagaatgaggtaaaaaaaaggaccaagcctttgaaacaggaagttagaaaaataaaataaacccaaagaaagtagaaaaggtatttaagataaaattagatattaatgaactagagagcaacaacaacaacaaaaaagataaagatctttgacatgaattttctggaagataagctacagactgagaagatatttgcaaaagacacatgtaacaaaggactcttgtccgaaatatacaaagaactcttaaaactcaacagtaagaaaacagtctgattaaaaaatgggccaaagagcttaacagacacctcaccaaagaagttatacagatggcaaataaatgaaaagatgctccatgtcctatgccatcagggaaatgcaaattaaaacaacattgagataccagtacatacctattagaatggccaaaatcaaaatactgactaccaaatgtggaccaggatgtggagcggtaggaactctcatcatttctcgtgggaacgcaaaatggtacagccacaaaatggaagacagcgtggcagattcttaaaatacaaaatgtactcttactatgtaactcagcaatcaaaacttctttaaaattacccaaatgagttgaaaactgtgtccatacaaaaacctgcacatggatgttcatagcagctttattcataattgccaaaacttggaagcaaccaagatgtctttcagtagatgaaaggatgagtaaactgtggtacatccagaagtgggatattattccgtgctaaagaaatcagctatcaaaccatgaaaaaccgtggagggactttaaatgcatattattaaatgaaataagccaatctgcaatggctgtatactgtacgattccacctatgtgacactctggaaaaggcaaaactatgaagacaatgaaaagatcagtggttgctaggggttagtgaagagggagggatgaatagtcaacagcacagttttttttttttttgggtgggtgggggcctaaactattttgtatgatactgtaatggtggatatgtatcattatgcatttgtcctgacccatagagtgtataacatcaaataagaacccttatgtaaactacagactttgggtaacaacggtgtgtcaatgtaggttcattgaatgtaccactctgtgttgttgatagggaggctatgggtatgtattaggacagggttatatgggagctgtagcttctgcatatgtttgctgtgagccttaaactgctctaaaaaataataagttttttttttcttttaaagggggaaataaaccgttggcaaatgtgttgggggagggggagaagacacaacattgagaataataaggcataattagaggtaggaaaaataccgtgtgctacttttacatctttttttttttttttttttttttttgagatggagtctcgctcttttgcccaggctggagtgcagtggcgcaatctcggctcactgtaagctccgcctcccgggctcacgccattctcctgcctcagcctcctgagtagctgggactacaggcgcctgccaccatgcctggcgaatttttttgtatttttagtagagacggggtttcaccatattagctaagatggtctcgatctcctgacctcgtgatccgcccacctcggcctcccaaagtgctgggattacaggtgtgagccactgtgcccggccttttttttttttttgagatggatggagtcttgctcggttgcccaggctggagtgcaatggtgcaatgtccactcattgcaacctctgcctcccggttcaagcgattacaggcgtgcgccaccatgcctagctaatgtttgtattttttggtagagatggggttttgccatgttggccaggctggtctggaactctgacctcaagtgatccgcccaccttggcctcccaaagtgctgtgtgagccactgcgccagcccaagctggtccacttttacatacatttgaaagcttagaaatggaaattacctaaattgtccctcaagaagaagtagaaaaatagagtaaacccataaccagaaaaatatggtgaatatagtaaaagattccactccttccccaaaaagtactggatgattttatgggtaagttctgtctcataaacgttcaaggaactgccagttcctgtagaaaattatctccaaacattgaaaatggtaggacatcattaattcatgttagccagatcagaataacccagttccaaaatttgacagacagtaggagaaaatgatacttataaatatagctgttgaatttataaataaaataatgattgaatcaacgactcttagtaggatttctctttttttccttttgagacagggtctcactctgtcacccaggctggagtgcagtggtgcaatcttggctcactgcaacctccgcctcccaggttcaaatgattctcccgccttagcctctcccaagtatctggaactacaggtgcgtgccaccatctctggctagtttttttctttatttttagtagagatggggtttcatcatgttggccaggctggtctcgaactcctgaactcaagtgatctgcccgcctcagcctcccagagtgctgggattataggcatgagccactgtgcctggccaatttagtaggatttctcctaagaatgcaagaatagatcatcatcgggggaaaattttttcgtttataacatttacaacattaacagatttatgaagataaagaataatcataataaatgtcagttatgcattttaataaaattgtgtattaactcgtgatttagtgaaaactagattcttagcaaactgagaaagtgatttctcagattgattaaaggtatcaactaaaatctacaataaaattatagttaatgttgaagcatcagaaacatgcccattgtaatcaaacaaggattatggctgtcaccaccatttgaatgtattggaagttctgataaataacgtaatacatggaaaattaaataagtggcataaagactagaaaggaagataaattatatgtaaagtatataatctaggaaacccagaagaatcgactgattaactattaaagtgattgcccattaaaatcacctgagaagtgaaaaaaacccacagtgcccagtccctttccattacttcttccttcagttctcttggaaaatgaaaagaaacatggaatgtaagtagttgtagcttcggtgacccctgtgttcctccacattcttttttttttttctcaatttttttgtagaagcagggtcttgctatgttgtccaggctggtctcaaactcctagacacaagcgatcctctcacctcagccccacaaagtgctgggattgcaagcgtgagccaccacgttcaatctccacattttttgcatataaaaattgaggttacccatatggtaatcctgtaggtatttagtatcctaggaattgttaagaaaaggtaagcaatatacctacctttagtctacatatagcccataaggtttgtaacatcgtattttttaaaaatcgtgcttcctaatgggtaacactgaatgtattaaagtgtcatttctccttatttcgatatatttaaagataaatcttatcctagttaaaattgtgaaatattttaaaactttcttttcctttgtcatttccatataccaggcatattagtatttctttttattttattcattagtaagccatagtccctgccctggagggaggtgcccatggtcccctgagggcaatagaggtataaatagatccttgccagttattcctcttgtttgccccatgcctcttagtctgtagtttaaacaaatttatactgaccctaaaaatgaatgtgattttttctttttaaaaatatattttgaggcaggtacagtggttcaaccctgcaattctagtgactcaggaggcttaggttggagggtcacttgaagccaggagttccagaccagcctgggcaacacagtgagactccgcctttaaaaagaagtaggaaacttagctgggcatgatagtgtgtgcctgcagtgctgcctaccagagaggccgaggtgggtgtctcacttcagtgcagagactgcagtgaaccctgatcttgcactccaacctgggcgacagaggaagaccctgactcttaaaaaattaaataagatataaattttgggcaaaggtcggagctggtggagaaaggacacctttaactttatggtcttttcttttatccattatagcagttttccagaccactgtcattttctttcttttactgtctaatgcttttttttttttttttaaatctctgcagattaatttctcttctgttttacaaactaaatagaattttctataattactaatttctttccatgcctctccagatgaagcaaagcaaagcataaaatcagaaatacagcaacaactgttatctgtcaagtcttccatctgggttttgatactatcatgatttttgtgggatattgcctccattatttcatctgtcatatcttgaaccttttcctcctttcttggtatatcagtcaggatttttcattataaacaaactttaagaagttaaaagtgaaatagacattaaagattgagaatcttaggtgtgaaggttgtgcagtcaggaaaatgccaaaatcagaatgtcaaactattttagtggaggcactgttgctgctgccattgggcacaggtatcactgctgataacatcaatattgggcatatgacaccacaactaatacctctgcaacgtctgaaagctggatatctccttactcctttgatagattacctcattgaaccttctttgagtagtgagtttttgataaactgtctccctgctcctgcctgggaggaattctctcacctggagggatgggaaagtgaattgtgtcctctgtttaccttgctagctttttttttttatctccgtatccttatgtctgttctcatattacactttagtagtacaaaacttttgtgacagtcaccaaattcatttttctgctgcctcagctttgcaattgtgttttgacccagggcttctgtttactgtgcagctctagggagcatctttggaattgtactgtcattggcccaggcctgacttgcctttcttactgtcttttttcctaattttccttcaaaactcaagttaaccttttcttctgagacagcttttcttatctctcaagatctacttgctttgcactgtattgtttatttgatttagtattttaccacttctatttgaggttctttgtgcagaaactatcctacttttcttgtattcctacacataacgcagttcctaatatatagccattgtttactaagtattttaattaaatccagccatttataggttttcttttctgtaatagaattttattgaagttatgacatgaatgtaaatcagatttcattttgggagcttttagaaacagcatcaacaatggagctacttttaagttgataacaagtaaaaaaaaaagtgtctttcttgcagctcagatttcttgtaggttattaaattataataacatttaaaaactcatttcagttgatagtatggtagtatatagggtaaatgctaatgaattaattggtgtgtttgaggtgggatgaaatacaggtggttgaaaacttaaccacctataaaacttaattatacttggacaggtataattaaagaatcctgaagaaggatttcagtctttcctggactctgttacaaatagcttttcacttttcattctgaagcattaatacccatttaatgggtaggtactagtgttaatacttggatgtgattatgataacatggaactttttgtagccacattattaataatatataatttcataattagcctcagggatggtgaaagtaaatttggtttttcagaaaccttgcctttttgatgacatttatcactattctacaatacagtgaaatttttcctgtttaaacaatccacggccgggcacagtggctcatgcctgtgatcccagaactttagctgactgtggcaggaagatcgcttgagcgtaggagtttgagactagcctggacaacatagggagacccccatctctacaaaaaaataaaaaattagctaggtgtggtgatgcacacctatagtcccagctactcagaaggctgaggcaggaggattgctggagcccaggagggtggagctgtgatctgtgatcatgtcactgtactctagcctgagtgaccaagtgagaccctgtctcagacaaaaaacaaaaaacaattcacgtattattgaggagagtagtgaagggcaagaggcaaatgtacggctgggtgtggtggctcatgcctgtaatcccagcactttgggaggccaaggtgggcggatcatgaggtcaggagatcgagaccatcctggctaacacagtgaaaccccatctctactaaaaatacaaaaaattagccgcgtgtggtgatgggctcacgtagtcccagctactcaggaggctgaagcaggagaatggtgtgaacccaggaggcggagcttgcagtgagccgagatccaccactgcactccagcctgggcgacagagcgagactccgtctcaaaaaaaaaaagcaaatgtactatctcattatagtacagtgattaagaacacagaattcttgctccccctatctcactatctcacctagactggagtgcagtggcgtgatcacagctgactgcatccttgaactccggggctcaaactgattctctcgcctcagcctccctagtgggtaggactgtgcaccacaacacctagcaaattttttgtagagatgggaccttactttgttgaccacactggtctggaactcctggactcaagcagtcctcctctcttggcctgagccactgcaccctgccaggaattttttaaatatcagctatgtttaagacattgagcaggagcttggtgatgaggagttacacacaacagtgtatcatacaatagaccaccatggtacgtagagataagtttttatggctccatggtacttagagataaatttttatttttgacctaggtgggaaaggatttagtaatgaggtgtggcatttgattggacaaggaagggcagaagtgatatgggaacctgggtatttaaggctcagaaaacaaaactaagtggggcacaaagtttaaggaatatatgttgaacaattatgagattgaatgtctggagtatgcgaagaatagaggggaaatggttggaaatgtttaatgcacgttataagggccttgaattttaagtaagtgaatttggaatttttctgtctttattgggaagcccttgaacgttgttttatggagaaatagtgatggaaaagcattatttcagaaaaaaatctagtaataaatgagctgttttaactatccaggtaaaaggaaaatattgtcctgacttacaatagtgacagctaaattgatagcagagggtagatggaaagagaagtaaaattagttttaactgagacaaaatataggagactctgggaaacttctggtaattttgaccgttcctttcactaaatacactagaagaggctaggtgaaatactgaaacatgtttgaaaagtaagattatcaaataattagtaagataggaaatagaggttcaaggttgagagtttgggaatcaagggaaatttagagaaacaagcttccagtccttgttgctctagcagtgtatgttgatccagaagaggtagctaagagacttagctgtgagttttgtttgccctttgttagtagagggggaagttggaatattaggtctactaagagcgaaaattgaatacactagctccttaaagactgaagatgatcttcatgtcttttgggtagtccagaaaaccttaaaccttgaacttgggttaagatagcccccgtatataacagaaacaaacgtaaatcttctctagggaaataacattatttaagaccttaaactattttctcaaattatttttctaattaaaacataacaacctggaacttaagatactggaattgtcagacctagaccaaaatgagtatgctatcaccagggagctgtcattcagatttggaaaaaaatcagaatttttataactaaacaaaataagcaaaattaactttgtgacatagtttaacagcagactggacaaagctgaagagagtttagtgtatttgaaaatcaaacaatgatccagaattaagtatatccattaaaagatggaaaatacagaagagattaagaaatacagaggatataatgagaaggtctcattgagttttagaaagagaggagagaatgtggcagaggcagtattttaagataaaaatgactgagaattttgcagattggtaaaagacccaaatgtcatagattgaagaaacataacagttcccatgtgtgatagctacttgtttcactgatcctaagatacacagtttttcacattttaacatctgaaatctggatgcatctttcaattattgacaccttacagtccaaaaagattgaaattttgactcgtgaaaaattttccatgtcaacttctgttaagatcatgaaatttcagcacgaaagcattttagattttatgaaatatggtaaaaagaaatccacatttttatttatttatttatttatttatttattgaaacacagtttcattctgttgtccaggctggagtgcagtggcacagtctcagctcagtgcagcttgcacctcccgggttcaaggcattctagggcctcagctttctgagtacctggaattacaggcacgagccactaggcctggttaactttagtatttttagtagagatggggtttcgccacgttggccaggctggtctcgaactcctgacctcaggtgatgtgcctgcctcagcctcccaaagtgctggtattataggggtgagccactgggcctgaccagaaatccacatttaaaaacatcttagtaaaactacaaaatcagcaaaaataaaaaatctaaatcaatgagatacaagaaaggctgctttcaaaagagtgaaagtataggtataataatattctagagcacagctcaacagcaacagtgaaagtgatagtaagatgatacctcagtcttttgaaagaaaataaaccttacctagaatactatgttcatggaaaatatattcataaacagtatgttttaattaatataaatggttttatgttgtacctagcttttgtatctttttaaagccaaccaacattttgttctgccagtgttgattgaagtttcaaatactcataattgttatttaagcaactatttgtctgttaaagggaaaaatcttgcagaatgttgtactttggaatttataaccttaaatgcataatgagctaagcattcatcttaaaagtctcaagtaataagcttagaggtctcaagttaggaaaagaacaacaaaataaatatagggaaaatacaaggaaagaaataaagaacagaatataataaaatagaaaacatgcagtagaagggatcaagaagccgtaagatttttttttttttttaagactgataacgttgacactttgatgaggttaggaaaaagagagatcctaaataaccagtattaggaatgaaaacagagtatcactaggatcttgtggatggtttaaaaaaaaactcttaaaattatggacaactattcaaacttgatagacgaaatgggtagattcctagaaataggcaatttcccaaaactgacataagaaatagtaaacctgtatccttattaagtataaagaaatgaaatccataatttaaaatgttcttataaagaaaagttgaaattcaaatggttatactggaaagttctaccataacatttaatatgacagtaacttcaaccttattctaaagaacagaaaaataggatcttctgccttcataaagatatcataacctttataccaaaacccaaggaaagatgatacaccagtttgtcttatgtacatagatacaaaaaaaccatacatacacacacgcacgcacacaaaacaaaaactggaacaacagaaacacctcagaatattagcaaattgaattcagcaatacatatataaaaaggagggtaacccagcatggccacctgaggtgaatcctgggaatgctaggttggtttaacctgaaacaattcagcatgattggtcacttgaacaaattgatgagaaaaacatttcagagatgccaaggagcctttgcttcatgattttaaaaagaagctattagcaatctagaactttgttaaccttataaatcttacagaaacatttgtaggagatatcatagtttatccactgaaatgttaaaaaagatttcccttttagatgggagttcaagatgtggatatcgtatctccagttcaattcagcattatactagaaatgattctagccagtagaacatcaaaaaatgaaaacaaaatacagtgttgtaagagaaatgcctgtgtttttgggggttttcttttttttgagatggggtcttgctctgtctcccaggctggggtgcagtggtgagatcatggctcactgcagccccctacctgccaggttcaagcaattctcctgtctcagcctcccaagtagctgggactacaggaccatgcccccaagcacagctgatttttgtatttttagtagagatggggtttcaccatgttggccaggctggtcttgaactcctgagctcaaggaatccacctgtcttcagaagtgctgggattataggcgtgagcccgtgggcccggcccctggctgttaatattcactgacaatgtgattgtgtattcacaaacaatgtgattgtacatgtggaaaaatcagaatctggaggtaaattgttagaataaatgtctttagaaagaaatatgaaaaatttcttttttctttgacccaataattccgctctcaggtatatatccaatagaaagaaatacgtgcacatctacattgaaagtcatatataaaactggtggtggctcatgcctgtggactcagcaacatgggagaatcgcttgaggccaggagttacagatcagcttgggcaacatagtgagaccccgtatttacagaaaattaaacaattagctatgcatggtggcatctgcttgtagtcccagctactcaggaggctgaggtgggaggattgctggagcctaggaggtcaaggctgctgtgagccatttttatgccactgcactacaacctgggcgacagagtgagaccctgtctcaaaaaaagaaaaagtcatatataagcatgttcctagcagtatttattcatacttcaacctataaacaacccagatgtttatcactattacactagatagataattatggtatattgacatagtaactattcagcagtgcaaaataaatgagcaaaagctacaagccacagcatagataaatcttaaaaacatagtgaaaagaaaaggaccccaagtaatacctatctactatatggttctacttacataaaatataaaaacagttgaaactaagtttatattgtttaaggatgtgtgtttaggtggtgtagctatttaaaaagggcagtgattaaaacagttgaaactaagtttacattgtttaaggatgcatatttaggtgtaattattaaaaaaaaaaacagggtagtgatcatacgtttaggggggcttgtagagtactagcagtcttctgtttcttgtcctgggtggtatttatatactggtgtttgttttataacagtttgtaagctgcatgtttatgtacttctctaggattgtgttattgcaaaataaaaatcattttaaaacacatatacacagacataggaaaaggatcagtcttaaagggaaggtccatcttttttcctggacatgtaggattaatagttcctttgtacctacaagtaaacttacattttgccaagacagcttttctcactgctctcctaggctctagtatattaaatctatcctaaatttaacttagattgtgttaacttacttgagcaacctctgctacccttgtggtttctgccacatcaaagccatactccccggatttggggtttgaaaaccttgtgtacattcactccattctgtatgtctttgcttataactgtatattccttgggatgccctctgctattcaggcctcaatcttaagagctgtagctttgtacagaatcagagcgtatcaagaatacttcattctggggttgtgctcatagccatcacgtacaattctgtgcatcacaaatcgatgcctcctatgtcttcttattgtctgtattctttttttttttgagacggagtctcgctgtcgcccaggctggagtgcagtggcgcaatctcggctcactgcaggctccgccccctggggttcatgccattctcctgcctcagcctcccgagtagctgggactacaggcgcccgccacctcgcccggctaattttttgtatttttagtagagacggggtttcaccgtgttagccaggatggtctcgaactcctgacctcgtgatccacccgcctcggcctcccaaagtgctgggattacaggcgtgagccaccgcgcccggccttattgtctgtattcttaccacatttaccaacttgtttcaacatcttgaagttagttttctgtacttctctaggattcttctcccattcttgcatgctaagtagcatgtcatactacaaacaggtattcatctctttccttccaaacaattgacattacaactaactagcataattcctacatatagttgctgaataggtgagggaactgtgttaaatggaacttaattatattactaccttgtgttttgatggataatttgttttaacatagctgaattttaaacatacttgtttgattcataggctttcaacttttacagcctgaggacttgcattagatatattgaaaaatcgttatcaaaacaataaaaagacaatttctttttatatacttgaagaaacgatatttctcttcagttggaatgagatccactgttgcatgaatcacaagtagtagtgtgttttattttctagataaaaatgtatagcaggagcaaaagaccattaagcagagggtgtagatttcctttaatgcacgtatttggaaagaggtggacaaaaaaagccactgtcttggttttctttgaagtaaaaatagttttttaaaaataatggttcttgtcgttttggggactgtagtctcttttgaaaaagtaatacaatcttgaaccttctcctgggagtgcgggggtggggcgggggcagagaacatttgtaaataagttataacatttggattctgcccaattgttgaaatgccagggacctccaattacaaatttatgtgtttgatgatcttggtaaaactgaaatagtcataagccagaagtcgtagacaaccaccagtaaagatgacacatgtgtttgtagtgtggctggaacaccctgtgaaaaccagcatctgtgtcttctaaagcctgtattgtacagatgttctccattctgtgttagaaaaagaatagtcattaacttcttttgtaaatgtcctccatacttttatttttatcttttaaattttatttctaatagagatagggtcttgctatattgttcaggctggttccgaactctgggcttgagcgatcctcccagcttgtcctcccacagtgctgggatacaggctcactagctactgcacatagccttttttttcttttgaaattttatttacctgcatagttttacatctacctttaaaactcatgagaaacaataaaattttattatgtaaaaaagctttttgattagcaaaattttttatcgtaaaagctgaatgggggggatgtaagaggtcaatttactgttcacttggcttttgggtatttaggtttttctgtagtaaatgggtattggatccctttggaagatggcatagtttattgtaattctgttatggttttgcgaattcgagcctagaaagagttatcttaacatctgtttcactgtggttagttccttaatccacctgccttcatcctggctcagaactaaaaaggttaaagtatgcagtaagatttttgtgctgccacttggaagtagtattaattagtagctgctctatcaagcattcttttgcttagcagtaagcaaacttaggagattttattacaatgctgtttttttaggttttattttattataatgcctttttaaaaaaaattaggctaataagaaaaatcttatggcctcaaaaagtattctactttttctgaaaaatatatgagcagtatgtatatttagctataaaaactacatagaatacccatttttttttagagattagcttaagaaacctaagtcttttatagcaagctgttacagatttgtgtgagttctcatttttgttgttgttgttgttgttgttgttgtttgtaacatgagggctaaaagctttccttaggataaaaaggttttctatccttaactcctttagatggtttttgttctttggaattctgaacttacctagtagaggtatgtagttatgccagtcatcttacattcttttgaaagaataactttaaaaaccacaaaggatgcagtaatatcttttaatttgtttgaaaacttacattctgcctcaggaacccttttttaaatttaattttttatcaaagtaacacaatcatgattttttaaaagtccaatagtttcccaagagttataaatgaaaaatagtgctccaaaccctcagttccaatcccattccccagaagagaaagaactatttattttagtattttttatgacttattattccgtattgctgttttaagacagtcatcttcatacctcatgttacttttgctttttataaatgtgacggcagttcttattcattcgtatgatttaaatgaatttaagatattcctttgctcctttgacattttcccttaaatgtacattttctaaaagtagaaaaaaattacatcattaacaggttaatgtggctggggggagttgaaatggcagttcttggaagggttttggcaccctggatttttgttctttgtcagaactataaggtatagaataattgtgacttttgtagtattttgaaattgcaatccgatacccataaactgccatatgtgagtgttaaaacagaaatgttttggtcatttagaagtaaacgttatgtgtatatacattttcatacatggatacatataacctataatgtgttttttaatacattttcatatgtgtgcttatttttactccctctcaggcttatagcaatagctagttgacttgcaaatgtataatggaagcattaaaagactggataggaggattgagctctgatagtttaagaataagcatagaggctgggcgtggtagctcacacctgtaatcccagcactttgggaggctgaggtgggcagatcacttgagcccaggagtttgagaccagcctggccaacatggcgaaaccccatctctactaaaatcacaaaaaaattagccaggagtggtggcacacatccgtaatccgctactccagaggctgaggcacaagaaatgtttgaacccgggaggtggaagttgcagtgagctgagatgaagccagcctgggtgacagagagagactttgtctccctctcccccgcaaataaataagtaaataaaggaatacagcgtacaaaagcctactttatatctttaaattggttttacattttgcttttctgattctattgtgagaattagtacttctccaatagttgttggtctttatgaagtatgaagacttagtagctttgaagataaaattaaatattcgaatggcagtgatgccacagtcactcaggattcaagaagaagcattagccagtggtgatccctaccagccccgtttcctctctcctcaaccagacataagagctcttaggctgtaactttcctgccttgaaatttaattcatattatttggtatgtttctctatagcaggcaagtaaaatgaaaaattaagattcaaatattctggaaagttgtctgagtaccaggttgctcagctgtatttctgtaaatatactcaatgtgcagaaataatcctggagagaagagaatttacaatctactgagaaactgcttaaatccaatattttttaaattgacagattattgtctatatgaaaatcttaatgtagagaaatataggccataggaatgggtgttaacctgcttgtgccctttcttcactaaggaaaggctgaaggagaaaccatactgctgcttgtttttttactttgatcaatatgatttcctgaaaaggataggcagggttacagggaaggagagaagcacagtcctaggataagctttgcagctctttcaagtcaatgaagcagagagaagtatttggttaactcattaaagatgcctcaactacagtgctttacattgagtcagttcctttttattttggtctgattttcagaagcaatgatttacatagaagccagcaaactgaaggaacttccagatagtgcccaggtaaacagtgtggatagttaagaatccagcctattcttctatgcctggactactatccaggcacagtagtcttaaataaaacaatcataattagaagaaatcagctttgtcttaggaaattaaacataagactcttgagatgagggatcagaggtaaactgataaaacaacagaaggtgaaaagggaactgacagaacagaaaaaaaaaagaaaggataaataatgattttgtagaacttcaaaccatgttgatagcagaaagaaatagagcaggcattacagaaaataggtctggaagacaggaaaaggacaaagaagtaagtagcaactggtaaacatggaggacaaattaagagactggatgcaaaccaaacatattcttaacaactaaaggatcttgaggtaattaatatccaaatgacatttcaaaagagaaagttaagtgcttagaataaagcctagtggaactgctaaagttcaagaataaagaaagaagaaaatgagaaaattattttggccagacttcctcagtaacaacaggtaacaagaaaatagaacactatctctatatgaatattgaggagggaagggattttggccaaagtgagcagttgaacacatttaaacattagaattatgtctaagtagttggaggtgatcaagtttatgagacaaaaaacagttatcattcttgaaagaaaggctacatgatataaaaacaatgggccgggcacggtggctcatgcctataatcccagcactttgggaggctgaggcgggcagattacaaggtcaggagttcgagaccagcctaaacaatatggtgaaactctgtctccactaaaaatacaaaaattagctgggcgtggtggcaggcgcctgtagtcccaggtacttgggaggctgaggcaggagaatcggttgaacctgggaggcggaggttgcagtgagccgagattgcaccattgtactccagcctgggtgacaagagcgagactttgtctcaaaaaaaaaaaaaaaaaaaaaaaattagtgaaaaaattatataaaactgtaatcaactgggaagagctttaggaagttctgaccaaaaccaaagggatgatcaatgtattatttaagttttataaattaagaaatgtatttaagtattaattacataggccactcctagtaaaactaaattagattttagtaatttccaaataaacattgtggagtcaggggtgaatggaccatataataaatacagatcagaacaaatacatgaaactttggtaaaagaaaaagatttctgggcctactacccccaagaatatgagtggatttttagcttcccactcatatttcatttaaaatacttagcagtatttgaaagttcctttggtggcttctagaatggatcaaaaagctataaactccaagccacatgtagtggtgtgcacgtatagtcccacctatactcaagaaggtgaggcgagaggatctcttgaggccaagagttcaaggctgtatgctattattgcatatgtgaaaaactgctgtgcaccagcctgggcaacatagtgagaccctaactcattttttttaaaaaaggtattaactccaatatacgctatttttaaaaatgctgcaaactccagtacatgctatctaaagcacaggaattcagattgatagtaaaagtgttgatgtgatcggacccaacaccaggctgtgggggcgacaaagtccagcggagtcaaaggaatgagaaaagacaagagacaaagtgggaccagggggccaacgctagtatggaggctgcgaaggcctggagctctgggagcccacgctatttattggtgatcaaacaaagaaacaggtggtgaggatgtgggggttaaaaggaagcggtgtatcaagcgaatgagctacagctgtgagggtttagcattttctttgaaacatatggctagttgagataatgggagtgctagaagtaaggagccagcagtctagcaggcatgcaagccctgcctcagcttctctcccgacactcagcttttctcccaacaaaaagaacttgaaatacctgagaataaagttactggaagatgtgcaggatccacatagtgaaaaaaagttataaaactattgagagactgaataggaattggaattaagtaaattaaaagatactttgttcttggctaggaagacaatattatagagtcaattctttcagtcagtttactcttgatataattgtagtaaaagttccaagaggatttgaaaaaaaaattaatgattgtacttaacttgaaaaaacaaatatggaagaacagagaaaattctgtgagaagaatgataaagggatctttgtcaaatattgagaatttatcgactacaagagcagacaaattagtggaatagaatggagagtccaggaataaacttgtctaaataggaaatttgggtatatagtgaacagatcagtggggagagttagattagtcagttactctttaagaagaaactaagtgcttgtaacatgcctgtagacattaagggctccaggaataataaagtagtcctcatggggtttacattctagcagagcaaacataaagagtgattacagttagtaatgttgtaagtgctgcaaaggactgcagagtaacaatgggatgtaattcaagggaaccttatctaatgggggtggaagtgaggagctgtcagagatcagttatttgaggaagctgggtgtaagctggaacctaaaggtgggaaaaagtgtttccaatagatgaaacaacccttcaataagtgattagatttttggattgaaatgaaatggaatcctggctttactccttattacgcaaaaataaatcaacagttttaatggaaacaatttaaaggtgagatctaaatcattaatgaatttccattaaaaaatctttgggtatagaggtcttttaaagtgtgatatgaactgcagaaatcacagtggagtagcacgataaatgtgcctacataaaaattttaaagtggtaattaaacactattaaagaaggttgaaagacaagaaagaaatgaaagaaagcaacccatgaaacaaagatttactcttcctctttgcatactgaacttaatagggaataagatcaccacagaaaaatgtgttcaccttcactaataaataaataaatacaagttaagtctaggtatttttccctatctgatgggctaagattttaatctaggattatttatatgtggcacatttaaatgtccttcagaataacattggttggatatattatagtaaataactacagtggaatattgtgcaaaaatgaaaaatgtagacatttaaagacaaaggtgtctgttagatattgtctagtgaaaaaagcaggttataaatctggactagggtgttacttatatgaaattagggacacatgtctgtgtggctgtatactcatagaatgctgtctagaatgttaaccaaagtatgagagtcattagttccctgttgtcaaattttggatgacagaagtttgtcttgtcttgggagcatgaatatttttataaaacaaggtgtttagctggtttatgaattgatatttagtgttaatctcttatgctttcagtttttcaggtaaaacttggtattttatattatctttttttttttttttaaatttgagacagtctcgctctgtcacccaggctagagtgcagtgcagtggcaccatcttggctcactgcaaccttgcctcctggattcaagcggttctcatgcctcaccctcctgagtagctgggattagaggcacctgccaccgcgcccagctaatttttttgtatttttagtagagatggggtttcaccatgttggccaggctggttttgaactactgacctcaagtgatccacccacctcagcatcccaaagtgctgggattgcaggtgtgagccaccgcggcgcctgtaatcccagctactcgggaggctgaggcagtagaatcgcttgaacctgggcggcaaaggttgcagggagccgagatggcgccactgcactccagtctgggcgacagagtgagactgtctcaaaattgtaggaaagcatttgattttctgctttaaatatattctgattatctgaatcatcagagacattaattttctatttgtatgagttcctgacaacttttaactttctgataatcctcctttttataatgtgttggcatttcgattgataatatgattatttcattgaactatgctgtagtcaaagtatttataaaaaagatatttatttattagtcttaggagaagtgatatggtttgttctcatttgaatgatttttctggaggtacagtaagatatagtagcctttgacacaaagcctaaacaagaccttaattaaaaatattggaaatttcttttgagtattgattacttttaaaattgaaaatctcctgtttgtatataaagagcattatagttactgtaatctgggctttacaacccaaaaagtaattgaccagattgcacattaatatttttgctggttatattggttttacagattgaaaagtttttttttttttaatatctattgcttttcccttttgaatagtaagctgtttcaggaggccagggaacatgtctcatctgaattaattggaaacattgtgctaagtatttactgttatcttaaccacctcaacccaccttaaggtctgctctactatcttctgtccagaggtttgctatttagttaaaactctaggtagtacttggcatatatatactcttgatgtcttagatatggaactactctatatttagatacatattttatgaaaagctaatatgtaatttattttatataaaatgtttgaagatacacttctttgttttattcctcctcctttctcagtaaattaaaaatatttcaaaataatgtttagaaagcaagtctattatgtaaaatgagacacgtaataattatatttttaagatgatttgtgcagtaagataaatgctttactgaagctaatatgtttaaattgctttaactaaaattattaataaaatgaattcatttgtataaaatacagcctacccatgtaaaatattactcttcataggtaccccagcaacagcacaactttaatccttaagttttagttgcagtactgttaaaatactaatagcttaatttcccaagattcagttatttaaaaccaaagtttagggggaaaaaggcagcaaaactcagtctactagtttacatacatacacacacacacacacacactcatatatatgagagtagactgaatttttgctgtttgcaatatatatatatatgcacatgtatacacacacctttatttgctataatttgtaccatgtagcttttatttcctctgaataaaaaggttgttatcttgttttattttaattcaacttcttgcttttccctatagaaagtcaggtttttggagagctctaacagtgtgcaagttgctgggctcttatcctttctgtttaaataatgcaggtactttgatggaaacctggagaagctctttgctgagtgtcatgtaattaatccaagtaaaaagtctcgaacacgccagatgaatacaaggtcatcagcacaggatatgccttgtcagatctgctacttgaactaccctaactcggtgagtatctggtagtttaaggctagtgctgactttgtatttcagagggtaaatcaacttccattatttaaacaaaggaaaatttgtgggtctgggagtagtaacctctaagccataacctatcaatgtattcagtgtgaggaaaggaagaaaaagagtaaaagcttggttcctcttacctccaacccccatttgttttttaaagcagcaacaacttgtccaagttgtcatttatagacctaaatctttctggagtttattctatcaccatgggagaattgtgtaatagtaggcagtaagtagaattctttctcatccaaattaaaatagatttaaactttaagtgttttttaaatatccagaaacactcataaaataccgttaatactatttgctagggaactctcagaattcttcagaagataagattttcacttaatcaaatccattcaaatggagattgttaaatatggtatgtggggacagagttggagcagaaccagtgatatagcaagagaaccaaagaactgatgttaatcccttaagtacaaataaccttcctaaaaatttattgaactgaagctggactcagtggctcatgcctataatcccagcacttggggaagccaaggtgggcagatcacttgaggccaggagtttgaggccagcctggccaacatggcggaaacctgtctcaactaaaaatacaaaaaaattatcctggcatgatggtgcatgtctataatcccagctacttgggaggctgaggcatgagaattgcttgagcctggaaggcagaggttacagtgagctgacatcatgccactgtattccagcctgggcgacagagtgagactccgtctcaaaatataaaatagaatttactgaactgagatgatttacttacttgatttacttgagtgtttactaaggaagtttagtcttaagatgtctaagataacttaattctatgataattacaactgtcttgttcatattctctgctttaatagttaagcatctctttctaataattactatataacaagtctttgacactgttattttaacaattatttggttgatgggggtctcactatgctacccaggctggagtgttatggctattcacaggcacagtcagtgtactacagccttcatcagactcttgggctcaagtgatccttttccctcagcctcccaagtagctggaactacagacgtgcaccatcaagcctggctaatattatatttatattgaaggatttttattgtttatcttagagttgtatatgtgtatctctaatggggtccatttgtggggagttaacttgttcacatgtacaagtgatgagaaaagttttaaaagaaaataaagtactcttagagaaatagaatgatcagtgagttatttagtaggtaaagtggtgaactgaattttcaaattctcaagttctgatcgtaactctaacgtgaaatttttggctttagcgggaggtaagccatttaatgtcactgggtttttcttttttctttctttcttttgagacggccttgctctgttgtctaggctggagtgcagtgatgtgatcactgcagcctcaaactcctgggctcaagcgatcctcccacctcagcctcccaagtagctgggaccacaggcgcatgccaccatgtctggctgatttttctgtgtgtgtgtgtgtgtgttttgtttgttttgttttgtttgtttgttttttttgtagagacggggtttcacctgtgtgtgtgtgttttgtttgtttgtttgttttggtttttttgtagagacggggtttcaccatgttgcccaggctggtctggaacttgtctgagctcaagcagtctgcccacctggcctctgaaagtgctggcattataggtgtgagccaccacgctcctccagttttggtttcttctccttttcttttcttttctttttttttggaggggggggggtgggacggagtcttgctctgtcgcccaggctggagtgcagtggtgcgatctcggctcactgcaagctccgcctcccaggttcatgccattcgcctgcctcagcctcccgagtagctgggactacaggcgtctgccatcacgcctggctgattttttgtgtttttagtagagacggggtttcaccatgttagccaggatggtctcgatctcctgacctcatgatctgcccgcctcagcatgccaaagtgctgggattacaggcgtgagccaccgcgcctggcctctttccttttctcttttttttttgacacgagttttgctcttgttgcccagactggagtgcaatggcacagtcttggctcactgcagcctgcgcctcctgggttcaagtgattctcctgcctcagcctcccgagtagctgggactacaagcgccggccaccacacccggctaatttttgtatttttagtagagacggggtttcaccatattggccaggctggtcttgaactcctgacctcaggtgatccacccaccttggcctcccatagtgctgggattacaggtgtgcaccaccgcacccaacagtttcttttttctttctgatgagttgaataagatactctttcaattttcttccaacctgagtattgtatcatttctcttaccttaaatcacaattctaatttgaatattttttaaaaagtactactgttacaatatattaatattttgactattttattgtctttaacagattctccttgccagttgacatttatatagtgcttacagttaaatgtttctgtgaggtaatactaagacccaggttttacaaggtttccttacttcttggcgtttttcctcctgccctatcatagacagttccttcttaacttaaatcttaactctgatttgagtactgaagcttggctgcttccaaatatccactataactttctcgctgttcttaatatggtctaacaatctcaacaaactagaattcaaaatcatgacttgagatttacagtgtaaatttttgttttgtacttgtaactgatgatggagaaacctattcattgaacacactaggcactattctaagaaacaatggagaataaatacataattcctaaccagataatttgcaggttagttgggtagataagtagtaaggtgacatattcagaaagagtggtaagtgctttggtagggcaaatataagatacgatactgtgggaacgtgttggagggatacctaacccagtttttgatcaggcaggacttaccacagaaatctgaactaacatctgaaggcatggtagttaggctaaggaggaaaatgtagcaagtccaaggaagagagaatgtactttcaagaactgggggatggtaaatagtactaaaagattcagagaaaagatttaaaaagttaatttgaaatgaaatgaaggagtgaggtaggatgggaaaccagacttcatgggctaaagagtcactgacttgaaggtgggaaaggaaatggaagcaataaatgtaatgaaattactcttttacaagaaatttcactatgcaagtgataggataagatagcaaaaggaacaacatgggttggcaagtaaggtaaggcattatggaaactgctaagtgttccgaaaagtatcatgacaaaactaggatgtcctttcctcataatttttagactcatatagaaggataattttaacctcttcagttttggaagtaaatgtcacctgaaactcttcataaagttttattattggatgagtgagttcttcacttacattgtataactcccacattttactactctccaagcatttgtacttttttattatatatatcttcagtatctttatccttccagaaagcaatttttgctttatgcagtgtcacatgcacattttaaaataagtgcttttgatagcttagtttacaaccctttggagttaactgtcctgagtggctgcttctttcaaaacaatgtcctgagacattggagcactttgtaaattcatagattccaacttaatgttttaggttaaagtagttaagataatagctgtactggcccaccactgtgctaggaaatgtagcttcgactacagcgtctctctctctctttttttttttttttttgaggcagagccttgctctgtcgcccaggctggagtgcagtggcatgttctcggctcactgcaacctccaccccgcagtttcaagcgattctcctgcctcagcctcccgagtagctgggattacagccgcccaccaccacacctgtctaatttttgtatttttagtagacatggggttccaccatgttgtccaggctggtctccaactcctgacttaaggtgatccacccaccttgacctcccaaagtgctgggattacaggagtgagccgccacggccagccagtgtctcatttttatgaagtaaataatttgtattttctaagaataagatatgtgaagtaggtaaaggcagagttgaaattgtgaggaagggtggtccaccatcccgtcccccattcctgaagcccctctgtggaatcttggtgctgctggaaactgcttgaaaatacctacgtcccaccctattttccttttaacacattacattttacacacaagggaaccgattcccaggtcatttgttcaatttttataaacaaaggggtttcaattttagaggttatatggacaacttattatggaagaaagattcttaattttcttactgctatttgacattagttgctgtgtatgtaaagtgatgcagataaatgaaacctttaagagtgtattcttaagtttctttaagtccattaatttcttttgtagataatatttcatgtatttttcgtgtactctcttgatcggatgtatttgtgatataaacagggataagtttagtgaatagataatatgatcccctgggacaggggaaagcccagggagccatgtaggtgaacctagctcaaggttatgaggaaacgaatatatcagaggagggagagggaaagggaagtaagacagacaggaagatatctgcgataataatatgttcctcgaaagcacaatgaatatgtatctttagactacagatttgtgtcttggtttttggtgtttttatttttttgctctatctttagacatccatgtatgatttatttttctaacttgtttaatcttgttatctgattagagaagttatttaaaaagaataaaaagcttttatctgtgtgctgaagttgtaacaaggttgagagaggtgcatctcacacgagtgtgattacatttatgaactatctttttatcttaaaatgagctctagactagaagtcaaaaaaggttgagacttaaagtgatcacttagtaaccattgtgaccgttgatctctgttaaggattcctacttgaaaaaagaatgaagcacatataagcatgtgtatatgtttttaagttttgaataaaacattttagagttgctgatatatttactgtatttgtgtcttttacagaataccccttcctttaacagccttaaaaatcaaagactccattagtgatgtggtaacaagttagtgccaaatctccttctctgatggggagtaatgataatagattccctttaagcttgatatttattttacatgtcattctttcagtaaacctaattgcaggactgatacacttcatatatatatatattttaatgagatgaagtctcactctgttgcccaggctggagtgcagtggtgtgatctcggcttactgcaacctccgcctcccgggttcaagtgattcttctgcctcagcttcccgagtagctgggattataggtgtgtgccaccatgcccagctaacttttgtagttttagtagagacagggtttcaccatgttggccaggttggtcttgaactcccgacctcaggtgatccgcctgcctcagcctcccaaagtgctcggattacaggcacgagccactgtacccagccctctcatagatttcttttcatgtccttgtctttgtatttaaaaaatatagttgatgtgctgtatatagaatttctgtcctaacgagatatttgtatctaatatcataagtaacatcagaaattttataagtacatgtcacataatggctaaatagaaaatctaagggaattttaaaataccctttataagagccacgaaaggaaagaataaaagagctaggaataaacttgataagaaatgtgaaagattgctatgaagaaaacttcaaatactaagataaaagaatgacttgaatatttgagatagaagaaataggaaaatattgaaaaagaagattaaattgacaggggagagctgagtgaggactagtcctgctagatacaagagtagacagagcggtggaacaggatagagtcaaatatgcatgaggagaatttagtgtattacagaggaggcatttcaaataaggtgtattatttgatacatggtagcagtggaacaggatacagtcaaatatgcataaggagaatttagtgtattatagaggaggcatttcaaataaggtggattatttgatacatggtgttagagcaacttggtagccatatggaatagaaacttaagattcctacctagcttcataaataaaagttaatgaattcacaagcggtaaatttaaacggtgataagtttcactgtgagtgaagagcttctgtatggcaacaaaatatgaacactaagaattaaagtgggggaaaagatttcccctacttataaatggccaatttcctacataagtaaaaagcctccgtaaataagtgaaaaacccacaggcaaagttggcaaaatatatcaagagagtatacagaaaaagaaatatacagtgtaaaaccttttttgaaatattataatttcatttataataaaaattcaaatcaaaactaaagaagttagtgtgtttttcacctattagattggcaaagatcaaggagttggatcatatactacattgtcatgggcatgagaaatcaagtactcttgcacggcataaatgacgacaatctctttgcaggggagcctgatgatagctattagattgtaaatgtatatatttattataatgtcacctctacagatttgtcctaagatacattcataagatcacaaagatgtatatatagtcaatgcagtagtatagtaggaaaaaaaaaggcagtgtaaaggttcattaatagtagactataaataaaattgtggtacctttctataaagaggcaaacccacaccagtgtggtaccatatgagaaatccattggatttatttttgtttttttaagacggagtcttgccctgtcatcaggctggagtgcaaaggtgcgatcttggctcactgcaacctctgcctcccgggttgaagggattcttctgcctcagtctcctgagtagctgggattacaggcatacactaccacacctggctagtttttttgtatttttgatagacacagggtttcgccatgttggcctggctggtctcaaactcctgacctcaaatgatctgcccgccttggcctcccaaagtgctgggcttacaggcgtgagccaccgtgcccagccctattggatttttttaaacaacaacaacaaaaaaaaacaaggtgcagaagagaatttgtggtactgttacagtgtgtgtgtaagtgtgtacgttagaacacctctggaagaatatgtaaaaaactggaaatagcagttgcttctgggtagaggaaacaaacaacagggatgggaatgagggaggcctgtttttttttttttttgagacagagtctcgctttgtcacccaagctggagtgcggtggtgcgatcttggcttactgcaacctccatctcctaggttcaagcgattctcctgcctcagcctgccaagtagctgggactacaggtgcctgccaccacacctgcctaatttttgtatttatagtagaggcaggattttgccattttggccaggctggtcttaaactcctgactgtaagtgatccgcccacctctgcctccagtagtgctgggattacaggtgtgagccaccgcacccggcctagggaggcttatttttcaacataaactctgaacttgtactgttaaagtaattgtttttagtaatgtctatttaacttactcaattaaaaataatttagaggtaaattatggcaaaatgttctttaaaataaggtaaccattatttgaatctttttaaaagacataatcctccagatcatctaatattatttaaagtatttacttaatgtcccattacaggatactgcttcatttaacgatcccttaactcttaagattttagaacaaagtgttagttactattatccttagctattctgaataaatcttttcataacaggtttattgagatataatttatatactatccagttcacccatttaaagtggttttagtatatgctacagagttgtgtgccatcgccataattttaaaaacattttataaccccccaggagataactttttaaattcaccccctaattcctcccaagtcccccagcccctaggcaactgctcatctgttttctttgtcaatggatatacctattctggacatttcatatgaaagaatcaaacaaggttttggtacggtggctcacgcctgtaatctcagcgctttgggaggccgaggtgggtggatcacgaggtcaggagttggaggccagcctggcaatatggtgaaaccctgtttctactaaaaatacaaaaattagctgggcgtggtggtgcgtttctgtagtcccagctatttgggagactgaggcagaagaatcacttgaacctgggaggcgaaggttgcagtgagccgagatggtgccattgcactccagcctaggtgacagagtgagactctgtctcaaaacaaaaagaatcaatatgtgatcttttatgactggcttattttcattcttttacaagaaatttcactgtgcaagtgataggagaacaaccttggaaacaaggttcatctatattgtggcatttatcagtactttatttccttttatggctgaataatattttatttatggaaatatggaaaaatatttttttcttcagttgatggacatctggattgttttcattttttggctgttacgaataatgctataatgaacacttgtgtacaagtttttgtatggatgtatgttttcatttcttttgagtatatacccaggattagaattgctgggtcctatggtaactctatgtttaatattttgaggaactgcctgattgtttccaaagttgctgtaccattttacatttccatcaacagtgtacgaaggctccaatttttctacatcctcaccaacacttgttattaatattggctttttttttccaaatagagtctcactttgttgcctggtgtggagtgcagtggcatgatgacagctcactgtagccttgacctctcaggttcaagtgatcttcccacctcagctcccctgagtagctgggattacaggcatgtgctaccacacctggctaatttcttaattttttgtggagacagagtctcactatgttgcccaggctggtcttgaactccttgcctcaagtaatcctccgctctcagccacacaaagtgctgggattacagatatgagccagtgtgctctgctttatctgtctttttattatagctgttctagtgagggtgaagtggtgtcttactgtggtgttgctttgttttgttttgttttgtttgagacagggtctcactcctttgcccaggctggagtgcagtggtgtgatctcagctcactacaacctccgcctcccaggctcaggcagtccttccacctcagcctcccaagtagctgggactacaggcgtgcgtcatgatggctgactcattttgtattttttgtagagacagggttttgccatgttgccccgccttcatggtggttttgatttgcatttccatgatgctgaatgatactgagtattctttcatatgctcatttgtctttttatatttaatacaaacattgttgcccgcctttcctaagatgtatgtgtgttcggtgtatctgcatgtctagattcaccatgaaaagttcattttaggagcccatctattgtcaaattggacattttagccacgtaagaaatgtgaccttacagagccctgttgagtcactgtttatagtgagttttctgataatacctttgttaagttcatgttttgtttttcttacagtatttcactggccttgaatgtggacataagttttgtatgcagtgctggagtgaatatttaactaccaaaataatggaagaaggcatgggtcaggtaaagatatcaagttgtttttcagtttttgttgaatttcctatagtgttaagacccttgcacaaatttgcacaaataaaaacaggtgaagctttatgtgtcatgattctagattcaaacaactaaagataataggctttttcctaaagtaatgtggcattccagttaaagagccactccaggtaacgttttctcagccggcatcaatattggtatatgttaacttaaacttgttgcacgattttgtcagattatctcgcttttgcctttaaaattgtgtgtttaaaaaccaattagtcaggttagcaagtctagttactttatggtgataaacatactctcacacacatttcctttaaggagaaagggaaggattgagatcctgtaaacattaaggtattcccagaacctagcaaagtgcctggcgatggtaagcattcattaaatatttgttgaatgaagacagtttaaatttcaatctttttcagactatttcgtgtcctgctcatggttgtgatatcttagtggatgacaacacagttatgtaagtatttttgatagattctgcatgtgaatattggttagttggttaaaccaaattaatttttacttagtacctcaaaggaagtgaaactttttaaagtctgaagaaactttttaatctgcgttccttagtagtagtacaaaagcccatttgtaacttggttaaatgcctgatcactattcttacaaacttagaaatgcatggtagctagattttgataaaccttgggattggagattagaatgtgtgtatgtgttagttgaggtgttcttggaagcagatcccaagatagaataaaaggtgaaactgacttattgtggaatagcatctgtgcaaggtaaacagcaggagcagatagacattgatataggcctgacatctgttaaaagacaaagaaggaagattcaataggaagagactttatatgatacagctatgagagtctttggcagccctgatgggggaacttcagtgcatagattgcccatagaggaatacctcaataagtagaaagagctgggcccagtacacttgatatgctcagttgttggctgggactacccagggagtcatggtctttgctgaaacactgctgctgatttcagatacactacagctggatgctttcagctaacagctcttcttgtgaaaggttctttcttttttttcttttaacttttaggttcaggtatacatgtgcaggtttgttacatgggtaaattccttgtccgtgaggtttggtgtacaaatgatcccatcacccaggtagtgagaacaatacctgatagtttttcaactcttgccgtcccaccctacccactctagtagtccccagtctaaatagtcttttattctcatcttcatgtgtactcactatttagctctcacttataaatgagaacatgtggtattgagtatttctgtgttaattcatttaggatgatgacctctagctgcatttgtattgctgcaaaggacatgattgtgctcacttttttttatgactgcatagtgtttcatggtgtccatgtgccacattttgtttatccagtccactgttgatgggcatctaggttgatttcgtgtgtttgctattgtgaataatgccacagtgaacatactagtgaatgtgtctttttggtagaatgatttattttccctgtgatctcaccaacatctgttatttttttactttttaaaattattttttgtttaatttttttttactttttaataatattccttatgactggtgtgagatgatgtggtacatcattacggttttgatttgcatttctctagtgattagtggtgttgagcatttttttgtacctgttggctgcgtatatgtcttcttgagaaatgtcttttcatgtactttgccctttttctttcttttttttaagtgaaagcaagtttattagagaagtaaagaaacaaaagaatggctacttcgttgacaaagcagcctgctcatttttaaatggggttatttgttttttgcttgtttgattaagttccttatagattctggatatgaggcttttgttgggtgtataatttttaaatattttctctcattctgtaggttgtctgtttactctgttaatagtttcttcagctgtacagaagctcattagtttaattaagtcccacttgtcaatttttgcttttgttgcagttgcgtttggggacttagtcataaattctttgccaaggctgatgtctagaatggtatttcctggattttcttttaagatttttatagattgagctcttacattaaagtatttaatcctttagttaatttttgtatatggtgaaagatataggggtcaagtttcattcttctgcatgtggctagctagttatcccaacaaccatttatgtgtgtgtggctattatcgataggattgcattattaatttggcgcttaccttgaatgttattggtatatattaaatgctactgaattttgtacattgattttgtatcctgaaattttactgactttgtcagctctaggagccttttggcagagtctttagggttatttctaggtatagaatcatcatcagtgaagattgatagtttgacttcttttcttatttagatacattttatttctttctcttgcctgattgctctggccaggacttccagtactatgttgaataggagtggtgagtgtgggcatccttttcctaagtggaatgcttccagcctttgcctgttcagtatgatgttggctatgggtttgtcatatcatagatggctcttaatgttttgaggtatgttccttcaaagcctagtttgttgatagtttttatcatgaagagatgttggactttattgaaagctttttctgtgtcatttgagatgatcgtatggtttttaattctgtttatgtggtgaattacatttattggtttgcccaggctggagtacaagtggcaccatatcggctcactgcaacctctgcctcccgggttcaagcaattctcctgcctcagcctcctgagtagctgagattacaggtgtacaccatcacgtccggataagttttgtatttttagtagagacagagtttcgtcatgttggccaggctgttctcgaactcctgacctcaggcgatctgcccgccttggccttccaaagtgctaggattacaggcgtgagccaccaagcctggccaataactattttcaatttgtgatggtaacaaatctttgtcaagagaattgtcttattaatgaccagagtgacacttgctgccaccttcttgagaatgcctattcttgaagatggatgctcactttcttttacttccttatcaatatcagataaactaagggtggaaccttgtcctaataactgttggctgatgtttgctctcacgtcctggtggtccatgccaggtttagatagctttttaggctaaggccagctatcagaaatcattagggtttgtcataccagaaaagcattatgggtaatacatgtgtaaataagatgtgtgtgtttggcaatcaaggcatctgacttttggcctgatacattccttattattatttattgatataaaatctgtaatataaaactcattttaattacagttatccttagtatactggggattggttctaggacccacgtcctccaccctgaatataccaaaatctgcgcatgctcatgtcagcccagcagaacccatgtatacaaaaatttgaccgtccatatatgcaggtttcacatcccacaaataactatttttgatccctgtttggttgaaaaatattcataaataagtggacccatgcagttcaaacctgtgttgtttaagaagcaatggggttttttttgttttttgtttttttaagatggaatctctctctgttgcccagagtggagtgcagtagtggcatgatctcggctcactgcaacctctacctcctaggttcaagtgattctcctgcctcagcctcctgagtagctgggattacaggtgcctgccaccatgctcggctaatttttttgtatttttagtagagacgaggtttcaccatgttggccaggctggttttgaactcctgaccccaagtgatcacccacctctgcctcccaaagtgctaagattacgggcgtgagcaaccgcacatggccagcaactgtatttttaagtatattatccagtggcttttagtatatacataatattattctacaaacatcacctaattgcagactattttaatcaccttatatccgttaagcagtcattcgctattcctttctccccctagaccctagcaaccactcatctgctttctgtctttgtggattagcctattctagacatttcatataaagggaatcatgtaatatgttgccttttgtgattggcttctttaatgttttcaagattcatccatgttgtatcatgaatcatcactttactccttttcattgctgaataatggttccattatatggacatttccattttttacggaaatgtcttatgtgaacatatgaacatttgtgtacaagtttttcattgaacatctgtttttaattctcttaagtatatatatttcaaaggagaattcctgggtcttgtggtaatgctatgtttaactttttgaggaaccatcaaatacacaaattatttttagaccgcaggttccacttctgtgaaatatggagatttactcatttaaaaaatattaattgaacactttctacaggcgtactggacacctggggatcctttcatggggttgggaggagaaagacagatattaaacaaatgattatacagataactgtctaattaaaattatgataatttctataaagtagatgtttaaggtgccatgagaactgagagggtatctatatccaaacgagtgtggaaactcaggaaaggcttccttgagtaatactttattgtaactgagtgaagtaatacagtaatagcgtctaatatttattgagtgcttactatctgccaggcactattctagtctcacaaccatgtttctgatatctattttacagattagtaactgagaaatggagagttcaaagaatttaccttcaattcatagctagtgagttgtgaggctggcattcaaacctaggctgtcccaccttagagctccattacaatattcttgtctttccaagggaggcagccttatgcacagcctctgaggaagggtggtacttactgttttgaggaaatacaagaatacgaatgtgataggagtgcactgaaagtgccacaggacagggtgggatcttgtggaaggagagaggcctatgaagctcaagagtcaaatgaggccagattggttcatttaaaagattttaatggggttgaactacatgcatgttcttcatgtctttctcagtgggaatacactcagaggagtatttaccatagaactaatgaaacttaaacttcaggattcctcactacgtgggatcctgtgaattctggaaattcttgtgagttatagtgttcagaagaggccaggatgcagtcagtgagcatttctggttaatttctaagagctctcagaagaagaaggctcttaaaattgtatcagctttaggtatcacaaaacctggatccatttcttaacatttctggcaacaatatctgtctcatttcgcatactgatttgggtggggtgtctgaaggaaggtggctgagaattgctgtcttaaggcatgatatgatatcagagtcaaaagaccctgaaatgcgcttatacttggcactagttggtaagtcattaggctgtaataaaaactgggtaaaagtagactatttaaaaaataagaaccatggaaaaaaagtctatgaaaataaaactatacaaactttgaaattattgttctgatcagtacagttatatttgttgatagcctatgtgcatttcagtatttacagcttagggcataaacatgtagccgtagcataaacagcttttgaaactatgttttataaatgtggaaaatactcttgactggaaactttctaatctatttttattcttggtttcaggcgcctgatcacagattcaaaagttaaattaaagtatcagcatttaataacaaatagctttgtagaggtaagtgatttgttttccttcttgtaagaaggaattctgtttattaatagaaatactattttaaaaattataatttattgacagtaaaaaacatctttaacatatttatgaagcatgccaaaatacctttattctcaaaagagtatgacaggccaggtgtggtggctcatgcctgtaatcccagcactaagggaggccgaggcgggtggatcacctgagatcaggagttcaagaccaacatggcgaaaccctgtctcttctaaaaatacaaaaattagctgggcacagtggcacaagcctgtaatccgagctactcgggaggctgaggcaggagaatcgcttgaaccctggaggcagaggttgcagtgagccgagatggcgccactgcactccagcctgggtgacagagcgagactccctcttaataaaaaataaaataaaataaaataaaagagtatgagaaaccagtaagtacatctctccatagatcttgaccttggataataaaattatttttactgtattcttcctttacttttctttatccctagctgagaattgtagtagattactaatcgtgtcatgtttaatcatgtttgagattctaaccctgctatttctctgctcgttttaggtttcattaccagtaaatcttgttaataaagaatgctatcctttattggaccatgcctttgcccatttgttctatgactccttttgtgctacagtggcagagttgagtagttgctacagagactgttctggcctgcaaaaccaaaattctttaccctcttggcttgttacagaggagtttttcagcccctgtatgacaacatcagtaacttggtcttttaattctagaaagtaattatttctgttagagattaaacctggaaacagcctattttagaaatagtgtattatttgaaatggtcaatggacttctgaattctggtgcagagtgtttttttttcataatactataaaagttatatttccttttgaggaactaaaatgcaatctttgcctgtggtttaggaactgggttttttgtttgtttttttttttccttcttacaagagctttttatgggagaagttgtatgtatatcctttagcctatcttgaactattctgtagcttctaaacaccttccttgataaagagtatatctgattttcttgtgtcttttgaaaattgttctgaaatagaactgtaaataaattagtggtttttaatggtcacatacatgatatttaattaaagttattcagtgggattttgaagatagaacaagaggtgattcatgtattttataaaaccaggtcttcagggatcagtcatctttaaaaaaaaaaaaaaaaggcacatctgaagtgttgctatagaagaccacagcaagttttcataagcttgtgtaattatcccccatttgccccttgtaccagagaagcaatataaatagcttgatgtactaggaaatcttgcatcatgacctaatttaatttgctgtctttttttgaggcagggcctcattctaacacccaggctggagtgcagcagatgatcacagctctctgcagcctctacttcctgggctcaagtgatcctcttgcctcagcctcctgtgtagtcgggactacaggcacataccaccatgcctggctaaattcttttttcttttttttaaggtagagacaaggtcttgctatgttgcccgggctggtctggagtgcttgacctcaaacagtcctcccgccttggcctccctaagttctgggattataggtgtgagccactgtgcccagccagctgtcattttttattttctaacttgtatttcagtgcaatcgactgttaaagtggtgtcctgccccagattgccaccatgttgttaaagtccaatatcctgatgctaaacctgttcgctgcaaatgtgggcgccaattttggtaagcaagtgatttcctaaattgaaatagtgcacaaagcgtttccatttctcctgtttattcttggtagtaaaatagcagaaaaaaagtgtttaccttaggcagggagatgtttgatactggtttaaaatagtatatatctctttcagaattgaatgaaaaggtcacatcttaaaaaaatttttcctctttccttgatgttctaacttttttgaatttttttttatggagaaaatatacaactctaatcatatcttcctgtatgctccactgtaacttaatgggagcaaacttgtagatctgggactatacgtttttctttactctgccaaattttaaccttacttatgcaaaggaaatgtgcaggtaaattctgctgatggtctcctttttaactaagagttttcctgtggctcctctcgcccagctttcttggtaacttgggcttttggagttctatagtatactcttcagcctctgaattctagatttgaactgccaggaagtttccagtgccacatattaggggatgtcttaatcagttcaggctcctttataggtgttctagttttttccaaagtggataggctgaaaatttttcaaatttttgacttcttatttccttttgatgaacagtttatctctaggtcattcatctcttcttgcattttctataaacattcaagagaagctaagctgcgtcttcaacactttgcttagtaatttcctcaaccagatattcagtttcatttctctaccttccacaaaacaattcagccaacttctttgccactttatagcaaggatggcctttcctctagtttctaacagcatgttcctcattttcatctgagacctcatcataatggcctttactgtccatatttctaacaacattctgttcatggccatttatttaggttttctctatgattgaggcattccctgcacttctgtctttctgaatcctcaccagaattacccttaacaattcagttcattcacagtgatctaggctttttctagcttgcacttccaagctcttccagcctctacttactacctagtttcaaatcggctttcacatttttggttttgttagaacagcaccctcacttcttggtaccattttctgtcttaatgttcaggcttttataacaaaagaccataaactgggcggcttctaaacaacataaatttatttcttacagttcttaagggtgagaagtccaagatcaaggtgccaaaagatttgttgtctggcgagggcctgcttttctggttcatagatggtgcctacttgctgggtcctcatatggtggaaaggacaaggcagctctctgggccccttttttttttaaaaaggatgccaattccattcacctcctaaaggctccacatcctaatactgtcacattggttattaagttttaacatacacattttagggggacacaaacatttatatcctgctagaagttaagatgattttctgttcctttgagggtcttgaggagtaagaagccaatcaagtcaaggggctctagacccagcaaatagattttttgttttgttttgttttgagagagggtctcactccatcacccaggctggagtgcagtggcacgatctcgcactgtaacctttgcttctcaggttcaagtgattcttgtgcctcttgagtagctgggattacaggcgtgtgccaccacgcctggctaatttttatttatttatttatttgtttatttatttatgtatttatttttaatagagacagcatttcaccttgttggccaggctggtcttgaactcctggcctcaagtaatccacctgcctcggccctccctaagtgctgggattacaggtgagaagcaccatggccagccagattttcttttttgctgcggggtggtttggagggggaaatattttattggtattccatacctttctttttttcctccaaacatctatagaattacacttaacacatcattaataataaatatttccaaaaagagcaggtaagctcacagagattaagtatgtgtaaaatacatactgtttcgataaagattaattatgtattgttattttagagaaaaggtggataatacctactttccaatgtatttttagcgtgacacatttcaaacataaaagtatagagaatacagcagtgaatacctatatagctacaatccagttaaatcaaaattagtattttgtttttcttcattaagagataaaacatgacacatatatttgaagctccttggttccctgctccttcccattccccatctttcttttcagaaataaccatttatcttaacctgatttaaatcaatagtagtttgtttctgtctttagcaaaggactttttgccattcgtaaattacttaattagctaattaatctgtcattttattatttttttcttaagcatttgtgtttgttaattatacttcttttacaagtgtatatgtcatgaacttagaaaacaaaagtgaattactgattaacacatgtttagtgagtatttagtctttttgttttataccttgcccagtaccatttccctctacagggcggaggttcatttgtttaaataatgcaaagatgtgacctatttgcttcccatatattgtttactgtgtattagtactaaattatataagtaacctacaaagtcagccttttattcttcatttagggtgttaagtaaaagattaaaaatgcactgatgaagcatgggttgaaacttctcaatatagtctgaggcaccttagcaacaattattatgaaattgtcatcaaagcgtgtcttcatgcttatagtcattcttcacacatattgagtacccactatgtgctagttctactactaaattctaggtaattaactgtaaagcagacatgggttctctccttgtatttgccagtcactagaaactagtgacaatactgtggaactataaggcatgaaatgattggcttatttacttgcttacagtaggtaggccttaattctattaactctttgtgtcacttaacagctttaactgtggagaaaattggcatgatcctgttaaatgtaaggtgagtttgtctgacatttcaatttttaaataatggcacacttctaagacttagtgactaaaaatcatagctgatgattttgttatctatctattgatagatttttttttatccttttaatttcagatgatcattacatgtattcagaggtaattccttaggataagccaagtcagctcctgattgttattaggataaccatggctaaggcacctctttgtcaggctttgtaattaggggaatacacaccttgcagttgggcttctcttcaagctctaggttccccactcagcttctgccaaagaaaatcctgctttggttgattttatatatactggacattgtagctatgggatttccctggcttaagaggatgtgagcctagtgataatcttattcattggcttttacatttaagcttgactatagttaagtgctaaagtaatttgctatttttaaaagtcttttgttgtatcctaaccgttgttattttcaaacagtggttaaagaaatggattaaaaagtgtgatgatgacagtgaaacctccaattggattgcagccaacacaaaggttggtgttttccttcagtaactcttggtaataaaaatgataaggattggtactttggcattagcaaaagcaatgaggtgacctacttacaggctttgtttcatctttttctccattgagtctttttttttttttcccagaatgtttgcctgttatttcctttttctctttgagtttattttagagtattgagtactgtagtacagcatccacagttctctgccttaggtttcttctactggaaaaaaaattagtgttctgtagaggaaaaagctgataatttttcaagtgtgggatttgtgcttggctgccatttagtatacaaatgcattggagtttactccgcctagcttggttctgttaggctaatttacatttttgtttctaattttttgttttgaagtacattgctcttgatactagtttcaaaattcaatttcaaaattcactttcttaaccccagacaaatgtcttagaagtgtttaaatcttgagtacccttctcctcgatcactaatctaatgagcaagcatttgaatgccaaccgtgtacccagctagtcttttaatacaaagtcgtattatccatcctttatgtaattcagtcctatcctatccccatagtgagtgacttgggtaatgaatggtaggttggttcatgggctattcatttttagtattattttgtacatgtaaagatgatgctttaaagaatgctgagttgtttgacccatagtatataaagctatctttgaactgttgcctcagtcatcacaggacaatgagattaagaagtgtgtaaacaatgaaggccgacgcaggttgtctgtgtgtgtttaaatatacatcttacatacttatatataaaacatgaatttatatttctgtctcccagaaagtagtgaaacagtgaatcttgccacataaaacaaatgcccaagtctttaaggaatatatggtagaaattaatattttttgttccctccaaaaccatcacgataagcataactcacgtcaatcaaagaaaaccttactataaatatactgtaatgtcagaaagtggttacttgttttgttattaaaaaaaaattcttagccaagcattctttttttgaaaattgaagattttcccacaagaaatgttccttaagtcccagaattctttaatatgctctgaaaaactaatatttagaataaggcaattatattttcactaaattgtttaattaaatggtagccttttttctacatctagagaaattcctacttgtaagccccaaagatgtttaaaatagggagtacaggcttgaatatgtttggcttagtttagattgtagattaccaaggaagaatggcaatttgtaaaacaaatttagctgctcagtatttttgagagaaaactgaagagtttttctcttgaggttttagaagcttttaagattattagctccctaaacagatatgcatattgtcagtgatatcctaacattttggaggtttaatactattaggttaattataaccaagaaatgtagaatgtagaatgacgcatattttatgcctgaaatttgcttgtttggaaaaaatgtaaaatttcttatgtgggtgatttcaaaaatttgatttgaaatatataattaaaaagttgctatattggcctattttaaattgctatcattgatgggcagcatagtcaatttcacaaagaaggccaaattgtgcaaatactaatatagtgggtgatccctccttgggagagttacaaacctcaatcacaaatgcaaaaacaaaaaatccataggcctacagagcagtaattttggcttactagcaaccaagaatatgatatgaggccaggtgcagtggctcacacctgtaatcctaacactttgggaggccgaggtaggcagattgcttgagcttgagagattgagaccaacctgggcaacatggtgaaaccccacctcaacaaaaaattcaaaaattagccgagcatggtggcatgcacctgtagtcccactacttgggagactgaggcaggaggatgacttgaacccttgaggtcaaagctgcagtgagccatgattgcactgctgcactccagcctggtcgacggtgagaccctgtctcaaaaagaaaaagaaaatgatttggacttggaaaaaaacaatctaacacgatctctgtagcatacttgttaaggagtacaatgaaaagaatttaaaacatggttatttggtaggagaaagttggaaaatccagtagccacaaaatgaatttaccaatcaaggtctgatttcctagttacctgacactgaagtcagattgcttggatttggatcctgacttgacttatgtgaccttggactagcttctttataatttttctctcccttagtttattcatctgacaaatggaaataggaatagcaccactataagaattatgagttgatgcatataaaacactgagaacggtacatgggatatgggaagtactcaattatttctagatgacactagagagtatagtatatttatatgaatagaatgcttttatctcctatagtactgttattactatatatatgactaaaagtacttaaaatgatttgtctctcagccctacttaaaaagaaatcctaggaaggctgaagtggaaagatcacttgactccagaagtttaaggctttagtgacctatgattgggcctctgaatagccactgcactacagcctaggcaatgtagtgagactctgtttctaagtttaaaaaaacaagtccttaaattgttgtatgtcttaaaagccagtggtaataatggtaacagctcattttaaatagtgcttaagtgttcaacactgttctaagtgctttatatgtattaaccacaataaataaaatgtttaaaaacaaaccaaatctagaactggcttttccttaatgttagtaatgcaacctagtgtagcattgacaccaactttatagtttctcttcataggaatgtcccaaatgccatgtcacaattgagaaggatggtggttgtaatcacatggtctgtcgtaaccagaattgtaaagcagagttttgctgggtgtgtcttggcccatgggaaccacatggatctgcctggtaggttggggaaattaagggaagaatgtgtttacataagtatgtgccatgtattatgaataacatttctacctcatagatatcaccatctaacttgcaagctaaataaatacatagtgtgtgattaatgttataagtctatgcaagacatagagggattagttagatatatttcataaaggaggtaacaatttagatgaactttaaggggaccaagagttcattagttataaaagtagtaggaaaaacatttagggcaaaagttgcaacatgagcaaaggtagaatgttgtgaaaatacatgactttttcagagaataactgtattatcaaatgtgcctctctaggccaaaattgaaaactcagatgctgttggcaaaacccaacctgcaggtggttttactctgcatatcattagacattgtggaatgctttaaagccttgctaaaaggctttgtcatattttttctttaaataagcatatatatgttgctttccttgttttattgatgacttacttgaactaatataagaatcttgggccaggcacggtggctcacacctgtaatcccggcaatttgggaggccgaggtgggtggatcacctgaggtcgggagttcaagaccagccctgaccaacatggagaaaccccgtctctactaaaaatacaaaattagccaggcgtggtggcgcatgcctgtaatcccagctactcgggaggctgaggcaggagaatcacttgaactcgggaggtggaggttgcactgaaccaagatcgccccattgcactccagcctgggcaacaagagtgaaactgtgtctcaaaaaaaaaaaaaaaaaaaaaaaaaaaaagaatcttacacagcatatgaagcagttttctcactggttaagggcataagcctccactgggtgacaggcaaaagtttaagctctgaaactctgtagttatgtgaccttaagtatgtttcccatcctctgtaaattttattcttcatcttctcaatgaagaaaataatgcatatttcataaaatgtttaagggattaaatgtgttagtacatttaaagtcattagccaagtgcatggtatatagtaagcactcatgaaatagctgctcccataatgtaggctcccataactgatgtatagtaaccactccaggggaagtgcaagtcttactcatctatgctctgagctgacctctctgggtatgttttccccttcccaccattctgtatatcatgcagttttaaatgactctgaaaaactgtaatagcaaagcacatagcacagcatctgttacatggtaggctgtcaactgttggttctctgtggtttataaaagagcagataaggtgaataatcctggaaaattagaaatatttggcttaagtaacagatggcctaagagataagattatctctttctcaaaaagttgagttaggaattcagacagtcaataaaggttctagaaggacagtgttttctaataatgataggtgagctgatttgaaatggactgcctcaggaggtggggaatttcctatcactggatagagaactaatttattatagagagaattcaaacactagatagggttagaacagttcctttcagcctgctaattctgtcattatagcagtagaaccctgggtgttttaacatctcaatttctctgttataaaagataacgttggtgttagataatctgtaaatccaggttaaaattctgattttttttttttccttttcattgattttttttttctttatggaatcctctttatttacttgaaggtacaactgtaaccgctataatgaggatgatgcaaaggcagcaagagatgcacaggaggtaagtatatgtataacaggacaatagttgactaagaatgcacgttgtatattcatattcattagagaataattttttttttttttttttgagacagtgtctcgctttgtcgcccaggctggagtatagtggcatgatctcagctcactgcaacctccacctcctgggttcaagtgattctcctgcctcagcctcctgagtagctgggattacaggtgcgcgccaccacaccctgctaatttttgtatttttagtagtcagtctagtctcgaactcctgacctcgtgatccactggcctcggcctcccaaagtgctgggattacaggcgtgagccaccacgcccagcccagggaataattgagtagaacttttcaattctgaaggatttgtgaaagacattccagtaaatattggatatctatttacatttagaaagggaatcttatccaaaatatttatcaagaacattcttatagtaagtttattttcttttcattaatgtagttacatagcacattttagcttttggtagagtcttgctttcaagatccctcctaccccaagaagaacagtagtgaacagcatttgttaaatggccctggtgctatttataggcaatatcttacttacttaaattttttttaaacctttttgttcatcaagaagcgctgatgattataggtgagctgatttggtatggagtgtctcaggaactgagaaattccctattgctaggtagggaaatgacccactgttatagaagggatccaaacactaggtgtggattagattctaaagcacttttcattcctttcagtctggtgattttattgtaattgtggaaccctggaatttaatagttcctacattcacccattccatattgaaattccccagttgtcccagaaatattcttttcaaatgattttcctagccagggtacaatctaaaatatggtttgcatctgtttcttatttacttgttaacatatcttcaaaatgtatttctaataaaaatatcatatatagaaatgagtatatatgtaacctagtctgtcatattgctagaagtgaaagttttgtctttccctttttaaaaagactgggaaatacggccgggcttggtggctcacacctgtaatccctgcactttgggaggccgaggcaggcggatcacctgaggtcgggagttccagaccagcctggccactatggtgaaacactgtctctactaaaaatacaaaaattagctgggcatggtggcttgcacttgtaatcccagctactcgggaggctgaggcaagagaatcgcttgaacccaggaggtggaggttgcagtgagccaagatttcaccactgtactccagagtgagactctgtcgctaaataaataaataaataaataataaaatgactgggaaattatattttgtaactataaatgatgtttcacagaccttcacaatgtttgggtccatttaaggggaaaaaatccctacaaattccaatattgatttaaattatatttattataatattatttaaatatgtataaacaaaaaccagctataaattcttgtgctcttgcacaattctacagccaaaccaagagagccacaaaatcagtgaaactcaagtaaatgttaatttggtagatactgttgttggggttttaaaaatgtattattactgtactgttaaatatcatgagataacttgttctcccaccaattttcttttctttcttaaatgatgtcccttaagtcatatcccactaactttctatatatttctatatttccaacattaatttttatgatgcattacttgatttgcccagaatgtattatggatatatgttcttatcacctttttttctccattaacctgatgtatttatttagccagatatgctgtttatcaacaaagaaaatatatgtggtttatccttgacctcacctggtctttatttggatgccggtagaatccctttctgagatctatagggagggtgggttatgtgcatagcttttgagccagagtctaatgtttagattctagatactaaaatagattatttttctgtttcacatctgttggactaaactagaatcttctataactgtgggagtacaaagaaagatttcctatcactccattggttgtttggttgattgactaattgattgggagccacgcctccctgaaaggatcacaccattgcatgcctatctggcctcctcatctttccccactcccaagctcttggcctagcatttactgggagttgtagtctgaaaaattactagaaggttgacacatattcaaaagatccttgatggtaccttgactgccctgcaaaagatgtacctgtgttatagaaaattgttgactcattatattgtaccacagtgccgacagttgtggatatttgaatcttcttgtcctctagactagggtcagcaaactttttctgtgaagaatcagatggtgtatatttttagctttgcgtactacataatctctgttgtgacggctcaactctgcctctgcccttataatgcaaaagcagccatagacttaaatgagtaggtataactgttccaagtaaattttatttactggctgggcatgatggctcaaacctgtaatgttagtgctttgggaggccaaggccaaggatcacttgaggccaggagttcaagaccagcctgagcaacatagtaagacccccccgccgcccccgcccatctctacaaaaaaaaaacaaagaaggtttttaaattagccatgcatgttggtgtgtgcctatagtctcagctatttgggagctgaggtgggaggattgcttgagctcaggagttccaggctgcagtgagccatgatgacgccacccctctttagcctggatggcagagaccctatctcagaacaaaaaaacaacaaagaaagcaaaacagttttatttacaaagacaggtggcagctggatttgtcatgcaggccagagtttgtatacccctgttctaagcagtcaagtttgttgtcttttccacgctccccaaactgctttcaggtcgctgattacatttctcattccagattctggcatttgattggagaatttgtcttgatcaggctcagtggctcacgcctgcaatcctagcactttgggatgctgaggcgagaggattgagtgcgggagtttgagatcagactgggcaacaactgagaccctgtctctacaaaaaatttattaaaaattagccaggtatggtagtgcacgctggctgaggtgggaggatcacttgagcctgggaagacttcagtgagccatggttgtgccactgcactctagctcaagcaacagagcaagaccctgtctccaaaaaaaaaaaaaaaaaaaaaaaaagtcttattagcagtgatggtatgggtgttcttttttcatgttgaattttagtgagaagcagtttcagaattcttagattaagtcaagtcccataacatcatacatgtcaatatggtaagggagggttttcatttcatttggggaacttgacaggcttggaaatattagtactttaggggaagataaaatgccaagcagattttccacatattttcagattggcataattttcctgttcataagcattggtttgatacttacctgactcttgaaataacatggctgtggttttgttgttttttcattgagatgagggtctcgcagtggcatgatcatagctcactgtagccttgaactcctgggcccaagtggtcctcctgcctcaacctctgcattagctggaactagaggcagcttgaggtgtgcaccaccgcgcccaacttgtgttggttttttgaagtgtttcgttgtataatgctggatcatgtggttagctaattatgtggctcagaattagtatttctaagcaagggaccaaccatagggccaagtagtatctgttatgtaggctttaaaacatggggagagaaagaggaggtaaggataaaggaaaagaacatacgtgtgttaggaacccctttgataggggccgggcgcggtggctcatgcctgtaatcccagcactttgggaggccgaggcgggcggatcacaaggtcaggagatggagaccatcctggctaacacagtgaaaccccatctctactaaaaatacaaaaaaattagctgggcgtggtggcgggcacctgtagtcccacctactccagaggctgaggcaggagaatggcatgaacccgggaggtggagcttgtggtgagccgagattgtgccactgcactccagcctgggtgacagagcaagactctgtctcaaaaaaaaaaaaaaaaaaaaaaaaaccctttgatagtggttgcatttagtaagcatttattaatggttttctgcaaatcaggtattggaaatactttatctttttaaaagtccattccctctagagatttatggtataatggtagaggcctcatatgaataattatatattataatgtaataatacaaaacaaatctaaactagatacattgttgctttgataacaatatactttacatatctctaaagacagactctctttacataactgtaataccattacagttgactcttgaacaattcaggggttagggacactaacccgccctacctccgcaatggaaaatccacataccacttttgattttcccaaaacttacctgttttaatagcctactgatgaccagaagccttaccgataacatagtcaattaacacatattttgtatgttacatgttttattatactgtgtgcttttttttttttctttttttgagacggagtttgctcttgttactcaggctggagtgccagtggcaggtctcagctccctgcaacctccacctcccgaattcaagcgattctcctgcctcagcctcccaagtagttgggattacagacatgcgccaccatgcctggctaatttttttgtatttttagtagagacgggatttcatcatgttggtcaggctggtcttgaactcctgacctcaggtgatccacccacctcagcctcccataatgctgggattacaggcgtgagccactcactgtgcctggcatatactgtgttcttaacaatgaagtatgctaggaaaaaagttattttaaaaaattgtgaagaagagaaaatgtgtttactttttattaagtagaagtggatcagccgggcccagtggctcacgcctgtaatctcagcactttgggaagctgaggtgggcagattgcctgaggttgggagtttgagaccagcctggccaacatggtgaaaccctatctctactaaaaatacaaaaattagctgggcgtggtagcaggcgcctgtaatccgagctacttgggaagataaggcaggagaatcacttgaaccctggaggtggaggtcgtggagagccgagatcgcaccattgcactctagcctgtgcgacagagtgagactccatctcaaaacaaaaaacaaacaaacaaaaaaacggatcatcataaaggtcttcaagttgagtaggctgaggaggaaagaaaatacaggagggcttggttttgctatatctcaggtggcagaggtagaggaagtcgaatgggattcaggagatgcaggcacacttggtgtaactttacaggaaaaccttacgaaccgttttgcattttcatttctctaaaaatgtttctgtatagtaacaatcctctttccatttgctttagtttcagtgctggtataatagaagggtccattcataaaggaagtccaaagcagtcttaagtaatcagaacccttctgccaaattgtctaatgtcaatttattttctggcactgcttctttagtgtcttcttcctcatcatctggcactggtttggaagcagctcatctccatcaagtggtcttttaattcctctggtgtggtgtctgttagctaacccttcaccttccacgttttctttgccatatccacagtctctttcgtgatttccttgatgggctctgttgtagatactgcgaagtcacgcgcaacatctggacacagttttctctaccaggagtttattgtttcagtcttgatgatgccatggttttttctataacaacgatgacatcttcagtggtgctctccttccagacttccatgatgttctgtgggggttctcttcgatagcattgacagtcccttccagagtaccgtgtgcatctttacgtttgtttacatttctctcaatgtgaatggtaccatatacggtctgtaagagtttgtgtgcataagttttgataaatctcaactttttattaatagatttatgtatattttatcgtagtaaatcataagataggctacatatgtcttatgcattcatgacaactctttttcttaattttggtttgtccgcaagtgttttcaaattgttggcaaacctccaaaaaatatttcaatatatttattgaaaaaaatccacatataaagtagacttacagtttaatcctgtgttgttcaagggtcaactgtatatgttttaaagcaatactctgttggtatcaactatctattgttcaaatatccccaattatcttaaattttgcttttttttgttttttggtgttttgtttttttttttcagaggtagagtctcgttctctccccaaggctggagtgcagtggtgcaactcggcaattctcctgcctcagcctcccaagtagatgggattacaggcacatgccaccacgcccagctaattttttgtattttagtagatacagggtttcactgtgttgcccaggctggctcaaactcctgagctcaggcaatccacccgcctcagcctcccaaagtgctaggattacaggcatgagccaccacacccagcctatcttaaattttcttttatagttggttcaaattgggatccacataggtccacaaattggatttaattgatatctcttgagtctcctctacctgttgttccttctcttcccccctccttgcttttttttctttgttgaagaaactagatcgtgttgtcctgtagagtttcccacattatggattttgctggttgcaactgcatggtgtcatttaataggttcttctatccctgcattttctgcactggtgattaattcaagaaacttgatcaaattcagattcagtggttggggggggagcccagaatacttaattgattatactttctattgtattatatcaggagttacatggtatgtagttgccactgtagttttctacttaaaaatatctctgctttttgcttgttttacatcttgtggcatactgtagaacagtgccatccagtagaacatttttgtaatgatgtaaatgttctttatcaccagtgtctaatttggtagtcactaagcacatgtgactattgagcgatgaggaactgaatttttagtttcttaaattgaattttaagtagtcaggtgtggcttgtggctactgtattggaaagtacaattaataggacatttttcaagagtattaaataacaaaagtagcagtagatgtctattcctgattttagcctagatcacagtactgtttcatcagtaaatcagctttttaaattattaatatttttaatggacaaatcataattatacacatttatggagtacagtggaatgttttgaaatatgtaaacaatgcaatgattaaatcaaactaattgttgtattgccttgccttaacatttttatggtgagacatttgaaatgatacttattttgaaatatatattattattgactatattcaccctgttgtgcaataaatctcaaaacttactcatccagtctatctgaaactttgtactctttggtcaccaactccccattccctcccttcctacccctctatccccgcaagcctctggtaaccgtcattatactctgtatgtctgtgagttcaacttttttagtttctacatataagcgagatcatgtagtatttcttttctgtgcctggcttatttcacttagtgtaatgtcctccaggttcatccatgttgtcacaacagaattccttttttgaggctgagtactcgtgtgtgtgtgtacatacatgacgttttctttctgtgttcatccattgatggacactttacatggattccatgtcttggctattgtgaataatgctgtagtgaatgtgagagtacagagatacctttgacatactgatttcaattccttttcatatatacacagtagtgggattgctggattctgtggtggttttgttttcagttttttaaggaacctccccataccattttccataatggctatactaatttacattcccatcaacagtgtatcaagagtctccttctttctttatctttgccaagacttatctttcatctttttgataaaaaccattctaacaggtgtgaagtgagacttcattatggttttaatttgataatcagcttttatgtacagtttatgtgttataattatatcacccaatttttcttaatgggacagcgatctagggcagccctgcagaggtacctgttctactgtaatcgctatatgaaccacatgcagagcctgcgctttgagcacaaactatatgctcaggtgaaacagaaaatggaggagatgcagcagcacaacatgtcctggattgaggtgcagttcctgaagaaggcagttgatgtcctctgccagtgtcgtgccacactcatgtacacttatgtcttcgctttctacctcaaaaagaataaccagtccattatctttgaggtaggagtagttctgggtgaggaaaaagcccaccttgtatcataggtctacctgatctttcatatataagatacagagttttcagggttcttgtttgttcagaacatgtaggtagacgaatgtatttattacaaagatacaagaaatttctatttcttgtcctaaattatattcagatcgatgtggtttagccagctagtgattaggtatgcaggttctggagtcagccctagattttaatctttacttcattatgttttagctctgttgatttggagcaaattccttaacctcttatttgtccattttaaagtgaggatagtacctttctaggttgttatgaggtttaagtgagacaatttgtgttttatgtgagacaatttgtgttaattgctatacggcacctggaacatcataagttctcaataaaagcctttattcaggctaaactaaccctgcaatattagaagttaatgtggtggttatctttagtggagaaataatgactaaaaagccagcttttagcagtaaaggttttctcaagtaaagatgttcatttaaaattgatgcataaaacattgatatctgtatatgactagacaataagactgactagcagatgggacttcagttgggtaacaggtacaaaactagccatagtggtaaaggatgatacaatttgaatcttccatacagtgttttcttataagaaataagtatagccagatgtaagcaataataggtttctattttttctcatttacctttgagttttcagcaaagagcagctctcagaacgagaagattccaaaagacattttaaatcctttcaaatggtcttcagtattcttccaaaagtaatgggtgaaatctttcgttcttttaacatttaaaaaattgttctggaaaagaacaaacaagttattagagatgaaagcccatagagctttacaggtgcagttaaaccacctatgaaagttacagaatgagtgttgagagcagtctgtagtcaacaaaacagtgaaaatggtttatcttttagctttattttgaagccaaaatttactttcattcttcttacagaataaccaagcagatctagagaatgccacagaggtgctctcgggctaccttgaacgagatatttcccaagattctctgcaggatataaagcagaaagtacaagacaagtacaggtaatttttttttaagctgttgaataaaactttctgccagtgatgatccttactggtaaagttcagtgatagtgaaactgggtttagcatatccagcaactgagcttttgccatgtttctcacagattgcttctgtccgttgggcactaaattgcaggtaatagtattggtgaagcatacatagagaaggaattcagccatttattctattggctaattccacttctgttcagttatttagttgctaccttgcaaggaagaaagaatccaaaaaggccaagtggcctttaggatgagagtgagaattgaatgttggtcttagcctgagaatcctatgtatgggtcatggctattcacaaatgagctatggaaacttactttttagagtttttattacatatatatatatatatttttttaatctaaggagatacttgtcctaggagtcgatttttcaagatgtgccgcctcttaagctagagatgcaaaatgttttatttctcaacatgaagctctttctcccaaagtgacaaatgctagtgtcttttgaaagttgtaggaaacttggggagtttggaagacttggagatttagtcctaaccaatatcttcccttcccttagccaattttagctaccatattttgtttacagtacttttacagttgacagagattttaaggacgtgaataaagaacccatgaaattatttctgaacctgtttatctgcagaactgtgggattgaattatgatttctaaggtccatcagaacttgtaacactttattgctttaaaattaattcccatggaatcatggctttcagaaaataccattttaatattagaagcagtttgatgtgtctgtacatctagacctgaacatgtgcctattaaaataaaaaataggtgcttggttccgagtctggataaactatagggatgccttaaaaataagtaaatgcctctttttttattattagaggctgacaacaagtttttttttttttctctttgattacagatactgtgagagtcgacgaagggttttgttacagcatgtgcatgaaggctatgaaaaagatctgtgggagtacattgaggactgagaatggccctgcataaaatgaactctgaaaactttaccatctagagtgctcatgcaattaaaacaaaacaaacacaaacaaggaggcactaagcctattctgacaccactggtctgtagtaccagaattgttttgttaatggaaagtttaagtaaattatattgtaataaaaaggtagataaaccattgtacaacagtattctaggccaccaacaaaagtgtgacagacacactaaaagccctccaactttaacttgtaacgtagcttcattctcaaagctgactccttttttttctttttccttttcctgagtgtagtacagttaaaatttcaaacagctccttgacactgcttttcatgttcaaaccagccattttgttgtactttggtaaaggacctcttccccttcctcccctacacatacagatacacccacacacagactgactctctttctctcataccccaaggtcatgagtgaatgatgcttagttccttgtaaagaaaatcttgggatggggaaaggggtaggcagcaagaggattcaacaaacgaaaaacataaaaactttgtatatgacttttaaaacaagaggacaacacagtatttttcaaaattgtatatagcgcatatgcatggacaaagcaagcgtggcacgtgtttgcataatgtttaattacaaaaaaatatttattctttaaaaatcttcaagattatgtctatttgctgtgcattttctttcagtttgcttatctttcccgggttggggttgggataaaggtgtgtcggtttagcacctctggaagacctatctagagctctttcactttcctgaggttattttgccctttctggtgttggtatgtctgttgccggccatgggcctcatgccttgaattcctgctcttgatcagggacaagggaggtcaagctctgactaatgccatgacctgattaaggggtacagcagggagttttgttgctacagctcatgaattaacctgtcccaacctaatccccctccatggcatcatgcctctacccaagcctttgtgtgcccatgttatgcacacagctgtaggcattcttaagtcccctgtcgcatccagtggaagcattttaaaatttcttttactttttggttttcccttaattgctgcttttcagattttagttatggctcgtctgctcaccccttctctacattagggtgtcaaagagaatgttttgctttaaatataaatagccattcatttagtctcagattgtgaatttaaaatggtggataccgaaattgcttgtgtgtgttgctgtgggtttggtttgaaggcaaacacccctagaacatgatattcccatctagtgcatttaaatagaaatcactgagtttgctgcttttttattgtcagcagataggagaattaataatgcattttagctgtgatgtccatttttatgaaattcctactaagagctatgttaaaagtaaaggatggtggtggttgtattaactatatacctgtttaggccattctggctgtggtatttttcaataggtcagcatctgtaaatctgtcagttttatacaggagtgcagagtgaactaggcaactagattaagaggtctaaatatgaaataccagttgaggctgaggacctcttcgtcttcctttaaatgtcttttgcctagggagtgtttaccatttgtgaggcagctttgtctgctcttacactgtacatcctattactccattgggaagtaggttcactttcctctggccttttgcctaagttaggctttgctgaatcaaccctacttttccttttagaaaaggttgttacaggagatttactggcaactgttcttttcccatcaaaaatcagtgaatgtttgctgagtataaatgctgcttccttaaaccacttgtcgctttaggatcaactttacctgtaccttttctcctttcctcccttgccacctcaggtgcaaatctgaactcagtgtctgcttcttccattttctcgtctctctcccctcttcccccattatccatatgacattattttacttcaaatgacagcatcaatcttaaaaagatatacattaaaactaaggagtttttttaaagaaagcctgaataagttcctttccctggtaactttgaaaagcagtcagagttgctatatagatatatgtggctcctttaaaatgctttgtgtatgtgtggtgtttaaaaaaaaaaaatcttaccagttaactttgcagtgtctaggtttgagtgtcataaatccacgtgttcctgttgcaacaaatacccaaaaattgtgtgtgcacttcctaataccagtcttcacccatggaggaacagtgctttttagagatgctttctatttcaatgttggcatactgcctgagggtattgcagttgtgggtgcattccctaatttgtatgatcaagatgaactggcccttttctacttccaagcttttaacagataccaccatatttgacagaattcccagagtgaattgcttgtgttattagtagattcagtgcccccagctgggataggcaagccatgacagcttccctgtttcacctacagaagtcttatctgagggatctattcacagtaagcaccaaggtctccatgtcttgaggtcagtttcattgtcttttgaaaagtgcatgcttcatttgaacaattcattcagcagcagatggactttcagtgatttaaaataaaattttgatccaaagctcaggacacaaaccacagtggtaaaattgagtagcatataatatcagactaaattatctgtaattttccacaacccagattgtatgtgttttatgtgtgtttaaataaatatgttagatacacgtgtatacatacacccatatacaacagatccaagactggctgacttcatttgaaatggttgaatctgctgtgtaataaagtggttcaaccatgattaggaactgaaatttagtagaagagggaaaaggagttaatgtaacaaattattttagctacaaaccccggtaatagagcacttgggggatgggatggggtgggttggtgagacaatcagaatggtaaattgattaaatgctcctaaccctgtaattttgtgcatagagcaccctatgctgtggaaataactgttcttagatttcattgtaactggactgttcaggttgcccagagggaaagaacattcctaattctaataaaataaacttttattttgttattccattagttacttatgtttatttttatagttaaaaaatgactaaaggtggctaatagccacccgtattatgtgccttattcactgttcccacttaatataaaatgtcaaaaattggttgtttctttgcagggaactgtgaatgagcccattcccccaacatttaacttggttaatgaagctttcagagcattttctgaaagatttccaatttctgcatctcagatattgaatttaaattgtttgtgttgtaacagtgatacaaaaatgttcaatagctctttgaatgccactttttttaaagaaaatactttaaaagtcattcttagctaacctcaaaactcctttacattactttcattttagctcactcttaaagctgatactgttatatagggatgaagggagagttttcttaaagaaggtcccaaagttgaagatcgtttgtcattgatactctggccaagtccaggttttaggacaatttaatttactcttatttggatctgtaattatgggagtttatcacttttcctcttcaaagcacttcaacttactgtctaaaacaagtggagaagaaattgccattttttataaaggaggaagataaggctcactgaggttaaataactccctcaatttttcatttccttctacctgaaacttaacatcatgctacctctttgtatcatattttgttattctggtcacagaatgacctagtattctgtaccagggaaggtagttcttaactatattgtacttttaaaccacattaaagactattataaatgcctatcactgctactgttagaggttgctctatactatctctgatctttcatttgttgcagtttgcaacacagtagttgagaataagtggtttagtatgatttgcttaatagtacccaagtaatttgcagttgttggtttagttattcaaatgaatttccattgtaaagaattttggatagtctgcaggaaattgttacaggatgcacagaacatcccatatccattggatctcagcctttgaggctttaaaaagatgataagcagtgagttttatgagaaaattttggctccttcagaaacaggaagataagtgggcccctcagatttttcatatatctttggggataaagttggttatatctggtttattttagggattttgcttctgtagttacccaagatcaaatagccaactcagaaatactcagttggatatcaatcaaatagtgcctaccaggggagtaaacagacaacttttaggtttttagtttttgcttttgtgtggagttgagtccaatttttaaggcaactattgttgacctttctctaggcggtagcatttaggatgggaaaaaataatatgagttatgtgcgaaaagcagttttcaggctatcatttagggccacagatatgcttatttaggactattttcagggtaggagccagttaaagtttgtatatcagtcacacattgatatgtagcagctctatcaataccacaacaaccttattaccatagtaattcaggggtctcaagtaatccaggagtctcaaactgaaatgtcaacaagagccaagtaaatattttagaaatagagtaccctggagtagatgggctctgagaggagcctgtgaaatccagacttcatgtgaattctcttaattaaatgtgggccaaagaaaacccggccatgggcagtttttttttcccagcttctactagtcttggcttgcaacaatgccactgtccatctggcattacctagaccagtgatacttaaacttgactgcgaattggaatcactgagaagctttaaaaaatattagtgcctgagtgttactttatggagattatgatttaattgctttgggtaggcatcagtaatttttgtaaagccctttacgcattctcacccctaattccagccggtgattctcacatgcagactaggttgagatccttgatctagactgccttctatagttgcaaaaagagaatataggcgagcaactccagatcataagggacaaaatgattcaaggcaaattgactggctcagaatagggcctcactggaggccctagttgagtgggttttgtggaatggtgcctcccaagggtctggtgtgcagtgcccaatttggttttttgttggttttctggtaagtggtccaccttggagaaaatcacaaaactaaaagtcttaccaagaagtagaactgacaagcagccatgttgattggcagtacattctcttaccaagggggagaaatctatctagggaaaataatacagagtctgagcaaaggaagttgagtggttataagcaaaactgtcattaaagctagttgcgtcaagtctgcacaattccacgagcacttaagagtttacaagtttctcatgtctatcattcttttgataatcttgtatttttatttcaagtgtggtatagtagtaagaatattggtatttctcagccatagatttcccttttgtaaaatgggaatactaataggaactgtaatttgttgagtgctttttgccagatgccttacttttgtctgtatcttccaagcagccctaaagcaaaatgggcattgttaccctatttttatgaggaaagacactcatatactactaacttactcaaaagttacacattgagtgtataacagggccatgcttgtctgattccatatgttcattctattatgctgctgttgtctgttacataggaatattgtgaggatcaaagaacatgtgaaaacaaaacctagttacaataataagcacaccagtgctaacttgggcaaaagataaggatacagagctgtctcagagactcccaaaggcaggatgagattgggaactagaaaaccattttggacccctaaagtggtattgtctactatctgtacatcattctcttacagctcttactgctgcttttcctgtcagttaccccatagctccaggtattacatgttaactgttcctgacacatgtagacagaaccaatcagatccatggggcaggatcatcaatacaaacatgggtgttgagagcttaacttaatcgggaaggagatcttggagatcatagttcgctgggttcacatcatggaaatcgtctttgacaaaactgaaatgccctgaagttttaattttttaaatacatgtaatgaattggtatatggtagatactcgtggctacttagtatttaccaaatgctttgtttccatctcgtttatttttattttttatttttttaagagacagtcttgctatgttgcccaggctggacttgaactcctagtctcagccaaccccttctgcctcagcctcctgagtagctgggatcataggcatgtgccactgctcctagctcttccatctcagtcttatgatgtagttactattttcattttataaataagaaaatagaagctcaaataaaatgggtagtttccttgaggtcatcctgttagtaagtggtggaatgaagttacaaacctaggttttattggtcagcacacacagtgccgggcactggcagtacagcagtgaacaaaaggtctgttggtttgtctgaagctctcaaccttgattctgcatagactcggtggattgcccaaggccactcaaccagttaatatcagagccagctctgctgtttgaccagtatattattttcaccatgctgtatctgcttctcagtcaccaaaagcaccagctaaaattgtatatagactgattaggggacttccaacctaagattgtcctggaaacttaattcttatcttggctcatctcttcaaaacagatgcctctttcgttggtgacctcagatacactgttcagaagtactcaaagtattccttttttctcacatttgagagtcactctagcattttaatgagttaagcaagccagccctgcatttccaaacccttcccagaagtctaaccttactttgatctgatgacatgggctttttaaaagattactatttttttagaggtggggtctcactatgttgcccaggctggaatataatggctattcacaggcacagttagggtgcactactgccgtgaactccaggactcaagccatcttcctgccacagcctcctgagtaacctaggactataggtgcatgccaccatgcccagctgacaatggctttatatacataatatttcctcagcaacaatttatgtcttatttggcacctgtaaaaccctcttcactgattatgcctgtttaaaggtttggtatttactccaagtcacctgcctttagccatggagtattcaagtttctttcagaatgagaatttggagggtgctcatagaaatataaaacaaggctgggcatggcggcttacaccttgtaatcccagcactttaggaggctgaggcaggtggatcacgaggtcgggagttcgagaccagcctggccaacacagtgaaacctcatctctactaaaaatacaaaaattagccaggcatggtggtgcatgcctgtaattccagctgctcggaaggctgaggcaggagaatcgcttgaacgcgggaggtggagtttgcagtgagccaggatcacaccactgcactccagcctgggcgacagagagactctgtctcaaaaaaaaaaaaaaaaaaaaaaaagaagaagaagaagaaatacaaaaccaactctttatagtagacagtttatcccccagaaagctttttaggctgaaaacgtttctatagattttggatttccttctgatagctaaaatttgtttctgtataacagagtagtgccctataagccagttcagtgcacattaaatggctgttcttagaattatgaatctgaggcttatgcagtgaggctctagctctctggagtcagttggtcaagtgggattcctgaggactgagcaaacacacacagagcaggattttgtcctaagttttcttagggatcctatccaaaaacaccattacttgaatttcccagcttccttttacagggagacttccttgctatgtgtactcccacctcggtatgtcaaatcattttctcagaggaagtacagcataaaataataaccagcatttgtagagcacttcttgtgggccttcttgggcaaatagacattctcatggaatgctctaaaattgttaagttcttgcacttgctctcaagtcatttataatctaattgctggtcttcctggtatgaacaaagatgtttgcttgttaataaattcctaccacatacccagacttgtggtttatttctatctaactagggaaagcactaaagagttttccaataaggaagaatgatctgagtgtctacctgctttggaaaagatgtctgccatggataggaaatgattttgtatcccaaaatcctagtactaatttggagtgttgtaaaggtcagggcagcaaatgctagagagtgggattaatgaaaagttatagtgttctgcatgcctttgaataattaatttttactccatttttactcgcttgcaataaagtaggttaagtgctgtactttaaggaagtccatgtacaagccagtgccttaacaatggtcaaatggttgctcactaaccaatggaaataaatgactgttgtttccacaaaattgctttacagattctaaatgctatctctgggacactggattgtgtgctctttaagataaattccataatcaagggcctggccctgaatagattggagcccaaaaatctcactgaagcaaagagataataggccagtaaagagtgggagacaaacactcctggaataggaagccactactcacctttattttaaattgatatatagaaattaatattacaaaatgcacacatcttaagtgtgaagtttgatgttttgacagttgtatacgtctgtgtaataactaccaaaagaagacataatatgttacaattaacccagaaaattctcaagtacttttaaatcacccctgagcacctccccactccagtgatcacttcttgatttttatcactaaagatttgttgtacctgcttttggattacatataagtggaatcatataataatgtactcttttgcatctggcttctttcactgataatgctttaaagacacgcatactgtatgtattaggacattgttctttattgctgagtagtatttcattctataaatataccacaatttgtttattcattctcctattgaaggacctttaggttgtttccagtttggggcaattatgaataaggatgctatcgatattcttacacagccttttgtttttgttttttgtggatatacatcttcacttgtcttggataaataagagtagaaaattactgggtcatatggtaagtgcatgtttataagaaactgccctcttattctccaaagtggttttaccattttgtactcctatcagtgatgtatgagagttacagttgcttcacatgtctgtcaacatttacactgtcactgttttttatattagccattttagcatatatgaaataactgattttaatttacattacatttccctgattaatgagttgagcactttttcatatgcttatttttcatttgtatatctttcaagaagtgtctttcatgtcttttctcattttaaagttgggtgtctttttattgtaggtgttattctttgtattttgaatataaatcctttgatagatatgctatgattttttaaagactctatgtattcacttattgggatctttcgatgaacaaattttttttataaaatccactttatcagttttttattttatggttttatgacctcaaagtcacaaagaatatattttcttctagaagttttatggtttgggattttatgtttaggtctgtgatccatctcaaattaatttttgtgaacagaatgaggtttggtttttttccaacatggatatacagttgttccagcaacatttacttaaaaagacttttctttacccattagattgacttggtagcttggttaaaaattgatcacgtgtgtgtgtatttctacattttctgttctgttccattaatctatttgtgtatccttacatcagtaccacactttggattattgaaactttctagtaagtctttaaattagtaaatccttcctttttgttatttttcaagatcgctttggttattgtcgattctttggattgtcataaaagttttacaattagctcatcttgtttttcaaacgtagatgtgctgggttagctgtgttcatgccactgcattccagcttgggtgacagcaagaccctgtcaaaaaaaaaaaagaaaagaaaaaactgctagaatcttgatatggggttttgttgagtctataggtcaatttagaatgaacattttaatagtattgagtcagctaattcatgaacatattaagtcttgtcatttatttaggtattaaatttttttctcagcaatgttttgtagcttcccttgcgtaacacttgcttatcttacattagactttttcttaagcatttgatttttaaaatatttttgattttcttttctttttctttttttctttttttttttttgagacggagttttgctcttgttggctaggctggagtgcagtggcgcgatcttggctcactgcaacctccgcctcccgggttcaagcaattctcctgcctcagccttttgagtagctgggattataggcacacaccatcatgcctggctaatttttgtatttttagtacagacggggtttcaccatgttggtcagcctggtctcgagctcctgacctcgtgatccaaccaccttggcctcccaaagtgctgccattacaggcgtgagccaccgcgcctggctaattttcatttttaagttgtttgctgctagtatctagaaatacaattgattttttgtttgtttctttagagatgggtctcactatgttgcccaggttggtcttaaactcctgagctcaagggattctcatgcctcagccacccaagtagctgggactttattcacgtgccagtgtgcctggctgatttttgtatgctgatcttgaatcgtgccaccttgctaaattcatttattctagaaatagttcttgtagactccgtagagttttatattaaatagatacacaacagtgtagtctgcaaataatgtttttacttctttttctgattttatgccttttcttctttttttttttttttttttttttttttgtctttctccactggctacaatatctagtgcaatgtttaacgtgtggtgagagcagacaccttgccttgttttcttaatcttagggataaagattttaatgtttcatcactaagtataatgttaactgtaagtttttcacagaccagcccaaagaagttcctttctattcctaatttgttgataatttttattaggaagggttattaaattttgtgagatgcgtttttagcttttaataagattattatgtatttctctttttattttgttaagatggtatgttacaggggttggcaaactgtggcccatgggccagatccagcccatggacagttttgttgttgctgttttagagacagtctcactcttttgctcaggctgccaggctggagtgcaatgacatgatcatagctcactgcagccttgagctcctggactcaagcgaccctcctgcctcagcctcctgagtagctaggaatacaggtgcatgtcaccacaccaggcaaatttaagaaattttttgtagatcttgccgtgttgcccatgatggtctcaaactcctggcctcaagcaatcctcctgccttggcctcctacagtgctgggattagaggtgtgagccaccacacttggctctcatggactgtttttgtttttgttttgagacagggtctctgtcacgcaggctggagtgtggtggcatgaacgtggctcactgcagcctcaactttcttggctccagcaatcatcctgcctcagcctcccgagtagctgggaccacaggtgtgcgctaccacagctggctaatttttctttttcatttttgtagacatggagtcttgatatgttgcccagattgatctggaactgctaggctcaagtgatcttcctgccttgcactcccgaagtgttggcattacaggcatgagacacagtgcccagcctattgcagtgttttttgttttttctgttttttttttttttttttcatctttgtttttgtttttttgagactgagtcttgctctatctcccaggctgtggtgcagtggtgcaatctgcaacctccgcctcccaggtttaagcgattctcctgcctcagcctcccaagtaagtgggattataggcacatgtcaccaagctcagctaacttttatatttttagtagaaacggggtttcaccatattggccaggctggtcttgaactcctggcctcaggtgatctgcccaccttggcctcccaaagtgctgggattacaggtcactaggcgtagtagggctactacgcctggccctactgcagtttttaataagagatgagttctctcagcttttgtctataagagaatgtccttacttttatttttgaggggtattttagttggatataggactctatgttgaccttttatttcttctttcagtactttaaagaagttattttattgtactcaggcctcatttgtttctggtgagaagtcattcatcattttaatttttatttcctttccgtaatgtgtggttgttctcaatggctgcatctgtgcattatatttacttttcagtagattgactagggaatgtctaggtatgtttttctttgtatagagtttactgaacttcttggatctgtgttgatgtctttcattaatattggttctttcttggccgttatccgtttacatttttctcttgtctcatactctcttgcttctcctcttctttggagattctagttacatgtatattagatgatttgatataaacctacagatctcagatgatttttcccctgccctgttttctttttgttttcagtttggatactttccatttaaccatctttaagttttttgatgctttccaatgttaacctgttaaacttgtttattgaattctccatttaaaaatttttatttttagttatttatggatacatagttgtactgaattattcatttctaatatttttatttctagcatttcattatatttgtatagttacaattttctgctgaaatttcctatttcttcatgcatgttttccacattttccattctactttttagcattttaatcagttattttattgggttttttctgttttttctttcatttttaatcagttattttaaggatccaaactgataattcaacatctgggtcttttctagttctgcttctattgagcccttcctctcccttaccatgaatcttattttcttgcttttgcacgtcttgtatatttgattggatgatggacgttttatgttgaaaaaaaaaagaaattgaagaaaatgtttacttccaaaacagagcatgccctttgtttttttttcaggccacttgaatggtggctcaatctgatgtatatgaattctagactggggcttcactgcagttttagtttgattcagtttgcctctagcttcaaatatttgaaggaacgtagaatcagaactctcatatcaccagggcctgagttttgggcattggcaagattccagagatctgactttgcttcatagctaagccaccagcttttatcaatgtgggagatctttccctactttacaaccttgctgccaggatttttttttttaatcaatgggctggggataggaggatctttctcagctctcatgtgtgccctgcccttttgtagaggaatgcccacaatgcctaggggatgggtttctcagcatttctgaccccatttaggctccaagagtgcctctgttggatttcacaacaatcctgcctcccctttcatttttaaagggtattttgcccttgggagaagtcaagctctctcagcgttccttctattatccacacctttagtgtactacaccttcctgtacctggttatcatctaaggggtaagattggtgggaagccttcctctgtggatttgggtcatctaggttctaatgtcaaaccagcctccaaggggttgtgaaaatgttgttaaatttcagcaggtttctcttttctcccccctgtagtattcctcttcctaccatagttcaactaggaataacaacagctagggggtctcttctctcctatgaaggacttggcactttctggagtttggatcatttaggtttctttggtttttgtttttattttgagacagggtctcactcttacccagcctggagtacagcctgtagtgatctcagctcactacaacctctgccttcctggctcagttgatcctcccacctcagcctcctgagcagctgggactacaggcgtgtaccaccacacccggctaatttttgtattttttgttgagatagggttttaccatgttgcccaggctgatctcaaacttctgagctcaagcgatctgcctgcctcagcaccccaaagtcctggggttacaggcataaaccactgcacccaacctagatttctttgtgtccttagctttctgatgaattaaacatatgttttattttctagctcatctggccttttgttgttgtttgctagagtgggaggtatattccttgtgactttgttcatatcactagtgaatttcagaagtaggagtttatttttttaataaaaaatttttttaggtcaggcacagtgtctcatgcctgtaatcccagcactttgggaggccgaggcaggtggatcacctgagatcaggagtttgagaccagcctggccaacatagtgaaaccccaactctactaaaaatactaaaattagccaggtgtggtggtgggcgcctgtaatcccagctacttgagagactgagtcaggagatttgcttgaacctgggaggcggaggttgcagtgagccgagattgtgccactgcactccagcctgggtgacagagcaagactccctctcaaaaaaaaaaaaaaaaatttttttttaaacacgtctcactgccacccaggcttgagtgccatgacatgatcatagctcactgctggcttgaccttctgggctcaagtgatcctcttgcctcagcctcttgagtagctgggaccacagtcatgtgccaccatgcctggcttttttttttttgtagagtttgggtctcgctatgttgcctgtgatcctcccaccttggttttccaaagtgctgggattaaaggcatgagccaccatgcctggttaggaatgggagtttaaacaatggttttatttacatatttcattagctagtatttttttcttttttgagacagagtctggctctgttgcccaggctggagtgcagtggcacgatctaggctcattgcaacctctgcctcgtgattctcgtgactcagcctcctgagtagctgggattacaggcgcccgccaccacacccagctaatttttgtatttttagtagagacagggtttcaccatgttggccaggttggtctccaactcctgacctcagttgatccacccgcctcagcctcccaaagtgctgggattacaggtgtgagccatcgctcctggcctcattaactgttttcaaaagtaaaagtacatggataatacaaagttaaattttgtagaatcataaagaaaagcaacaccttcccatcttaactcccctagtgcctctactccctccacagagacaaatatcttaccagttggttgtgttttcttttccaaactgtatttctaaaatgtgtcaatatctcttccttttattttttattttttgtagagacaggggtctcactgtgctgcctaggctggtctcaaactcctggcctcctacctcgacttctcatagttctggcgtgagctactgcacctggcctcccccttattatttttttaaacatgaatggaagcatactatattttctacactttatttgttttatgtaactattttaacaacctgaggacttttacaggctgcataatatgtcttaatatggatgtatcttagtttatttaaacagttactggtgatggacatttccatgtttccagtattttttctcacaaacaatgcagtattatgcctttgtccacattcaccattgattgctattgagtatatctgtagcatcaagaataggcatactgaaaatcctccatgaagtccagtgaagcttcatattattttgaagtgatatttcccagtgttggctggactctcaagcgtttgtggtataggttttgggaggactggacacttccaaagagaaataagatgttacagacttgtccagcaggtggcatcagaacaaagctggctatggaccttgtcagtacaaatgataaaacattaaaaatgtaaaaactcaactgtagctccttgtttatacatatattgggggtgttgaaaagttaccgatgcctgattcctcttctatgtcctcagcccccaccataaaaatagataaatgccattttttttgtatgcccagcacagctatatgatttgaataatcttgataagcagggtcacatttgaggagatttgctaagggaaatgaagatccatctgtgacacaagaaacatgttctatgtgatttctgggattttcctgtgaacatacttcttgtttgtttgttttacagtggatctcactctgtcacccaggctggagttcagtggtgcaatcatagctcactgcaaccttgagctcctgggctcaggagagcctctctcctcagtctcccaagtagctaggactacagacacatgccatcatgccaggctcattttaaaattttttgtagagacgggtctcactatgttgctcaggctggtattgaactcctgggctcaagcaatcctcctgcctcagcatctcaaagtgttgggattacaggtgtgaaccatagtatccaacctattatgtttttttaaaaagagattgttctaattatgtatataattaaagtacattaggtttagtgattgcaatttgagaaaccaatgtcctttcttattgaaaaaggccctggtacagaaagtgttctatcttcctcacaagatctgaggtcaaaggagagattttgaaacattatagcaatggcttctagttattgaataaagaatgtcatttgctcctcacaggacccctttcagggagatttcacatattgggaaacagcctcatgagctttctacaaacatctttgtccttaagtcttcccatttcagtaattggctgtaccactcatccagcagctttcaaagtaagaaacctggcaatcttcctttaacatccatttccctttccctcattcccccatatccaatcatgtgtattggaggtttttccacctctaaacttgagaacccatttactttttctccatctcctttgccatcacactagtccaagtgaagtgtttcatcatctcatttgcagcatcctttagtttaccctagattatcaatttttgtccccctcccaattcagtctctactcatgagctaacatgagtttattaagtgttcattctgaccatgccattccttgctcaaaattctctagtgccttcccaatgcccttaaaataaaattcctcatatggcctttgtggatctgcactcctacctcttctcctattgcaaccaaccctgttacctttttctcttttcacactggtcttcattctgtgctgcaaactggctgagattcttccatcctcagggcctttgcacaagttcttcctttgccttagaattctttcctggcctgcacatgtcttcatcccctttccctaagctaatgccttaccctttaggtctcattttaaacatctcttacccaggaaaaatttccctgtccaaacaagtctagattggctccccattgtttgttctaactgttctatatttctccttcttagcatttatcacaattcttggtatgttgtgcttttcactttcttagtcgctattattggagtaggtaatacatccatatagtacaaaattcaaaatgtattaaaggtatagagtaaaaagtcttctcttccctgtccccccgctacccagttctcctctttagaaccacttttagcattttgaatatccttccagaaatattttctaagtatacaagcaattatgtatataatattcctctttatttttgcctttttattaatacagatactatatgcattttctgcactttatctgttaataatatatcttggcaattattcaatattaatatgtaaatagttgcctctttctttttcatgcgccatataatatggacttataatttatttaacctctatctaggttggttttaggcattggttattacaaataatgctgcattgaatacctttgtatgtaaagtcatttcccacatctatgcctatagaataaattactagaattgaaataattcagttaaagattatgtgcatttttaattttggtagttattgccaaactgctctcaatggaagttttatgaattcccactagtgaatgcatttgtcctcacaattatgtcagtgaaatttttgttctttgccaatgcaagaaatggaaagtatctcttggaaactaatttgcatgttttttttccttgcacagttatattttcatatgttaaagagccatttgtatttcttggtgaattgttcataaactttgcttacttattatctaatgtctgactaatttgctacactctaaattcccaattcatacttaagtctcgcccttgcaatttagatgtacaatctgcctcttcagtggtttccacaccaaaaaatccacaggctcctgaattttatatgggcctaagagtcttactgaaaattggaagtcttaaggtgtagtctattttatgcagtgtgaggcctttcatgctctgaaatgtaccactcttgactgactttttcttcttcaccctgtccggcactgtgcccttattagccagagaaatgttccccctttctcccaggaaacgttctgaccttaccctggtccctcaaggactctccttctcccccaaattaactttcaaggagtttctccaacccaaaatggcacccttcctgaaaagatttctagtggatactgttttctgtacctcactacggatgtattttgctgcttggctccccgtctccattttgctatggcaaacatttttttccagaaatatatcagataaaatgaacatgtggtcccttttgttgatttttgttgggatccatggtattgatttcttctagtttagataattccaccgtggcaagcttttattcctagcatagcgctcatgaggagaatgttagtcacttggtgttattaatgctaaaatagtaaacaagaacacaaaatttgctagattagaagtggattttttttccaggctgggcacagtggctcatgcctgtaatcccagcagtttgggaggctgaggcaggcagattgctttgagctcacgaattcgagaccagcctgggcaacatggagaaaccccgtctgtactggggctaattttaccaaaaaaactagccaggtgtggtggcacacacctgtggtcccagctactggggaggctgaggtggaaggatggcttgagcctgggaggcagaggttgcagtgagcctagttagtgccattgcactccagcctgggtgacatgtctcaaaaaaaaaaaaaaaaaaaaaaggtaaggaatgaattaacatgaatgaaaaaggcatgatctgcagtcagtcacccatggtcaaagatagcagataccaattcattctcagagcgaaacgaaatcagcccaatgcttttggcaaactgtggttgcctccctgtcatcatcatctgggctcactgtggctcgcccttctggccttgcttctgaccttgccatctctggggaggcttctttgcaagcccaagcttgggctccccttctcagaaccatgtgcatacttgtcctggaactgtttttttttttttttttttttttttttttttttttttgcctgtgcctcttggagggcaggggccatctggcacaaacctgcatccccgcagttgctaaattaatgaacaaacaaataccaagtctttcacaatgtaacttgagagtggaggtagtggtagtggcaactccatctgggggatgagagaaggtggaggctgagttttggggatggcttgcaacagaagaggagagattattagcagctaaaggagtggccagggtgaacaccaagcattttcctgactggggagctgtgggtttgtttatggctgggtaaggggtgaaaccagtgagcaggagagatagctagtactggactggagtgaaaggcatctgtagaggcaggagacaggatggggaggtagaggagttggcctaggacaggacagcacttatttgaagactggtgggcaggaggaaaggaaggagagggattgagaaatgacctggaggtcctcagtcagctgggagaagacctggaagagggggattggctgctgttgggatggagaggagggccaggggaggcagtgactcacacggagggaggctcggggatggggactttggcagtggggggtgggaaagacatactcgcaggggatcggaaggccccgtggcaactttgtgtaagtcctggttcagtcaaggagaggaatccgagggaaatgcctgattggacccatggcccactctgagagaaaggggtactgtgggtgtgcaggaggaagagcagctgggaagtaggagtgcctaggactggatccaactggaaagggggcagatatgctcccaggatcagggtagggaccctctaggaagggggcgttctgagagggaggttgtggggagcactgtatgggggtccttggaggtgatttctgggaaggggaagtctggggcagggctgtgaggagtcaggaaagaaactgtggagtccgttcctcacccacctcctgagccctggggtctgaggcccccaggaaagagggttcagtggcacaggagggtccagggcaggagagagaaagcagcctctcaggtcttcttggaaaggaactctgaccaccagtgtgaatagtcttgcagaaagctaagcggacaccaagtgaaagctggcccctcccctctcccagagtgggaggggccagcggttgcatgggcagctttccttgtgatgccacagtcctctggacacactgctgccttgccacacctcctttccctttcatctttctcatcaaccaatgggcttggcagcattgaggccatgcccctattctgtgttctagtgtggccctggttatccctcctctgactcagttgcacagctacctggcaggtgaccggaggtgtttagcagtcttgcctggattgcgctgatgtggccccaaccccgcctccctccccacaccaccatgtaggaagaaactcaacagagcaaattggctgcagccaagaaaaaggtaaaaaccaccaggtcatagcccctgacccacctgcagacttcctctgacggcaggactactgccagagtctgtgccactcctgaggcacaccgggttaggcccccctggtgcctctgcactccccctaccaaaatattgttagccagcgctgttccctcagcagcccagcccctgccctcaacagtcaccccagggtgactactggggcaggtgactcctggggctccctgctccagactaggccctgacctcctgccccctcccaagcctgacctccctgggctctttggcctggcatctccaaggactaagacaaccacttctggtggttgccactcacctggggatgtgagttttggctggccaggctcctggggacagggggcccaaggggcagtagagggtaattgttaagattgctgggtactggttaaaaattctgggtttgaatcctgcctctctgtctgctggggatatgatttagggcaagttacttgagctctttgggcctctcttttcatatctgtataatagaggtggtattgtttgacttccatttgtgaagtttaaatgaaatttgttgttgtttttatgtgaatccctagtacatagcctgctgtaaacacacaggacacccaggaaatggtcattgctgtttgattttcctcgccccagtctcaaggggaagccaggccaatgagaaaagccacttgccatcagcctatccctttagaagtcactgaaagggccccacgtgtggtgtaagagaagatcttacttgccaccagcttgctgggtgaccacagaaaaatcactatttcccctgagcctcagttttctcctctataacatgatactggataagatcagtgtctttcaaacttgtttttcacctggagtcaccttagctcaactgaacccttactcagaagtctggttttttttttaacagaagtggaggtctggagctctaccacattcatcgcccatgtcctgggcctgaggagaggggtccagtgagcgtattgagaggtgcattggtcagctgactccactctgtgactgcgtcactcaggggacttttccatctatttgttcctgcccctggcaaggcagcaggtggccatttggaagaatggcacaggccatggttttaatctcctctgctcttcttcagcgtttcctttccctgaatccacatctttctcctaccctgactttcttgcttctctctaagccacttctgtctttctccccctgcccttgtttttcccttttcatctcctgtagattcaggacattccgaaggtgctggtgtccaaccttaactactccaatggggtagcactcctcgactggacaagtggaaggtgaggcagtgcccagacccctctctggcttgctgtctccagctatgcatgttcctgaggcttctctggtttgggggatactttgcctctggcttattttatgttgctgccattaaccttcagcctgtttatgtctgcttcttcacttgcttgattgattgagtttttttcctttccagcatcttttatcatcttggaaatggtgagacataccttaaagtttaaaagtaatttgggaataatgtacaaagcaggaatatgggatttggggctttttttttttttttgagacagagtctcactctgtcacccagactggagtgcagtggtgtggcacaatctctgctcactgcaacctctgcctcccaggttcaagcgattctcttgccttagcctcctcagtagctggcattacagacacctgccaccatgcccagctaatctttgtatttttagtagagacgaggtttcaccatgttggacagactggtcttgaactccttacctcaagtgatccaccagcctcagcctcccaaagtgctggagttacatgcgcaagccaccgtgcccagtcccttgctgtttttatactttctctatatccataactgtttcccatggaagtttttgtttctttgaatttctcatttttattacccctgcatcatctgctaccctaaaggatctggaggtaagaggccctaggctgaggtgcagtgaccctgcaggccagccctccaacctcctctcacagtgggggctgggtgcccctctgccagctgagacagcccacacacaccccagccctaatgattgttctctctacctctccctgcagtcctcctccaactcctcctctctgtatgcacctcagagccggtaccaagaactagcagtagccctggacttgagctctgcaacaatcagtcaactcattgaaaacatagtcattggtaagagtccagtagagtcccctgattccactctgccaatcctgggctccagtttccccttggggccctgaataaaggggctgggggcccctggtgccaaggacaaatggagagctggggtgcccatgcctcacctagagggaccccagagcaaggagcatgcagcatggctcttccattgctgccctctttgctgactctctcttcttcaggtacccctgctccagtccttgccacacacgccctggggttgtcacctctcagggaagcgctagcctgattggttgtcaggggccccatatttctgccctgactcagtctctaatttgcccttgagtctggacaagccacctctcctccttgggcttgtgtttccagaggaggtagagagtatcaaaggtctctgttagctctgagagtctgagatttaaagtcccctagaatggaaacctcagggcgaaggcctcctgtctgtccttttctgtcctgtatctctgttgtgaagaactgtacctggcctgtgtgtgctcagtaaatgttcattgaatgaacgcacctttctaaatcacaagctggcagaagggtgggcctttctcagactccgtctctggaggtttatgttactgtccttttgagagaatccagattcagactttgagttctgtggctgtgggcaaaaaccaacaaagacccacatcctgtgtccttgggagcttgaggagagttgaccagtttgtgttgccattgggtctgagaactttgcctttaaaatccattcctggcccctgcctaccgcttcctggtctggggaatagagctgagggggccaccctcagtcacctgaatttgactctccccacagaaacagcagaagaaacaagtggaacatcagctggaagaagtaacatgatttctttctttgctcacgacataaatgctgggtttgggggacaatcagatgtagaggtgccagtctcgtgtcgcccacttccagcctggggaagaaggctcacccctcagattccaccccatcctcccaggttatcccgataacctggtcccatgggtgggcctgtcctggggcattggtggcattctgggggcatgtctcttgctgtgccatctctgcctccccctggtaagagctctgtcttcctcttcctgtaggaaaagaaaaccaacaatgaaatacacaaagcacaaatggagcagttagaggtgagtggagggtggggagttttctcctgtcctctggagaatgtttctttccttctctttcagcacttgcttggcttttctcccaaaggttcaattccagacaatcaacatcctcatgttggaaaaagcagacttgaagaccaccctttaccatactaaacgtgctgcccggcactttgaaggtgggaatctgggcaccccatcatccttcaacctggcactttgacaggtctttagggggagtcctttgggccccatctcaacctctttcattacagcagaatctaaggatctggccagccacctgcaatattccttgcagtgtattggagagttggagtgggctctctgtgctgtgtctccatgcagcagcaggaggaggacagggtgagtccaaccagctgccccatcccctggcagcctggcttcccagatagaggagtgagcctaaaggtcccttctgcaggatggagtgtcctgcccagaaggcagcatggtcatttctcgctgcttttgtgtatggttgttagaggcagcctggggctgagtcagctgctgtgggtgagttggggggcactgtggggagcgagcactggatgcagagctcagaggccacacagcagctccagaactggatggtgaagatgagaagtttatatctggggagcccaggccattctacacagtgccccttaaaagggcaaggggtaggctcaatatacaactcggtcggtaaagatcaagtcatttccaagcctgtggtctggtttttaaaagaactgttccacacagtcctgaaacaggagaggctgcgggagcaggaggagaggctgcgggagtaggaggagagactgctggagcaggagagactgctggagcaggaggggctgcaggaacagggggagaggctgagaaagcaggaggagaggctgctacagaaggagaggctgctggagcaggaggagaggctgcaaaggcaggaggagaggctgagggaagaggaagagaggctgtgggagcaggagcagaggctgagggagcaggaggagaggctgctggaactggagcagaaagccaagctctgggacgagcaggcagagacacacatgcaaaccatgcggaatgactgcaccaccatcagccacatgctctcgcagaaccacgagcttgataagcagctgggcgagccacagtacgacttccaggagctggtgggttgccccacctggggagcctgccttcctccctagccctccaggcctttgtttccccacctgtaaaatgggcatatgtagccctcacgtgaaatggtacttctaaaggaacctgtgagccagagccctgctctgatggctgtgagagagagggaatgatttttctaacttgcctccacccttcccggtgacatgggaggcagacatcaagttctggggtctccagctgcagtgggtgaccgctgattgcttctctttgtccagaacaaagagagcaagggcgcactgcagttggagcagcaagtaaagttgctgcaggagaagctgggtgacctgaaggagacggtaacctccgccccatccaagaagggctgggaggcgggcaccagtctctggagaagggaagtgtgaggccaaaggcagctccagcctggaggcaggtgacgccagcacccttcagggcagtcctgtgactgtttcttgcttcctgccctctgacttttagaggtaggtagccctgggctcctcccaggtctggacatcatcatcccagctagaggcatggagcccccaatcataggggaagagacagtggtataagaggctcctttgctgggggcagtagctcacgcctataatcccagcactttgggaggctgaggcagtagaatcacttgaggtcaggagtttgagaccagcctggccaacgtggtgaaacctcatctctactaaaattacaacaacaacaaaaaaaaattagccaggcatggtggcgcatgcctgtaatcccagctactcaggaggctgaggcacgagaatcgcttgagcccacgtggtggaggttgcagtgagctgagattgcaccactgcactccagcctgggccacagagtgacactgtctcaaaacaaaacaataaagcctccttagattcaaactggattctggcctgggttcctctggtcaccgttcaactacttttcatctctaagtctctgtttctttaacttcaaaaggaagttagcattttccttgcagaggtgctgaggattgaatgagagaatacctggaaagcattaggcatgtagcacacttagcagatggtggttggctccctctgcttttccaccagtctgtggcctacagtttaaatggtgggaagaaggacatgagatttgaggctgaggaaggaggcatggagttctaggcaagggaggaattctctaaggcctggagcaagcggccaggggcctgggcaggtgacagagccccacggtgccctcgctaccctattaatgggcccagaatctggaagccagccaccatgtgccctcacgcccagggtcttcctgcaagtggagctgaagagccaagagtctcagagtctgcagcagcagcgagactagtacctgggtcacctgcagcagtacgtggccacctgtcagcagctgacctctgagaaggaggcgctgcacaggcagttactgctgcagacccagctcgtggaccagctgcagcagcaggaagcttggggcaaaccgatggctgagatggcccaccaaaaactgcaggagactcaggggagggagttgctgaggacggggccccaagagggatgacctgcatcttctgtgccttctcactctctttcctggccccttaggagtgcctagaagctgccagccagcagaaacagcagctagaggcccagttgagcctcatggctctccctggagaaagtacaggagatcacttagaggaagaagagagagccccaggaggaaggaggggggattgttagcagcataggactgaggagttggaacagacctttagaacagctagtcattatgccgaccgggtgtctgcactaagtttggtatcaatatggtgacctcctggggagcagggggccaccaggttgcctaaggatgggtgaactggcccagatcagaaagggagcaggtcagaactcccacactgactggtagtgggactgtgcctgggaaatataacaagatcttggttcttaaaagtaaaaataaaagtaaaaaaatagtaaaaaaaaaaaaaaaaaaaaaaaaaagaacagcagctcatttccctctggggaggggctggctcagggttacacagtgagggtgggggcagaggtggccccacagtacctcccttgttgggttgtctgaagacccctttggccaaaccctacagatggaggaggacatctggacagtgaggaggaggaggtgccttagccccttccgagcatcctggaggacctggagagccgggaggccatggtgagctgactccccctgcacctcctttgccaccttcctctgtggtccctcccagacccccttatgctcttcatctccccaccgtctgatttctctggaccctcaccccttccgggagccagtgatcagacaccatttcacctgtgaccaacaggtgcactctctgaggccccaagggaaggggctgcactccaccaccctgccctgtttgttctgtgtatgcccctacaagaagggcatcagggtggccaggccatgcagccaggctccagacatccccaggatctcagcccctccaagggtacctggaacattgaggcacagggagaagcaactggccagaacacacatccagctccccacatgctctagagggtttcaggtctctgcctctcgggaccttgggctcccccgattcagcctcgtcttagttctgactctagtacccataatttgcctccatttcccaatccagaaattggaaaggaacatctccatgtcccttgcttgaagacctggccagagctggtgccaggctacagatgcctggcaggaggcaagaagggcacactcactttccctttgtcctgggaggcccacataccaacattgccaccactgctgccacctggaagcacaaccaaactagacacaggaaaaggggaagggttgagtgaacctgggacactgcaccccaactttaatgtgttgttggattcaatttgctaatattttgtggaggatttttgcatcaatattcatcagtgatattggcctgtagttctctgttttggatgtatctttggttttagtatcaaggtaatactagccttgtagaatgagtttggaatagtttgggtaaggtctctagttttggaatagtttgagtaaggttgatatgagtttttctttaaacgtttggtagaattcagcagtgaagcaccaggtcccaggcttttctttgctgggagactttttattaccatttcgatctcattgtttgtcactcgtctgttcaggttttggatttcatcatggttcaatcttgataggctggatgtgtctagaaattgatccatttttagttggttttcctatttctttgtatatagttgcttataatagccactagtgatcctttgaatttttgcagtatcagttgtaatgtttccttcttcatctttgattttattcacttgggtcttctctttttcttaggctaaaagtttgtcaatgttgtttatcttttccaaaaaccaactattcttttcattgatgctttgttttcttcatttcaatttcatttatttctgctctgatctttattatttcttttcttctagtaattttgcatttgctttgctcttgcttttctatttctttaaggtgcattgttaagttgtttatttgatgcttttcaactttttaaaagtgggtgtttatagccataaagttccctcttagtactgcttttgtcgtatcccataggttctggcatgttgtgtttccattatcatttaagaaatgtttcaatttccttcttaatttcttcattgacccactcgtcattccagagcatattatttgatctccatgtgtttgtatagtttccaacatttctgttgttactaatttctagttttagtccattgtgatcagagaagatgtttgatattatttcactcttttgtaatgttttaagacctgttgtttgacctaagatatggtgtatccttgagaatgatccatatgctgaggaaaaaaatatgtattctgtagcccaagggagaagacacctgcccccactctgctgcaacacacagcgctctgctcagggatggggcagtggagtgctgttgttacacaaggggctctctgtcggggagggaacagaaatctgttctgtagtgtttgccatttttggtggtgcaaatattccatggctgatttcaaactgccaccgtcttctcagcctgggcttgtttgtacccacccttgggaaggctatccaagtatttgaaaggatgtgggtgttgtgatctaaagtgtatctttattagatacactccagcccagttatgctatggttcttgcagactcatagaggaactgccttgttggtctcagataagatctggaagaattctctgggctaccaggtagtagagacccttattctgtacctgtagtttctctccaaaaaacagtctctctctctccctctctctctctctctctctctgctgagccacttggagctgggtgtgggctgacacaacatccctatggccaccaccaccactgggactgcactgggtcagacctaaagccagcaaagcactgggtctcactcagggcccgctgtcaacactacctggctgtcgcctatgttcactcaaagccaagtaactggggctctacagtcagcaggtggcaaagccagcctggcttatgtctttcccttcagggcaacgagttctctcaggccctggtgggtccagagatgctgtctgggagtcagggactacagtcaaaaaccttagaaacttacctggtgctttattctaaggcggctgggctgacactgaaaccatgagacaaagtccttcccactctgcctttcccttttcacaggcagaggagcctcaccctgtggccaccaccacaggcccacagggagtgctgccaggctactgtcgatgttcacttagggcccaagggctcttaagtcacttgtggtgaatgcttccaggcctggggctcacccttcagggcagtgggcccccctctgtctcagggcaggcccagaaatgctgtttaagagccaaggcctaaaatcagtgaccacaagagcccatttagtgctctaccccattgtggccaggcaggtacctaagctgcaagacaaagtcccttttacctttccctctgcttttctcaagcagaagaaatctctcaccacagccaccaaagctgtgaatgtgctgggtctcacctgaagccagcatgtcgcagagccttactccaggcctatagcacattacctgggtatcactgttggctattcagggcccaagggctcttgagtcagcaggtgatgaatcctgccaggactagaatcttttctttaaagcagcagattcccttctggcccagggtgtatctagaaaggtaattcaggagctaggtcctggaatgggggtctctcaactctgactggggctgtatcctactgtggctatccaagacgtaagacaaagtcctctttactcttccccctcctctcctcaagcaaaaggaaagagccacttttgttgctgcaagctgcactgcctggggttgggggaggggtggtacaaacactcccttggctgtcctggctggtgtctctctaggtcgtgtgcctcttgagtccactggctctgagcccagcatggcattaggatgtgcctaggagttgaagtccttatggactagactgctttcaagtttatttaggaccctggggcataatagcctgccatgccaaggcttgtcaaaacccaagcctcaagcctcctaactactgggatgggtgaacccctctgggtagggctggtctaaatgctccctccatgggcaggtgtcacgtgagttccacctggtttcgctttctgctgtgacagggcagcactgagttcaaggcagagtcccacagttgctgcattctccctcccccaggtgcacagattctcagcaccacagcgaccactgctgggggagggggaggggtgatattggtgtttcaaggctgtctctcctaccttttcagtgcctctttcagcgacatgaagttaaacccaggtactgtgagtcctcgcctaatttttggttcttatgatgatggttttctggtggaaacagttgttaaatttgattttcctgcagggggaatgattggtagagactactattcagccatcttgctctgctcctcctccctcccttcactttaattacctcctaatagccctatttttaaatacaatcatatagggggttagggctccaagtatgaattttgaggagacacaattcagtctatagcatttggacttgggaagagggaggaaaagaacacgcacaggaaagtcacagtgtaagcaacagtatggaggtgggaaagttcagctcatggataggaaaaattgatccaagttggcagggcccacagggagatgtggtggggtggtgagtggcggccacatcaaaagaaccttgaatgccaggctgaggtgggaggcatttcctgttgtgtggaatgtgccatgaggtggtggggagggtaacgtgatgaaaggacatttgggaggatggatctggcatcagtgatgggtgggggtaaggagtgaacaaagctggaggccaggaaaccggacacatggcccagagttcaggcataggctgttcaaaggcagtttccacactgagttccaatgtggatccaagcatgcagcggatatatttggaaaagcaaaagcattcccttcccattaccacacagtttcccagctgagttcatcaccagagtcctacacatcagacagtcaacctgccccaaactctgtccctagaagctgtggcccagagggagcccttgtccagctgtagcccggggacgctgcagcctgagcaggactgcacctgttccctcccaggagcctcatctctgtccggcctggctttggcttcagatgccctcagctttggcttcgaaatctgttgggtcagattcacgagagctctggccttctttgggttgggaattttaaatagttttttcaagcaggcagtagatcaactctacttgcttacttctgggtgcatctcctgttccccggccccagatcttctttttccttggtttatcctctcattgtgttgcagcacatcttccagtggcttccagagaaacagtgaatggaagccaagctttctgaccctcacatattttagaatgtcattgttctaccccaattcctgattactagtttggctggatgtaatgctctaatttaaacataacttctcttcacattgggaaatattgctctattattttctagttcccagtgttgttgggaagaagtcagtgtcatgcggagtcttggctctttacatatgacctgtcttttctctctggaagattttaggattttctatctttgggttcttggaatttctcagtgatgtaccttgttataggtctttctacctatactgtgctagtcacttggtagactcttgaactagaaaattatgtgcttctgtggggggaagccaccagcatgtttgggtcctggtttgggtcccaatggggcacatgtgggaaagaccatgaatgcccatgtctccgactagtttccccatcagaagtgttgttgcaccaatcatcctcctccattaaaactggacagactaagggccactttcctaatggatgggtcttcttggttcatctcatgctcccaacagagctccctcccggggatgggaacgcgccatgccaggagagccctcttgatccagcctccagccaaagccagtccccctgccaaacaggccctagagttacactggagggtgacaggcctaacctggaaatttcttgctgaaaattgtcagtttcccacacaagtacagcctggcagttaattcaaattcaaaccagaagactgctgcttcagtctcgactgcttgaaaattaggttgtgtagagctttcatttgctggaaattgtgcagccagacattgtgcagattgacccagtagctacagcaagtacacacatagggcgccaagcaaggacaagtgtgcacatgtgcgcacgcacacacacacacagcagaaaatctagaaataaactattttaatgtcagctgtcatggaagttttgtgtcatttccccaaaaaaacacaaattttattttatgatttagtctagtatttatttagaattacttaaggaaaaggagacgtgagtgcagtggctcatatctgtaatcctagcactttgggaggctgaggcaggaggatcacttgagcctgggagttcaagaccagcctgggcaacatgatgaaacgccatctctataaaaaatatgaaaattagccagatgtggtagcatgtgcctgtggtcccagctacccaggagactgaggtgggaggatcccttgggcccgggaggcggaggttgcagtgagccaagatcacatcactgcattgcagcctgggtgacagagtgagatcccatctcaaaaacaaagagaaagaaagaagaagacagagaaagagaagagaaaagaaaaagaagagaggagaaaagaaagaagagaaaagagaggaaagaagagataagagaggagagaaaagaggggaggggagggaaggggagaggggaggagagaaggggaaaggagcaatgggatcctgatatctggtatgggaaaacttaagtggatacatctgagaactttgaacctccagtttccactaaatgctctgatctaaaagaagaaatgctctttccttgctaagagaagggcagctgccccttgcctggaaactaggcaaagagcctccaacaaggccttacagcaggatgaagtgtgtcgtcattgctgccccacattgacaccaggctatggtcattcctcatcatggcctaaggtcacaagcacaatctgctctgggagaataatatttttgccaaaaatgtcacaaagtatgtactggcagaatctgagagaggaggtggaggagtggacataagggtgttggaccagggggagactaaaggctgtatacacgagaatacagtgacctgggagcactctcaggatttaatggcttggcaaagacacctggggctccaacacactgctgagtggctccttgaaatgtggacagaacagttgcttcagtgaattaggaggagattatagaactgcattcgcaaagcatcaaagaagcaggaaagtacagggaggtaggaatgttggaatggttcattatatgccagcagattcggaatccaccacttgactgtgtgcccttggagggctcacaggaactcccctctctaggctaacaaggaaggcactagtgagaagggcacctgaatctttaagagactcagtggcactatccttggtaggccaggatcgacaagaggagatgctgccatgagaccaggcttcgtggtgtcagtgggaacggtggaaggtgagaacagcggatgccaggtggtggcccttcaccatcatccacaaggtggatgtaattaacttaattggtaggaaggctagagtgacagccaggatgccttgacctccagggagctgttgtgttagctacaaactgatggcattccaggggagagttacataggcagttgattagggtattttgggtttttttgagacaggatcttactctgtagcccagtctggagtgcagtggcacaatcatagctctctgcagcctcaacctcctgggctcaagcgatcctcccacctcagcctcccaggtagctgggattacaggcatgcaccaccatgcctggctatatttttttctaatttttagtgaagatgaggtcttgctatgttgcctagactggtctcaaactcctgagctcaagcaatcctcctgccttggactcccaaattgttgggattacaggtgtgagccctaggatatttcctgatttgtgtattcaggaaacaacaacaacaagatctggcacatggaaggctgcaacaaaaaattacaatttcctagccagttttcagactgagacaattgagacctatagctcatggattgtaggggaggctgggtattcttggaaaaagatcctgcaacattaccacatggtattcattaattattctccaaagggatctggggtcattgatgaaagtaactgtagctgatgaaaagggaatacccagactgtttgagggccatttatataggattagagctgaccctgacaccataagatccacaatgccaccatgtcccctccccaacaagactgaggacatgtgaaatctaggtaataaatggatccctggatgaagaggccacagccccatccggttgtcatttctctgtccctaaatatgcaattgatatgagtatgcttagaagctaacagagctctcactttactccctgacctgtgggtatgagccactatagtaggaagagcccaggggaagtctctgaaactacctcttcccacttccgggagcaatgcagtattccaggtggaatcacagagatttatcacctccctcaactgtgaccgccaccttataatgatggtattcttacatttccccacctgtcccttgtgccattctcatcatcattttacttccacacgttataaaccccacaatgttattacttttgcctcagtcaattatttctagacatcaaaaaatgagaaaataggatcttttctatttatccatgtatttattatgtcagtggtcttcattcctttgtgtagaaccaaatttctatccagtgtcatttttcttctgaccaaagaactgcttttaacacttcacagagtgcaggcctgctggtgattatcctggcttttgtctgtgtgaaaaagtctttattttgtcttcattaaattttttaaaaattttttattctgttttttgttttttgttttttgtagagatgaggcctcactgtgttgcccaggctggtctcaaactcctggcctcaggcaatcctcctgcctctgcctctcaaagtgctgggatgattacaggcatgaactaccacacctggcctcactgactttttaaaactgcttttaatcccttatctgcagagttaactttttcatgtccagtaattcttttttgttttattttgagacaaggtctcactgtgttgccaaggctgcagtccagtggcacaatcacagctcactgcaacctcgacctcctgtgttcaggtgatcctcctgcctcagcctcgtgagtagctgggactacaggttcatgccaccatgcctggctaatttttaaattatttatagagatatctcttcttatgttgcccaggctggtcttaaactcctgggctcaagcaatccttgtgtctaagcctcccaaagcactgggattacaggtgtgagccaccacacccagcctgtgttttttttttttttaatacatcttccatttctctcttctcatcatgttcagatttttctagccttcttgaacatatggagcatatttataatatgttttttaatgtctttatctgctaattacatcatctttgtcatttctgggcctatttccattgatttatttctctcctggttataggccctattttgcctgtgtttttcttttgttttgtttgtttgtttgtttgtttgtttttggagacagggtcttactctgtcacccaggctggagttcagtgatgtgatctcgcctcactgcaatctccatctcccaggttcaagtgattctcgtgtctcagcctcccaagtagctgggactacagttgcataccaccacgcctggctaatttttgtatttttagtggagacagcatttagccatgttggccaggctggccttgaactcctggccttaggcaatctgcacgccttggcctcccaaagtgttgggattacaggcatgagccactgtgcctggccattgcctggtaattttttattgactgtgtttttgtgttgtgactgctggattttgttttgctttaaatagtgtgggactgtgttccagcactagttaagttatttgaaataagttggatctacaaaggtttgctttcaatctttgttaggacagtttcagagaagtctttactccagtgctcatttagccccactattaaggcaatagttttttaaagcttctcttccatttcctaagtattatgaggtattttcattctgactagtgagaatatgaattctctctagcctgttgtgagctctggggattcttctgtctgctttctggcagttctttccctgggtactttcttctcacatatgtccctatcagccctttgccaaaggcttgagggcatcttccatagctctccagagttcacgcgctctcttctcccacctcctccctggtactctacctcacaaattctaccggccttgaagatcttcccaagctctgatctctgtctcctcaatccaccaagaccaccggactttggattcccctccctgtgttggagcctgtaattgcttccggcagtaaaccgaggacactctagggttcaccttcttttagggatcatagttctgctcgacctgttctccgatgtctgaaaactattgttttatattttgttccatttttctagttattaaaggtgggaggcaaatctggtccctgttatcagtcatggccacatgtagaggttgcaggatgttgtttacatctgtatctttttttttttttttgagacaggatctcactctgtcaccccaagtggcaccatctcggctcactgccacctccactttgtggcctcaaatgatcctcccacctcagcttcccaaagtgctgggattacaggtgtgagccactgtgcctggcctgaaactgtatctttcttattaccagagaagttaaacattttttcctgtgtgtcagcagcatttgtgtttctttttctttgaattttcatttttccagtttgaactttccatttttcttagaatttttggtctttgtcttctctacttttagaatagaatgaatatgatattaatcatacttcgaattgtggccatgatggagtacctgtattgatgatggtctcccagcataaacaactacaaagctggacaaagtacatgaagaaattgtcttcagccattgggcaataggcagttccaggtacaatctgagagaagggaatcacatgaagttactgctacatttttctggtggggaaagtttcaaaaccctcaatgacagcacgaggaagcagagtccaggcaaaggatcagtcttgtttggtggaggaaacggagactgctgctcagggctgctaaaatgtgtgtggcagggtatcagaaaggatggagttgcagagaaggagccccagaaatcttatagaggttgctgcaggtccttggccaaatcccaaactatgaatgtgtggattgagactctgcaaggcctagcacagaacagccgatggggagctgagagctaaacagcgatttcagtggtcacagagtgctggaaacacatctgaattctggctcagccagcatctccactcttggaatctcaggacttgatgaatatcccagacattcacaggagggcctagaaggccatgccttgggattaaggaagattctctaggaataaggtcaaaactaaaaaccagctcacgctaacaaaacctaaaatgtagccttgacacacgtgatcaagttaacccatcagtaatttaattccctgccaaaataaaactcaacactggagtaggataacataacccacatctctacaatgaaggttcacaatgtccaacagctcaagaaatacttagaagacatgagaaaaagtgagaaaatatatcctacaattaagagaaaaccagtcaatacgaactgacccactgtgcatggtggctcacgcctgtaatcccagcaatttgggaggccaaggcaggtagatcacttgagctcaagactttgagatcagcctgggctacatggcaaaaccccatctctactaaaaattcaaaactgagttgggtgtgggggtgtgcaggggcccataacccccaggctgtggactgtacccgtcggtgacctggtaggaaccaggctgcgcagcaggaagtgagtggtggacagcgagcattactgcctgagctccgccccccgtcagatcagcaggcattagattctcatagaagcgtgaatcctaatgtgaactgcacatgcaagggatctaggtttcacactctttatgagactctaatgcctgatgatctgaagtggaacagtttcataccaaaaccaccacccctgaccctgtctgtggtaaaattgtcttccacaaaaccagtcaggactgctggtggcacatgcctgtggtcccagctacttggaaggctgaggtgaaaggatggcttgagcctgggaggtggaggttgcagtgagttgagatcatgccgctgcactccagcctggacaacagagtgaaatcttatctcaaagaaacaaacaaacaaaagggccgggcatggtggctcccatctgtaatcccagcactttgggaggctgaggcaggcagatcacctgaggtcagaaattcaagaccagccaggtgaggtggaggttgcagtgagccgagatggcagcattttactccagcctgggctacaagagtgaaactccatctcaaaaaaaaaaaaaaaaaaaaaaaaaaaaaaaaagggggcccataaatggctcacacattggaattagcaggcaagagctttaaagtaactgcatacatacatcaaagattttagagaaatatcaacacctgtgaagatggtgaaaaaagaatttagagaaataatttttagtataagtatgtcctaaatatgcatggtacatacttactaaaatatagtttattttttaatcagaaatctaaatttaactgggcatcctatattttatctggcatctctaccccaaagccaagaaagagagaatccagagtcctatcttttagcaggtgacctagcctaggacagggcctggccaggggcaattgtgcattggatggattagagatgccagtcattcaaaggtttgccagacctgcatacaatcaacattatttttatttaatatttttgtctaaagcaactttaaaaatgttaaccctttatttggaaatatagattcagaggaaatttcaaagatggtacagagaggtttcatgtactttttactcagtttcctccaaaggttctattttgtataaatgtaggacaatatctaacaatgtcacatgactatgtctatgccattttatcacatatgtagactcctttaaccaccgctacgatcaagatagagaactgttccgacaccacgaaaattccactcctgctattactctgcactcattcctggctcttcccctccactattcctactcctggcaaccactaatctgctttctgtctttataatcttctcacttcaagaacattataaaatgcaaaaattagccaggcgtgatggcgttagcttgtagttccagctacatggaggctgaggcaggagaatcacttgaacctgggaggtggaggctacagtgatcctgccattgcaatccagcctgagagacagggtgagactctcaatgaatgaatgaatgaatgaaagaagatctggcatggtggctcacacctataatcccagtgctttgggaggccgaggcaggtggaaccgctgaggcctggagtttgagtccagcctggccaacatgacaaaacgctgtctctactaaaaatacaaaaattagccagcatgatggtgcgcgcctgtactcccagctacttgggaggctgaggcatgagaatcacttgaacccaggaggcggaggctgcagtgagccgagattgtgccactgcactccagtctgggccacagagtgagactttgtctaaaaaaaacaaacaaaaaaaacaaaaccaaacaaagaaaaaaagaacattatataaatggaatcacacagtatgtggccttttgagactggctttttattttttgtactcagcaaatgccctttgagatccgtccaagttgtgcatgttcctttttattgtttttttttctgtttgagatggagtctcgctctgtcacccaggctggaatgcagtggcatgatctcagctcactgcaaccctccacctcctgggttcaggcaattctcctgcctcagcctcctgagtagctggaattataggcacccaccatcatgtctggccttttttttttttttttagatgaagttttgctcttattgcccagtacataggcatgatctcagctcactgcaacctctgcctcccgagtttaagcaattttactgccccagcctcctgagcagctgggattacgggtgccccccaccatgtccagctattttttttgtatttttagtagagatgggattacaccatgttggccaggctggtctcaaactcctgacctcaggcaatccacctgccttggcctcccaaagtgctgtgtttataggcatgagccatcgtgtctggccccctttttattgttgaatagtatttcatagaatggatgtatcagtttgcttaaccattcacctatgggggagtatttggttgtttccaatttggggctatcacaaataaacctgccataaacaatcatgtatgagtttttgtgcagacatcagtttatttattttctggtacaaatgcccagaagcaattgctaggtcatatattgaggtgtatgtttaattaaaaaagctgccaaactattttctagagagtctgtaccattttatattcccatcagtgatgtatgagttagttttgtctgcatcctcgccaatatttgatattatcactatgtttgatttgagctgttctaatagatatgcagtgatatcttactgtggttttaattgcatttccccagtggttagtgttgaagatctattcatgtgctttaagtcaactcatttttaaaacctaaataaatgtatttaaaaaggaaactttcgctttgggaggccaaagcgggtgaattgcttgagcccaggagttcaagaccagcctgagcaacatggcgaaactctgtctctacaaaaattacaaaaatatccaggcatggtgacgtgagcctatagtttcagctacttgggaagtgaggcaggaggattgcttgagcctgggaggttgaggctgccgtgagctgtgatcgcaccattatactccagcctgggagacagagcaaaaccctgccttaaataaataaatgaataaaaggaaatttgtgattagtggttctcaaagtgtggtccctgagccagcagcatcagcatccccatcagctgagaacttgttagaaatgcagattctcaggcgccaccccagacctcctgaatcagaacctctgaggcgtgggttcagcgacctgtggtttaacaagccctcccggtgagaatcggtctcattcactacagatagaaggaaatggtaaaaatcaattcatccccgtatcgcctaaaatcctcctgtgggccccaggttggcacagcacacttttgggcaggagccccactcacagaggccgtgacaagaatgctcctgcccctggggttgtgcagtgacagctcacacagctccacgtggcggttctgagtttgggaagcgctgatgtagtcctactacagcccttcctgcccttcactggactgagaaaatccaggctctgaggagggagagacttgcccaaggtcacccagcaacatggtcagtctcctttcccagggccctcacaatgcgtggcctgtttaaagcctgcctctattcactgctgagtgaaaaatccagctccaaaacagaatatggggaaggatactatcttgtgcagcttatgtttatagctgcagatacgtgggaaaaaaagtcagaaaatactgttgaagcagttacttagggagaaaaggtgtttgctggtcttttgtgtttttaacttttctatatttcataatttttatcacaataatgtttagttacataatcaaaatgtattaaatgttaaaaattgacatgaagcctgatccagccacggcctattgttggcagagtcaggaagccttccagatagagcagccccgcacctgccccaggtcacaccctgggcctgggcacatgctaggtcctctgtctggacaccctcaccctgtggtggcctccacgtccgtacccaccagcacctcctgtgggcgaggccctacattacatccagccctgggcacccactagcccagagggcacctcatggtctgagagcccgcctgtctgtctctaaagagaggaaaactccttgggacatgtgttccacttgacccatcacccctggcctggtacagaaaggtagacagtgggtatttggtgaataaatgaatggatgattagaatgaattcccaaaatggcaatttcctgaggcccttctccagctggcccaggtggaaccagttccacttttcacaggaaagccaggtgggaggagtggggcaggtgtgtgtgaggggccagattcttgagggctgcatggacatggggctttggcgggtctgggggcggcagtgcttctgtgggagcctcagggagggctcatccttggaatccaccagggtatcctggtacccccagctgctgcgtggcgtgagaagtcctggctggtggggacacacaggtacttgtttggattggccacctggtccagcccaaggagctgtgcctccagccccttggggaaaaactcacttctgatgtgtgacaacagctgcaggcaaggggagggagaggtgtgctgggcctcggccttagaagccagaagccctaccttggtctatatgggaaaggcatgcggcctcagctagatctagggtcctgggttatggtcagaaccctcccttatggactcagtgacttgggctgaccccgcccctccctgagcctcatcagtgaaaccaggatggggccagggctctcgacacctcccagctcagacctctgactttctcccaggagggcaggagatcagacagaggtgacccgggctctcctgtttacctcaacctccttgtgaagcctccctctttctgcctgtgaggtgggtggggccggaaggaggggcattcacctgtaggcctctgacttctctgcccaggtgtacctggagagcctggtctatacccggtgctctgctacaccccatggcctggccatgacctccctgcctccagagcagccctggcccagggaagaagctgtctctgcatcgaatgataggtggaaaatggaagtggggatgatagctctgaaaaggagtcaaggaggaggtgccttcccaaggatgctgagggtttttccagaatggaacttgactggtgcgggcaaacatcaggaggtgggaagggtggctccctctgtgggagccagggtgacttgcctggatcgaacagtggtaggcagtgggtagggcaggcagagctggggtgcccagagcctggggtccctgtccttgcagaggactggattgcaaaacaagtgtcccctgccttctggctgggggacatcctctacttccaagcccagacatacacctgctgccacaagcccctgaggttcttcagaggaccaatgggcagccacacccatgctgggccagcctgctgggcccacctgcaccatggtcagagcccatgactgaggggactctctggggacaatgggggcagtctcatgctgccctcttacaggtggatcagtccctgggatctggtgttgggccggggtaggctgagtatgttctctgatggggtgccttgtggacagcaggtagagcaacttcttcttggctttcttggacctcaggacatagctgaacactgcgctttaccctggatgccttcagattctcaggggaccctgggaaggaagaggggctgcccctgcaaagggccagggccctggcccatggttgcttcccccagcaggtacctcctctccagattgacatcacctgattcctgaaggcctgagctacagaccagagccccaacaccctcaccaaggcctgttcttaatcagagcagctagtatatgattccggagctgaagcgggcagagagagaatgcggggctctgtaagacttcttggctccctgctgcggtgggccctgtagaaggccccccagaaatctgcagctgctgtaagtcactgggaggaagctgcagcagacatgtgtttcccagcctggtagatggagaagggtttccgggtctccgagtgggaggcccaaacgtggccttggttgtagcagtgcaggaattctagccagctctggggcccagggcaagtcatttaacctctcagaaccccactcctggtcaccatgtggctcttgtgtggttgtaaagaacacccctggccacttatgtcccatcagtggaagcctagcatgggtggagacccccgagactgaactcagtggcaggatccagcctttccagctctcctacatagagcccagagccagcagggtgggtttcctgaagaagcaggcactcctgtgggctggagagcatgattaaaggtccctttgggaaggtggaagaggctgcggtcagtggaggccataatgaggcagagcttgggcagaaggggcatgattgggggatctgagacccaatagagactggactgaggacactgtgccactcaggtggtggaaactgagctagggctgggccccctggtcccgagtgaggcctcaccagtcttggaagctgtgccaaaggtggcttcatgtaagggtgcatctgaacactttttttttttttaagagatggggtcttgctctgtcatccaggctggaatgcagtggcatgatcatagctcactgcagcctcaaactcctgggctcaagcgatcctcccacctcagcctcccaaagtactggaattacaggcctgagctacagagcctcgttttaaatcttaataaatatctccccctggtctgcttccctggctgacacacatgctggcaacttgcccctagacagacatgtttctggacttggttccatttgttctgatgggctcctctctctcaatgaccgcacgttatattatgtggccattcttacacgtttctgtatagacctgagggttagtgtattaatgtcaaagttctactggtttttcgaggctgggtggaatgtttgggttaatttaggagtgggcatcttgacaatataggcttttcctccgggaatggtgattctgggacgcaggttttgcacattctggtttattgcttggctcgctgccacagagggatggcactgctccacatgccatgcccaagagatgtcccaccttatctttctaaatcaagctgaatgttctcagctgacaggatatcctatcagtgctgcggggactcacaccttccaaactgagatgaagtgaggtggagactatggagcagatccgtgctgactgcattcgcccttcctgacccacactgctgctggccggggctatgtctgagccatcagagggcattgatttggggacggggcggggggcggtcctggagagatgcccctcacctccctcagctcctcctgtccacctaacacttggccaccaaggtccctgacttccaggccccagtcaccactaatggggtgctgcatgggaacaaagtgtaggcccagaacctggagctcaggtcactcctccttccattcgaagcctctgcccctcccaggtgattccaccctcattcctccatgggccaaatatcctaaacaaaggcctggacaggggtctttatccgagtactcagaaaacacacacggaaatgctttgcatgccccctgtggcctgccaggggtaagagcctgcccgtcaaaatgcacagtcctggttcttgcagggaggtgaggagcggaggaagaaaagatccatctcattctttcagcaggatcctaaacttgggaaagccagatgcagtacatttcttaatcctgatacttttataactggttatagcggggtcacatgcgcaactgttttccaacatctttcaacgggccacataacatcctgtaacttctttttttaatttttattttgtaaggccaggggcagtggctcacgcctgtaatctcaacgctttcggaggctgaggcaggaagactgattgaggccaggagtttgagaacagcctgggcaacatagcaagaccccatatgcaacagagaaaaaaaattttttttttttgagtacagtggcatgatcacagctcaccatagcctccaactcctgggctcaagcgatactcccacctcagcagctgggactatcagagcgcagcaccacatctggctgatgttttaatttttagtagagatgcggtctcactatgttgcccaggctggtcttgaactcctggcctcaagagatcctcccaatgtgacctcacaatgcactggggttacaggcatgagccaccatgcagcccctgcaaaatctaactgtccttcaggtgctccttttggacctcctagctagactgccattggcaaatgccagttgattatccacccacatttatgttaatggatttcccatgttttatttgtctagaccaggctttctccacagcagcactgttgatgtttagggctggacagttctctgttctggagctgtttgcgcctcgcaggatgtttagcagcatccccagcctccgcctgccacatgccagcagcactcctcagtgtgacagccaaagtgatttcagatactgtcaaatatccccagggcggcaaaatcacctccagttgagaactgctgacctaaaaccctctggaacaatgttagatcatggtaatgatagcgcatactgctcctgaccttaatgggaatacctctagcatcaaagtatagtagtacctgtatactactgtctgggctgttattagtacactgtattagtccattctcatgctgctatgaagaaatacccaagactgggtaatttataaataaaagaggtttaagttgactcacagttctgcatggccggggaggcctcaggaaacttacaattatggcagaagacacctcttcacagggcagcaggagagagaaggagagccgagcaaaggggaaagcctgtaataaaatcatcagatctggtgagaactcacttactatcatgagaacagcatgggagaaaccacccccatgattcaattatctccacctggtcccacccttgacatgtggggattattgcaattcaaggtgagatttggatggggacacagaaccaagccatatcatatcctttatattagcatactgtatcaaagtataattttctttcttttttttctttgggacagagtctcactctggctctggctggagtgcagtggcacaatatcagctcatggcaaccttggctcactgcagcctcagcctcctgggttcaagcaattcttgtgcctcagcctcccgagcagctggaactacaggtgtgtgccaccaatgcccagctaattttgattttgtttttagtacacatggggttcgacatgttggctaggctggtgtcaaactcctggcctcgagtgatccagccacttcggcctccagaagtcctgggattataggcgtcagccactgcacccagcctgaagtataattttcacaatatgaaaagcttgactttcatacaaataatgaaggaatacgtataagatattttctttaatttacaagggagtcagcaacacggtgaagctagttcaaggagcgttttgagagacagtgtctgtagtgctccaggaagggcattccgaaatgcattctgagatagagacaaaacttgttaatatcctaaagggaggccgggcgtggtggctcaggcctgtaatcccagcactttgggaggctgaggtgggtggatcacctgaggtcaggagttcaagaccagcctggccaacatggtgaaaccctgtctctactaaaaatacaaaaattagccaggctcaatggtgggtgcttgtagtcccagctactcagaaggctgaggcaggagaattgcttgaactgggaggtgaaggctgtagtgagccaagatcatgccactgcactccagcctggacaacagagcaagattctgactcaaaaaaaaaaatcctattgggaaataaaactgtcatctttgggagttatcttttctactgtactgaaatctgtaagttaacatatatacatattctcacatatattcataacatattctctagtatatttccctacattagtggttttcaaaccatggtctcaaattggaagcaccagcgtcacctgggaacacagacatgcaatgcttaggccccacctcagtcctattgagttagaaactctggtgtggggcccagcagcccatttcacaagccttgcaagtgattaggatgcactctaatgtttgagaaacactgctctaaatagtcaatctttaatagtaaaacaagtatctatgaaacaatgctcagtatgacattaaaagggcgcaccacccaccttttaactttatttctgaatttaaatattttgtctgtctaatgttaaatttgctgttttgtttttcaaatactcttaagataagacagttttcatctgttcctaattttctttttaaataaaaaatggtcccaaaactatccatttttctcttctttaacctactgacagcatgaaataaaagttgaaccattcctacatctttttttttttttctcaccttgttgctcaagttgactgaaatgcagtggtgcaatctcggctcactgcaacccccacctcccgggttcaagcgattcttgtgactcagtctcctgaggctgggattacaggcacccagcaccatgcccagctaatttgtatttatttatttatttacagtagagacgggttttgccatgttggccacactggtctccaactcctgacctcaggtgatctgcctgcctcggcctcccaaagtgctaggattacaggcatgagccaccgcacccagctttttttcttttcctttttttgttttgagatggtctcattctgttgctcaggctggatggagtacagtggcgccatcatggctcactgcagcctccacctcccatgctcaagagatcctcccatctcagcctcttaggtagatgggatgacacgtgtgcaccagcacaagcagctaattttttgtagagactggggtctccctatgttgcccaagctggtctagaactcctgggctcaagcgatccactggccttggcctcccaaagtgctatgattacaggtcttatgttcttaaaatttttctttgacatggtataggatagtctagtaacttaacacactgttgctttcaagaggatagtgcttatgatttgtaaaataactcttcagaaatgagttcaattttaccatgaattgggacactttctatttctattctatagagcagtttacttgtcatgaggtctgtcttttgaaaacttgaaagcctgcaacaataaaaccagctgcacctggtgcatgggataggcatggaattgaggagagagctcaaactatggtcagccttctgtatcctcgggttctgggtccttggatttaaccaactgtgcatcaaaaatatttggaaaaagtaaaacaataaaaaaacacaaaaatttaaaaatactttatatcagctatttacaaagcatttatgttgtattaggtattatagcaatctagagatgatttaaagtatacggaaggatgtgcataggttatatgcaaatactatgccacattatatcaggaacttgagcatctgtgaattttggtatctctggggtcctggaaccagtatcttgaggttactaagcgacgactgtattcaatttcttctttggttattagtttattctttaatgtatttttgttgttgttttgtctttttgtttttgcctcttcaagtcaacgtcggaaacttagttgttctagactacccattagctcaaagctaccagtaatcagactaccactgcaatctaagcaaccgattttttttttacccatcagactggcaaaaattaagataagatctattgatgttgaagctgtggggagttttcctgagcatgttaattatgacagccctttttactaggcacctagacgattcatcaaaatgaaataaaatacccatgcacttgaagaagttacctggttatttccttatctgggtgctggttatgtgaggtctacagttgatgaaaacttattaagctttatatttctaataggtacaattttctgtatgtgtaatatatttgaaaagtttttaaaatgttttttgccacagcccgcagctgtgtataatgctattcgcttaacagtggaaaacatggcaatgacctgaatctccctggctcccgggatcctacccccttaagttaacgaaaataaaagtaaaagaaataacttccactgtctttcgtaatgccttaaatccgtcctcagttaaaccggcggttggcgctggttttttccagggcaggattctgggagacggaggagcagacgccagcatttcgcccccggcacctccagcgggctgcggtccgctcccggcctcactcgagcaggccccgccccgccagaggccgttagtccaagtcacgtgatcgtcgactcagctgacctggcgggaccggaaaaagaaattcccgggcgatgatgaggcaccaggggtgaagcggacatgggctgctggagcgggaatgagggggcgccagtggctccggaaacgggttgaggttgtctgcactggccgctccgcaaacacagtgtgtgcgggcgtcagggcagcaggtctggtagagaaaagtccaccgccatccctctcccgagtggggcgggtaagacagagcaggccggccggcttagagttccctgcttccctggcggaaggaagggcccctgactcctggggcaggaactagggcttgtctggagctgggagtcctttcaggtcttctctagctccaaaaggacctcccaaggacacccccttccccagccctgctgtgggacttggacaggaaagtgctagaatcaggctcactcttgcacactgttaggaagccactccgctcttttcagatccagaaagtagtagttttggggctgatacttatccatccattcatccaatccatccatccataggttcaaagtgcctagtctataccatgaattgtactaggcactgggaggacttgagctgccgcgggaaggggaaatcagaggcttgaattggcagtcatagttaaggctccaggggcagagacctaactgcgccttgtgtgtagtgctaagggggcttcctgaggatgccttcaaccttaaaggcgatggcaggagttggctggctgaagtacagtttgtgtaccaggggttgggaggcaacggtgggaggcgtgtgtcttcagacagggaacagcatgtgcagagacttcaggtgagagagagcatggctccccaggaatgaatgcatttcccgtagctgggagagtatcatctggaggttagggaaagatgagtctggacaagtaaaggccaaatcttcctgactgttggatcaccacaatcaagataacgaatatatccaccggcccccaaaatttccttgtgttaggggctattttaggaagtatgatcaagaagggctggcctgccagggtggagtggctcacgcctgtaatcccagcactttgagaggccaaagtgtgcagatgacctgaggtcaggagttcgagattagcatggccaacacggtgaaaccctgtctttaccaaaaatacaaaaaagttgggtgtggtgacgcatgcctgtagtcccagctacttgggaggctgaggcaggagaattgcttgaacccgggaggtggaggttgcagtgagccgagattgtgccattgcactccagcctgggcaacagagcgagactccgtctttaaaaaaaaaaaaaaaaagaagggctggtctgatgaggtgtcacttgagcagagagtggaatgaaataaaggatagcaagccacatagagagtgcagcggaagcaaggctggtgtccctgagctgcagcagggaagctggagtggctggagttgtgtgggtatggggaagaagggagagagttcactcgtctctgtgaggcccaggactttgttttatcccatgctgtacccccagcacttagagtgggagctagcacagagaaggtgctcaattgatgtttgctgagcagatgaatgcctggagtagacctcagagcagggtttggtggcagggtgggtcaggtagagtttactcaacagcctggtgataggggagaacaagtggccagagggtatccatctatgtcggggaccaggggtccctgctgggcagcagtgtgggagacacagggatcctggccacacctcagtcttctttccagcctgattacctgcctccctcccttgcagaggtttcggttctgtggtgatctggactgtcctgaccgggtcctggcagagatcagcacgctggccaagatggttgagtgcacagggtctacactgggtggaggaggggtgttgggctggggattgtggctgtagaggatggtgaggtttctctggggctagggcctcagtgctctcagcctgtgctaccatgctttgtgaccttgatcagtggctggcctgctttgagccagtccccaggaagaaggggtgaggtttgccagcctggctgatgtaaggacttcctttccagtcctctgtgaagttgcagctgctctgcagccaggtactaaaggagctgctgggacagggaattgatgtgagtacaagatccagcaccccattgtcccatgaccttatgaccaccactgccctgaaactctgcactaggcccggggagacgggtgagccagcctctcaacctctctgggcacctcccttccttctttccagcctgtctgttccttattgcaggatccaggctgggggtgaggggctggtgagcagggacctggcaccccctgaaggtctcctttccccatagtataagaagatcctgaaactcacagctgatgccaagtttggtgagcaccccgctgagttcacaggccccaggcaaccctgggacctcggcctggtgcctggtacagagcccgccccccacccccccgccaacacacacatcccagcagtatccttaacctgccttccctagtggaggagcatgagggaaagaaagacattgacagtcccaccttcctgtcctctgccagctcctggtggagcagtagcagtgcctatggctccaggaggcctgggggctttgagctgaagttaatagggcaacagggaggtggctgggcccacagtgacaccccctgtcccatgcatgggtccctgagagtcaggcgatgtgaaggccacagtggcagtgctgagtttcatcctctccggtgcggccaagcacagtgtcgatggcaaatccttggccagtgaactgcagcagctggggctgcccaaaggtacgggttgtgggtgggcagctgggcagcctgtgggccaagggctgctagagagtgggccaggccctgtgaccctgaggtgtaccctgccctgtctgggccaggagcccaagcccagcccccacctgctacctccagagcttctccattctacccccagagcacgcggccagcccgtgctgctgttatgaggagaagcaaagccccttgcagaagcacttgcgggtctgcagcctacgcagtaagtatgaggccagccagggtccgggctcatcctagaaggtgcacgcagcacacaaagtgcgtggagagtccagggagacaatttaaccgcagtcacataccgagcagccgcagagccgggacgtggccctcggtctcctgaccccgcgcgctctgtgatgtgtacgtacaggatcagaccttgccctttcctcctggctgacccttccttagtcccccgtgccccatgtgtgagcacccagctcactctcattcctccctctccaaagcgtggtccctggcagcacgagtggcagaagggacagcagagactgtggacccctcagctgcacctaagacctctgtgtggtctagccgtgtgtgctgggggaggcttttggccaccatttccccctctgtaaatgagaccgatacctgtggcatggaggacaggaggctggtgtgagtgccaagcacttggagcagggccctgagtgagcatggacatgggaacaggggtgtttctcgactttgtgcaccttggggatgggagtggggctccctgcatgggttgacaaggcattgctttcccccaccccacctctgtcccagccctgcaagtccagtccttgggggtctaggaaggaagaagcccctggctgtttggcctcaggctggtgcctggccctctctggctctgagttcctgggaaagtcagcacccaaggcatgccctcaagtttagcaccttgacaagaagggcggggacactgggatcaggcccaactctttggccccaaatcccacggccccagctggaggatgaggagacgctgggcttggatggggaaatcaggggtgtaaaggggcctgctcacccctcagcttggctcaaaggctcaaggcgtcaaaggctcagcctgccactcaggaaggagccctggccaagccagacactcaccaggacaagggcaactgtgatgagcaggaggcccaggatgaggagagccatggcatagctggagataaaggcatccagcaggctggaggctttggggctaggactgcctagagcagagcaagaaggctatggccaggcggggctctgcctctcagacttctgagaagacagaatctgggcccagaagttgctgcgggaccagagagctggggctaggagcaccttagagggctccatgaggaggggaggcaggcttcagatcagggcatgtggaggcagcgagcccaagggaggaggcagagggacagagggaggcagcctgcagagggaaggaggtactgaccgaggtctaggatgaccatgtctaccaagacgcccgctgcctcccacagggtgtgcaggccctggcgtgcacagtgccacatgacggcctgggctggcgccaccctgaagaaggtggcacccactctggcggtcagtgggtccagcctgctgagaggattatcacagacttcaggggtctgtgcagccttgggggactaggggaggtcatctcttccagcctcctgtcctcaaccccagaaccccggtatgagccctgggtcacccagggccaccccggacccactggaattcctccaccaccgcttggtcaaagttctgcagagatctgaggacaagggtcagctggggggtcagaagaggatgaagagggtcacagctctaccaaacaaagcttcattccttgtggcccctggcccacccctctgctgccaacctcaggctggcccagccctgcagagtaggtgcccaaaggcatcgtagcagttcctgtcatgctggtctccccccggggccccctctggagcctggtaccacagatctcagggtagggggtacagctcagtctcccttccctctcatccccctcataggggcttagtccaccaaggcccctgactgctaggggacccacacccacggcctccttctttctgactgctggcccttccccagcctggatacttgagccctgggcagaggggtaacaatcccaggactgtcttcataagcagagaggccacttggcaccaggctcttactccttgggctgagctcagcagcaggtgtgtcaccaaggtcccctgggcagaaggggctcagccctgagggcccatcactcgccatgcctgcacgttcctgctaggcatccaccctggggacccagctttcccccttcccccagctgctggcaggcctgtcttgattcatccagggtccttcaggccatgccgggaagcagccagcagctgggaggagcacttggggtttctgcatctttttttatggagctgacttgggtgggaggggctacagactcaagggagactgcaggccaccccttccccactccctggctgggtaggcttccagctcaggagtctgattggaaggatgggaccgtcctgtcacagaggcaggtctgagtagtccaggcccagttttaccctccagcagggcccctttcattcatttgtccagctggctttgcccaaagcacaagtaatgtctatgtgtactgtgtcccctgtccccaaggggagtatggctccagtcctggcctggaactcagagaccttagaattagaggccacatctggcagggtggaccagcatggtctgcccacggccagggcaggtaccatgttggcagccccagacctgacaccacggctcccgtctcccctctccacttccatcctgcacatcacctacactacgcgctgtccctgatgaatccaagctgtcagcttctgtcagcttggctgggaagtcatgctgaccgtaaggggaatggtgcagcctgagttgggggctgagtgggaatgggcctggtgtggggtgggggaggtgggggtgaggcgggtgtctggcgcctctctgcttatcttcctttctcctttgtccacaaaggaggcatcttttccatgtccctctgccaccctggggacataaaatactgccccacttctgtcttcccttggacatagcccacctatcttcctgtgggactcagggctttgttttgtcctgtggcccacatgagaagcaattatccctgctctgctcagctgagagaggacaaactgaggcagagcaggggaacaactctgtcatagtctggctgttaatggcagagtaaagaccagcccttccctgagtgtcaggtccagtagacattatattagtccgctttgcattgctctagaggaatacttgagactggcttatttatttatttttgagatgaagtctagctctgtcgcccaggctagagtacagtggcacaatctcagggcactgcaacctctgcctcctgggttcaggctactctcctgcctcagcctcctgagtagctggaattacagccatgcaccaccatgcctggctaattttttgtatctttagtagagacagggttttgaaatggagtttcgctgttgtggcccaggctagagtgcaatgttgtgatctcaactcattgcaacctctgcctcccagttcaagcaattttcatgcctcagcctcccaagtagcttggattacaggcacgcaccaccatgcccgcctaattttgtatttttagtagacagggtttcaccaggttggtcaggctggccttgaactcctgacctcaagtgattcacccgcctcagcctcccaaaatattgggattacaggcatgagccaccactcctggcactgagactggttatttataaaagaggtttatttgcctcacagttctgtaggctgtacaagcatctgctaggcttctggtgaagcctcaggaagcttttacttctagtgcgaggcaaagagggagcagacatgtcgcatggtgagagaataagcaagagagaggaggcatcaagctctcctgtgaactaatagaaaactcactcattgaatcacttgaacctgggaagtggaggttgcagtgagccaagatcatgccactgcactccagcctgggctatgagcgagactctgcctcaaaaaataaaaaaataaaaaataagaaaactcactcattaccatggggagggcactaagccattcatgagggatcccccaccatgacccaaacacctcacactataggccccatctccagcactggggatcacatttcaacacgagatgtggatgggacaagtatccaaactatgtcagaggcctccccctccctctcatcagaatcttctgtcctcagttcaggtgcatgctggcctccatgcctggcttcctagaaagtcatcttggcgccaaggggttgggcagggccactaggctgagggttggagccctatctctcctagtcccagcctgggtctccatcactgggtaacccgtactgctcgctgcattctctccacacctgctccctacagcccaggggtcagtctgggtgcaggcctgggtagaggtccaggagcagattctgccccccagctcatacttcctgtgcaccatggcagaaaatgcaccagcatggccaggagcactggcttgtccctgtagtctcagtgttttgggaggctgaggtggaaagatcgcttcagaccagcctgggcaacatagtcagaccctgtctcgaaaaaaataaaattaggcatggtggcatgcacctgtagtcccagctactcaggaggctgaggtgggaagattgcatgaacccaggaggtccaggctgcagtgaggtgtgattgcaccaccacaatccagcctgggcaacagagcaagaccctgcctctgaaacaagaaacaaagtgcaccagtgtgtggattccagcttctcctggtgtgtggacctgacctcactcagccccatcagtgagtaggaggcttcctgctgtcttccagaacactctcaccactacacctgtgttcctcctgcattctctggcaggctttgtgaggagacctgtcacctgcctctctggctgccctaaggcccagctcaaaccttccctgaccctgagaacctttttctgaagagtctttcccccacccataggccccctcatttcagagcttttggtggggtgagtacaaggatcgactctctgctaccagcctgggtagggtccctagggttgggtctctggatggcatatgagggtctagaccaggatccagatgcctgtaacctgaagggcaggccctcagctgccccaacttcatggagcccctcgtccagcctgaccttctgggataggcccagcccctgcatcctttggtcttggtccctgcagggaactctggttaccctggcttacctactttgactccaaaagtaatgctgacatcccccgtgagacacagtgacagactgagactaacgtagggttacgtggctcagagtcaccatggccaggcagagctcaggtcctagcactgttcagccctgcctcccgggttcaagtgattctcctgcctcagcctcccaagtaggtggaactacaggtgcatgccaccacacccggctaattttttgtagttttagtagagatggggtttcactgtgttagccagcgtggtcttgatctcctgacctcgtgatccgcccacctcaggctttcaaagtgttgagattacaggcctgagccactgcacccagcctccctaacactcttctagctctggtgccctgcagggtctcccttggagcacctggagcccaagaagctgtccctcacctttgcaatcccagggactcgccccctgatcatgatgaaggtggacccaaacccgctgaggggcctgaaggagcaaaggtcagcctctgcctcccacggcctctctgatgggggggatgttatcccagcagcatgagctgggagcagaattgggaggatggggggttttctctgtgggtagctctgggctccaaggtggagccctcttaacctggccgctcccctgtgactctccttagccccaggcaaagaaagcagcttgccggaggtcacctgtcagatagggaaagagtgggacctgggttctttctcacccagctgcagctctcccttcccccagccccttcccccaggtgatagagaacctggcaggctgtgtcccatagaagagttcactttccttctggtaagggatgggaaccagcttgggatgggagggatgaggggtctgggggctctcccagccctgcctcacatttgaaggatggcatctgggtgtcagcatggtttaggctagacggggcggccccgaggtttatagcctggcctcgggcaggatgctgccatgccaccttctcttctgcacgtcctgacctggcatcctacctaaaggtcctcaggtctcctgccccctgggcattgcccccactccctgcccagacacagctgtccttgtcctggactaatcttcagagattcttgtccagcccacagctttgctggacatcgcaggctgggccaggccccctgcccagcactaacatctctgtgtgtctcaaccagactgagctgcagcttcagggtcagggtaggctctgacttaattgacgtgacccaggacaaggggatttattgatggtgtcacatatgcttaagctcttggcctctatgatttctttggggcatgatacccctctgtcccatgcttaggtgcccacctgtggccacaagtacctttcttaccaccatccctacttgagatcggtgtccaggcacctgtggctccacgcagaacgctgagcacagagccaggcctgggcggatgttctgcaggggctgcaggagctgacagtcctgaccacccagcccgtggccatccattccctttcaccgtggctggctcttcatccaccatccttccaggggccaggcctgaacccaaactgacttttacctgccctggtcccccttgtgcctatcaggttcttggctgagcatgatgttcttgcccatttccttgattatcctcaaaaggtttatagaaccacttggggacatcacatctgtctaccaggtcctcaccagagacatgactgccttgggccgggcctgggatagtcaggggtcacactcacctgttgggacctagcttcagtggcttcaatctgggcaatggcctgatgggcggctgccccttctcctctgcttgggggaggcaggagaggaaggtcagggaggagatctgcttcctgcccacctgacactggttggaagcagggcgcccacctgtgcctgtctcaccttgctgcaggtgcatcggaggccgaacccctctcccgatctcctgcaggtgcagattccaggtttccagtgggtgtcagtgtgggctccagagctctcctggtcctagggaaccctgggctccatgaggccttcgcctagccagattgtttcccacactgtcacctccccaccctgtcacctccccaaacatggggctgcatgctctgtgccctgggtgggacattggaaggagtgccaccttccaggtttggatcacagtaaagcctctgccatggggatgtgctggccgagacagatggggttgaaccagtcatgatatgttggccttgggcaagtcatctgtgccttgcttccctttccccagcagccagaagggataatagcacctatttcacccatactcaagtgttcatttgttagcaggaactgagtcccggaggaggtgcaggtggagccattgaggcagcactgcagctggacctgggtctgagtcccagctcctggctgtgatatgcatcactctctccatttatttatctgaaagacagggctgtgctgttctggggtcactgtgagaatgcaactggcctgtgtgagttggtggtggcctcctgtgatagcttgaggtgggctggaggtgtgtcttgaatgccccctcacccccatggggaagacccacttagggaagactcaagtgtctgtatggaggaacccacattccctgcccctcagctgtcctctgtcccttcctagccccctctgctgtcctgcaggctctggcggtggccatccagcttggtggccatctggctgatccactcctccaggtggaccctctgtcctcatgtggtgcaggtcccattgtgccacctccagacaggccatgctagccccagggcctccgttccctgttacccagcccccacccccaggtacgtgccacctccctaaagcccactgtgtccaccagctgtgtttcaactctgtctctgagcaaggcctaacgcaaagcctgaaacagcctggcttgtagagggccaggagaccaaagcttgaagagagagtgacggtctcccagagcccacttagcctcagccccagggctgtgtccatgctgttcctggctccagtgagccaattctctcccctgacgcccgtaagggctccagtggtgatggaggtagctggagagaacaaggctgtcttaaccctccctccctgagaaggcccaacggggaacgttttaggcatcagggcattctggggggcatcttccagggacccctcctataccctgccctgccctggctctctagtgagaaattgcagttgcttggacagtggggctgacccaggacaaatgcatatattgggctggtcttcagggtgctggggtaggggcaggggcacttcagggataggaaggaggggcctgtgtgttccagaagtacagaggaacctggtgccggccgccgtcaacccctatgtgatgatctttctacccgccctctttcgtgtcttggtgctggctgctgtctttggccaggtaagctcatggtctgggctcctggggtccactcactgggcctccacactgcctgcaggtaggggagcctttgggccaggactatccttggctccccttccaggtggtgggttcaaagaccattcctgggttccaccaccgccaagcctcaatggtgtctcgatggtcacaggaactgctggggctttctaggttaagacccttgcctatcccggtgttcctccctgcagtagggggctgcaggggtcagcctcagtctctgccttgggagcctgccttaccttgcctgaactcaagcgatctgcctgccttggactcccaaagtgctgcaattataggcgtgagccactgcacccagcccagccttgactttgaaatatatgttgtacatccagacagcagtgaactctgggggaacaccaaagatgaggagaatgagagaagagatacctccaattaaaggagttaggaagagatgcttgaacttatgttttaaaaagtcaatgcaggttgggcacagtggctcgcacctgtacacacagcaccttgggaggctgaagtgggtgaacggctggagcctagaagtctgagaccaccctgggcaacatggcaaaaccccgtctgtacacaaaatacaataattagccaggcacggtggtgcctgtggtcccagctactcgggaggctgaggtgggaggtcgaggctgcagtgagctgagatccaccactccactgcagcctgggcgacagagtgacaccctgtcttaaaaaaaaaaaagtcactgttttggggttttctgggtgaaacctctgtttccataaaaaaagaaaaaggtcgagacagtgtgtattactgattcaaaatcataacctgatgcttagagtaaatcattgtatctattgtttcaaaaaccaacgtcaggattattaaaagttaattttattgggtttttctttaagcttggctgattcactcaggtctgtcacttccaagcccatgttttactactttgtaaccctatttggaaggaaagctgcagctcacattatgatccatcctgagatgaagagtttcacacatatacaccacatataccccccaccacagtatgacgacacagcaacccaaccttgggcaaatggtaccactgccagcaaatttttttctttattttaaatatttttactgtatttcttctaacagcagcaaatgcatttaacactttattgagattctcaacagctgccatttggtttgtatagcaaattgtttacaaagtaacttttttccatttttgatattttaatgaaaattatgttcttcagttttaaagctctgtccctctcccaaagaaaggttaataactaactaccaagtaatgattatttgggaaaagaagaaaagcaaaaccagcttgtaaacacttctggaacgtgggtaaggggccaaagtcaagaccttctgggcccagtgcaggtgctaggcttgcctcgggacaccatcagcacttccccatccacaacatcctcaacagctgggagccatgtgcagaccccagggggcttcctgttccacaagctcccctctctttttcctctccacccttgctgttgggcctcccttccaaatctgcctaacaaaggcagcaggatctttaatactgttcagctttgtcaatggagacaggatactctagaaagttgagagattccctggtccagtctgggggaggaaaaaatatgcagtgtagcatagatggttttacttgtccactcagacacatgctcatacttattagatggatgtatcagatgcttcaaaagtcctgatgtgtagtagcacaaaagctgcttgtaaaaaggaagttgcaaaatgataaaaatttctgcagcagttcaggctcctgatgacaaagctggttctgataagtagttcttttgacatgcacagcagctttcactgttaagtcctgtgttccagcggtttcatttagaccataggaagttgaaagcaaagtttaaatgttctctgctgacaaaatgtggtatatatccatcaatggacttctactcagtaatgaaaggaacaaactaccaaaacctgttatatgtcatggaccaacctcaaaaaccttagctaagtaaaaagccagacatgtgaccacatattgtataattctgttgatttgaaatgtccaaaaaaggcaagttgatagagacagaaatggtctgatttacctcaagaagtagggattcaagctcttagggtacatgtgatacatacattagaagaaataaggaaaagaaaagaaatttatatgtaaataaatgaaaataatacttctccctgattataaagaaaattgcattctttttgtaataatttggaagacaaaatatgaagaaaagtctttaattttgccactgaaagcattctggtttgttgctttttatatttttttatgcatatgaacattttaaaaagtagaatcgtaatatatagtcttttgtcactatgttttgggcatatttctatggcagtaaatatatccttggcatcatctttttaaaagctcgatgtgtattaagttaatcattgccaccccagaagtaaattttcttatatatatattttaatggacgcaagcaagcattttggggctgaagtcatagaagtagaatttctggagaaaaataacataaaatagttttaagatttttaatagaaattttcaaattatcctgcagaaaaattggttcagtttatactcccaacaggggcagagctccagtatcccgtttccatttgtcctctttgctgatatttaaggagaaaatctcattgttttcattgtatttctttggtttctagtgcttttgaaacttttttttttttttgagatggagtcttgctctatggcccaggctggtgtgcaacagtgcaatctcggataactgcaacctctgcctcctgggttcaagcgattctcctgcctcagcttcccgagtagctgggattacaggtgcccaccgccatgcctggctaatttttgtattttttagtagagatgggatttcaccatgttggtcaggcccgtctcaaactcttgacctcaggtgatccacccacctcggcctcctaaagtgctgggattacaggcgtgagccacggccctggccttgaatcatttttatgtgcttattggccatttttattcttgtgggaagtgcctgtttctccattgcctattttctggccaagctcccaagtcacatttcacttaatttttatcctgctgattgaaagcattttaacataaacaggagcaggacagactgtaattatctagatcttgctctgtcacccaggctggagtgcagtggcatgatcatagctaccacagcgtcgtactcctgagctgaagcagttttcatacatcagccttccaagtagctaggactacaggtgtgtgccaccacccccagctaatttttaagattttttgtagagatgcgaattcactatgctgcccaggctggtcttgaactcctgacttaaagtgatcctcccaccttggcttgccaaagtgttgggattacaggtgtgaactactgctcctggccgagggctcattttgtttgctagtggtgatattggtatctgtttatatttgaggctttggtgctagtgctgatgtattacactcaccatccgaggtttgcaggacttttgttttaatattgaatagatggaactgtttacttctgcatctttgcaggcatacaaaatgtgcctaccaggactctgctttatatctatcgaaagcaagaagtaatacagtaaaactttgcctggctagaggctttggaagaatggagtattctgatttaatgctattgaagtgtgaaggtgaaaagaatgaaaaacttacatttcctgttgaatgcaacttgaaaatacagccagtgattccacttttcttctctagtaagtttggacattctgatctacttggtgttttattatagaactgctagtgtgcccgagacttacattgtgaagacactttttaaaaaacttgagaggtaagagggtgtaaatggtattgtgtgagatcaggctggatgagaactgacacttgtaaacatactttttaggctgaatctctgattgccgtttgttttcttatttaactcataaaaataaaacacattggatggagggtgggagcaggaaggagatttatgtcttttaattgcatgccattgtttcatatcaagacagaacatatggtatccctggctttggacctacagaaggaaacacatttttctgcctgctgtatgccagaggttcttgaacacctggagggatgactgcagcacagattgctgagccctactccagagtttctgattcaccatgtccagggtggggcctgagaatttgcacttacaaaaggttctcaggttctgctgctgctgctagtccagagactacatttttgagaaccactcttgtctactaactgtaaattgtagaactctagaacaa

SEQ ID NO: 46 - DNA, 150501 bp, Homo sapiens
tatatgaaatgtggcattggcgcctggggacagcgtggcctgtgtaaattatgcaacttcaaagcctgccctgttttgcagtgtattccatccttgaggagtcccgtggtctcagggtctgaatgcttggaggagacttacctccgtgaacgtttccttctctgcaaagcggggtgaaaggtctccatttcaccaaaggctggatggagagggggtggtgtgtccagtgctagcccgtgcaccgccagagagaacctgctgcagctcccgttctcctgggcagatgacagtgccgcctcccccatgcagcccacaggactcctagggcagcccctgttttggccgccaaggccactgttttcatttgagtgtctggaggccataggttgtgttttcacttgaggtcgggagttcaagaccagcctggccaacatggtgaaacctcgtctctatcaaaaatacaaacattagccgggcgtgatggcgggcgcctgtagtcccagctactcgggaggctgaggcaggagaatcgcttgaacccgggaggcggaggttgcagtgagtcgagatcgcgccactgaactccagcctgggcgacagagtgagcctccgtctcaaaaaaaaaaataaataaagtgcacaacccagtagattagcacaccggccatgtcgggcggccgtcaccactgtccggttgcagagcattacctcaccccaaaaggagaccccatagccttaataccttacttaagtgtgcagtattcttttagtcctgtttctcataaatgttacccaaattgaggcgccgctctgcgcccggcaccgggggaggcggagggacccgcaggtgtcgggtaggtgcggccgccccgccagggccccgcgtcccgcgcgcgacgcgcgcctcgtgggaaccggtgtcgcccggcttgggctcccggctcacctctcgggtgtgcggcaggggtctccgccccggggccacgggaggggaagcaagggcctcgctgtctcgccgcacctggggaagggacccaattagcgcggaccccacagcgcagcacctcaccagctccccgcaccaacgccccggcgcgctctttgaggaaaaagcagagggcgacttaggtacccacgccgtctcagcgccgaccaatcggcgcacgctgcggctcctgcgggctcgctggttggctccggcgtcagtccgtcaggcgcgctcggagcggggcgtatctggccaatggctctcgctacagcttcctgagggctggctggttggctcccatgtccgtccgtcaggcgcacgcggcggagcggcggcggcggcggcggcgttgggggcggtagctgggcgggcccttagttccgggcgcgctgcgaccgttgggtgaggcgagcgcggggtcgggtgcggggtcgggcgcgggcgcggggtcgggtgcggggtcgggcgcggggtcgggcgcaggcgcgggcacctctcagggagactccgggccggagcgggagcgggggcgggagaggccgcggggcgggggcggggccagcccgaggggatttctctgagccgctgggccggaaaccaagtccgagcgtggctggcgcgggaaagttcgggaacgcgcgcggccgtgctcggagcagcgccagggcacggtccggggttttgcgcggggtcgcggctcccagtaccgcctgaggcccgtgggcggcccacccggccctgccccgtcccgggtccgtcgctcccccgcaccctgtcgcccctccacgctcagctgtgggcccctcgtgtccccgaagccccgcaccctcagccggctgcgtgctcgggagggtcaggggcgcctccgacccctgagtttgccagcgccccccagccaggggtcggggaagaccagtgaggctgggggcggagccgactctgctgccttcctgcccagtggctggggagacccaggctgagcctgggtgaaaagtccctctggctgctgggagggtcgggggcagcaaggagccagtgcggggatgggctgcggtggaccgggccgggatcggggccggggcctggtcctggcagtagcaggggatgtttgtggaaggtagagccgagaaaaagaggagttgcaatgtctgcaagaatctggcgtgagcagctgaaggctggtgcttcctaggccaagatgaaggagtcacagcgcccatggcctctcgggaggcggccagatgggcagcctggggtcaggggaacggtcagggccagagctgggtattttggagttgtcattttgaggccccgagggctgagggtcagtgcagaagagcaccaagcctccactcggtgtagggccgacagggggtggggtgtctggcagccggtgaagacggggctcggaggaggagggagtctggtctgggtcaagtcaagggaaactaggactgagaacggaccctgctctgtggccacatgattttgaagggacggaattactgccctgtaactcagtctctctccctgttaatagccctagtttttaataagaggaactgaatgtattaatgggtggacacttgtaaggttcaagatctcctcttctaccacgcttgcttctgatacttttgtataaacagttgttaagagtttaggttgttatcaagcttctatttggtattattttgagcctgaaaaagatggggttacatataaaattgtaattttatttatttattttttgagatagttttggtcttgttgcccaggctggagtgcagtggctcgatctcggctcactgcagcctccgcctcctgggttcaagcgatttttctgcctcagcctcccgagcagctgggattacaggcgtgcaccaccacgcccggctaattttttgtatttttagtagagatagggtttcatcatgttggccaggctggtttcaaactcttgaccttaggtgatccacccgcctcggcctcccaaagtgctaggattacaggcatgagccaccgcgcccggccatgaaattacagttttaaagttaacttctagtatttggagggcctcatattcatggctgcatgcagatcagtgttcctgaatattactcagatgagcttttatagaagtgggttagaatcaggtgccattgacgcctgtagtcccagctactccggaggctgaggcaggagaatggcgtgaacccgggaggcggagcttgcagtgagccgagatcgcgccactgcactccagcctgggtgacagagcgagactccatctcaaaaagaatcgggtgccacccagtgaactcttacgtggagtccagtattgtatgaagcagttgtgtgctgttggtggagacatgaattgaggtttgaatctccagcatttggggcatcttggagtctgcttgtgagaagggcgaggcctgggttgaacccaagcgtttgcggcgactaggtgacccctgcagcggccaggttgcacccatatctgatttgatgtcatggtttgggcagtgtttgacttgtgtaacaatacagcttgtccttttgagagtcaccgatgccaccaaaccatgttcacacaccagagtcaggatgccaggtctcagctgcctgatgactccagcttagtgaaggcctctgatttcttgtgggggtgtcccattgtgaagggaacacacagctcggccctaccagcaacaagggtgccagatgcccccactctcctgtggaggggagtctcgctctgtcacccggctggagtgcagtggcacgatctcggctcactgcaacctctgcctcctgggttcacgctattcttctgcctcagcctcccgagtagctggactacaggcacccgccaccacgcccagctaattttttgtatttttaatggagacggggtttcaccatgttagccagggtggtctcgatctgatctcgtgatccgcccacctcggcctcccagagtgctgggattacaggtgtgagccaccactgaggggcttttttacgttaaaacttgtttgtttgtttttctttttttgtttgtgtggttttttctgttttttttttttttttgagacggagtctcgctctgtcccccggtgtgagccaccacgcctggcctttttttttctttttttgagacagagtttcgctcttgttgcccaggctggagtgcaatggtgcgatctcggctcgctgcaacctctgcctcccaggttcaagtgattctcctgcctcatcctccagagtaggtgggattacaggcacccaccataatgcccggctaatttttgtgtttttaatagagacagggtttctccactttggtgaggctggtctcgaactcctgacctcaggtgatccacctgccttggcactcccaaagtgctgggattacaggtatgagccaccttgcccggccttaaaacctgtttttgacatttctttgccattttaacttttttgttattttatttttatacctgaggtcttgttatgtttcccaggctggtctcgaactcctggcctgaagtgatcctccaacctcagcctcccaagtagctgggattacaggtgcaagccactgtgtcagttggtcaccgcatgtgtgagagttccccccacacttattcagtcggtcaccacttgtgtgagagtcgcccctgcatgctcattcagtcggtcactacatttgtgacagtcatccccgcatgctcattcagtcggtcaccgcatgtgtgataatcacccccgcatgcttgttcagctcgtcaccgcgtgtgtgagagtccccaccgcacgctcgttcagccggtcaccgcgtgtgtgagagtccccaccgcacgctcgttcagccggtcaccgcgtgtgtgagtcccccccgcacgctcgttcagccggtcaccgcgtgtgtgagtccccaccgcacgcttgttcagccggtcaccgcgtgtgagtccccactgcacgctcgttcagccggtcaccgtgtgtgtgagagtccccaccgcacgctcgttcagtcggtcaccgcatgtgtgagagtccccaccacacgctcgttcagctggtcaccacgggggtggcacttttgtttttagctgacttagctgatagaattgggagttttagagtaaaactgatctggaagcctgaaaaaaccagcagcacattgttcgtttccaggttgaatcgctcctagctgacccctcacgtctcttatgatacgtacagaaagcaagagcagcccatgccgtccggccgcgcaccaggtctcagtctgtgtgtctggttcaggtgaccatggtgttcagttcagttcctcctgcctcgtgtgtaggccactgagagctccctagtctaagccggaggaggttctggtaagtgctaggcacagtggaagtcggattccaacatgtgcgcaaattggggcactgtcagaagtgtgctaaaatcttggtgtagcacttttgagccttcgtggtggttttcattagttcttaaaatgtatttatgaatgagattcaaataaaatgtttaaggaatctctaagcacaaagaaccccagagtgtagtgtgggcatcagtgggacctcagggtcccctgaccgggctgcctgccgtgtcctggctgtctggggttgtgttttcatttggaaacaggaataatgatccccgaccttccagccgtgtcaggatgtcacgatggccacgtgaggccgtgtctgtgagaagcgtctgccggtggtggaggacgtgcactttgttgtgaacctcggctcactgcagcctcctcctccccaggctcaggtgatcctcccacctcagcctcctgagtggctgggaccacagatgcgagatcctcccacctcggcctcctgagtagctgggaccacagatgcatgccatcacacttggccattttttgtatttttagatttgtttttttatgtgtgttttgtttttgagacagatggttgctcttgctcaggctggagtgcagtggcatgatctcagctcactgcaacctccgcctctcaggtttgagcgattcttctgcctcagcctctggagtagctgggcttacaggcttgcaccaccatgcctggctaattttttgtatttttagtggagacggggtctcaccatgttggccagcctggtcttgaactcctgacctcatgatccgcccgcctcggcctcccaaagtgctgggattacaagtgtgagccaccgcgcccagccatttttttgtgtttttggtagagacagggtttcatcatgttccccaggctggtcttgaactcctgagctcaagcaatctgcctacctcggcctcccaaagtgctgggattataggtgtgagccaccatgcctggcccatttttgtggttcttttatgtctgacaggcatgcctagggcagggagggcacacctctgtctccaccttcaagagcgcatttaggaggaatgtcgatatgaaaagaatcaagctttgtctgaaagatgcaccaggacactcttcagtgacattgggaaaaaagaacgctcaccctgaatcttttttttttttttgagacgaagtttcgctctttgtgcccaagctggagagcagtggtgcgatcttgactctctgcaacctctgcctcccaggttcaagcgattctcctgcctcagcctcccaagtagctggaattacaggcgtgagccactgcactcggctaattttgtgtttttagtagaaatgggtttctccatgttggtcaagctggtctcgatcaccacctcaggtgatccacccgcctcagcctcccaaagtgctgggattacaggcatgagccaccgtgcccggcccattctgaatctgtctaccctagcaaaacgatcctttattttactttcttgccccattcgtacactggcatgactgcactcatagggttcttcacattttatatcctatttaacatcttataataagtataaaataggattttgtcctaaagaatgtggtttaaggccaggcgcggtggctcacgcctgtaatcccagcactttgggagaccgaggcgggcagatcacgaggtcaggagatcgagaccatcctggctaacacggtgaaaccccgtctctactaaaaaatacaaaaaattagctgggcatggtgactggtgcctgtagtcccagctacttgggaggctgaggcaggagaatggcgtgaacctgggcggtggaggttgcagtgagccaagatcgcgccactgcactcccgcctgggcgacagagcgagactccgtctcaaaaaaataaataaataaaaagaatgtggcttaaaaaccaatgatacttaaaaatagaaaatttctttgtccaaagtggattagaagccactttgttctaaaaccattaaacctttttaaactgttagtggctcagccaggcacagtggctcatgcctataatctcagcactttgggagattgaggtgggcagattatctgaggtcaggagttcgagaccagcctggccaacatggtgaaaccctgtctctactaaaaatacaaaaattagccaggcgtggtgacaggcgtctgtaatcccagctactcgggaggctgaggcaggagaatcgcttgaacctgggaggcggaggttgcaccttagatcacaccgttgcactcccgcctgagcgacagagcaagactctgtctcacatgaataaataaataaaccattagtggctcatgaaatcaatgtaatagcttctgaccagaacaaaagaaagaaaatagaacactcagaatgcctcttatgaagactaagtgtagttctgtgaaccttttagtgacgtacatgtatgtagcacgtctccacatgtcatgatgaatgtgcgctgagggtgcagtcctggtgagcaggctaccacctcagtttgccacggctggtatgcatctgtgagctccggaacatccacatagctctgccgcccacaggagcaggtgcacccaccttcgagaaagtgggagaaacaggtgtggcgtccccaccgagggaccttgagcactgggcaggcagagccccagcgtcccttctgttgggtggttggaggagtaagtttaggttataagcatgttttctgaactctgaagtgccacacgaatgtaaggtctcactaaattacagattcagaagctgggattgaaagcacaccactgctggctttggggggcagacaggtgactgacagtctcgtcacagtttctcaagagtcagccctattcaggtcagtgagcgcaggtcagggatgaggtcgctgcactctgcgttccccagtcctgtatgcggcgtcagttttggcagtccacgtgtctctcctgtagaggattagaggggccagccccatgggtctgcagggttggcgcaccgtctggggaagacacttggaatgtgctttcgttggtgagccaggtcaaggaaactttggggaatgtttgcagagagctgaggatggttgtcttggggcctaagtttttctgacttaaaaagcacctcctatttggggtctgtgtggtagtgaccctttttcttttttactttttttttcgagacggagtctcactgcaatgcgcaggctggagtgcagtggtgcaatatcggctcactgcaacctctccttcccgggttcaagcgattctcctgcctcagcctcctgagtagctgggattacaggcgtgcaccaccacgcccggctaatttttgtatttttactagagatggggtttcaccatgttggtcgggctggtctcaaactcctgacctcgtgattctcctgccttggcctccgaaagtgctgggattacaggtgtgagccactgcgcctggcctttttttttttttttttgaaatggagtcttgcctcatcgcccaggctggagtgaagtggtatgatctcagctcactgcaacctctgcttgctgggttcaagcaattctcctgcttcagcctccacagtagctgggattacaggcacacaccacaatgtccggctaatttttgtatttttagtagagacagggtttcaccatgttggccaggatggtctcgatctcttgacctcgtgatctgcctgcttcggcctcccaaagtgctgggattacaggcgtgagccaccgcacctggctggtagtggccctttttcaggggtttacaggtaaactttccttccactttttgagatctggggacattacatgggagttggaggcaagtctcggaaggctgctgggccttgtcctgggcgcaggcttcttaggcccacctcagggttgccaaggggcaggtgtgcagatccatagggaccagcaccggggctcttccaagcagggcaaaggtgttaagggaacagaggagagcagggggattgggggcatcatgaggatggagggggacaaggccagatggggctaaacccagtggccgggtttccttctgagtgcccaggatgttcctagggagccctcagtgaggggtgccctattgtgggtatgaaggaggagcagagagcagggtcggggccagagaaggggctagtgctggcagcatggaggcagagccagtggaattggcctgtgattggacaaggaatgggctcagaaagcatcctggatagctgggcatggaggtgcactcacctgtagtcccagccactggagaaactggcgggaggatcgcttgagcccaggacttccaacctgtagtgtgcatgatcacacttgtgaatagacagcgtactccagctagggaaacatagtgagacccctgtttctaaagaaaaatgaaagcctcctgggtttggctgagtccctggtgaatggtggagcggtcctgagagctgggaagacctctttctggcacagcaaccggggcagaggtgagaggagaagggcctcagcagtgttctggccttttgggttcatccaaaacttgccggtcctgggcctgctgggagaggtcagcccctttcaggtgagcagctctggggccgggtgacccacgccaccgtgtcgggcacacagtggtgcttcgttttcctcactcctggggccacagccttcctgctgcggttctgcctggtgggtgggtccatgctgctttgaggaggcaagtgacctaaggcttccgggacactcttttggcaacttgggccttggaaggacagcagagcaggtgtgcagtgttaggacctgtggctgagctgacctaacagcctgcctggaggcatcagtcaggctcaagtagaacagcaaggcccccatcttggggctgtcgtccaggcacagagcggtcagcatctactgtccttcctggagaaaaaagggaaaatgcatttgtcatttaaatgttggaatgggccaggcacggtggctcctacctggaatcccagcacattgggagggcaaggttggatcacatgaggccaggagtttaagaccatcctggccaacatggtgaaaccccatctgaaaaatacaaaaaattagccacctgtggtggcgggtacctgtggtcccagttacttgggaggctgaagcatgagaattgcttgaacccaggaggtggaggttgcagtgacagattgctccactgcactccagcctaggtgacagagcgtaagactctgtttaaggaaaaaaaaaaaaaaaaaaaaggaatggttctgagaagtcattccttaagtaaataaattgccaccccaggttgccctcttgggaggggactctggaggccgccctccacccttaggccagggcctgtcagtccctgcctccctgggctgcctcctggggatctcagccgacaccatgcccctgtccttcctccacctctttcccaggttgctctgcctgcagtccaccttctaggagtgagcccccccacccccactggaagtccctctctagctgtccccagttccctgaatcaagactgcttccctgccagagagatgaccccaattcctgcctcctctcactaggctctcaggggccgggactggggacagagcatacttagagctagccctggccctcgggctgcttttggaaggaggagcatggcaggcgagcatcaggtgacacgtgcccccacggggagcgcaagaaggcactggaggctgttgcgaaggagcagtgggtttcgggtcctcatgaccggccctggttccgggtgtgaggctgtggagacgcatgggtctgcctttctcatccgcagcttcctgttgctacttgggaagctccatgtttgctgtccggttgtgtttcgagtctgttctcttgggcgtctgtgccgtggaagttccttgtgcttgatagggccagcacgtgtgaacaatcttcacttcagctagaagctttgaagtctttggactcaagctttacccaaaccgcttataaggttggggggaaccgagtgcctgtctctccccgcttttttttttgagtggagtctcgctctgtcacccaggctggagcacagtggcgcgatcttggctcactgcaacctcagcctcctgagtagctgggactacaggcgcccgccgccacgcccggctaattttttgtatttttaatagagacggggtttcaccgtgttagccaggatggtcccgaactcctgatctcatgatctgcccacctcggcctcccaaagtgctgagattacaggcgtgagagttgtagttcgttgagagggagacagacctcgaggaaatgcttggtgtgcctgccgggtgactgctcgctctccttgtctgctcactctgcccagtgaatgggtctaggcatcctcattgttcccttcctctgtcctcaacatcagcccaaccctgaccaggccccttcctgaggttcccacacaacaggggctccatgttcagaaggggagagagaaacccacctggggatgctctgtaaggagagcagagcccagtggagtctctgcccgggacgctgagggaggaagagctgcggttaattcaaaaggaagggtgaggtgcaggtattggctggatgatgctcagagaagcaggaagagtgggcatggcactgagtggctgaggccatcactggtggccttggtgcttaggcagaaggagagggcatggtgcagggcgctgaggccgtctgtggctgccttggtggggcttactgagttctagtggacagcaaggtgccagggcagggctggcacatggagggctctgaaggccatgtgtatcgtctgaagtgagggaaacccgtggtagctaaagggaatgcactagccagccccaggtgcgccacattcctgctctaggggctggagggaaacccgtggtagctaaagggaatgcactagccagccccaggtgtgctacgttccgctctcggggctggaggggaacccgtggtagctaaagggagtgcactaggcagccccaggtgtgctacgttcccgctctcggggctggagggaaacccgtggtagctaaagggaatgcactaggcagccccaggtgtgctacgttcccgctctcagggctggaggggaacccgtggtagctaaagggagtgcactagccagctccaggtgtgctacgttccgctctcggggctggaggggaacccgtggtagctatagggagtgcactagccagcctcaggtgtgctacgttcccgctctcggggctggaggggaacccgtggtagctaaagggagtgcactagccagcctcaggtgtgctacgttcccgctctcggggctggaggggaatccgtggtagctatagggagtgcactagccagcctcagatgtgctacgttcccgctctcagggctggaggggaacccgtggtagctaaagggagtgcactagccagctccaggtgtgctacattcccgctctcggggctggaggggaacccgtggtagctaaagggagtgcactagccagccccaggtgtgctacattcccgctctaggggctggtctggcggcatggctctctcctgagtgccttcagagcctgagtgccagcaggcaggcgtctcctgcccagtgggtttggtaagatatatttcagaaggcatccaccactctaaaacatgcttattgcaggaaccatgggggagaccaaagggcctagagccttgagaacctctgaccattagtgttaacaggaaggcagcctgttcccctagctggggagggggttgtgcgtggcaggaagcccgtgcgtctgtgtctctttggagctgtgggttggttgtgtggatgccagctgtgtggtccccagcctcactgagcctgagtttccatactagcggcgggagatgggactagagggtctccaaggctccctgaagctctgcgattctgcttctctgagtcttgaccgcaggtcagtggggacccggcccctcaccatcgcctgctactgatcaccattggtttggttttgtctcgaggactgttctggaattgaggtgtaacgtgctgtgtgttcttccttagggctttgttcgcgggggtcacagctctcatggctgcagctagcgtgaccccccctggctccctggagttgctacagcccggcttctccaagaccctcctggggaccaagctggaagccaagtacctgtgctccgcctgcagaaacgtcctccgcaggcccttccaggcgcagtgtggccaccggtactgctccttctgcctggccagcatcctcaggtgcatggggcctgcaggctgggaggaggggcaggcaggctaggctggttttagagccacgctgcccagcctggtagctcccagcagagccgggtccagcttagatgtgctccagttatcgatactccctggatttcggaggtttaccacaaagaatgtaaaattaataattttaaaatagcaatttgaaatacgattttggatacatggggttaaatatagtacgtcattacagttaattttatctttttattatttttaatgtgagtactggaaagtttaaagtgccacctactgctcactttttggctgctctaggcagctaagacagccgccttccttgcagcgagtggtctgagaggtgtggcctgtgcacatcggcagcagctcggcctgtcgggagagccggcaatacctgagttactgcagcagatgtccttggcggttcaggcgtgccttcctcacaaacggagtgataaaaacagtgtgctgtgaatactggggtttaaaacatgtcctgttaacatttgcctgctgttggtttcactaaggatgagaaagtttaaactgtggtgtggaggtaggtttttgaactgaagcaaatggtgtttgttttttgcattaggtttcacagtgggttgttttttgccttttttccccactagctctgggcctcagaactgtgctgcctgtgttcacgagggcatatatgaagaaggcatttctattttagaaagcagttcggtaagtaaaatgtcttgaagctaaaaatgttgaacagaaaatgtcttaatttcctttacaacatgggtggggctgggcacagtggctcacacctgtaatcccagcactttgggaggcccaggtagggggattgcttgagtccaggagtttgagaccagcctgggcaacatagtgagaccctgtctctacaaaaagcaaaaaacttaccaggggccgggctcagtgtctcacacctgtaatcccagcactttgcagggccaaagtgggtggatcacctgaggtaaggagttcgagaccagcctggcgcacatggtgaaaccccatctctaccagaaatacaaaaaattagccgggtgtggtggcgcacgcctatagtcccagccacttgggaggctgaagtgggaggattgcttgaggctgggaggcggaggttgcagtgagccaagatcgcatgccactgcactccaacctgggttacaaagtgagacccctcctttaaaaaaaaaaaaagaataaagggccgccagaagttgtcccttagcagactcctgaagtttagggtttggaaactttggcatcaaggtgagtccaaaaataaaaaggaatcagagagtcatcctctgctcctggagtggcctggaaaggcgatgtgacgcagtattggttggtttggacgtgtggtctgtgttccttggttgctgcagggagtctgggaggaggtttaacccgagggatattcctctccccaggccttcccagataatgctgcccgcagggaggtggagagcctgccggccgtctgtcccagtgatggatgcacctggaaggggaccctgaaagaatacgaggtaaagatgcctgcgtgtggcatggtgacagaagctccagcagtcgggagtcgtccacgctccccaagcagttatgaccttgtcctgcacgttcctctcactggggctgaagcctgtctgatgtctgtggaggaagagacggagctgctccttagagtatgtccatttagaaactcaagtagtgcagagcacagacctgcaccatggagcttgggctgtgtgacctcgggcgaggtatttaccctctctgtgcctcaggtttcttgtctgtcgatgggggtgcaggatcccaccatcgtggggtggctgtgagggttggaggtgcctgtgtgagccctgggaatgccatggttatctgagcagtagcatttcctgggaatgaaggggagatcgctgtgcaccaggacctgcagctttcaagtttggtgggggtttttgttgtgtctcttgtatccacaaaggattgcttattttgaattgtgttgacactggaaattgcagaaataatggacacacttgtcctgtggtcacagcaacataggcagtggcccgcacttcacttggctgtggtttgtccctgtgtgctgggcgagccgtgcacgccttcctgcactggggatttcagtgtgattctcacgtcaccttttaggcatttggaaacttcacctgtagtgtagaggccaggaggtgccgagagagctcgtcgaggccactacagctcgccaagttatgcagtcttccttcttgtaatgaatgccctttaagaggtttctctctgggatccttgtacaggattcctggagtaacactgtccacagagcccaaaggtagaggcagcccagtgtctgcggatgaatggataaacacgggaagtgtgatctgtgcacacagtgggatatgattcagccttaaaaaggaaggcgattcggacacacacaccccagggatgaactctgaggacagtgtgctgagtgacatgagccagttaccaaaggacagatcctctgtgattccacttaggggccacccttagagtcatcagatccatgggtacaggaagtagaatggaggagacaggggtcattgttcagtgagtaccgagtcatacattggaatgaggcagtaccttgatgccatccaatccagccccaggttggtgaggctgtgagggctgtttgctcagaatcctggctttctgcacttaggggagcttcctgcccgggccagagctgggatctcctgctcagccggaccctggggtgttaccggctgggttggaattggacctgcattactgtgtgtttctcctctcctgctccccgccctgtgagcctggccacgcctccctcttctcctcgcccactccccaccctgtgagcctggccacacctcccacgatcttttgacagactctgctttgtggtctttgggctccaagtttcgttttttcagaagaactgccccagctgtgtctggggtgaacaagatgtgctttcctccctagcacggggattgcgtcctggacacggagcggtagctccagggcactgccctagagtgagactcctacctctgtgggcagagatgccagaccgccctcagccacgacgtgcgatgcaaagctttctaggctcctgtgtggctctgccgcacaaacggctgtggcgcatggcattgtaccccccactccctgctccttgaaagagatgcagcttggtcattgcccagtgctgtctgcaagggagatggctccctggggaggtggcccagggtcagggtctccctgggagggttggggtaccagctggctgcagggagtaggggtgctatgcgccatgccaccctttgagaggactgaggagtgtctgggggacaggtgggataatagtttccagctctgcactggaccctgagtcctctggggtctctgccacctccaggctcatgggatgccacattgacaattatgagggcctccggctgagggccaaggactatagccagcccctggcctggggcgccacgcggtcctgcaggcacgcagggtggaaagtccctggctgcacctttgagagctctggaaagtccctgagaggagccgggtttggtcatgtgggaggggcgggcactgctctggaataacttggctgtggcctttgattttgttgataaaacctctcactggctgtaaatgtcacacatggggacggaaatcaacccgtctatacagttgggagccgctctgcccctcggagccgcctctctttgctctccgggtgctcggagtgtgctgctagttggggccttattgtaaacacagtacggaggctaaggctgcctttcctccttgatggtcggaactttattggaaaaggggaaaatcctgcttagcttttgaatgtttgtcctttgcaatgatgcctttctaggaactgaatgattttatttatttatttttatttttttgagacggtcttgctctgttgtccaggctagagtgcagtggcgtgacctcggctcactgcagcctccacctcccaggttcaagtgattcttctgcctcagcctacaggcgcctgccaccacatccggctaattttttatatttctagtagagatggggttttaccacgttggccaggctggtcttgaactccttacctcaagtgatccatccaccttggcctcccaaagtgctgagattcctggcataagccactgcacctggccaaatcgaataattttaaaactttaggtaaatgttgatggagtgcttgctgagtgccaatagcagaactgaattccccagtgggcccctgagctactcgttctggcagctggatgcgggggtgcggggagactttccagagaggacataggctggctgcacgagcagcggaaaggccaggaaaagccaagtatgctcggcctcatggacattctagtgacattcagagggatgacgactgtatttgcgtcaaatgtgtagtttgaattctggctgaataaatattgatttttttttttttaaactgtgtctgctgtgggtggggagaagactgagacagatggtgctggtgtagatgtatctgctgcaggacaaccctggtcccactggagatttcaagtaccgagtgccaagagaaaggttttttttgtttgtttgtttgttgttttttgcgatggagtctcactctgtcacccagactggagtgcagtggtgcgatctcggctcactgcaagctccgcctcccgggttcacaccattcttcctgcctcagcctcctgagtagctgggactacaggcgcccccaccactcccggctaatttttttgtatttttagtagagatggggtttcaccatgttagccaggatggtctcgatctcctgacctcgtgatccgcctgcctcggcctcccaaagtgctgggattacaggcgtgagccaccgcgcccagccaagaaagattttatttttgacatttcgagcatgcagcgcatctgagcagtgaggctgagagtagaggtgtgccgctgccccacaggcctacatgctgccccgcagcacctgccagccttcgccagcctactttcagcccttcaaccccccacacacatttttttcttttctggcttattttaaagcaaatgaagatgtcatatcatttcacctatgagcattttattactattatttttagaaatagagtctcgctctgttgcctaggctagcgtgtagtggtgggatcatagctcactgcagcctcaaactcctgggctcaagtgatcctcccaccttggtctcctaaagtgctgggattacaggtgggaacccactgtgcccggccattttactatgttttaaagaacagtcttttttatttttatttttttatttatttgagatggagtctcactctgtcgcccaggctggagtgcagtggcacgatcccggctcactgcaagctccacctcccacgttcacgccattcttctgcctcagcctcccgagtagctaggactacaggcgctcaccaccactctcggctaattttttttgtatttttagtagagacggggtttcactgtgttagccaggatggtctcaatctcctgagctcgtgatccacccgcctcggcctcccaaagtgctgggattacaaggcgttagccaccgcgcctggcctaaagaacagtcttttaattaaatctaagaacattgactatttgtgctttcgtttttaggtttcataagccagaatagttgctgaggctcctctttgattcagcttgatggtggcttgttacacactagtgtggccgagggctgggtcctgtcccgtcagtgggtagcagagtgcaaggcgctgttgggttcagggagttggttcctttagcaggcttagcttgggccagtgccgctggaggtcttggagggctgggcccatgttccctggggcgcctctaaggagtagttgctgtgcctgtgtgaaggtttgggaggaacactccctggggaggttgaatggaagccagcccaagtgcctgtgctgtccagagcagggtctcccctcttgggggaagtagcattaacctttcctgagtcacttggggctcctgagctgtagccagctctctatggagctgctgacccccactccccaccccatgaagggccccgcagccaggtcctctgctgccctggcctctcaggaaccttcctctcagcacattgtcctcctctctccgggttgtgcccatcggtacagaatatgctctagtctctcctgtctcaaaacttagtgttgtgctcagtgagctaagctaggcacaagaagataaagactgcgtgaattcactgacagagtccccggagtggtcaaattgagagccaatagatggtgctgggggctggagcaggggaatggggagttagggtttaacagggacagggtttcaggtttctacaatgggaaagcgtgatggaggtagatggtggtgatggttacataacatcagtgaaatgtacttaataccacagaactgtgcacttgaaaatggttaagatgatacattttatgtttatcatgattgaagaaacagcagattttcaacttcctgttcctttgacttccattccctttctctgttcccagtcatagcagacttctcccaaaagacgtgtttaactctggccaggcacaggggctcatgcctgtaatcccagtactttgggaggcttaggtgggcagattgcttgagctcaggagttcaagaccagcctgggtaagatggctctaccgccgggcgcggtggctcacacctgtaatcccagcactttgggaggccaaggcaggtgaatcacgaggtcaggagattgagaccatcctggctaacacggtgaaaccctgtctgtactaaaaatacaaaaaaattagccgggtgtggtggcgggcgcccgtagtcccagctactcaggaggctgaggcagaagaatggcgtgaacccaggaggtggaggttgctggttgcagtgagccgagatcgcgccactgcacgacagagcaagattccatctcaaaacaaaaacaaaaaaccaagatggctctgccaaaaatacaaagaaatttagctgggtgtggtggtgcgtgcctgtattcctatagtcccagctatgtgggtgctgatgtcgaggctgcagtgacctgtattcttacccctgcactccagcctaggtaactgtatcagtccattttcatactactataaagaaatacccgagacttgggtagtttataaagaaaaagaggttgaatggactcatagttccatgtgcctggggaggcctcacaatcatggaggaaggcaaaggaggagaaaggcacgtctcacatggcagcaggcaagagagcatgtgcaggggaactgccctttatcaaaccatcagatcccatgagacttactatcacgagagcagcacgggaaaaacccaccccatgattcaatgacctcccaccaggcccctcccacaacacatggggattatgggagttgcaattcaagatgagatttgggtggggacacagccaaaccatatcagtgacaaagtgagaccctgtctcaaaaaacaaaacaaaacaaaaagccctgtttagttttatttctgtacctcaccagccccttatggaggcaggtgggacctcctgtggcttgggccagaggcctgagagtccttcttgacttctctgtgttcctgtaagcggcacgttcagtctgccggcaggtccacgtggctccccagacacatcctgaatccggccctctctcccgttacactagcacctttgtagtgcctgccaccccgttcttcctcctgtgactgctgcggcttcccaaccttagagtctgtgagaggtgcagctgccaggcagtcctggaagggttcagccacatcccgtcaccttgctgtcctgacccctcacattcgggcagagccctcaagacggtcggggaagccctgcctggggcagcagtgggctggagaggtggctgggttctgcatcctacattcttgattcttcctggcctgggtgtggcgaggagctggcaccgcctcccttccctctgtgtccttttcccttgccaccctggccatctgtggacgtccacagtcctctgcctcgcctgacgcttagcctgcggcaccggctcccgcttccctagtctgcagtctgcatcttgtggcaccttccccggccctgcctccactgcctgccttccctggtgttctggcactggtggtcactaccaggttgtcagctccaggagggcagggcctctgcccagctcctgggtggctcagtgtgtgggaacgtgtaggtgcctgagtgaccttcctgtgtgtcactggccctcgcctgtcttcctcgcagcttcggccctttcagatgcgtgtgctgtgcagctagacccagctcctggcaccttggcctggtgggcttgtgcctcaggcctttgctggcttcctggtgctggaggcagaggccagctgcccgcatgctatctcccgtgcgtgttccctacctcttcacacctcccacctgcaatgaggatggggctgggactggcaagactcagcctggaccgcgttgggcttggtcatcagatcgagcgtggcctgctttctcggttaggagctggtgtgtgtggcagggacccgctggcgcagagcagggactgtgcacttggctgtttcagggggcagatcggggagcctggtggtggcaaggcatccacacagagacccccatggcagagcatcccctcagctcagtgtgcggtgaagagagtggagacgaggacacactgatctgatctcctcctgccctcccacctgtgggagccctgagagctatctgcagagggcggcccccaggaccagcatgcggacaccaagccagcgctacatcgccttgtgtccccgggtgaagctgtggctgcccaaatgtcccacgcgagttctactgacgcttcctcctttcgttgctagagctgccacgaaggccgctgcccgctcatgctgaccgaatgtcccgcgtgcaaaggcctggtccgccttggtgaaaaggagcgccacctggagcacgagtgcccggagagaagcctgagctgccggcattgccgggcaccctgctgcggagcagacgtgaaggtgcgtggggtggagcagcagcctgtgtggctgcagccatgcggggctgagctggggagctgcgtgctggccactgcggctgcgtcggcccctttgcactcgttccaccccctcggccctttccctggagacacgcgggcggatgtttcttggcagaactgggaatgggtgtgaagttaatgccgaggcctttcaaaagcatttttgtaagccgggcacggcggctcacgcctgtaatcccagcgctttgggaggctgaggcgggcggatcacgaggtccggagttgaagaccagcctggccaacatggtgaaaccccgtctctactaaaaatgcaaaaagttagccaggagtggccaggtgcggcggttcatgcctgtaatcccagcactttgggaggccgaggcgggcagatcacgaggtcaggagctcgagaccatcctggctaacatggtgaaaccctgtctctactaaaaatacaaaaacaaaattagctgggcatggtggcgggcgcctgcagtcccagctactcaggaggctaaggcgggagaatggcgtgaacccaggaggcggagcttgcagtgagccgagattgcgccactgcactccagcccaggcgacagagcgagattccgtctcggaaaaaaaaaaaaaaaaaaaagccaggcacggtggcgagtgcctgtaattccagctactcgggaggctgaggcaggagaattgcttgaacccaggaggcagaggttgcagcgagccaagactgcaccactgcacactagcctgggcaacagaggaagactctgtctcaaaaaaaaaaaaaagaaaaaaaatttttaaaaaaagtttgtttttaggacaaaaaagcatttttgtcttagaaaagtctaaatgcatcaggtagagagtgcggtggtgggtgtgcgtccgtcctcgccaggcctgggctttgctctcaagacagttgctcaagtctgacttcgccttccccaaagcgttggtgagaatagcgccatgtctgagatgcagctgtgactgctcacatggcctgcagcctgtgtctgcgtccctgttgtctgtctttgccttggtgtatctgaatcacgatccatacagggttcctgcctttggtggaaatgtctctgggtctctctctgcctctggggcccatggcatcttttttcctgggctcttgtccttcaggagccccacttccctgagacccatctgcacttccctgtaaactgtcagatggacgggcctgaccatagcacatctggggtgccaagccctccgcagcagcatgtcagggtctgtcttggagacgtcccgcatgccgccagccctgcccatccgccaggccctcccaccggcctcgcctcccagcgggagcagcgtttccccatcttcaccggggccgttgtttcacgtggcttccaaatctcctctggtggcttgggtctccctcgcattgccctgagctggcagaacaaacaaagcgttaagatctccgaggctcctgggtggtgctggcaggatcctgcccgggaggagcactgtccttcgaggctggagggtgaccacgtgctcctgcggcccctcggcgctgcccagcctgagcactgtgtgccgccctccacccgcgcctggcattggcgtccaccctcacactcctgatcccttcttttgaaggcgcaccacgaggtctgccccaagttccccttaacttgtgacggctgcggcaagaagaagatcccccgggagaaggtgagtgtccttcacctccttggaggaccgcagggcggggcccatgtgttggacgtgagggtcccgtgggtgggggtggggcaggttatgacccttgtgcccaaaggaacagcagtgcaaagcccctgtaacgttgggtcatggatgcgttcagggtggcggccgctctcctgagtgggccgggggccaggtggctgagtcccgagccctcttcctcatcctccagtgtacatagctgcttacttttcagcaggtcacttcctagttatcctgaaaatgaaacattaaagttctcatcgccctccatgtgctgcttatgagaaatgttgttactgactttgaagctgaatgtttgcagcaagcggttggggtggagactgggcgccctagtctggtctgctgccacagccgtgaaatgtgggtggctcgcctggcagaactttgtccctggtgtccttacttctttcaggaaaatggtttctctcccagttgagagttaactgctgcagatgacacctttaggaaaggaagctgggaaataatacgcatggaaacattttcccaaactgcctcccttgttggaggtgtgagggtagctcatccagagaggctgaagctctggaaggggcacctgctctgtgtgtcagaggtccaatgtggaggcctcacaggtggcagcccccatctgggcagctacaggaggggtcaggctggccaggcctgcccgcgggctcagcctgacaggtgtgtgcctgtctttctgatttgcttctgtttaaatataggtcacagcccaagtcctgaaatgggtagggctgggggacgggacagggctgtctcctcacctctttccacttgtctgttaaatgtcccgcactgtgagcttggccgagtgctgtctgaaagcatcctttcccttcacctggagactggagcgccatagaggctatggctgctgccatgcccccttcagaggccaggacgcctgcctggggcccgtgtctgtgaggctgtgtcccctgctggtggggcctggaggtgcccccgagaggtgccctctgcgtgtgccccagtctgtgtcagcccttgtctgtcctgagggggttgtacagaggagttaggaggtgattctttccttgagactgtttccagagtgaaagacgaagacgggcgcccacgcagcgcggtggtgtctggtgggttttgtccccacccatcactgtgaacacggggctttctctgtgcatggtgcattttcatccttcccgtcttttttttttttttttttttggagacagagtttcgctcttgttgcccaggagtgcaatggtgtgatctcggctcactgcaacctctgcctcctgggttcaggtgattctcctgcctcagcttcccgagtagctgggattgcaggtatgcaccaccacacccagctaattttgtattttcagtagagatggggtttctccatgttggtcagtctggttcttgaactcccaactttaggtgatccacctgcctcagcctcccaaagtgctgggattacaggcgtgagccactgccccagcccattgcatctttattttgatgttcacagggcctcatcttcagactgaggggcctttcaggctctctgagaatgaatctcttgggccccgcctgcttcctcagggcagtcctgtctaggcatggaactctggcccttcaatgcaggccgacatataggggctgcatgtatgtgcagggtgtcctggggctgtctgtgccccctggcccgttccagaggagaatgctgagagtgctctcaggtgtttctaatgtgtgtggcgtgcttgggattttctcttatctctttttttttttttttttttttgagatggagtctcgctctgtcacccaggctggagggcagtggcgagatctcggttcactgcaagctccgcctcctgggttcacgccattctcctgcctcagcctcccgagtagctgggactacaggcgcctgccaccatgcccggctaattttgtttttgtatttttagtacagatggggtttcaccgtgttgaccaggatggtgtcgatctcctgacctcgtgatctgcccacctcggctcccaaagtgctgggattacaggcgtgagccactgcgtctggccctttttttttttttttttttttttttttggagacagagtctcactctgtcgtcaggctggaagtgcagtggcgcaatctcggctcattgcaacttctgcctcctgggttcaagcagttctctgcctcagcctcctgagtatctgggattactggcacctgccactccacctagctaatttttgtatttttagtagagacagggtttcaccatcttggccaggctggtcttgaactcctgacctggtggtccacccatctcggcctcccaaagtactgggattacaggcgtgagccactgtgcctggcctctcttatctttttttagtgttgcaaatcttggttcctaacactggtaacgtatttgttttatgttatatatagagtaggtttaaaattaaaaatacctactgagcatggtggctcactcctgtaataccagcattttaggaggctgaggcgggaggatcacttgaggccagttcgagaccagcctggccaacgtggtgaaactccgtctctactgaaaatacaaaaattagctgggcatggtggtgcacacctgtagtcccagctccttgagaggctgaggtgcgaaaattgcttgaacccaggaggtggaggttgcagtgagctgagatcgcaccactgcactccagcctgggtgacagagtgagagcctgtctaaaaaaacaagtcaaggccagttgtggtggctcacatctgcaatcccagcactttgggaagccaaggcaggtggatcacctgaggtcaggagatcaaaaccagcctgtccaacatggcaaaaccccttctctactaaaaatacaaaaattagccaggtgtggtggcacaggcactcctgtaatcccagctacttgggaagctgagacaggagaatcgcctgaacccgggaggcacaggttgcagtcgcagtgagccaagatcgcgccagtgcgctccagcctgggccacagagtgaaactccatctcaaaaaaaaacaataaacaaaaaccagcaacatggcttctgatgatgaggccactgatgatgaggccacctgtttcttcgaagctctttttgttcttggaagtacatcttatgaagatgtggggtccacataccatgttcttattataaaggaattttttttttttttttttttttgagatggagtctctctgccgcccaggctggagtgcagtggcgcaatctcggttcactgcaacctctgcctcctggattcaagtgattctcctgcctcagcgtccctagtagctgggattacaggtgcccaccaccatgcccggctaattttttgtatttttagtagagacggggtttcactatgttggccaggctggtctcaaactcctgacctcgtgatccacctgcctcggcctcccaaagtgctgggattacaagtgtgagccaccgtgcccggctacatactatgttctgaggtgaactggaatacattttttctttgagtttatgtcagctgtggtatatagttcatttgcttcaggttcttttaaaatgtgagggttttttttaaagatttgcttttgttctttgacgatgtaaactattggcctgctgtcttatcagtcagagctgtgcagaggcacaggccccatctcatcctcccagcccctcctctccatctttgctggttttgctggagcctttctcggtgaccatgctcccagggcttggtcgggttcctcaccactgcctgggacatgtgcagggctgagccgagcatggggcggcgtatgttgggacctggtcctttggaggctgacctgtggggctcgctggataggagaagtgggcctgggcctcatggccaaacagcccagaagccttggcagtgacggacacctcgtgtttgataaggtgtttgccccttcatggtgatgctggcaggaaccacagacgggcagtgtttagtgtttcctgggggcctgggggttgccctcctgccctcacaggaaccctagggcaccctttatcagatgaggaaattgaggtttacagaggccaggcgcccagctggcttccagttccatggacggccctgccgtgggcagcctgggggacttgtctcctcgcttccagcagtgccttctcccacacctaccctacctgggcgatcgcaccccccattcccagcatgctgcgcacatgccaggttcctggcctcttctccttcagcttcctgtggtggaaatttctgagcctggacagatgagagagagcacattagaacttggggccctgctgtggctcaagatggggggtgcccagtgacagttctgtttcattcctgcctccacttcttcccgcagcccagtgtttcatccgaaaatacttcagtgacagcagagggatccttgctttattttaagagaaaatacattgtgggttcacacggatgtttgcatttcagattcttacccaacttccatgttgctgtctcctttctacagaaagtcgtggttcctgttgacattgctatacataagaacggtgtcagtagcactgagtctgatccatggcaaattatgtgatgacgaagttctctttctagttctctttgcttttagagtctgtattgagttgctgtgtcataagtcattcgaagcagcgtctctgggcaggcggctgtctcagtattccacggaggcccatttgtttcattttgcttttgagttttaaagattgccctttaaaaaaaaaaaggccgggtgcggtggctcatgcctgttatcccagcactttgaaaggcggaggcgagcggatcacctgagctcaggagtttgagacctgcctgaccaaaatgcagaaaccccgtctctactaaaaatacaaaattagccgggtgtggtagcgcatgcctgtaatcccagctactcgggaggctgaggcaggagaatcacttgaacctgggaggcagaggttgcggtgagctgaaatcatgccattgtactccagcctgggcaacaagagagaaactccgtctcaaaaaaaagttttgtaattttgtaaaatggttacatggcaccaaagcgaaaactacaaaaaaggtgcattctgagacgtcagagggaaatgtgtcaggctccccgtccgcagcgccgtgcggtcgttcagaaatttgcattcccataagcattgtgggagcaccgtctcccgagacttgccagcacagtgtggtgtgaaggttggacgtgccactgtgatgtgtgagaaacacatcagtcctctgtatcgggggtccacgccgtggatccagccaaccgtaggttggaaatgttcaggtaaaaatgcactgaacacgcgcggacattttttattgacacagcgttcacgttgtattggtcatgagtcaccgagagctgatttcaggtatgagggagggtgtgcttaggctctgtgcaaacactctgccatcttccatcagggactcgagcatccttgggtttcagggaccctgagaccaacctcctatgggtggcaagggacagcagagcctcgaggcggttctgacgggcgtttcccaagctgtggtgtgaccgagcccatctgtgcttctcttgctgttcatgactcctgcccactgaatagtgtttttggtttttgtttgttttgggggaaattgttcaaggttcttatgtgactgtttctggaaactgattcacagttacggccgtttccctccttccgggtatgaaatcttgtgctgcgtctggcatgtgtgggtttggttttctcacactcagagccgcgacacacctgccatgtcacctgggaaatggaggaggaacttggggttcatgtttttcctcgggctgttcctgcatccatagacccatgtcagataccacagtgttagtctctgtttcttccctggttcgatgttcctgttgtatgtgagtgtctgtgtgcacttggcccctttctggattttacgttttgcttcatgtcgtgtctgtgtcatcctgtaccaccacgcaccgggtgagcagtgggcgtttgattctgggttttgaacccaggccctgaggcctcagcaccgcatgtcctgtggactgtgatagagggacaggcgtgccatgtgacacacaagctggggtctccacaggtgtcccgaaatgcttgcccatctcagttactggcacagtgtgcatgtttgcacgtgtgtgtgcacaggtgtgtgagcgtgtcgctttggaaatgggctgttgggtttcattcagtgtgagagtgaagaggccaacggggcaggtcatgtaacctctgtgtcagtcagtgtggtccatgtggaagtgctgaaatgcatcagaacagagaaagatggctctgtgacgtcactcccttgtagtttcaggaccacgtcaagacttgtggcaagtgtcgagtcccttgcagattccacgccatcggctgcctcgagacggtgagtcggggggtctgaggttgggggccacccctcatcctgggtgtggtcttcactgcctccagcccagtgcttcctggtttccttccagctgctcctcagccacctctgcagcactgcctcctcctgccccggctgtccgagtgttcccagcttggtctctgggctggcagccctgtccactccctcctggtggcattgtagtgcctggctttgactgccacctgtctctgaggatgcccagtgtgtgtgcccacctgtcgccttgagcctccctgggtgttgagtgcacgtctcagatgtacccggccggctcgccacgaccactccttggccgctgtctccctgcccccatctcacacagaaaagggcagcactctaacccagcggctgtcgctgagccctccgccaccagcaggcactcgggcccctcctctcgcctcatgcttcacgttcgggctgacagaggtctcgtctaccctcaaatggtccccccagccgtcactgccctgtccacatcatcctcatctctcactgggacccaggctcaggcgcttatgggacccccgttcttttccgttctggcctgttcacagatggaaatcgatcacagctcttcctcatggcttctcattcagagtggcctgctcctgtgatctttccctcccctcagctatctcctctgccctgctcgctggcctgagcttccttgggcatgcccacttgtgcccaccccaggcacttgggcactggcacaatggccaggcgcctgggtctctccaggtggacccccctgctccacccctgcagactctgcccctctgtcgccagcacctcgtgtctttgtctcttgtccgtcttgccctgtacaacaggagccccttgaggtcaggaccctcgaggagtactgggcccagaggtggtccccagctgaggtgtgtgcctgatggatggagaggggcaggccgtgggtgcagaccctcccctggccagctcactgggcgggcaccttccttgcttgaagacagggatgtcttgacggcatttgtggtagagtcagttgctgacttgattctatgtggccttaggtattgtgtttttttcctaatggtgaaaaggagcgtggctgcttccattttctttgtctgcgttggatagtcttctgctgtccgtgttcttgtctgtttcctgctctgacgtggcatctgccatctctaggaagcccaggcttcccgtgcgggaggttgcgtagtgaccacccgggcctcagtggtgcttgctgccgccaccgtgctccttgtttctgggcctcttggtgttgagaaatgagagagaacacagcgtgagtctgtggcgatgctcgcttcccgtttgcacaaaggatctccccgtgctggcacacccaccccaggctcagccagggcctgctttttccacgccgcgcacagcatggtcccaacagcagcactctctgagaaaatgcagggcgagctctcgtccagctgtttgtgtcttgagtgcccttctgctctctgggtggtcatgcctctagctgggtacacatgtaggtccatttgtttcttttactgtaatttttttagagtgttttgtttatatatatatatatatatatatatatatatttatttaattaattaatttatttatttttgaggttgagtcttgctttgtcgcccaggctggagtgcagtggcatgatctcagctcactgcaacctctgcctcccgggttcaaacaattcttgtgcctcagcctcccaagtaggtgataaaaggcccaagtagctgtgatcacagctgtgtgccaccacacccggctaatttttgtatttttagtagagatgaggtttcaccatgttgcccaggctggtctcgaacttctgacctcaagtgatcctcctgcctcagcctcctaaagtgctgggattacaggcatgaccgcgcctggcctcattttcaaattttgttgtggaaatttgaaaataatttaattgcaaagtcaagtctataaaatgaggtatgtttaaggaggcctagcttccagccctgtgttttcaccttcccctgtgggtggctttttatttcttattttattttgttttatttcattttatttttgagacagagtcttgctctgtcacccaggctggagtgcagtggcgccatctcggctcactgcagcctccacctcctgggttcaagtactctcctgcctcagccttccgggaagctgggattacaagcacacaccaccaggcccagctaatttttgtatttttagtagagatagggttttgccatgttgaccaggctagtctcaaactcctgacctcaggtgatccgcccacttcagcctcccaaagtactgggattacaggtgtgagccactgcacctggcctattttaatatttatttatttatttatttatttatttattttcgaaacagagtctcgctctgttggccaggctggaagtgcagtggcaccatctcagctcactacagcctccctctcctgggttcaaactattctcatgcctcagtctcccgagtagctggaattacagacatgtgccaccatgcccagctaatttttgtagctttactagagacagggtttcaccatgttgcccaggcttctctggaacttgtgggtggcttttttttttttttttttttgagacagagtttcgctcttgttgcccagactagagtacagtggcgcgatctcggctcaccacaacctccacctcccgggttcaaacagttctgcctcagcctcccaagtagctgggattacaggcgtgcaccaccacgccctgctaattttgtatttttagtagagacagggtttctccatgttggtcaggctagtctcgaactcccgacctcaggtgatcctcccaccttggcctcccaaagtgctgggattacaggcgggagccaccatgcccagtcatgagtagcttttttaaaatggtgtgttgcttttatttttcttttctcttcctttctgtccctccccctccttctttccctccccttcttcccttcatcccttcatctcgtcctgtcccgtcccttttttcttttcttccaaacagggttttgctgtgtcagccaggcagggatgcagtggtatgatctcggctcactgcagcgtcaacctcctgggctcaagtgatcctcccacctcagcctcctgagtagctggaaccactggcacacaccaccatgcccagctaatttttaaaaattttttgtagacgtggggttttgccatgttgccccagctagtctccaactcctgggcccaaatgatcctcccgctttggccttctgaagtgctggaatcacagttgctagctactgtgcctggctgcaactaagttctatagcttcacgttctttaaacacacctgactttcagtctgtcatacacaagaaggatcagccatgaccaggccacccaggcatccctatctatgaccctggcctgtctcctcagctcagctgaggcccacgtcttggtggccgtccccgggtgggagccgaatggtggatggagccagcagcctccctgccctgtgtccgcaggtagagggtgagaaacagcaggagcacgaggtgcagtggctgcgggagcacctggccatgctactgagctcggtgctggaggcaaagcccctcttgggagaccagagccacgcggggtcagagctcctgcagaggtgcgagagcctggagaagaagacggccacttttgagaacattgtctgcgtcctgaaccgggaggtggagagggtggccatgactgccgaggcctgcagccggcagcaccggctggaccaagacaagattgaagccctgagtagcaaggtttgtgcctgccgggtggccagccatgaggaggacagtgtaaagggggatagtgttcgtgccccagcaggttctagcaggtcctggagctttagagcccggacaatgtagaactccatctgcaaaccccagtccagtgtggtttaggggaggctctggcccccttcatttctgagtcctgtcatctaaggggcccaaaccctggaaggtcctagaggccaggccgtgggcaggagcctcttctctctgatgggagggcagagtcagccatggatggggatgtgcatggcctggtgtggcttctgagcacgcttgctggcccggagcttctgtgtggacttggagccaccacctcttggcgagggtggggttgggttcttgtgtgcagggagtggacatgagaaacatggagcccaggggtgcccaagagcactgtcctgctggagatcggtgggtgtgggaggcaggggctcgtgcccgcacccctcctgtaagagggaaggtggtcttggcacccggcaggtgcagcagctggagaggagcattggcctcaaggacctggcgatggctgacttggagcagaaggtcttggagatggaggcatccacctacgatggggtcttcatctggaagatctcagacttcgccaggaagcgccaggaagctgtggctggccgcatacccgccatcttctccccaggtgtggttctaggacccccacctcactgcagctgctgtttacttggcacctgggtcccctcacccctgtgaccacataggatggctcccaagggtggggctgggatacgacccccagtgataccgggagcagctacacctccctgagtggcaagtggggtagctgaatatgggctggccggtgggtgccctcgggcaggggtcggggtaggggggttgggccggctgccctcctgccgtgccagccctcgaggtgtgcccctcgtcacccacagcctggtcctctggcacacagccctaaagcagacattacatcaacaggctctcctgcctgatcacagctcccaggaagacagggcgggtgggggtggctgtgggggtgggacatggctctcagggccttggagctgagctagtctgatccctcccaggttcattttccacacggagctcagggagggtgtttctcacactcccccaccttttttttttttaaaccccaactatggggtctcttgagagggtgctcgtggggtctcccctggagggcactgctggagagggggtggggtggtggctgcccagctgcaggctcctgccaggactgtgcttctgggcgctgcagtccagaggcggcccccctgctgtccctcgaggccctggctgaccttgtggcggccccagccatcatctcggccccaactcagtcactcccttcttgggctttgttgccatggctcagaacacgccctcgtgcagactttatttttaggctgagttggtgaacctgctgatagaatcttaggttctaggatcaaggccgagatgctgtaggcacctttcctgtttgaatttagcctggcactgctcgtgaaactcagcactgggggccatggcagtcctgtgctctggcgccctcgaggcggaaagagacccaagcgtcatctggaggggccgccacattgtgtggtgcctgctgccaaggccttcagcagggaccagaaacaaaactcacactctttcttctctgagttgagactggaaaaatgaaagattgttttaggggaaacttgagggaacagtctgggcagcctgcagggcatggccctgttcctccagggctgggaaagtcagcactgctttctggtggcgaccttccctctgcagctgctggctcagccgattgtatatgctgggagctctgcactaagcgttgggtgaagggtcagcattgtggaggccctgccacggaggtggtcttcttgggagctgcactcaggcaagaggacctgtttgtgtggaacatctgctttaagcaatgctggtgaacacagcttgtgtgcggcacgcgtgcaggctgaggacaggcagaatgggcctgggggcacggtggaggacgaggatggggaggatgggcctgggggcacggtggaggacgaggatggggaggatgggcctgggggcgtgtggaggacagggatggggaggatgggcctgggcacgtggtggaggacggggacggggaggatgggcctgggcatgtggtggaggactaggacggggggaggatgggcctgggggcatgtggaggacgaggatggggaggatgggtctgggggcacgtggtggaggacgaggatggggaggatgggcctgggggcacgaggtggagaggactaggacagggaggatgggcttgggggcacgcggtggaggacgaggatggggaggatgggcctgggggcacgcggtggaggacgaggacggaagggtggtcctggtgctgccacagtggggtccctgcgtgcagacctttgcacacagtgttctgtcatgtgacttggaaagcagcctctgccgggttctggctgtcactcacgtctgtgtcttgttgggtgggaaggaagtcgactcttcttgttttggggttcactctagccagtgcctcttctgaggcaggcttggggcccaacctaagccctgggccggtcagggctccctctgtggctctgccgaggtcccaaccactgcatttagtggatctcgccatgtggctctgctcatcttcttaagttttgggggttacatttgggattcttagaaatgctttttctggctgggcacagtggctcacacctgtaatcccagcactttgtgaggccaacacgtgtggatcgcctgagggcaggagtttgagaccatcctggccaacatggtaaaaccccatctctactaaaaatacaaaaattagccaggtgtggtgtcgagcgtctgtaatctcagctactcaggaggctgaggcaggagaatcgcttgatcccaggaggtggaggttgcagtgagctgagattgcgccactgcactcagcctgggcaacaagagtgagactccatctcaaaaaaaaaaaaaaaaaaaaaaaaactttttctaagtactacctttttttttgtaatgaaatttgttttcattggaaactaactgcatagtttgagggaaaaaaaacttttctttgcaccccagaacctgaatgtttctttgtaggtgtttttgtccctgggggagggcagccaggcaggaagagccctgccccgcccttgctgagtgtcagctcaccaggcacccctcctgcctccccagccttctacaccagcaggtacggctacaagatgtgtctgcgtatctacctgaacggcgacggcaccgggcgaggaacacacctgtccctcttctttgtggtgatgaagggcccgaatgacgccctgctgcggtggcccttcaaccagaaggtgaggccgtccctgcaggcttcgctagggccgcacctgggagtccctctgggcagtgcagcttctgtggtgcagggttgtgcgggacaaggtggcttgggctcgctggaccaggtgtctgcagcaggcacgtcaccctgtgatgctgtgtcacgcggtggagagctctggcagtttgttgtttccatgatttctgagcactggtccgtgacacaagcacctggcttcctgacctgtcagataaatataaatatgactaagaaaaagcacaaggccgagtgggcggggagtatgtatccctgtgatcccagcactttgggaggctgaggtgggaggattgcttgaacccaggagtttgagatcagcctgggcaacatagtgagaacccatgtctacaaaaaaaatagaaaaattagccgggcatggtggtgtgcacctgtattcccagctattcgggaggctaaggcaggagcattgcttgagcccagtaggttgaggctgcagtgagccgagatcacgctactgcactgcagcctgggcaacagagcaagagggggctctaaataaatgaacaaaaggacaaagcacaaaataatgcaagtttgggggtgcccagctttagcccaggactccagatgttgatgggcatctggaccagtagtttgaaaaccctgccctggagagagagtgcagaggaaggaacacagcttcggagccctcttcgtcggaggtgtcatttatttatttacttattgttaagacggagtcttgctctgtcgcccaggctggagtgcagtggcatgatctcggctcactgcaacctcccctcctgggttcaagcgattctcctgcctcagcctcctgagtagctgggactacaggcatgcaccaccacgcccagctaatttttgtatttttagtagagatggggtttctccatgttggccaggctggtcttgatctcctgaccttgtgatccgcccaccttggcctcccaaagtgctgggattgtaggcgtgagccactgtgcctggcctattttgaaaatcagaatctattattttgtggaattgaagatgcagagactagactggaatgagagaaggtcccttccttttgccacagttggcccagacttgctacttcccccaccccctatagctagtggagtaggcagagcagagttgggtgggggagggggtgtggagggcccacaggcccttgtctgtcctggggcatccaggttcacagtcctgacagaggcagactcaggttctccctgaaaagtgctcttcacgagtgggcagtgggtgcttcatgatctctttggcaagaaaatgtctttgccagatgtgttattttttgcattttcctaataataattcaagttcaggagtggtaagctttagtctaggactccagatgtcagtggacaggaaaggccagaatggacacagattccccagagagaagcggaatgccggtggctggggagggctggggagcccgggcgctgtggcaggagcaaggccgcccaccacgtggtctcggctgggcctcagcctctggcctgggtcctgggatggcctcctgctggtggccctgccagtgtccagaccctcgggagccagagagagacggcccacagacctgtgtcccctccctggggctctctcctccaggtgaccttaatgctgctcgaccagaataaccgggagcacgtgattgacgccttcaggcccgacgtgacttcatcctcttttcagaggccagtcaacgacatgaacatcgcaagcggctgccccctcttctgccccgtctccaagatggaggcaaagaattcctacgtgcgggacgatgccatcttcatcaaggccattgtggacctgacagggctctaactgccccctactggtgtctgggggttgggggcagccaggcacagccggctcacggaggggccaccacgctgggccagggtctcactgtacaagtgggcaggggccgcgcttgggcgcttgggagggtgtcggcctgcagccaagttcactgtcacgggggaaggagccaccagccagtcctcagatttcagagactgcggaggggcttggcagacggtcttagccaagggctgtggtggcattggccgagggtcttcgggtgcttcccagcacaagctgcccttgctgtcctgtgcagtgaagggagaggccctgggtgggggacactcagagtgggagcacatcccagcagtgcccatgtagcaggagcacagtggatggccttgtgtccctcgggcatgacaggcagaaacgagggctgctccaggagaagggcctcctgctggccagagcaaggaaggctgagcagcttggttctcccctctggcccctggagagaagggagcattcctagacccctgggtgcttgtctgcacagagctctggtctgtgccaccttggccaggctggctgtgggagagggtctggtcccacgccgcctctgctcagaccactgtgtgggaggtgcacagcacagcctgcgggtaaagtgtgagagcttgccatccagctcacgaagacagagttattaaaccattcaaatctctgtggtcagtggcatccatttgattccaggttgcctgcggcttccagccttggcagtggtgaccctctgcgggtcctcctggcctctcctctcacagacccctccccacggggtgcctagcccctgcctgcttctctagctagccaggctgtgttctctgttcctcacctgatgtaagctccctcttctcgagccttgttccctcttctggaatgttcttccctgtccatctcctctcctgggcctccccagggactcctgtgagagcagaatgaggatgagccagccctggtcctgcctttctgtgcacaggctccaccgagcatcctggctgcacccggggggtcctggccacaccgagggtcctggctgcaccgcccctgtggtgtgtttttgggacagtgcaggcaggcgtaggcacggcttcacactcggtgtcagggcagccgtgctgggacctactgggcatctgtatcggggtccaggataaagtgctgtcccctctcgacgtcttcacgcactgctgtagtttgagaagttgaccacagaaaagtacagaaaataactcaggcacggagctgaccgacgggcattgtctgtgttccgtgagtgtgtactgggcctaaagagcaagcattgcagagccctgctgttccctttcccggcctcacctcagctccccaggccacgtggcgggaattgaggcgttccggttctctttgggctttagaattttgcatctgtacgtttctgtattcacaaataagaatattgcattaaaaatgcagaaaccatccactgggtcagctgcaggtagctgggcttttgactcagcctggctacttttaatgcatcttgtgctgggcactctacatggtggattctgactgccgtgtgtgagttccctagagagcaccttccagtctcttcccgtgtcttcagggtttggtgactggagatagccagacctgctctcgtgggtctcctgtcaacctggaaggagggttggtggtttctaggcctcccctttttagcagttgccagcttgctttgcagaggggctgcatccggtccttccaccagcaccagggggagggttcccatcactcccatccctcccatccctgcccgtgcttcgtgttgttggaattgagatgctgcagcgtgctgtgtgtgaagtgaagtggcatcgctgtcacgtgcgtttctctgatgactcggcggagtcaggcgtctttaccacgcttacctctcccttggattctctcccgtgcgaattgcctgttgatgtctttttctcatttttcttctggttgttggtctgggtcttattctgctggttggtaggagttcctgatattcctgattacggattctcggttgtgtctttgaactgcgtttctgttgctcctgatgtgcagaagcttaagccttacacatgatcagctgatcttatcctttatgaatggtgctatttccgaccgactcagaacatcctgaccttccctgaggctggaaaccactgtcatgttttcgtctaatgattgtgaagttttgtctttaacatactgggcttctatatttggggatttgtttgtatgtgacaggttttgctgggtcactgcagtttgttaaaacagattgattgaggtcatctcttctcacttaaaacgaaatggaactgtgaaatgagaggaatggaccaaaaaaaaatcctcccccagggacaaagatggggaagaagccaacatcccacaaaggatttgaacccattttggaaggtgggaagtgggttggtgggtggctgctgagcagaagagggctgagggggaagctggccacaccgggaggccctggcatggagcagagtctaaaagtggatcaactgaaagacggggcagagcagctaccttggaggtcctttgccagagcagccggatggtcctcctggccctcacctccctgcagtggagatggaggtctggagaacctggggaagagctgaggaccgcaccccccacgcagtgagagcagcatcgggctccaggctgcagaaggggcagaggtctgcactcggaacaattccctaggcactggctgccacaccaagaggctcccacgaagcagaccaaggcccttgagggacaaaatgctctggagcagccccgtgggcaggcctggcccagccgcctcatggccttctggggaagtgacaggctctgtgcaaacccacagaggtaccatcgtcactacctaattttgggacatttcatcaccctgcagagaaaccttcccttagcagtcactgttccctcccgctcagcccctgacagccagccataaacctaccttctgtctctatagatttgcctactcaggacattcatgtgaatgtggcctttgcttttactcagcaagatattttcatggttcctgtgtgttgcagcatgcattggagtttcattccttctaatggctgaataatctcttgtatggatgcaccacaccttatttatccattcatccgttgctggacatttgggtggtttctactttttggctactctgaaaatgctgctgtgaacatttgtgaacaagtttttatggggacgtgtatttgttttcatttctcttgaatatttataccgaggagtagagctgctgggccgcttgttcagctcttggaggaattgccgaacttttgtgtcaccttacatctccctcaggaagtgttttttttttttttttttttttttgagacggaatctcgttctgtcttcctggctggaatacaatggcacaatctcggctcactgcagcctccgcctcccaggttcaagcaattctcctgcctcagcttcctgagtagctgggattacagctgtgagccaccacgcctggctaatttttgtatttttagtagagacagggctttaccatgttggccaggctggtctcgaactgctgacctcaggtgatctgcccacctcagcctcccaaagtgctgggattgcaggtgttgcacctggcccctaataacatttttaaatttcacgtagtaaaattgatttgttcttttgttttgttcatggaacattcaattccatggatgttcacacctgtgcagatgtgggtaagcaccatacctgggagacaggcgagccctgccatctcagaagactgttccactttccccatagtcaccaccccgacccgtggcagccacacacctgtcctccaccactgtagttatgtctttccaagaaggtcccataatggagtcctacaatgcgtggctgggagcagcgagatctgcagaacgccgctgagactgatcaggatgcgtgcatcagcatttgttttctctcttttttttttgttttttttggagtagtgctctatggatggatcagtttgtctcgtcacctgttgaagggtgtttgggttgtttctaatgttttgcaggtctgaatagagctgctataaacatttgtgtacaggttgttgagcaagtttttatttcattaaggtagttagcagtggggctgctggatcacacagtaagtgtatttttaaattcaaaagaaactgccaagcactttccagaatagctgtagcctgttgtggaatgccagcatgagccacagttcccgctgctccacatccttgtgggcactttgtgttgtcagcattcttttttaatttctttttaagatatagggtcttgctctgtcacccaggctggagcgcaatggcgcagtcctacctcactgcagcctcaaacccctgagctccagtgatcctcccacctaggcctcccaagtagctgcgactacaggttcacaccatcgtgctcagcttattttctttaatttttgtagagacagaatatcactatgttgcccagggtggtctcagactcctggtctcacactgtcctgtcttggactcccaaagtgctgggattataggcatgtgtcactgtacctggccaaactttattcttgtttctctttttctttttttcctttttcctccctccctccttccttttttcttttcgttttcttttctcttttttttcgtttgccctgccctgccctttttttttttttttttttttttttttttttaaagacagtcacagtctcgttctgttgcctaggctggagtgcagtggtacaaatcctacctcactgcaccctcgagacctcaggctcaagcaggtcttcccacctcaagcatcccaagtagctgggaccacaggcacaccaccacactcggttaattttttaaatttttagtagagatagagttttttttttttttttttttttttttttttttttgagacagactctcgctctgtcaccagactggagtacagtgacccatcttggctcactgcaacctctgactccttggttcaagcgattctcctgccccagccttccaagtatttgggattacaggtgcatgccaccacacccaggtaatttttttgtatttttagtagagtcggggtttcaccatgttggccagtatggtctcgatcttctgacctcagatctgcctacctcgacctcccagagtgctgggattacaggcatgagccactgcacccagccggagacagggtctctctgttgtccaggctggcctgaaactcctgggctcaagtgatccgcctgcctcagcttcccaaagtgatgggattacaggcattagccaccacgcccagccagttgttgtttttcagaattgttttccctatttttgtttgtttgacagtacatatatatttcacagtcaactacaaaaaaattctgggattttgattggaattgcgttaagtctacacatcagtttggggagaattgacatctgtgttgagtcagacaatccatgaacatagtctatctctattctttatcagcgttttgtagtatttcatatgtatgttgaactggctggaatgcagtggcatgatcgcagctcactgtggctttgacctcctgggctcaatggatcttcccacctcagcctcctaagtagctgggactacaagtgtgtgccaccacgcccggctaatttttgtattttttgtagagatagggttttgccatgttgcctgggctggtgtcctggactcaagtgattcacccacctctgccttccaaagtgctgggattatgggcataaaagtcaccacacccagccagtatacatatcttgtacatgttttagtaggtttatgcttcagtgtttcttttacttatttattgcttcctatcccacagcttactttgtttcttgagctgttgtaagaggttgttttttgaattttggtttctgactgtatatttccagtgtttaaaaacaaaactgatttttatgtgttgttcttatacctcataaccttgatgaattcacttactggttgtaggagattaggattttgtttgtttttatagatttggggggattttatgtgtgaacaatatgtcatccattaataaggacagttttatttctttttattcaatctctatgccttttatttcttttgcttgccttgttccattggctgacttcccgtttataaggttgaatagtaatggtaagagtctatagcctttcctcattcccactcttggggaaagctttcttgctttcacaattatgtatcatgttacccacggggatttttggtgatgctgttttatcaggttgagcaagttcccttctacttctagtttgcttctagggttttttttttttttttttatcatgactagacattttatcaagatgtttttcaatggctgggtttggtggctcatgcctataatcccagcactttgggaggccgaggcaggcggatcaccttaggtcaggagtttgagaccagcttggccaacatggtgaaaacccatctctattaaaaacaaaaattagctgggcatggtggtgcactcctgtaatcccagctacttgggaggctgaggcaggagaattgcttgaactgggagacggaggtgacagtgagctgagatcgtgccattgcactctaacctgggcaacaaggaaactgtcttccaaaaaaaaaaaaaaaaagatgctttttctataccaagtgatatgttcatgtggtttttctcctgtacagttaatatggtgacttatgttgatcttcaaatattggaccaaccttgcattcctggaataaaccctacctggttatggtgcactatcacttttatatattgctggatttgatttaaattttttttgaggattttgcatctctgttcatgaaggacatttgtctataattgtcttttgtattgtctttgtctggtttttggtatcagggtgctgtgggcagaaaatcgagaccaggagtgggtttgttgtcatcacaaatgctcgaaaaatgtggaagcagctttggaactgggtagtaggcagaggccagaagagtttggaggagcgagaagaagcttagatgccattcatggagtgtaaagggtgattttgttgagggctcagaagagaactgtagggaaagtctgaagcttctttgagaatacttaaagtggtcatggtcagaatgttggtagaaatctggacagtgaaggccattctggtaagatctcagacagaaatgaagaacaaggtgtcagaaactggaggaatgaccatcctagttataaagtggcagagaacgtggctgaacggtgtccatgcccagtccttcctttgtggaaggaactgggatatctggctgaagaaatactcagggtgtggcatgttttcttctaactgcagagagtaagatgtgagaagagaaatgaattaaagatggaatttataattaacaaggaaagaatagggatcgtaaggattttcagcctgcccatttagggagtaaataagatgtctttaggagaacagaccaagtgtgtggccaagcaacttagtatggacagaacgaagccagaggctgctcatcaggacagtgggaaaatggccccagaggcatttcagattcctggtgctgcccctcccaccacaggcccagagtgccaaggcctttgggaaggaaatatgtcaaaagagaggtgtagggtgtggaccttagagcctgctggccagggccaccccaagtcttggctgtctgcattccagtgcagaccccctaagccactccagcctgtctcatgtggacccagggaaggtacaagtcataagccttggtggtgtcgattctgcagccttgcaggagctgtggggacatggcttcatccactgggtgtcacacaggatgtcacaagtctccaggccagagccatggcagagagcccacactagggcaatatgtggtagagccttggggataaggccacccctgagaccccagaactggagagcctctagtgttcattgccagcctgggagagctgaaggcacgagactccaacctaagagagttgtgtgaggtctgagcccagcaaagctctaggggtgaggttcccaagagcctgaggacccagccgcaccccacggcgtgcagaaggcaggatttggagtcaaagatgatgattctcaagccttaggatttagtagtattctccctgttggactttggacatgcttttgaggcctgttattcctttcctctttataatttatccctttggaatggaaatgtctgttctatgcctgccctaccattgtattttggaagcacgtaacttgtttaatttcacaggctcatagtggagggaaagttgcctcaggatgaatcatgccttgagtctcacccatgtttgatttagacgagactctgggctttggacttttgaatggggccattgggatggaatgagtatattttgtatgtgaaaagaacatgaattggtgtaggggcagggatggaatgctacggtttgaatgtttttatctcccaaactcatgttaatatttaattgtcattgtaacagtgttaagaggtgggatccttaaagggtgattaggtcagagggaagataggctggaattggtgctggtataataagatgagcttggccctctcttgcccttccaccttccacagtgacacaacaagaaggattgcaccagacgctggcaccttactctgggacttcccagcccccagaactgtgagccaataaatttctattccttataaattatctggtctcaggtattcggttatagcagcaaaaacagactaagagaagacaatgtttgtgccccccccacccaatttcctgtgttgaaacataatctccaatgtgatggtacttggaggcaggactttttagatcatgagggtgcaacacttgtggatgggattcgtgcccttaaaaagaggctgcagcccagtatggtggctcacgccgtaatcccagcacttacggaagccgaggcaggcggatcacttcagcctaggagttcaaaaccagcctggacaacatggcaaaaccccatctctacaaaaaatataaaaattagctgggtgtggtggtgcatgcctgtggtcccagctacttgagaggctgaggtgggaggatcacttgagcctgaaggtcgaagctgcagtaagtcatgactgtactggtgactcaaggctgggcaacagagtgagaacctgtctttttttttttttttttttttgagatggagtcttgctctgtcgcccaggctggagtgcagtggcgcgatctcggctcactgcaagctccgcctcctgggttcacgccattctgcctcagcctcccgagtagctggaacttggtctcgatcctcctgaccttgtgatctgcccacctcggcctcccaaagtgctgggattaacaagcgtgagccaccgcacacggcctttttttttttgtatttttagtagagacgggattttaccatgttggccaggctggtcttgaactcctgacctcaggtgatctgcccgccttggcctcccaaaatgttagggttacaggcgtaagccaccgtgcccagcctttttccttctctttttatagatacctaatcttggtatgaatggtcctttttacatcttctatttttttgctgagactttcatatttttacatccattgcaaaatgtttgtgattgcttgctctggcatatttatagtagctactttaaagcccttgtcagataatttcagcatctgtgtctgtgtcacttcctcccaagcctggcgtttggttggtgaggacttgcaggttccccctgcatatcgggaagtgtgagtttttgttcagggtgcatctacctggggccatggcataatgttcatctgcaatgattgtaaggtgttcagattttgtaaatccaaataaaactgttttaaagaacacaatcctcagccgggcatggtggctcatgcctggaatcccagcactttgggaggccgaggcgggcggatcacgaggtcaggagatcgagaccatcctggccaacacagtgaaaccccgtctccactaaaataatacaaaaaaattagccgggcatggtggcgggcgcctgtagtcccagctactcgggaggctggggcaggagaatggcatgaacctggtaggcagagcctgcagtgagctgagatcgcgccactgcactccagcctgggcgacagagcaagactctgtctcaaaaaaaaaaaaaaaaaaaaaaaatctctctctcctacattgctgtctgcaaaacaatggaggttatggatgttagattgcatctcgatgttaaacctttgctaatgtacttatgggaatcacaaagattctgtttgtaaatacagaagtgaattgtagacataaaatggttgtgccatgtggataatggcaggcactaggtgacatttatgtagtaactaatgacaaaaattcatggctagtggcatataaaatactctttgcagtaaaatatttccttgattaatgttatagaagggggacataacaaggaactcacagttggtgtggcagctagcctcaaagactgtctttcatttggtttcagcacctcctgtttggggttattagcatcttagaagagcacggtggccttgtctgatgaagccgaattgtgctggtctgttccgagctggtttaagtgttctgatgggcagctgtggatgttggggttcagagcttagtcatcgttgcctgaaatggcactagactctacaatttctgccttggagaacactcagttcttacttgtgatttctggtagaacaagctttatttttctagcctagtaatgatcttgaagcagaggaatcccagtgccttttaagaattgtgttggccggtgcggtggctcacgcctgtaatcccagcacttctggaggccgaggctggaagattacttgagcccaggagtttgagaccagcctgggcaacatagacctcatttctacaaaaattaaaaaataataaaaatttgttgtgtggttttttaaaaaagctactaattgtttttgggaaatagaatttatgggtctttacctttgcacattgaatcttttattttttatttttattttttagaaacagggtctctgtcacccaggctggagtgcagcggcccggtgattgctccctgcagccgtggcctcccagggaactagggtttcaggtgtgagccgcggtgcccagctgcaagttgaaatgttgtggttcttcgtgtgtcaagcaattttgggctatattctagacattttgaatatgactttatgagatctgggtcatgtttgaatcctgtgggaaatgttgaagtctggttagcaggcacttggtcctgtgaaggttgggcccacattgttcctgcccgcatgagtatctttggttagcaggcacttggtcctgggatggtcaggcccacactgctcccacctgcgtgggtgtctttggttagcaggcacttggtcctgtgagggttgggcccacactgctcccacctgcgtggactcctgtcttcagagctgctggtctttggtctgggacccaaggctggtctgcagttccccacgtccatggtgtgatcattagacccatgtgtctgcatgtgagctgagcccggcatccacagccaccccatgtgggtgcttcccaagctccccacgctgggtttggttgctgggctcactcactgtcagttcagacagtgacatgcccttgactgggccgcgttggagtctatgtggcaggaggacaggggaggaaagctaatgggggtggtcccaccctcaatacagccgcactgagctgtgagggactttctggccccaagtttggctctgatgggttcctgtagccaccactcccactgccatcagggtcacaaaagaatggagaagagggtaaacccagggcattgcctcactgaccctgcgcatcggcgtgggttcctttccctggcccttagggctgctctgggctttctgcctggccccagcactcacgtccggtgttgcggctgcgtggagttcaggtcatggatgttaggtcaagcaccagttctgcgaaacttgggatcttgctgctgctccctgacccagctctctggcagctgctccaggccccgtgcacaagtttcatagctgcagtttcacagagttcactctgtcgcccaggctggagtgcagtggcgcaatctcagctcattcccgggttcaatgaattctcctgcctcagtcccctgagtagctgggattagaggtgtgtgccaccacgctcggctaattttttttttttttttttttaagtacaaaaggggtttcaccgtgttggccaggctggtcttgatctcctgacctcaagtgatccgcctcggcctcccaaagtgctaggattacaggcatgaaccaccacgcccggcctgacctcagcatatgttttctgaggacttctgttcttttgctaattcagtcactttctctttaaacactgggtctccacccctgccccgtagatggggtgggggcatgcatgccgctccattcccctcccagggctgtgtttctttcgtctcctctgtgccatcttctgctgcctggtcctctcgtcgagtctgtctggtccagcactttccacatatcaagatttttttttttttcttttccttttttgagacagagtcttgttctgtcgcccaggctggagtgcagtggtgcaatctcggctcactgcaagctccgcctcccaggttcacgccattctcctacctcagtctctcgagtagctgagactacaggcgtccgccaccgcgcccggctaattttttgtatttttagtagagacagggtttcaccttgttagccaggatggcctcgatctgacctcgtgatctgcccacctcggcctcccaaagtactgggattacaggcgtgagccaccgcgcccggcctacgtatcaagcttttgatgcagtcactcgccctgtcattttccagtgtctaattggctccctttttattttgaaatgtccaagtcctcttgatttctgtccccacttttgttttatggtgcataggaatgtttttgttagtctccttgaatgtgaacgtaggtaagtccttttcaggaaattgctcaattctttggagcctgcccgtggtgtgcttgcatttacagaatctgtcagctcccttctgagggtgttagtctcagggcagcttatcttgtctgggggtctttggtgtgtcttccttcctttccttgttctcgcccacgttgggggttttattatgaactgcagtggtccccagggcttcccagctggagaccaggagttggcagggcagaggctccgtccctctgggtggcgcagcctctctcggtggtgctgtccctgatcccgtcggtgctcgagctcagccccagggtctctacctgcggcccacgtggctcaggggaaccatcacctcgacactcactcgtctcctctgcgtcctttctctgtacggggttgcttgctgccatgtttggagccacaagctctgtgtgcttcctataatgggcagctgacccgagtgccaggctctactcctgccatcttccttgtcaccaccatcgccccgggcccccgagctcccggtgcagttccaacaaagcctgtggggtccagctggagctccacctctgctcccacttctgggcccctggtcccatcctcgccggcctgaactgactgtggagaccgccctggcactgggagcgacacggcctgccgactctggacccagcagccgagggactccctcaaggacgggactgtggggggccgccctggcactgggagtgacgcagcctgccaactctggacccagcagccgaggaactcccttaaggatgggactgactgtgggggctgccctggcactgggagcgacgcagcctgccgactctggacccagcagctgaggaactccctcaaggacgggactgactgggggggctgccctggcactgggagtgacgtggcctactgaccctggacccagacggcaggccctgcatgctgccagccccggcacatgtgccaggcatctccctggaggtcatggaggacagggcagtgtgacaaagtctggcaccagcacatgacctcagacgcacatgtcacctgtcagcagtgactgcaacattcactccagtaggaccactgtgccagcaataacagcgtcacccgtcagcagtgaccatgaggtccactccactgtgccagcagtgcccacagtctccctccctgcagacagagactggacaacaatgtgctgttgccaactgtttattcagggccctgaacgggtggtgcgtggacatgcaacacactcgggcccacagcagcgtgaccggccgctcccaagccccgggcgcacaaccacagccaggagcagcccctgccaccactgggccaccgtccagggccccacaggaccagccgaaggtgccccgggccgaggccagctgggtcaggtgtacccctagcctggggttgagtgaggagcggcacccccagtatcctgtgtaccccaagttgcccaggaggccgagggggccttgggctccatctgcactggccaccccgtgccaagcatcacagctgcgtgagcaggtttgtgtgtgagcgtgtggcggggcctggttgtccccttcctaaggcgtaactgctataagcatctccacctctcccgctcgggaaaaagccacagagcctggcgatgtcctcaaggggtcccggtggctccagtgcacccagcacacctcagcgcctctggctggcaagccaggagaagaaggtgcgaggccgtgggcgaggtgcctggaggacgcgcatggtgcgtggggagcgccaggctttgatggtggcgtcgtcgctggccgtgagcagcagctcctgctcctggggactgaagaccactgagttgaccacatcctcgtgccgcagcctggccagacagatgttgtagtggcggtcccagatgtagccgtgccggtcctccgccccgctgcagaacagcgcctgggtgagccggccgcccgcccgctgctgcccacacccgccctgcaccacgccgcgccctgcacctggccacgaagtccctgctgacgtccaggaagatgaagaagcactcgtcgttgggcgtgtaggcgcggtgcgcacgcagagcccgcctcacctcccgcatggtcttgaggtcgaacaccagcaggtcaatctcctccgcgattggtggcggctgcatggggtcggccaccaccgcaccgttgggccaggcgcggctgttcacgtacaggtacctgggcgaggggcactgtgctaggtgtgggccgcctgcgggcaccccgcctgggacactggcaagaggcccacctgttgtcgggcgacaggcccatgccgatgatgtgtccgtgtatgtctatgacgtggtccagcgcgtcgaagaaggcatcggagccccggccctcacccagcacgggccctgccgtggtcatctggtgtggcaggatctgcttgatgcctgcagggagggctacggtgagggtccctgtccaatgccccaaggacatcactccagggcagcttcctacctcagtggtgtctctggggctgtgagcaccacagaggtccgtgggcactgcctgctccgggggccccagacctgaatcaggcccgtcggttgcttgctggccagcggccctgcctgcgtttgttttcactgctcatcccacaggccccaggtctgggcttgtgaccccaggggcgagtgaacgatcccagctttgcctgtggacttgcttgctgtctgcccctcaggacccctgcccggcctcccccaagctcctaggaccgaggcgggcagcatggcggcaggggtgtaccgatctggtgtggggagtaggtgaggcagccagtggtgaagatgaggtacttgctcttggcgcctgtggcactgcgctcgggtggcttggtgtggccctgggccagcagctcggccaccttggtctctagcatgcgctccgacagctgtggctgcgcccgcccctccagcacgcggtccagaaagtgccgcaagccctccttggcgtgggcgggggccgggccagccaccacctcctcgttgtcgctgcccaggtcaaagatgcggcagggggacgtggccgggtcaccggcttccagcagcaggtcagggctgtcgaagcggctgcagtcggccaccatcaccgtgcggacggtgctggcattgaggttctggatcttgaacagccgcttcaccacgttgacgttctctgactccacatcctgggggcgggggcacgtgccaggtgggcgccgggcgccaggccccaggagggcagccccgcccctagccccgcacgcacctggaaggcattgttgagccacagcaccgagcaggaggtgatatctccgatgcggtgcaggttccccgagatgaggctggtctcggtgagccaacagccaaacacgtcatagggcttgttccgcacgcgggacagcagcgcgaaggagtctgtggggaggccggggctggacaggctgtcggcgtggggcgggggcagggtcaacccgccgcccgtgctcacctaggctgatgacagcaatctcgccggatgaggagttgtgcggccccaggaacacccccgaggccagcagtagcgagtcgtccttgttgaactgggagaactgggtgtagctccagttgtagggccgcatgtccgcgctgtgcagcagcgagatggtcaggtcgttgctccagatctgttcggcaggggcggctgtagtgatcgcctggccaggtcgcggggcgggggcctgctactacacagccatgaggccccagctctgccagccctactcagaggccaccagggagcagggaccccttccagccactgtcatccactcggggggcattggtatagagcggaggagcctgcccctgaagcaggcggctgtgtgtgggaccctctcctcagcactcagggccaccctgcaccgctcctgatcctctgtggtccctccgctggatgcagggaggctgctgtcacctctggcctgacccacccccccccccaccaccacctggttggaacgcctgggtcctgggacctccgtgctgcggcagagctgggtggggtgtgcaggacacctggccgtcctcaccttcacagtgcagtccttggagcaggacgcgaactggtacccggaatgggagaagctgaggtgcaggacctggtctgtgtgttcccgcagcgtctgcacctccacgcagggcaccgtgtcatacagccgctggaactcctcgtaccaggacatggccgctgcgggtgggcagttgtcagtcctgggcccgggccttcctcgcagtcacggccatgagccgagtgtggccccagcagtcctggcaggccccgtggtgcccctggaacccactagtcatggcataggcctcggctgggggattcaaccctgtagctcacagagacccctgtaccccccaccccccaagtgacccaatgaaccctctggcctccaagctctgaggggcgcctgcgctgtgtcctgacaggcctctatcagggtgtgggggggtgagcatggacacgcggggccgcggggcgggcccccagccaggctgacccccaagcgcaggggcccggggccctggctgcagaacgtgggtaggggccccacacgccactgacctgggtgtcggggcacgtcgcgggccacctggtagtagcggtagaactgctccctccacaggaactcgtcccgcgacacggcctgccattggcggcacaccagcccggcggccagcacgtcggccgggcccaggctcaggaagatctggtagaccaggctgtcggggagcaggggcgtgccgccctcgtccatcgtgacattctgcccaggcggccctgaaacccaccaacggctgccctcagcccaggcccgggaagggaggccgagagcgggcgtcctgttcctccagccccaaccgtcccgccgggagttccacggggctgcgtgtctgcaggggacgcccgggtaccgccgcccaaccaaggacccggcagctccgggcgggccgggccggcccctctccgccgcgtcatcccccggcctcctgcggccggcagcgggcgcccctcagcccgccagggcccggaccgccgcacgcgaggcacggggacaccaggcgccgtccggggacgggcttccgccgagaggaagctcggggcggccaggcagtggcctccgccctgcggccctggagcagctctgcccggcgggctcggggcggacggcggggacgagcgcacgggcggcctcggggctcctgcactcgcccaaggcgggcggggacgacaaggcgggacccccgagggccgcaggcgcactcaccacggccgcctccgcccgctgcgccgcccccgccctgcgcgacccggacccgcttccgctgccgcagccgctcggaccgccgcccccgcccaacggggagcccgccaggcccgacgccacgagccccgaggcatcgatggccgaggaaggcagagcgcgcgggtagcccgcatccgcccctcgtgcgcctgcgccttgggctccggcggcctggccggcttttctttgtgcgcctgcgcgcactcgggcgcattgggaacagcgccccttgtggccagcgggcggcggtcgtgggcggggttgcaggcgaggctcaacgaacgctggttcgggacccgcctccggcgctccctgttgccgggccctgagcaagtggcttcatgaaccccgtgacgttggccatggagataagaccactgggtgatggtttaaggaagataacgtgtaaagggctaaggactgtcggtggaaatcaggggtgcaggagaaatggataaacagccagaggtcaactcggactttgtacataggacatggtgccagggccctgccaggaagtgcagatcgaagctaggctcacgaggaggctggaggtggggggtggggaggcaacggatggacatggacttcctgggctgggctctgtgacagcagagtagactctgtcctgggacttggtggtgctacccttggcctcccacagtcctgccaccctgctgccgccaccatgctgccccctgggactgcgaccctcttgactctgctcctggcagctggctcgctgggccagaagcctcagaggccacgccggcccgcatcccccatcagcaccatccagcccaaggccaattttgatgctcagcaggtagaagttggggggggtagagggaggcaggtagaagttgtgggaggggtagagggagacaggtagaagttgttgcgggggagagggaagcaggtgaagttgtggggggtgtagagggaagcaggtgaggggccctcccacagtgccctcgagttctcccatggtctgcccccagtttgcagggacctggctccttgtggctgtgggctccgcttgccgtttcctgcaggagcagggccaccgggccgaggccaccacactgcatgtggctccccagggcacagccatggctgtcagtaccttccgaaagctgtgagtcccagagcagccctgcaccctaaccccaaccctcctctcagcccccggacttcagccctgctctggcccctgaccccaccccggctgtggcctggactaggattcctggttggggtctcccagcctgtggtgcctcctccccgcccccccagggatgggatctgctggcaggtgcgccagctctatggagacacaggggtcctcggccgcttcctgcttcaaggtgaggcaggggctgcagggcatgtgggtgggggatgacgcagccactgtggctctctgacatggctactgtggctctgccccagcccgagacgcccgaggggctgtgcacgtggttgtcgctgagaccgactaccagagtttcgctgtcctgtacctggagcgggcggggcagctgtcagtgaagctctacggtatgtgggggccagcctctgtgaccaggcaggcgctcaagctctgcacactcactgggccaccccgaggggctgggtgagcccatggggacacacttcctttctcccatcctgatcctcctgctaagcaggggcccagggagtagtgacagacaggcctggtgtgggagcagggagagggccccgagggggcaggggacacacagaccccgtttccagagccctccacgccgcctggtgccaggaccccaggaaccctgtctgccctgcagcccgctcgctccctgtgagcgactcggtcctgagtgggtttgagcagcgggtccaggaggcccacctgactgaggaccagatcttctacttccccaagtacggtgagtgtccccagcaggtccccagctcagccacccccactctctgggctgatgtccagcctgacccctgccttgggcccccaggcttctgcgaggctgcagaccagttccacgtcctggacggtgagtgcacagcggggcaagcatggcggcgtggtgaggggggccactgccaccggctgagtctcgtctctgctgcagaagtgaggaggtgaggccggcacacagctccagtgctgagaagtcagtgccccgagagacgaccccaccagtggggtgcccgctgcctgtcctccgtgaaaccagcctcagatcagggccctgccacccagggcaggggatcttctgccggctgccccagaggacagtgggtggagtggtacctacttattaaatgtctcagacccctctctgactcttctgtccactctggaccggcgccagtaccaccaaggccctctctgcccccaccccgcctctttaaaagcccggcgctccctgttggctggagtccacgcagtgggcactgggccgatttcagcggctcttgggatttgggaggggagatcctctctggcatatgcccatcttgtgccctgctgggacctgggggcgtccagcctcactccaaggctgctcttgcctgggccattgtcctgcagcccccgggctgctcttccgcccccgtgggaggccagctgtctcccgtcactgcccattttggcctcttccgagccgagctggcaccagctggcccgtgttggtggcagcagttggtgctgtccacccacagccactgcactctctgcacacctcatccactcccacgtcccccgtgaaaccaggaagcagaagagaatgtgggggtgggccagctctgccctcggggcagcccctgggctagggccggagaatcaggaacccggcatggcttgaccatgctgggcctggacctggccgctaagctgctcctctcaggccctgcctgcggccactggcatttgtttgataagcatttctgaaggcccactgtgtgctgggccctgggaccaccaggtgggctggtccctccccctaggaacttacaagtccagggatcagccaccaatcggccacagtgggcagggatgggaggagaaggcaccttggagttggtcccaaagcacacggcctgggtgggggcagggaggagccagcagctgcttcaggggggtccccatcccacgggcggggctccccctgccgtgcccacctgttcactaagctgctagaccccaggagggcaggcaagtcaggtggtgggaaggggaggcaggggccctgactgccgggacctgggaaggagaagggcccaggaggtcgtacccttgcatcgccttcccccactccagctccatgtcccagagacccatgagatagcagggcgcagcagaagggctcagggttcagagctggcaacgccgggaagactctaggcctgagccccaggaaagcctcctccatgcctggccccacatcccccaaacagaaagtgagggtctcatctgggggcaggaggagtcgggtagctggccacggtcacaagcttcagggagggctgaatgtccgaggggtggcgccagagacccacccgatgaccttgggtgctgtggttggtggcagagtggcccagcctgaccctccacgcctctgactgcagggctgggtgggttcccgcactgagtgaagtgcgtggccacttggctgtgtgctctgggaccagaggatgtgcagcgcaaggattacaaggcatttcattttcacagaagcattgaatgagctctagttaaatttcaaacactacataaaatcacgatagctctgtgtgaatcattgttctttaaaatagtttgcataatttggctgggcgtggtggcttacgcctataatcccagcactttgggaggctgaggcgggtggatcacttgaggccaggagttcaagaccagcctgtccaacatggtgaaaccttgtctctactaaaaatacaaaaattagctggtcatggtggcaggcgcctgtaatcccagctactccagaggctgaggcaggagaattgcttgaacccaggaggcagaggttgtggtgacccgggatcatgccactgcctccagtctgggcgacagtgagactctgtctcaaaaaaaaaaaaaaaaaaaaaatctatggaaatggctgggcgctgtggctcacgcctgtaattctagcactttgggaggctgaggcgggcagatcacttgaggtcaggagtttgaaaccagcctggccaacatggtgaaaccccgtctctactaaaaatacaaaaaaaattagccaggcgtggtggtgggcgcctgtaatcctagctacccaggaggctcaggcaggagaatcgcttgaatccaggggacagaggttgccgtgagccgagatcgcgccattgcactccagcccgggtgacagagcgagactctgtctcaatttatttaaaaaacaacaacaaacaacaacaaaactatgcaaactggctgggcacagtggctcacacctttaatctcagcactttgagaggctgaggcaggaggatcgcttgaggccaggagttcaagatctgactgggtgggcaacatagtgagacctcatctctatttaaaaaaaaagttttttcatctatagaaactaacatttaattgttagcagtcttgcccaagacctgcggggtcaggagtccaggactgtcctgggtgcccccgccttgcctggacgtgagagtgctgtgtggggccccgggagcccctggtcccacaggcagggccgacaggcaggtgccgtgcccgtcctccctgcccacgcaggtgctcagagggacaggtgggccaggactcctccatgtggggacgaggcaccctcctccccagccacgccccaaccacccctggccccccaccccacccccaaggggcctcccagcgcccaggaccgtgtctgggaaaaggtctttgcccggagagtgggaagagagaggggagggtgagcagaggacaggccgggagttttccgggaacggaggaagagcagtggagggtaagtctgtccttgttgctgtggggaggccgagatgaaggcgatgggttgggggtgggggtgccggggagcgaagcagagggaagagaggacctgatgggaggggtcaatgggagaggccccagggaccggtccccacggtgggctgggggtccagggtgctgagtggaagcggcggtttccctcccgcctctcaaggacgccttgcagaaggcgcggctgctcctccccgtggcacgcaagctcccgggcaccgcctcccgcctcggcctcccaaagcgctgggctcactggcgtgtgctgccgcgcccggcccgcccaccccaggcggtatggaaggccgaggtcagagccaggactcccccgggagccccgcaggtgcctcaaggcccgcgtcctgcacggcccgttccagcgccgccggcccagccaggcaaaggcacctgcagggccctgattgggcggcggaggtcacgtgcccaccctccaccaatcacgttagacgggaggagcagcacctgcgtctgccccgcggtggggggaggaggcgcgccgaacccattgtcgtgtccgggaggctcctgcaggggacgtggggggcacagaggttaacggcagcagccagtggctacctggaggcacacacagaccccccagggcggcaggagtgggtctgggggagggagcatggggcctgaggcgctgcttggagccgagggaccctcctctgtgtcgaggactcggcccacccgacctctgctgctcagtctctgtgggtctcgggctggccagggaaggcccggttttcctcccgcagggccctgcatgggcggggtccgtagcggggactgtcctgtacatgggctgtgtgctgtgatcccaaatctccccagtgccctgcgataagacgggctccgggaggggtgcctgctgcgctgagagcgggaccctggggctgcggacaggcgctcctaggctggctggggccagggggatggtggagagtcgaaggcgccttggggagttcaggggaatgaacagattatttccaacttttccttccctgggccagcctcctgaaacgctagcgttgtgctggtgagacaaggcacagcaagctgcccttctacgtgggcagtgaggcctgggacagagcccagccctggagccctgaagtcctgggggctgggctcttcgagtggccaggctggggctgccacccagggcaggctgccgaggcccagggcacctcctgggatgagcctaagtcccttgtaagcagggctggatgaggggaggaggtggccaggacagggaatctggggtgggagggggcagccaggacagggacctggggggcctggacagaggctcacaggccaggcacacggtgagtgggaggcacctggctcacccttggtgacccctaacatggagtccagcacccagaggcttcagctacctgtgaggatgggaggagaggtcaggaaggggactccactccctagccccatcgtccaaggggtgccagggcagctagaagccccaagcctgccattgccctccctgccagccctctgtttacattttatttttatatttttagagatgagatctcagtcttgcccaggctggagtccagtggcacaatcatagcttactgcaggctcaaactcctgggctaaagcaatcctcccacctcagcctctcaagtagctgggaccacaggtgtgcaccaccacccccagctaacttttaaatttttttgtagagatggagtctcgctatgttgtccagggtgatgtcaaactcctgggcttgagagatcctcccaccttggccccccaaagtgctgggattataggcatgagcctctgtgcctggcctactaatcctttcttttaggcaggaccagcatggggtgcccactcccattagtggggcttcccagccctgcccctccctctgggcagagactgcgtttaaaatgccccagctgtcctcaccaggttgcctgggtgctctgcaggccccagcctccctcctcgcctgctcgggccacctccaccccggcctcatggccacagggcccctccctggtcctgttcttgctccagggccacggcccacgctgcggttcaggcatgtgtggagccaggcagggtgggggtaggggggcggctggcaggcccaggccctgcagggggaatgcccgggtttggccacagctgggccctgtcccttatggctgcggcaggtcacgctgtctgcctgggacgcaacattctgtgacagggaggaaggctggggcaggctgcgtggggcctctgaacccccagcatggggcacttggaagggggctgaagggggcagggcctcagaaatgagaagaagaggtggaaggtggacctgggggcccctcctaccccacctggctggaacccaagagaccgcaggtgggtgggtgggacctgaggagagcccacaccaagcctgccctgggcaccacctctcctgccagtcctgaggagggaggcagaggggcacacccccttgggaggggcacctgctgggtatgtgcatgaagaggtgggtctctgggtcacctgcccatggccacttccttctctctgtccctgtgggcccagcagctgccaggatgaggctgctgtgtggcctgtggctgtggctctccttgctgaaagtcctgcaggcccagaccccaacccccctgccactcccgcccccgatgcagagcttccaaggaaaccaggtacaggggttttgacggaaggagaagcagccggctgggtctgagtgcagggagaggctggtggctgagcaggcctggggatgctgcccagagagccaggaccagccgtgcttccaggagcccccaggcgggcccctgacctccagcagaggagggcccagcgcagaccttcctggcacccattccctgccgtcagcccagcccatcgctccctctgtgcgtgaggggaaacaggctcgggaaggccgcacagccactggccagggtcaccatgtccctgccagacccagagtaggctctggttcttgccagtgtccctggcgccggcccagccaggagcactgctctgtgaggggtccagaagctgccagggagggcgggagggggctcctgaccctgcccactgccacccctgcccaccgccgcccctgcccaccaccgcctctgtagttccagggggaatggttcgtcctgggcctggcgggcaacagcttcaggccggagcacagggcgctgctgaacgctttcaccgcaacttttgagctaagtgatgatggccgctttgaggtgtggaatgcgatgactcggtgagtggctgtccctgccgttccaagcgggtgaggaggatcccgggcctgggtcccagccgccagtggctcaggtgcgccatgggccctgtcccagcacaggcagcttcatgactctgcctgccaatgaccaaacccagctggggagtatacaaaaaagtgtgggcagctgggcgcgctggctcacacctgtaatcctagcacttcgggggccgggtgcgctggctcacacctgtaatcccagcacttccggggctgggcgcgctggctcacacctgtaatcccaggacttcaggggccgggcgcgctggctcacacctgtaatcctagcactttgggggccgggcgcggtcgcgcacacctgtaatcctagcactttgggggccgggcgcggtggcgcacacctgtaatcccagcactttaggggccgggcgcagtggcgcacacctgtaatcccagtacttcaggaggcagaggcagaaggatcacttgaactcaggagtttgagaccagcctgagcaacatagttagacaccatctccactcatgacgcttggccactcccgccgtgggtccctctgaataagtggctgaaatctcctgaggggcccacctcagcatggacctgccagcttccggagccttccgcctccacctgtcccctcctacagaggccagcactgtgacacatggtcttatgtgctgataccggcagcccagcctgggcagttcactgtggaccacggtgtgggtaagccagtcacaggagggagggacggggtgctggcccacagggatgtgacgtctgtgccgcctcagagcccggggcggacagagaggagacccgggtggtggacagcgactacacccagttcgccctgatgctgtcccgcagacacacgagcaggctggccgtcctcaggatcagcctgctgggtgagcctcccaccccgtcctgggcccgtgtgtggccctggaggcacctccttccaggctttgggtcagaccctgcctccccaccccgcctggagtgacttgggggtacagatagttcaatctcccacctacccagcccccaaccccctgccaagtgcacagacccatgctgggctccctgggctgcaggcaggagctggttgctgcctcccgggacgctggaccagttcatctgcctgggcagagctcagggcctctcggatgacaacatcgtcttcccagatgtgactggtaacatggttcacctgcaggcatgctgggcagtaggcacggggcccgcaggaatgagtttggttgaccctagaggagctggacccagtgtctacccagggagctcagccccagcctgcgctcaggggtctccaggctcctgggtccctgtgctcaacccaggctctgagccacctcctgccgccccgggtcccctgtcctgggccacctcctcccaccccgggtctcctgtcccgggccacctcctcccgccccaggtcccctgtcccgggccacctccccctgcccctcccgccccaggtcccctgtcccggcccacctcctcccaccccgggtctcctgtcctgggctacctcctcccaccccaggtcccctgtcccgggccatctcctccctctgggtcccctgtcctgggccacctcctcccctcacccatccctgctcacaaggagcttggactcatcccaggaggtgccctggacctcagcagcctgccctgggtggcagccccagcctgaccactcagacagccgcggcccccaaggcctgactcttcttgtgggagggcgaggtcagcctgagtccctcctcttcctggagggatgcccaccgtgcccttctgattcccgcctctggtcctttacatgtgcataaccacatgcacacacactcacgcatgagcaaacgtgtacagactggcacatgcctccacatgcgaacacccacttacacacacgccactcacactggcacacatgctgtctacccgtgcacaggcacacgtgctggtctgcacacacctgcacacacctgcacactcgctatgccaggcctcctgggtctgcagtgagtctgggggcccatggggacagggacaggtgaggggcttcctgaggacctggggctgttgggagccgctgtgggccacatcttctgccccttctcagcctccctcaccccagccccttcccctagacccactgctggtcccctttctccctcctgcttctcacctgaagccacctgcccctcctttgtgccctcccttgcttcctcctgggctctgtcccctgctccccctttgtcctccatcccgactccatctcccccaccaggctggtcaccccaggccagcgtctgttgaaggatgaagcagctcctgtccggcccagccctgcctcacagctgtgcgagctctgccctcctcagctctcaaacctgaataaatgcaccaagcccagagccccagagtgtgaccactatgaccttgggttgggcaaagagacaggagcaaggcgaccgctgaccctgcagggctgcaacagctccttctctgggcacactatggccccccagccggctgtctctggccagtgtgtgtgactctgtcagtgagggcatgcacatgtatgttcatgcatgagtctttgcccatggttgcaggttgtacaaggtcgttcccaggccaaggcccctccatccctgccccttgggcccttggctgtgggagttcgcaggctcttctccacctccaccctggtcagcactcggggctgccataccagatgcagccgggctggagcttgccccggaaacactcagaccccgagctgtcccaggcagcggctgttctgtcagggaagctggcctggagctaccagggtcccagaacaggaggaggccctggtgcagatgccccaggcctgggagaggggaggcggtgacaagcagcctcgggctggagcctgctgggcacagagacacaaagggtctgaggtcacaacccagacacccactcccagcctgagccccccaaccctgactgtacacccctgcaagatgtctgtattcggacgcccacccccaccggccagccagagcaactcatttctcagccctccgatgtctgtgtccatctcagcccccactgtcctccgggcagggagagcaggacaccacccagggcggccatggaccctagtggtctctggccttgctagagagtaaagagcatccagagacccccaacctggtgcctaaccttcacccaccaggagcaccccgctactcagaagcatggcccttgtttagaatccttctgccatcatgtgcacctcctgctgggcaggctgtacaggatccaagcagattctggaactggaagacggacagagacagcagacagactggaattcctccctgccctgacggccccaacgagatggatccccatgatcaagtcaaacgacaccagctgtggtgcttactgcagccacaattcaaccttttctgtgtgtctgactccccaacacacaactcccacaagggcaggcacaggcctgctttgtccatcactctatcccacattccaacatggcgcctgacacagagaaagctgctgaaggatggatggatggatggatggatggatgatgggtgcatggatggatggatggatggttagataatggttgcgtgggtggatggatggacagatgagcagatgaatggataaatggaaggatgggtagatgggtgggtggatggatgggtagattaatggataaatggatggatgaagggctgggtggacggatgatggatagatgtttggatgatggatgggtggatagacggttagatggatagatggatggttggatattgggtggatggatggatgggtagatggatggatggttggatgatgggtagatggtggatggttggatattgggtgggtgggtggatggctggttggatgatgggtggatggatggatagatggttggatgatgggtagatggtggatggttggatattgggtgggtgggtggatggatggttggatgatgggtgggtggatggatggttggatattgggtggatggatggttggatgatgggtgggtggatggatggttggatattgggtggatggatggttggatgatgggtgggtggatggatggttggatgatgggtgggtgggtggatggatggatgatgggtgggtggatggatggatggttggatgatgggtgggtgggtggatggttggataatgggtgggtgggtggatggatggttggagatgggtgggtggatggatggttggatgatgggtgggtggatggatggttggatgatgggtcggtggatggatggttggatgatgggtgggtggatggatggttggatggtgggtgggtggatggatggttggatgatgggtgggtgggtggatggttggatgatgggtgggtgggtggatggatggttggatgatgggtgggtggatggatggttggatgacgggtgggtggatggatggttggatgatgggtgggtgggtggatggatggttggatgatgggtaggtgggtggatggatggatgaagggtgggtggatggatagttggatggatgatgcttttttgctctttttttcttgtgccctagatggggaggctgaggttaaaagcagcaagtttggttgtgtctggattgggagatattctatactgtgtggttgtgaggacacaagcctgggtgtcagaaatcctggaccacagcctggcatatattggatttaaccctaggaaggttgagagtgaaggtggctgtcttttggcagaaagggcttgttgggtgttctttcctgaacgcgtcaaggaggtgtccctcaaccctggggtgggggtcagacacaaggtcccccagagcaatggcctcactctctactctcttagtcctttccctcatccctcctcctactgggccacggtgtccccatgggtgagactcactctacagggccaggacttgggccttcaccagcctggggcctgggccacgccctcacccgatgcctggctgcagcaggggatggcttctgcatggggtccaggcacaggacctaggccaaaagagaggagtggcctaaagaggctcagcttgagaagagagccctgccctgcccctgacaatctaagagagactccgcaggccaccttctccctcttgacctggcacagcctttgccagcggaaattcttttcagtccctctgcacagatggggaaactgtgaggttcaggaaggctggctggtcacttggcagggtcaccttgcccctgccagcttccctcccccaaggcagggaacataaccccggctgcaagatcatgaccaccatgtgctggtgggagccaccgccttcctggcacccagctgtaccctccagtggtgaccagctccccggacaaaggcacaagcagagactaagactccctggcggtgccctcctcctccctggcggtgcctctgcaaagcccagcgcactccccttccctccgtatcagctcctggctggggagacaggagatgctgcctaggcctgcattccttcccagctcttatggggagggcgggcttcaggcctggctggatccagggccccagccacccccttctgtgtcactggccctggccggagtggctgtgcagtcccattggcccacttcactcccacctgggttgcagatggtctctctcccagaagtcctcagtcctgggtggaggctgtgttcccccatcagtggtcaggggacccctccacacagccctccctctcttggactccagctaccacagcccccctcatcccatctttcctggggtgatacaactctctctggccctggtggtagcgggccctgtgtgaacctcctccccgcaagtcccccaggggcaccagcccttcctggctgaagaccctttccccatgtctgcaccaggggacggggctgggagctggcggcgtggagccgaggccaggagaggccaggcaggtggtccaggcatgtctgccggcatgtgagcccagaggcctggggctggacacagaccagagagggagcccgcctgcccacctgtctgcttgctggagtcaagccaggctggcccagtggggtggggtgtcctgctggcccctacccccatgccccaagcacggcagcccaggcccctgtgggtggccagattgaatctctttaccctggcctgaatctctttacatctgggcctgctgggtctgggaacagcctgtgcctgcccctcccacagaacagggtcagcggggttgggaagcaggtaagttctggtgggtggaggggctggacccagggctggcttccgtgcctccagtggccaccaccacctcccggatcagcccctgcggtggcagagggggcctttccccgaaggccagctgtggtccctctcagccttgtccagggcccaccacagccacacagagcctgtgcctgcgacggtgaccacaggagactgtgacagtgacggtgaccacagacaggccacccagggctcaggctgggtatggtgggctctggtgggaagcagctcccgcacggctcacggtggggagggtcccttccggtcctcaccccgcgataccccttcgcagagctcatgccccctcggggcactctacccaccgggtaccttccctgggctgccccacaggtcaagcgctccacccacgccctctcagacaccaagaggcagcctgggaggggctgggcaggcgggaatggaattttcgggtctgggccaggctgtccacaggcccaggagggggaccaggcccagctcctcttcacacttctcagacctggggcgaccggaggctcctgggtatccaccccagcaccccagaccaggaaagtgaggcacaggtggtagaagacctgccagagccgcccagcacctgggcccacactgctttcccaggatcaggctgcagagcccctgggcggagtgggaagcacagggtccccttagcgttgttctgtctttgtgggtcctgggcctgctcccgtgcagaccttcatctgagggcgtgtagtgtgtggtggggaggtggacacagctgtgccctgacctcaagagtggcctgacctgggtgcggggctgggtctgtgtccaaaaacagacacaaaaggccacacattatgtgattccatttatgaagttctagaacaggccaagctcctctccactattagaaatcaggtctgtggctgctgcgtccggggtggggacactgtggggtggggtggaatgttctgtggccaggggtgagggtgctacctgcagctgggtggcgggggggtagaatgttctgtggccaggggtgagggtgctgcctgcagctgggaggggtagaatgttctgtggccaggggtgagggtgctgcctgcagctgggggcgggggttgaatgttctatggccagggtgagggtacagcctgcagctgcggggtgggtagaatgttctgtggccgggggcgagggtgctgcctgcagttggtgggggtagaatgttctgtggccgggggcgagggtgctgcctgcagtgggtgggggtagaatgttctgtggtcaggggtgagggtgctgcctgcagctgggggggtgtggaatgttggaatgttctgtgttggggatcggagcgctgcctgcagctggcaggaggtggagggggtctggaatgttccacgtcaggatcaggttttgctcacgtgggtgttcatcgaggtgtgcgactcaggtgcccgtattgctgtgagacggctcccacggtgggacatggtgatgccacgctggatgcccccacgtgcacctcttgccgtgtgtgggtgaaactcctcccgctgagtgctgggctcccgggtctgggtctgggggtgcagcacacgttcatgttcgcattctcagaacacccactgaccctctcccaccaggcagagcccaccctccctgccttcatgtctgcagggcctggcgcggagcacgaggccgctgggcactgactatggagctcagagctgtgttggtggaccaggcatcccgtgaggccacggatggtggccgtggatctaccctgcctggcccacttctcctccacactccccttcacagcgcatgactaggcagccagggccctgagccctgcaggaggagttgaggggtacacaccaggactggaaagcctggggctgttgcacagagatgagcggggaggccaggctcctcaggaactcgagtggaagccccacccaccagggcctgcagggacagggctgcgaggggactgcctgcagggctgctgggaatgggacctggagccttggctgagcagggcgggggctcctgctggctcctgagcccagggccgcccagctcagctgggcccagcactccctgtccctcaggccctgcctgatccggtctctttatcttggccgagagcagcgccctcccggccaccatctgggcctgctgggccaggaccagctgcctggggctttccagcgctgcctctgcatgttttctgcaggaggaagaaggagggttgggggcagagtcatccagggactgagtgggcggcatggggggccagacctgtggtgcagagctgagctggagaccccctcagaccctaggccctgctacctttcccccggtccctgggaagcacgttttcccagtaacctcctggcgtgagaaacttggccccggctcgccgattccccgagactcaccccacgtgccccatacatacaatgcggggactcggggctcctggcaggacggcccacagagtcaggacagccaccagggcccccacacagggggacaggtgggctgaggggcccctctctaatcctagggtgtggggaggatctggcctcccagtccccagggcccctctgctggaaacggggtgctatgatatgaacgtgtccctagatttcacatgttgacatttcatccccaaatccacttttttttgtttttaagacaaggtctagctcagtcgcccaggctggagcagagtggcgcaacctctgctgactgcagcctcgacctccctggctcaagcgatcctcccacttcagcctctcaagtagctgggaccgaaggtgcgccaccacgtctggctaatttttaagttttttgtagagatggggtttctccatgttggccaactggtctcgaactcctgggctcaagtgatcctcctgccttggcctcccaaactgctaggattacaggcgtgaaccaccttgcccggccctcaaattcacatgttggttggaggtggggcctctgggaggtgattagggttagataaggtcctcagggttgggcccatggtggacttggtggctttatgagaaaagagagacctcagctggcagctcttgccctctgccacactgcaacttggccccttgacgttggacttctcagcctcctgaactgtaagaaataaatttactttctttgtacatttccaatgtcaggtattcagttatagccacagaaagctgactaagacgaagggggtgaagtttgtggggggcttgtgcaggggcagcccagggtcctcagagccaaccccaggcagctccacccaccccaggggctctcctgaggtgggccattgggggagccacctcctagtgtcctcttggcaaaccagaactaggagtgggctggggctgtgggatctcaaagaaggagtggctgtgggtacagtcaccatggtgagggagcagcagctgcccaggatgtatcagggaggttgaaacattgtctccatctctgtgcaccgcctgcctaggcgtacacatgccagatacatgtgaacacacagaggcacacacgtgtgcacacaggcacacacaggcacacgtgtacacacacaggcactcacaggcacacccatgcatgcacacacgcacacacgtgcacaggtacacacatgcacacaggcacacacaggcacatatacacacacgcgcgcatgcacacagggcctttgctctgtgatacagtctcccttgtttcttctgaaacatctcccaagggatgtggacgtgtgggccccgttggagaggaatgctggtggaaaaagctattttgttttgcaggaaattgtcttatttcttaggtttgtgtggattaactgggatttgggttttttccatccagccagcaactgtgcacttcagtggtgatcagagcgggtccctggctctgtccccacggggactctgccctgggagggggctcagggttgtagggatcctcaggccggaccccgagttggctgggaggatgccgatgagcgtcttgccccgtccctgcctgactcgggacacagagcccagggcctgggagtgctcagggcaggagacgcggcagatgccagcatgaggacggcccagcctggcagacagatgtcagacagaggaagaggaggcagtccacatgccagtggggccagaggccagcacagagcacccttcccatggggtctgagtccttgtgggatgaaagaaccccacactggatggtgaagccggcgggtccttccgcattcaaggcaggcgtcctctttctgtcgatggggccccaggcctgccctggagccatcgctgacctcccaaaccaggaaaggccacgagcccaggagatggggccggctgggggcagggaggaggagagggctgggctctaaggccgggctgaggatgtgggcctggggtctgggggttgctgttccggagccagcggaagcccctggatgaggggagaacagactccaccgctgggcggcaaggcgaggcacggggtgggtgggctgcagggctggggctgggggtcagctcagggagcagcaagcaggctcggggaaccccttcagaggcacctgggagttgggggagggggcccatctcatacccacactgtcctgtgacccttccaggggggaccatcccaggcctggcaggggagagggagcaccgtgcccaccctggccctggaggtggttctggggcttggggtagtttctcttctgctctccccctcccctcaggctggacagcgccggggttcagccccctgtgaccgtggggcaccctgggcagacgctcgctgaccaggggccctgcaggcctggcgctgacctcagacgggcagggggtctgtgaacccaacgattgctgccttgggcagctgtaggcgtggcagtgccccagggttcagcacctgcctgaccacacggcatcaaagccgcctgtcctccccagcccccgcacaacctgccactccctgctcggcagaggaaggagactcgggccacacccagggagggacctcctctggctcgacatggaaacctaggctgtagctccctgcttccccggctgtgtttgtgtggcctggtggctgaatctgcacagagagcaggacgccaggtgcgctcccgggaagctgtcctagagaggggccggaccgcacacctggcgctggaagcctccatgactggatgtttgcaagaaacagaaagaaacttctgtccagtctcagccacaggcacgccaggtcctctgctgccttgccgcaagctcgggggtttcagtgagaccctctcccactcccacggcctcgagtggaccaggtagccctggtgttgctccctgggtgctcttgaccccccaaggcggctacaggaaggagaaaggcctatcttgaaaggactggaaaacagtgcgtcagtattttaaaaattaagctacaccatcataggacctggctattgccttcctgggtatttacccaaaagagatatagcacacacccacgcacgatgcgtgtgcccacggcggctttatctgtaatggccccaaactggaaacacccccaggtccacccacaggtgaaggagaacaaatcgtgatgtatctgtgcaacgcgacactgcccagcagtgaacgaaggagctactgatgctctcaacaacctgcaagccccaaaataaccgcgtggggcagagggcggagggcggagggcggagggcggagggcgtcaggcagcgagaaaggtggtgcacgtggactggacgcgaagccccagaaagccaggctcatctccagcgacggaaacacagcagtggcctgggggcaggggaggtggtggaaagaggagggagggagggactccaggggggctcagggaatctttagggcgaccaacacagctgccccctgattgcaatgatagtttcgtgggtgtgtgcgtcaaaccatatcgcagaggccgggcgcggtggctcacgcctgtaatcccagcgctttgggaggcagaggcgggcggatcacctgaggtcgggagttcaagaccagcctggccaacatggagaaaccccgtctctactaaaagatacaaaaattagccaggtgtggtggcgggtatctgtagtcccagctactcaggaggctgaggcaggagaatcacttgaacccaggaggcggaggttgcggtgagcccagatcccaccactgcactccagcctggcgacaagagcaaaactccatctcaaaaaaaaaaaaaaaaaaaccatttcgcagagaaggacgcagaagccaatggaaaagctgccagtagctgcagctggcctgatgtgagccacaaaaccggatgtgacagtagggtgtgagccaaagtgtaaaacacctgaggtccacacggatgtcagtgaagggctgtgcccacccatgggagagcagagacaaatgatctcggtgcagcaaagttgcaaatgtgtgtggattccccttccgggggaggtgagggccacacacagggacttcatccagagaggacagttcaaaaagaaaaagacggagaggtgcagggttagggtgggggaacctcagccaggtgaccaaggtcaacatgggcagtgaaggtcgcgctgatggtgtcccccatgtgatgtggtgggaggaagccccgcccccattctcttcctcccgaccatcaccggattcagcgtgagaaactcagcagacggagcccaactgagggacgccccacaaacacccgagcagcgcccctcaaggctgctgaggtcatcaaggaccgggaaaagctgagaaacgtcactcaggaggagcccgtggaagagagacagaatgtcacgtggtgtcctggagagaaagggaccttcagtaactaagggaatctggagaaagcctggatgtcagctgactcgacgtcccaacactggctcactgattgtgacaaagggaccatgagaattaggacgccagcgagagggaaactgggggaggggcacgcaggaactccctgatctgtcttcacattttttttctgtaaatataaaacattctacactgggtgcagtggctcatgcctgtaatcccagcactttgggaggctgaggcaggcagatcacctgaggtcagcagtttgagaccatcctggccaacatagagaaaccacgtctctactaaaaatacaaaaattagccaggcatggtggcaggtgcctgtaatcccagctactcaagaggctgaggcaggggaatcacttgaacccgggaggggaggttgcagtgagctgagatcgcaccactgcgctccagcctgggcaacacagcaagactccgtctctctctctctctctctctctctctctctctctctctctctctctatatatatatatatatatatatatatatatatatatatatatatttctaaagtaactgttttttttttttaatttttatttatttatttatttttgagacagagttttgctcttgttgcccaggctggagtgcaatggtgcgattttggctcactgcaacctctgcctcctgggttcaagcgattctcctgcctcagcctcccgagtagctgggattacaggcacccgccatctatgtccggctaatttgtgtattttagtagagacggggtttcaccatgttggccaggctggtcttgaactcctgacctcatgtgatccacctgccttggcttcccaaagtgctgggattacaggcgtgaaccactgcgcccggccctatgttagttttttatagttttaaactatattagttttttccaagagtcagcttttgacttggatcttcctattacatctttgtttctgtttgtttttgtttgtttgttttttgagagagtctcactctgtcacccaagttggagtgtagtggctcgatctcggctcactgcaagctccacctcccgggttcacgccattctcctgcctcagcctcccaagtagctgggactacaggcgtctaccacccctgaacccggaagttgcagtgagccaagatcatgccactgcactccagcctgggcgacagtggaagatactatatccaaaaaataataataataataaaagtttacattcaataaataaaatttttaaaaggatatttacatcagtgtagtatgtgaagtaaacaagaaaaagataaaactcactttttaagtaaaaacaatgagtcatgttcttgaagtatgttgtaatctttaaatatcagaaaattaagggaagttaatttttattattactattatttttttttgagacacagtcttgctgtcgcctaggctggagtgcagtggtacgctctccgctcactgcaagctctgcctcccaggttcacgtcattctcctgcctcagcctcccgagtagctgggactacaggtgtccgccaccacgcccagctaattttttgtatttttagtagagacggggtttcaccatgttagccaggatggtctcaatctcctgacctcgtgatgtgcctgtctcagcctcccaaagtgctgagattacaggcatgagccaccgcacccggcccctattacatctttgtttctatttgtttaattctcggtctggtgagggtcagcccccaccaagggtcctggcagtttcccttctaggctcgcccctcccctgcccacgccccggcagccctcaccccagcgtggctgggcgggtgggggaggggcttcttcctgggagggaggggcccctgagccccctgcacaccagccgggccccatctgtgacctctttgccacgcctctaataccgctcgcttgctcagagggcacatggccggggggtccttgggagtctgtgcaaagccttagtcacatggagggacctgagggaggctggatgtggaggagacagtgagagaaggtgaggtccccgtgtcatgtcacccaccacctgccggccaccaggttcctgcctgggacagctgagccctgacagccctcggcgaggaggcccgggctctctagcaacctggctgcagctcctgacacaggctgggctgcccttggcccagggccctccagagataacccaagtgccctgtgagcaggcctgagggagggtgggtagcccaggacagggcacctgggggtgaggcagagaccaaagacccacaagatgctccccaatgcaggctgagctccagggagctgctgggatcctggaagaggacagaggccccccaaggccttagaggaacccagagactgctgggcccagtgggaggtgtctggaccctccagcctgcgcccacgtcctctggcccacctgcccatcgtgcctctgccaacgggcccagagctgacgcacccccacagcccagcgcccgggtcaccaagtcctgaactcagaaatgcacatattccctgggacccctgagaattgggctgtggccaggccaaggccaaggtcctctggggaagccccagctaaggtcagcagcggcctcccagggtcagccatccccaggggcctcattacaggaccagggtggtaagaagtccgcagccccgcacagcagctgtcgaggggaggcagatgggctgagggccctgggggagtggggccaagacctgctgcacccaggagagaggaggcttggaggacaggggtggggctgcatctgggaggtcctggcccagactggacccgtgggcagagcagggtgggtgccagcagcctcagcacagacacactccgtcccacccaccaccagcgctctggagcctgccccgggccagggaacagcttggcctgatcctgctgacgcctcagggcaggacagggcagggaggctccaggcggccacccatgctgggcacacagtggactctcgcacggtgtcttctgccgtcacaccctgacccagggctggccgggagccttcggggcgacagctccgaggatggacgtaggggtacgagggcagggacccgggctttgggaatcagagctgaggcctggggcctccctgggagctggtggtctctgcgggtgcccaccctcagcccacatttccaccccgcttcccctcccaaggttgagaccagggaatggtgggcaccagtggaaggcacgctcctcaatctttgctgggctgagtccaaggagggccccctgcctccccagcccagcctccctctgccctgcctcgccccttagccccgctgctgaggagggagaggggcaaaatctcacccttcctgcacttggagaaaaagaggttgcttgtcctggggtgggggccagcaggggacctcgttactagggggtcccagcccagaccctcacccacccccttccccacccccatcctcaccccctgccaggccagctgctgccccagagtcctgccccctgcagccctgtgtggagccctgggactcctgtgggtgggcctcaccctgctggggacggtccagccacagcgccagggcccccagaggggcctgaacttgcctttccacaagatctgtctccagcctggcctcagaaaggagcgggtgagtggcctccaggatggggaaggaggaaggagggtgcagctgggccgatgggcctgactgccacagtgagcatggccctcatggccctggagaaccctgccaggtgggaagagctcacgccctctgtgcaggtggagaaagtgaggctcaggaaggctgcccacccactggccagggtcacccatccctgtcagatccggactcctgccagagtcacgggtgccagcccagcctggaacccctgcctggggagggggtcctggccctgcccactgccagcccctgcagttctgggggagtggtgcgtcctggggctggcggtcaacactttcaggccggagcgcaggtcccaattcaggatgttggtggcagccgtggtcatgtccagcctgctcacctgaggctgggtgcccagagcccctgccgggtgatgggactgcccggggaggggagacggagggctgtggggtggagacccttcatacagacaggcaggtgggtggaccccgtgggtggaaggaggcagcgcctgccttgagggagctcacccacaccctcagcacagctgtggggcccctgcttctcccccggggcctgcagtttggaggaggagcctgtcctgagacccaggggcaggggaagatcagggcagggtgcagggcccagggacatggtggctgtggctgggacatcccaattccatgcatccagtgagaacttccacggggaggggacgtggtcagaggcggggacaggcaggctgccaggaagagcagcctcaggaagagtggggagcaggaccctccgggaggccaggaagcctcccctccccagctcatccgacctgcccctccccaaagccttcaccccagcctctccccaccacaacctcctcccacagggacccaccctgcaaacgctgggccaggacccctgtcccggagaagcagccagctcagaacccccttggaggccgggagggtgagtcttccctgcctgacaccccaagaaaggcccagaactgccccaggttaaggtcactccacatctgtaatcccagcatttagggaggccgaggcaggaggatcaactggggccaagagttcgggaccaggctgggcaacatggggagagcccatctctacaaaaataaaattgaaaaattagctgggtgtggtggtgcatgcctgtagtcccagctacttgggaggctaaggagggaggattgcttgggcccaggaggctgcattgagctgtgaccgtgccactgcactccagcctgggcgacaaagcaagaccctgactcgaaaaacataaataaattaaaatggacactccagggaaggtcttggtgtggccccagagggggcatgatcagcagcctgtccccagcagtagggtcctgagccctgcctgacccgcctgctccgtgcagaagtggggttggaaaatgacgagatggaggctacgccgagaccaagcgccaggagaagggacccaggccaagctgctcggtgaggccctgagcacggcgggaaggggccatgcaggaccccctgagggctgggctggggagggaggggtctccccagggctcaccccccttcttggcacagggcaggggaaggagctggatttagacctgagggagaaatttatcagatttgaccagatcctgggcatcagccttgaccacattcccttcctgccccagactggccccggcaggccttgggggtgtggggtaggcaagcagagaccacactgatgcggggaggttggcccagagccctgcaggccaaagcctggggccgggcagcagtgtccgccgaggagagggtgtctggtgcctgaatgacacaacctgagaggcaccagccccaatcctgtccgtgcagcccagcggggaggactgcccaggagaccataggggtccggaggtcaaggccaggtgccagagggtcctggcaggacccggggtcactggaggcaccccacgtacacggcaggcggaggggacggcagtgccggaggaggggctgcagggaagcccttgtcagcccccatttctgacccaagggccttggccgggaaggccaagcttgaggcaagagggttctgagctggaagaggccaggccccccagacgcaggggccccgtgggaagagggaggccatgagctgaggccacagcagctgaggctctgagagctgagagtgagctggggccctgccggagcctcgctaccaactgctccaggtgtgggggacactgcggggcccaaacctggacacacctgcggcctggagtgtcccccccacccaacccagggcctctgagggtctctgcccaagctcctgggtcccctgtactgggccacctgcagctcccaaggcagccctgggggcaggcaggagcccccgggtcagaggtcgtgcgaccctggccttggacccttgggcctctgaccagcactcctgcctcacagaagagcccgtggtgagccacgagtgtgactgccaggggtcctgggggtcccgggccactctgggatccacgaggccctccttcctcctggccctggcaccccctccacccctctctctcctgcaggtctctgcttctccctcctctcactctagcccctccgtgattctctgcctgggccggccaccctctgtcctgaggacgctggagcctggcccggcccttggcagccccaccctcaccgcccatcccagcctcgctggtgccccctccacgtgggaggctcagccacacctgcccccacgaccccatcagaaataaacagtctgtgccaggagaagccggatccgactgtccttgagcactgggtgatgggtgggcagggcctcggggagcagcccaggttccaggcccaggaggagctgagctcggacatttgtcctcatctaacccccagtggctgcctccctcccagctgggtgctctcctggcccgtcccacgctctctggtgaacagagccagattcatcctcaaacataggccaccctccatggcgcccagcagaaactgccctaggctggagggctgggaccgtggggtgacagaggctgcggaggcctgtgaccaagggtccctgcccagctccacagcacctggcagcccttgcccctgctaggagcgccctttcctcaccgctggctcttctcagatctgtggccccatccccctgggttgcctcaaaggaaccccagagtgagaggcaggagcccccatctcaggggcgtgggcccaggctccctgtgtgccaccccacgttcccccgatgggaggcaggagtccctgaagatccaggcccagccctgaccgggggtgggcacagaggtggggagcagcctctgggatcgggtctccacctgtgccctgccggagccagcccctgcgctgaatggtacttccggcttctggtctctgtggggagcggtgcccagcctggtgctacagtgacccaggggtccttaggcgaggccctcccaggcttggcccctgcccagaccctgccctcctggggagctcccgcccagcccctaaatgggtgaggtggggacactttagccctgaccttccatggccgagctgggcgcttcctgaagccagactgggcctcagaggtccactgcaccgggatcctggagctgagcttctcgaggccaggggtgtgggtgtggtgtcgggtgtgggtgcgggtgtggtgttgggggttgggccgccccctcctcccggccctgctacctttgggatgcggcagcctctgaccagcctgctggaccccacattggacagatcgttcagcacccccaaattgccatctgtcccccacagacagccagcctagccctggctccaaagctgcagaattggctgaggcttggccataaccgtctttggaccccatggccagcaatgcacatatgagcctcaagtcccagggacatatctgctcccctatcctctggcttgtcccgggctgccctgtcctctgcgccgtccccggctgctgggcgggcctgacctccagggtggtgctgggagaggtggccagaggcagccagaaagggtgagcggagaggtggccgtcccccatgtcagtgaacacccaaacagacaggcacagagaggagggctgggtgaagagtgggtcccatgtgctttgagcagctcagagatgccctgaggaggggctgtcccacgtggcccgtccactcaggcctccttcaatcacagagcagctcccttgacgcagggaggccttggggagaatttcttgcccctagaggagccctgagctgcccccaccgcacccggccctggtctccccggctacaatctcaggggtgctcctgctctgcccctgacttgtccagaacactccacagcgtctcagtgatcccgggcactgcccttccctatggaagatcctcagcggggcagctctggcaggagtgagcctctggggccgtgaggcttgggtacctctgaaaggtggggtgtagaggctgcccctccccagtcccaggctgggggagttgatcccaggctgcaggtgggtggggctcacgaggtccccatgagtttatttgaggctggtggacactcagtcgagctcagctcccaccagtcactgggacagcctcggccctcaagggcaaaccattggtggggatgctggacagggtcatcactgcccccggaggatgctggccggggccccagggtggagacagcttccctccaggaaaaggttggggtcagttctgggagcttaggcccaggccaccaggcttgtccatgacctgcctgggccgcaggcagggggatggccttggtgacctcttagggtggaggccaagtctttgcattttgtgactcaaagagactggttcccagagagcagggtggggcggccagccttcttcctgcccagccctccgccaggctccactaaggtcctgcctggcagccaagctcagagcaaagggaagggcacagagagtgtgcagggtggtccttgtccctgcccaagctgcaagaggctctgcgaaggtccctcctgcccctgtccaccttgcacagtcctagccgggggaggaggggagaaatctggcgtgccaggagctggcaactgcccagcccttcctggatgtggtgagagatgaatctccagccctcgggtgggcccaggtgcacccatgaatcagggctcgtgggcagctcccactcactggtcctcactcagccgtgtctggggagtgtctctgaccacctgctggccatcttgaccacagggactgaggagtccgtcctgaaccgaagcatgatcctgttagctcttccagctctccaggcgccaacgaccatatggtctcggtaacgactggtcagggaggagaagggacatgggacctgctgggctttctgcagcccactagaaaatggggaagaggaggggcttggtccctgttccaggcactgggtttgagggctggacacccgagatccctgggaacccctctggctatgggaggacccggccccatcagacttcagagtccctccctggcaggtgacccaggcctgcccagacggaagccattcagacccagagccacgtgtcctgggtctccctgccccgggccacccgccaccacaccccagagcttgctcaccaccgggaggcgctcttgtcctggaccagcctagcctgggttgggacctccagccaggccagtcagcgagccaccagccccaccagagtggaatgacagccaggactcagctggcagcgggcaggaggccagtcttgtggtgatatcccagccgcaactctcttcctgcccctcccctgtcctgacggcagcccccagctctgtagctgagccaggcttgcgggccacgcggggtcccgggtttaggcaccccacccctatctgttccaacagactctccctctcagcccatggcacagatggcatctgagctagcagcacgctgctgcttcaggcaggggttgataggaggtccaggtggaggagtgggttctcaggactgccttggcccccctgcaccgctgccctccttctccctgcctctcaggtgcctcccggctccctgggactcactccctcaccttggcctctgcctgggatgctacccggccacccccaccagccctgacaccagtgctgcccactagcccctgctgctacataggcatgcgcctcccccagtctgggctccttgacccccgggcactggggaaggggaacaaggaagcagtccacaccagcccactcccagggctcgtgcgcccccagcaagggatgggccacagaatccaggaagaagacgggctccggcccccagtggtcgccagcagccccgtagaagctcaccaccccaccccatccgactcactcctgctctcatgtacatttcccagctccccacccgggctcaccttcagaccagcggcagcgctcacccaccacgcctgccagggaagctcagtcccaacagaatccagagagggcccaccacatgtgcctgcctgtgacggcctgtgacagggccccagccagggccaacgagctggaggggcccaaggagctgggtgcagcgctggggtaacaggacagccccacggggtgctcccgagtctggaccagactcggggtggggaggcccagactcggcggggggcagacttggggtggggggattgctgggggaagttggggcctctggcaagggatagggcctgtgctcaagcccaaaggtgccccaggctgaaatgggcacccaggggtcactatcagagccccaacagctggccatgggggaagccatgcccagcaaacctggccctcgggaccctgcgggccagatcaagtttctctaccttggcctgagcttctcatcaacacttcacttgctgggcgtttcaggaccaaactctcagggtggaagtggggcttgtgtccccttctggggtggcagggctcggaaagggaatgatggtaggggctgtgagatgtgggtcctggcccccagtgggaagtcaccagaggcctcggaggcgggcatggctgaggaacacagcccctgccctatcagggccgctgggttggtgggccctgccagcaggaggagggtgggcaaggtccctgccagctctgtctctgggaccagtgggcaggggcctctgcctcacccccacgctgcctcagctggggcagcaggcccaggcctcttgcataagcgccctgtgggggacgaggctgcagctgtgcctggccaccccatcccccagcatcacgagtgttcagtgggctgtccccgggccctgggtggaggccaagcctggcccataaataggggtctcctcagtgccctccgctcctcctgcacacctccctcgctctcccacaccactggcaccaggccccggacacccgctctgctgcaggagaatggctactcatcacacactgtggatgggactggccctgctgggggtgctgggcgacctgcaggcagcaccggaggcccaggtctccgtgcagcccaacttccagcaggacaaggtgaggggctttcctgcgtcatccccaagggctacaggaccctgtcaggggaagggcactttccggctgggtcttccccctgggaggagtgagcgaagtcccgcagtgccgggcagtgccggccagggactgagcgggcgcgcaggaaggaggctgggtagccgcccgaggaggctgcccgcgagaagccctccctgggcaccgcgtcccgtctcccctgatgggccacgcagacaccgggccacacacgcgcccacgccagccagacacgtccacccctgtgggcacgcgacccccagaggacacacgagcgcacgttccacacctgggtgccaggacacgggcgggtggggcacagggatggcgacaaacactccgtgcgcggtgggggttgggagggacgcgcaccgcacagacagccggcgacgcgcgctctcgcccgggagctgctcggggaagcgccggagcgcgggtccccgcgccgcgcgcccctccctggcgtcgaggagaaccccagcggtccgcagagctgagccgaagacccgccccgatccccgccaggaatgcgacgtcctctgccgcccgctgtatgggccaggcgctcagccagggcacagaatcgggaccgggggcggaggggccgaagctggctggtgggcggcgtgcgagggtgagggactgtcctcgggaggggcgtggccagacgggggtgctgggtgtcaggggcgtggccagcttctggggctgaggcgtgaggggcggggccatctccgggggagggggaagtggggcgtggtcatctcctggggcggggcgtgaggggcggggccacctcccggggcggggcgggggcctgatgggcgtggtcagctcctggggcggggacgtgaggggcggggtcagctcctaggggggcatggggcgtgaggggcgcggtcagttccctggttgtggacatgaagggcggggccagctcttggggcggggtcgtgaggggcgtggtcagctcctggggcggggatgtgaggggcggggtcatctcctggggcggggatgtgaggggcgtggtcagctcctggggcggagatgtgaggggcggggtcatctcctggggcggggattgaggggcgggggtcagttcctggggcggggcgtgaggggcgtggctgctcgggggattgggcgtgggggcggggccgggttggagaccggaggagtagacggcagaggcgcccccgcaggtaggcgcaggtgggtccggagggtcctggccgacgcgggtgggggtcgctcgccgcagttcctggggcgctggttcagcgcgggcctcgcctccaactcgagctggctccgggagaagaaggcggcgttgtccatgtgcaagtctgtggtggcccctgccacggatggtggcctcaacctgacctccaccttcctcaggtgggacagcgggcaggtgggtttctgggacggagaggtccagggacaccctcgggcctaacccctgaccctgaggtcacccacctacaggaaaaaccagtgtgagacccgaaccatgctgctgcagcccgcggggtccctcggctcctacagctaccggagtccccgtgagtggggcctccaccggccccctgggcccagcctgggggcgacacttgccgggacgactctgggccagccccctgccgcggagatccatggggtgggaggtgatggctgccccaccagcgtcagaggcaaaggccaggcctgggcgtgactacccatgcacaagtgttagggacagagagacccttcctccagggggttggatcctctctggagcccaccattgtcttgtcaggccccttccctgccctctggagttttccccacataagcagccccccaaggcccctccatatgcctcctcccaattctcctccccaggacccaggggtttcctcactcccacctggggaatggctcccacggggaaacctcttcacttccggttctggcagcgacttctgcggctgcaccaggaatcctggttttctgagcctggctcccccagattctggtttggggacagggttcacaggctgtgcaggcgagagcagggcactggctggagagcagccgggtgggggagcatcccgggccagccgaggggctgagtgcccccaaagcccacaggtgcaccccttccctgaagcagaggtgaggtttggggggctgagtccccgacagggttgtctcttgggttcccagactggggcagcacctactccgtgtcagtggtggagaccgactacgaccagtacgcgctgctgtacagccagggcagcaagggccctggcgaggacttccgcatggccaccctctacagtacgtgccccgtggacgccgcccacacgcaggcctgaccagagggggctccccaagacccagggcagggcacacagcatcccccccgctgaggccagctccgtctccaccctgtcccaggccgaacccagacccccagggctgagttaaaggagaaattcaccgccttctgcaaggcccagggcttcacagaggataccattgtcttcctgccccaaaccggtgaggggtcctaatctgatggggagaggatcaaggtcagattagaggcaggcaggcagtctcctgactgggggaggcagaggggaggaggtggccccgccctgctcgaggcctgggccagggacagagggggtgagtgttcaagtcagaacctccctcccgcagccccttcatgaggagccccctccatgggggacatggagaccaggcgcccactctgtgccaggccccagcagctcccaggatgtggggcttcagcctggtggggggcatagggtagagggtgcccatgggggatacaggggaaccaaccatactgggctcaggcacagcctcctaggggtggacagcctgctcttggcagaggtggagaaagaccctctctttgtttccagtgcccagggagaggtgggaggtgatgggggatctgtgcagtttgggggctcagtcaagacgagctctgcgttacgggaggaacaggaagcccagtgggaaaattggcctaagtctggggttctgacgacagcccctggcttctttcttggcagataagtgcatgacggaacaataggtgagccactccattcattcattcattcattcattcattcattcattcaacacacatccacccaacccactctgcgatgggatggatcagggccccaggacagcctggtgctgcagacccatccttcccgatggctgcagtccagggccgggcgggagacactggggctgcccacattgatgggtgcacaggtgtgaggctcagaaggaaaacctgtcccagtggctggaacagggctgactcctgaaggctcatggttggggggtgcaggtgcgaggccccaggcagacaaggccaaggggctataccacagggaccacctggcagcaagggtgtctggctcctgggctaggaggaaaccagggtgggggagacaggatgggagggaacaggggatggaaggggagggccaaggacgctacatggatgccgtgggacagctcggagagcaggctcagggcggattcacccaccacccccaggagggaggcctaggctggagctggagtctgtggaccctggggctgggaagggtggagtctgtagaccctggggcagcggggatccaagccccagggatggatcttgctctctcagcggggctcagtggggctgggggcagagaaaagtccccgtagcccgcacctgctccatcgactggagtggaggtgggctggggtagactgcagtcctccatcctagcctttcggtcacacccctcaggactccccagggctgaagctgggatcccggccagccaggtgacccccacgctctggatgtctctgctctgttccttccccgagcccctgccccggctccccgccaaagcaaccctgcccactcaggcttcatcctgcacaataaactccggaagcaagtcagtagagctggctcctggctgtctgcgctgtcatcacccgtcctgggcctggccctggccacccggacctccccctctaaaatctcagcctgacgtcaacaaaggaacaggccctctagtgtttgctcccagtggggtcttgagtcaggacagctaggagggggtgtccctcactgtctcccacccaccccacacagtcgtgtgcccctgccccacagccccacacgtcgagccataccccctcagctgccactgccaccaggccggtgctgagctgggggtcagtgactcagctaatcccttaggcaggtgccctgcacccccaacgccaccctgtcaccccctcagcagtaaaggcctgaggctcgaggccccagaggagctttggacctgttgggtatcttgaggtgtgggattaacgcactgagattgggcagagataagggtttcaggggacaaaaagaaacatttgtttgaaacatgccagagtgtctccaccccgcatcaggacagactgacagagtgggctggggacaggctaccccatatcccttctggctccctgtgcgccccctgccctctgacctgggcctccagatcacagccttgtccactcaccagagccctggcaccacggccacaccatgcccggccagtgccctgcccaaccctgctcccttccagattcccacccaggcagccattctcaggtacacaatgtgcaggactcactgtgacctgcccaccaggcccccccgaggcagaccctgcagaggcaccaagcattttgaggctcggaggtgagggtgagcttctgggtggccttcccggagaagggggcttagggctgtgcctgagctcaaggtaggggggattccaacatcccagaggggctgcagaaggccgaagaggcaggatgggtgagctgcaggccccctagcccagaggcccgtcagaactaccctcagctgccaggcatccggccccaccccggaggaaaggcaacggatggctggggttgggtggagggagccaggccagagcgctgcagggtgcaacttgatcagaagcctgtcacagtgggtgcagtcccaggccagccgccccagggcacctcaggggcgtaaagcctacagaggagccacctcagctctgccctgctcccgtgtccggaggagatgccatcttgctgcatgatgcttcgggctctgctgatcagttccctccttgccctgctctgggcatccccaggccaggcccaggtccccatccaggccaactttgatgccagccaggtgtgcccagccctgtttcctcctcatctccaatgagtcctcccggctttggtgctgcaccccgggtccctgtccacaccctctttgatccaggctcagcagggctaggggcaggggaaacccccacctcacccgctccgtctgactggagtaggggttggctggggaagactgcagcctccatcctaccttttcagttgcatcccccaacaatccccagggcccaaaatagggacaagttggttgcctgtgcctcactgtcccccacccaccccacaaagacctgtgaccttgccacagccccacccatccagccgtaccccctgggtgccagctgcagacaggccggtgctgggctggtgggggccagttgctcatgtactgaggcccccctccctcagttctgcatcggggtcgagatgtgtacagcagcccctgccgtggccaggaagcagctgtgtcggggcagaatgtggtgggctcaggcccagggcacaggggcggcctcccagccttccctgcacttgccctgcagttccagggcacctggtacatggtcggggtggtgtcagatgaccaggacttcctggactccaaggacaccatgaagatggctgtggtcttagtgacccccttggggaatggtgacctggccctcaagtttggataccccacgtaagtgaccacacgagcccatcagactcagcctcagaggatggccagcatgaggccacatgaaggtccagagggaccatggtgtccccagcacattgaggtcagaccacgggtcctcgacggctctgtgcggcagagccccagatggcagccacacggagtccagagggacccaggccctggaggaagcactgcctgaggcctggtgttgagaaaagtgtctgcatgtctgtgtctgtgtgtgtatcactgtatgtggctgtgtctctgtgtatgtgtgtctatttctgcatgtgtgtgtgtctgtgtgtgcgtgtgtatgcatgtgtgtctttgtagatgtgtacctctgagtgtgtatgtgtgtatcactgtatgcgtctgtgtgtctgtgtgtctgtgtatctgtgtctggctgtgtgtgtctatctctgtgtgtgtcttgtgtgcgtgtctatgtgtgtgtctgtcagtgtgtctgtgtctgtgtctatctccgtgtgtgtgcatgtgtgtatgtgtgtgtcttctgtgtgtctgtgtctggaagggggacctggaggccctgcattctaggctgtgtgcctgtgaacaggtacttaatacccaccccacccccagcaggagtgtccccacctctaaggtcatcctaaagtcccatgtcctctaaggattgtgagggtgaacaggggaccctgggctcagagacagcaaggtaggctctaggcctgggcgctgggcaggggtggccactcaggggattggggctctttctccccaggccccatggcgggtgccagaaaatggacacgaccttcaccgagggtgctgtaccggggcagttcagcaacccaggtgaggtggggcagcaggcagggctgtggcgtgggggccctggaggctgcatggactgctggattggcacctggggccggggcgtgaggggtgccacgctcgggggggaggtgccctgggcctggggtcagcggctctcgctcctccagccatggccctgagtgacatccgagtggccttctccgactaccagcactttgccttgctgtacttggagatgcggaaagggggcctgcggaaccagtggctgcagctctacggtgggcgggctgcggggcggagacccagacacccccgcttcgggtctgggatgtcacccctgtgcctgcaccagccctttctgcacgcggaaggtggaaccgctggctcctggtgtctgtggccgcgggtcccggcccctccctgcccctctctccctctcttcgcccctccagccccttccctttagcttacccgccctccccaccttcagctcgagcgcccgagctgtttcccgaaggcgcccagaagatgcagctactggcgccccaagtgggcctgagccccagccagggcgtcctgctgccgaagtcgggtgagcggtgccggcagccctgctgggagggccaggccccgggtcacacccctgctggaagggccaggccctggtcactccactgatctcagattcgggacagaagtgcccggggcagacccagcctgtctgggtcgggggagggcgagacgttgcccaggccggtgttcccaggaggagatcgccttggggcaggtcgggggcctccgtcccagggaagggggcgcggggtggcgcctcaggctcgatctctctgcagaccagtgtgcgggcgcgctctcccgggtgagtagaccatggccatgcggagccgcggaccatgggccctcccagctcggtgggctgcaccgcggggccctctaccttcggggcagctagggacgacagcgggggtgatggggcacccgggcggatccgagccgcagcagcctggggaaccgcggggctgcgcgtcgggagggggcggaggcaggggacgccgcccacctgctccttgttttgcagtgaggggtccagcccctgagtgcccgcaggggtcagctgctccgtgcgcccagccctgcccaaagagccccctccctccacaccctggccccaagcgcaataaacaccctgaatgcctgtggcgctgtgcgtttcttgggggcagggaggggtggcgggggggcggccaggtacatgggcgccctgggggaggggccgggtcaccccctgttgcccctctgggtaggcgttagcccaggagggaccgagcctcggctccgtggcagggaggttcctcaggacgggccccagccccagctctgggacttttctacctccgcacggacccagacccccagactgggggcgccgggagggcgggacacggacaccacgcggcgcgcgccccaggcttcagcggacaccgccgcgcgacgtggccttccgggtcctcccaagcggctgccccagtcagtgtcggcggcttccatccccaggcgcccctccgggtcccccagctccccagcccctgactcctggctccaggacccgccccagaggcctggctgttccggagaccaacgaagcgctcccaactctgacccagggcctgtccacggagagtggagggcgaggaggacaggaggagccgcataaaactctgccctgcctggagtctatgtaggacagtgttgtcttttacagacaagtctcgaagaatttgaaggaaaatagcctactagctgtaatgtacctagttcagcaaaataataataaaaatactggttgcaaatctgtgaatatttggatagtgtttaatctgggtgatgggtctacggggtgcagtatgctctgatttctccttctcagttggtcagagttttgtttgtttgtttttttgagatggagtctcgctctgtcgcccaagctggagtgcagtggtgcgatctcggctcactgcaagctccacctgccaggttcaagtgattcttctgcctcagcctcccaagtagctgggattacaggtgatcgccaccacgccctgctaatttttgtatttttagtagagacaggttttgccatgttggccaggctggtctcaaactcctgacctcaagcgatccacccaccttggcctcccaaagtgctgggattacgggcgtgagccactgggcccagcccagaaaatttgttattaaaaaacaccactcgggccgggcccagcactttgggaagctgaggcgggcggatcatgaggtcaggatatcgagaccatcctggctgacacggtgaaaccccgtctctactaaaaatacaaaaaatcagccgggtgtggtggcgggcgcctgtagtcccagctactcgggaggctgaggcaggagaatggcgtgaacctgggagacggagcttgcagtgagccaagattgtgccactgcactccagcctgggccacagagcgagactctgcctcagaaaaaaaacaaaacaaaacaaaaaaacaccactcggcggagcacagtggctctgcatcccccctgcattcccaggaagattccgagccgggaaatgcaggttgccctccacagcctcagggatgccctttccttccttccagggtggggcagcctctgggggtggctgtgggtccagctgtggtcagcccccaatcccttgcagacgcatcgagtccctcacctcccacgctcagccctttctccacctagaagcccaggggatggattcacaagatgtgtcagatcaggcccccctgctcagcaccccacagtgggtcccattgcactgagagtaaaggcctaagtctttttttttggaacgaagtttcgctcttgttgctcaggctggagtgcagtggcgcgatcttggctcactgcaacctctgcctcccgggttcaagcgattctcctgcctcagcctcctgagtagctgggattataggtgcccgccaccacgcccagctaatttttgtatatttagtagagacggggtttcaccatgttgaccaggttggtcttgaacttctgacctcaggtgatccacccacctcggcctcccaaagtgctgggattacagccgtgaaccgccatgcccggcctcaggcctaagtcttgatggtggccaacaaggtcttctcttttaggctttcctttgacccaccatccactcccctccctccgtcctgctgccagcccctcacgtgtctcagggcctttgcccaggtcacccctgcctggactgcccttctcccagtgccactcagtgcactcactcccgtctctgaagtcttgctcaaatacctcccttggttgttgacctctgctaccccaaaacttgactggcccccactcccctagagctcgttctccggaccttttgctcctctttttggcccagcttccaggtgctctatgccttgggaaaggtcagccctttccctcccctgttctgcctccatcaccgacttcaagtgtgtgcgtggggactttgtaatccctctccttctgcttgcaaagctccactaaccttatatctcatacactgtattaatgtatcctacattaaagaaaattgctcccatggctgggtgcagtggctcatgcctgtaatctcagagctttgagaggccgaggcaggcggatcacctgaggtaggaggtcgggagttcgagaccagcctgaccaacatggagaaaccctgtctctactaaaaaatacaaaaattagccaggtgtggtggtgggcatctgtagtcccagctactcgggaggctgaggcaggagaatcgcttgaacctggaaggcagaggttgcggtgagccgagatcgcaccactgcactccagcctgggcgacagagcgaaactccgtctcaaaaaaaaaaaaaaaaaaaaagtataaaaaagtatctcagagaaggacgtggtggaagccagtggaaaagctgctgccagtagatgaagctggcccgatgtgagccacgaaacagaacatgacaccagggtgtgagccaaagtgtaaaataaacacctgaggtccacacggacccagcctgaggctagttaaatgaaggttttgcagttttctcgtcatgttttggaactaatctttgtttctggtcttgtgtcagttcctacagctgccacaaattatcacaaacttgtagcttgaagccagagttcaaaatcagtttaatagggtcgaggtatcagccgggctgtgctccctccgagggctctaggggagaaaccttccttgcctcttctagcttctttgtcttctttttttgttgttgttgagacagagtcttgctctgatgtccaggccagagtactatggcgcgatcagatcactgaagccttgaactcctgggctcaagcagtcctcctgcctcagcctcctaagtagctgggactacaggcatgcatcgctatgcctggctaatgttttctttttagagatgggtcttgctgtcttgctcaggctggccttgaactcctggcctcaagcagtcctcccactctgaactcccaaagcactgggattgcaggcatgagccactgggcctggcctcttctggtgggataccctaccttgtttccacctgagtgaccctctcctggcagagagagagccggacacactccattttagtttcttcacctgcggccccctttcaccttcctccctgaaggcatagctagtgtaaactgactcaaagcacgtccaggaatgcacctactgataagacattgaggcaagctgcaccagcagctcctggggacacgcgtggtggatggcacccaaaacccctgcatttatctctttgtgatagtttaagcctctgcacctggaactgtttattttttgtaactgcatttgtaaccaattaatttttttaactttttgccagttctgcttccgtaaaaattgcttcagctaaaatcccccctcccctatttagaccacggtataaaaacaaaactagccccttcctcggggccgagagaattttgagcgttagctgcctctcagtcgcggctaataacggactctttaatttgtctcaaagtgtggcgtttctgtataactcgcttggtcacaacactggcttctgatagcagcctgtaatccttggcttgtgggctgcatcgctccagttcctccctccatgccatgctgccttcttttctgtctcaaagcttcctctgcctcacttttaaaaggcccttgagatggcactgagggcctccctgggcaatccaggataatcaccccatctcaagggaatatctgcaaacactcctttcttttctttcctttttttggggggaaggggagacaggatctcactctgttgcccaggctggaatgcagtgcccagcatcttccatagacaatagcattcacaggtcccagggattagggcctgatatctggggcctgctacagccagcatctcagagttcacatgacaaagaagaggccccccagtcctctccaaatctgccccaccccagtcatcttggggatgaatctcccctttccactcttcccaaatgccagggccatccttgattgttctttgtctcctcctccctccacctccagtccgagcccatggtccacccctctcctctgcagcccccgtcctctctcctcacagcacagaatacggacttcacacacataagtcagacgtgccacttcccatccacccctgcttaaacctccaacagccaccaccccccattcattcattcacaatgtttattcagtgtctgtatgtgccagccattgtgtaagcgctgaagagacggatacactggcaggtaaaacagacagaaatccctgccctcatggacctcctggggtgatggacaataagcagggtaaataagtgtattggtggtcacttactgcagagtgacaggttaccccaaatgcagctgcttaaccagcaggcatgcattatctcccagtgtcagccaggcaggactctgggcctttgacacaaagtttcaggaggctgtggtcaagctgccggccgatgatgtggtctcatgggaaggctcagctggggcgtcagcttcccggttcccttgctggccatggtcatccccttagggctgcctcatgtcacacccagcaattcaagagcaattttgtcctattctagttgccagaagcaagtcattaataaagtccagcccaaggggaggggagtgcagaaaagtctaaacccaggagggtataacagggagctagctgccagaataaagcaagccaaagtgtactttctacagtgagaagtgtgaaaaatagggaaatgacaggagagagggatgtgagagctgggcagcatgctgcaatgtcagaacaacaccagggaaggtctcactaaagtgacttttgagtaaagacctgaaggaagcatgtgagtctggggaaaggatgtgccaggcagaaacagcagcatgtgcagaggcccagggggcaggagccaggactgggagtgaactgggaagcaggaggaggtgaggcaggcttgctgtgggagcactccgatatggaagcgtagcttacagacccactggccctccccacagcaccatgctgccaacctggccttcttgccgagccttgaacagaaccattatttatgtggccaggcctccgcctgggatctccctgtccctggtgggagccatcctcttcctcctgccctcatagcacccgctgcagtttctcctggcgcttggccctgcctgagagtgtggtgtctctcctattggatcctagaagctccagggagtcagagaccttgtctgttgatcgatatccaggcctaggacaacaggcacgtaggaggagctggaggaataccatgcgcgggacagagagcgcagaagccttcttccctggagatcgctctgtactgtgacttctttttttgtttgtttgagacagagtctcgctctgttgcccaggctggaatgcagtggcgcgatctcggctcactgcaacctccacctccctggttcaagcaattcccctgcctcacaggcgtgcgccaccacacctggctaatttttttgtatttttagtagagacggggtttcaccatgttggccagactggtctcgaactcctgacctcaggcaatctgcccgcctcggcctcccaaagtgctgggattacaggcgtgagtcaccttgccggaccaaccgtaacttcttacgattagagttaggaagcttccggtttgtgtgtgaagacgatggaagggcggggctccaggatgtatccgcagagccacggagggaacctggactcggctggacttggagccggggcgggggcgggagggggcgaggttcgagtggggctgctcgcgggcgcgagggccagagcccgggatcgcgccgtggagcccacgaccggcgaggccagcgctgggggcagggcctctggatccctgacccaggacgccctgctccggcccgccccgcgcactaaactcggcctctagtcgcctgaagcccgcgcgggtaccgggtccgcgcggcccggcctgtgcctttagccccgccccgaatccccccaccctcataaccccgcccctaaccccgcctccacacacagaccccgcccccaaccagactccgccccgcgcaagctccctaagcccgcgactggcctgcacccggctccggaagtcgttcttccgcgcaggagccctgagcccgcacagccccgcccctcccggcgcccaagccccgccccgccgggttcccgctcgcccggcgccatggatccgctgtcgccgccgctctgcacgctgccgccgggccccgagccgccccgcttcgtgtgctactgcgaaggggaggaaagcggggagggggaccgcggcggcttcaacctctagtgagtgggggtccgcggggaggtaggggtgcagggagctccgcgggcggccccgcctgacaggccttctcccccagcgtgaccgacgccgcggagctttggagcacctgcttcacgccggacagcctggcggccctcgtgggtaactgggcgggtctgggagccgccacacccctccttgcagtgcagatcgtctatggggcgacagacatctgggattccccagaaggctctgacaccctctgcccgccctgtagctgtagtcctcccattggctagggctctggggtcgggcaggtttcgggtgcccccagtgggcctcgggttccaggcagctcgtgacaagcccctgtgctctctagaaagcccgttttggcctgagtgcggctgaggacatcaccccccggttcaggtgagacccaagcagggaggaaggacgggtggggaggaggagggtctgccacagctctccgcacctctcctctcccagggcagcctgtgagcagcaagctgtggctctgactctgcaggaggacagagcatccctgacgctttcaggggggccctcggcactggcctttgacctctccaaggtaccaggcccagaggcagcccccaggctgcgggcgctgacactgggcctggcaaaacgcgtgtggagcctggagcggcgactggcaggtaggattgggggtgggcacctcataccttcactggggtcccctgctcttgcccccactcctggcactgagtggggttcccatgggctttcctccccagctgcagaagagacagctgtcagcccgaggaagagcccccggcctgcagggcctcagctcttcttaccaggtaaggcatgtccgcctgtgactcaagtagggctgtgctctttaacctggaactcagtttccccccaaacaagactcacgctccagagagaatgcctatctattcggagaaggttgtggttgggatgctgccaggttcaggagctgcccctgtcctgttttcccccagacccagatccccagagaggtggccctggacctggagtcaggaggcggtgtccaggagagtcgctcatcaaccccgggttcaagaggtaccctcccacagcccccttcctgcgcccagggtccaatcctggaccccacccctttctccacaccatagtgccatagtgacacccctcttccctcccagtaagaaaccagctggtggcgtggacttcgatgagacctgaaggtgcagcacaagcgtggccccgcggggagtccgcctatgaggggagaggcagtctttgaggcccccatcagagaccccccgccaccacctccacctgcctgtcctgggccaggactaacacggctcctcaaattccttccctgtcaaataaacagctcccttggttggaggctctggtggggctctgactcctggcactggcctgggaagggatcagggaacacccctgggcctgtgttctgggtgtagggccacaggatgtgaacagatgctgcagcctctcagctccctggagacttccttgctgggccggagggaggtgagcactctcagaccgtccagctattccagccctgccagcccaggagctgagaggggcccagccaggcagggccagggctccccaaggcttagaactttgttcccaccctcccaggccgcacccaggtagggcacggagccccgtgggaggatgcagacagaagtcccgtgtagaccctgagacactggaagtgccctgcggggaggggagcgcctgccccgggacaggattgaggaatgtgccagcccccatccacctggggcaccccgccccaccccggcctgactggtttgggagcccagtccggtcctggagatccctgaggccaccggttgcaggaggcctggagtctgcgccttcttagcgtggaggatgggaccggcccgacccccggcgctcctgcccctgtggttctgggctatcgggctgagcgtcccaccctggggtttggggatgggaagtgatcccgagacctctggcccttcagatgtcaggacaccctcactcccgacaaagatgcctttattgggcgacagacgcggggtggggcgctagcgggggtgcacggcgggccggtaggccgccaggatctcggcgctgtgcggacacgtgtatttgaactctttctcctgcatcgcgctgtccaggtagcggcgtacgccgcgcagctccgcggggatgggcgcctggcggaagtgcgcgcacaccgtctgcgggcaggatcgcggggcgcggtcaggacctgccgtcccccaggcgcgccgcggtcaccctcccgcccgcccaccttccgtgctcacgtcgacgatgtgcagcttgggcaggaggctgcagtcggccagcgtgagcctgtcgccgtccaggaagcggcggcgggactcgcgcagctgcggctcccccgccagctcgtgctccaggggcgcgcgcaggtagctgtccagcctggcgagggcgcgcagcagctgctggtacagggctagggggcaggcggcgcggtgaggaccaggcccagggcgccctcccgcctgggcacccgaccccctgaccccgcttcaccttcgtcctgcgcgggcaccgggttcttgatgaacgcggagaacttgtggaaaacgtcgttgccggcggtgttggactccctgtaacgaggcgccaggctggggaagctgcgggatgagggggtgggactccattagactgggggcagccccgtcccggccccacagtacccccacagcgccttcctgggctctgtcttgcgcgcgtcctccctgggcccccctcttttcccctcccaccctgccggggctctcactcgggcggccccagcgtctcctccagaaagtcctcgatctgcagcgtgtctgtcttggcgtcgctgtcatagagcaggatgggcagctgcgagccgggggcgaagtccttcagcacgtccggggacctgcgggcagcagcggggtgggaggaggccggcccaccagtgtgcgaggccaggcgggggtccacaggatggggcctcacctgcgcgtgtccaccgtggtgagggtgaaaggtacgcccttgaggagcaggaccatgaagagccgctggcaggaggggcagtgacccacgctctccccgtcctcactcgcctgggtgggtggagcgggggtggggggtcagggctggaagcagacccaggcatcctgccgccaggctgggcgggacccgcctcccactgccagtgggattggagggacgccagggctccagcttggtcggcgcgacttccaagtgcccagtgagggcccttgacttggtccccagaacgtggggaggggggcagagctgctgggagccttgaggcctggggcaggcttggcccctggaatcttgtcagagcctggacagaggccaggcccctgggctcagtccccaaaagctggttgcaggggtggggtgggcctcacaagctgttttctgagtgattcacacatgagactgggcactgtggccaacagcacatcagtcccccaccccagtccccgacctgagagctgatggggctgcctggcccagcaccccccatcctggaacaccgaccgtaagctccactgttggcagcctgcttggtacctccccaccaaggagctctcctccagaagactgggctgggcccaggagccaaggctgggagcaggaccagggccactgacccctctctgggtgactcgctgggtcccactttactcagcctctgtagggctgcctgagtccccctagccacccacaggaaggggctcagacattactgggaggcccaccccacagcctgccacagaaagcaaagcccagaaaagcgcttcctcccagacaccctccccgcagctgagtccgccctgcaccttgacaaacagctggagcttggtctccgccatggtgggagctgccgcggtcaggcgcgggtggggacctggggagctctttaagtctccctgtgcgccccgccctccctggccgaggggcccgccccgtggagccacctaggcgggcagatgaagctgcccagcgcgcagaaccagctgcctgagcaacgccagcccggccccggggtgtctgagcctgagggtgtgacctcagggtggcggaatggtgtggggggctgccctggacttgagtctggtgtgcacggagatccgcccacccggtactgagtgtgctgggagccagcgtggtgggtggagaccagggggcagggcatagggagagcctacaggccagaagggtgcagggggtgtcacctgggaagggggcggctctgggtcaggaccacctccaccgtgaacccagctcagaccctgccctatggctctcccttccgcaaataccccttgtcagggctcccagcccagaaagccagtgggtgtgggtgagcaggagaaatggcctgcccagcctggcttcagttccccatctgcagcaccagggcatcgggagggtgataagcccacctgggggagccgccccttcccagctacggagcagtcaggcagggccctccccgctcagggcagggctcaaattccagacctgcccgcaacagggcggggaggccagcctggctttggtgtttggccggcagtgcaggtctccaccccacctcccatccctcccactggcgctcagcgcaggtttcttacccccaaccccttaacctttaaaaagaagcagcaggagaggggttagaagccacagcctgcgtggctggaagaaagaggccaggggagggtggtggtccacaggtgtgagcctgcgctgagcctcctggcgtgattggaacccacagttcagtctggccctttggggtcgccaactgtgccttcctcccacctggccctgacgctttagggtgcagccccagggaggtacaccgaggggagattccacccagagacctggggtgcccacaggattggcctggccacacctcccccaggcggtgtggtgcctcaccagcctggacagggcagctgaggtggcactgctctcctgctcaccttctccccagggccttggtacgggcccctcatccgtccccggtggaacacactccagtgctgccccagtcagcccagcctgatgcttctctggataccacgccagtcggggctcctggacacagagccttggaaataccatgtggctgccccatcctttggtgtcctgaacctcaatttccctccatccggcctccacctcgattccaagccctagtatttcagctctttctggacactgtggttatagctccgcttgctggtttcccacatccctggcaggcaaatggccaaccacagagaagccccaggcccccagccccctctgctgccccggcatcctgtgtctttaacaccgacagacgcaccctcacaaacccacaggaaaaatgacggcacggacagaggccgtgaaccggtggctcagaaggaaaaagaaaacaagacacaggaagaccattcacctcacgcccgtctcaagaaacaaaccaacaagactcggttcaccgctgcagcggccccactgcgttctgtgggcgtgggctgtggactgtggagcggcagtggccatccaacacccccctgtgccctcgccacctgggaatcagcccggtggcttccttttttttttatggtttaatcaattcatttatttactagaaacagggtcctgccatgttgcccaggctggtctccacctcatgggctcaagtgacccacctgccttggtctcccacagtgctggaactacaggcgcgagctgccacacccggccggtttccctgtgaagggcaagtgagtgctggctgccccactgcgtggcgtggcgtggcgtggcgtggctccgtggcacggccaccaccctgtctatgggagactccagttgtgtccagggagaaggacggaaaaggtgactccatgcatgcccactgcagggagggcctgagattaggtaaatggcgtggcttgtgtccccttaaatttaaattcttaggctggagtcctaacccctagtgcctcagaatgtgaccttatatgggccgggcacggtgactcatgcctgtaatcccagcagtctgggaggccgaggggggtggatcacctgaggtcaggagtttgagaccagcctgaccaacatggtgaaaccccgtctctactaaaaatacaaaaattagccaggcatagtggcaggcacctgtaatcccagctactcgggaagctgaggcaggagaagtgcttgaacccgggagacagagttgcagtgagcagagatagtgccactgcattccagcctgggcaacagagcaagactccatcttggaaaaaaaataaagaatgtgaccttatgtggaaacaggggctttttaacattttttttgagacagagtcttgctctgttgcccaggctggaatgcagtggtgcaatctcggctcactgcaacttctgcctcctgggttcaagcaattctactttctcagcctctggagtagctgggattacaggtacacgtcaccacgctgagctttttttttttttccttgtatttgtagtagagacagggtttcaccatgttgatcaggctggtctcgaactcctgacctcagaagatctacccaccttggcctcccaaaatgctgggaatacaggtgtgagccaccgcacccggctgaaatagggtctttatagaagttatcaagttaaaatgtggtgagtaggatgtgccctgatccaatatgactgatgtcagtatagaaaggcgagtttggacacagatgcacagggagggccgcaggcagaaatcagggtggcacatctgtaagcctgggagccaagcggatgctctccaaggcccttgggaggaagcagccctgcccaagcctaggtgctatgtctgacctccagactgctaggcagtgagcttctgttttttttgttttttttttttaatgagatgcagtcttgctctgtcgcccaggctggagtgcagtggcacaatctcggctcactgcaagttctgcctccccaggttcacgccattctcctgtctcagcctcccaagtagctgggactacaggcgcccgctaccacacctggctaatttttgtatttttagtagagacggggtttcactgcgttagccaggatggtctcgatctcctgacctcgtgatccgctcgcctcggcctcccaaagtgctgggattacaggcgtgagctcccgcgccccgcggtgttgttgttttaagatggagtctcactgtcacccaggctggagtgcaatggctcaatctcggctcattgcaacccgcgcctcaccggctgaagcgattctcctgccccagcctcccgagtagctgggattacaggcgcccaccaccacgcctggctaatttttgtatttttagtagagacggggtttcaccatgttggtcaggctggtctcaaactcctgacctcaagtgatccgcccacctcggcctcccaaagtcagtttctgttgttttaaacccctcactttgtggtcctttgcatggcagcgccagcaagctaataagtaaagcagggagaagccaggaaatggaagaaaatcagcattaggatctgtcattctgagtctctacttgaacagagctgaaaaaagacgcaaggagctgtctgtgggatgacccctgacaggcagaaacaggctttcagttttgcttcctgtctgtccacactgtttgcattttctaccacatttttgtaataccacattttctaccacaatttcataatgttttgaagtaagaacagtatcacagccactaaccttaactagaccctggtccccgaggccacggggttatccctaaacctcccgtcccctgcagcccctgctcctgattcatagagccagcgttagaggggcccaagctgaggtcccgaggctgctgctctgggactgactgactggtgggttagaactctctccctccccaacacccctccctgtaggccccttccaaggggctctttttttttttttttttttttttttttgagacagggtttcactctgtcacccaggctggagtgcaatggcgcagtcatagctcactgcagcctccacctcctgggctccagtgatcctcctgcctccgcctgcacagggccacaccccagtgacatttgagcagctctgttctgaagggagacacacacctgtttggggggccggagggctgggggcattggggtattggtgcaaacttgtgcagagatttatctgctctgtgcatggagagagcctagaagcagtgagacctcgggagcggtgagacctcgggggcggcgagacatcgggggcggcgtgacctcgggggcggcgagacctcgggggcggcgggacctcgggggcggcgggacctcgggggcagcgagacctcgggagcagtgtgcagaccagagctcagattctggtcccaaagcccatcttccctaaaaggaaccagggttctgctagggactgaatgtgtcctccccaaaatttgtgtgttgaaaccctggcccctaggccaggcacatggctcacgcctgtaatcccagcactttgggaggccgaggtgagtggatcacctgaggttgggagttccagaccagccagaccaaaatggggaaaccctgtctctactaaaaatgcaaaattagccgggcgtggtggcacatgcctgtaatcccagctactcgggaggctaaggcaggagaatcgcttgaacctgggaggcaaagtttccggtgagccgagatcactccattgcactccagcctgggtgacaaagcgagactctgtctcaaaaaaaaaaaaaaaaacaaaacaaaaccctgtctcctgcaaggtgatggtgttaagaagtggggttggctgggcgcggtggctcaagcctgtaatcccagcaccttgggaggccgaggcaggcggatcacaaggtcaggagatcgagaccatcctggctaacatggtgaaaccccatctctactaaaaatacaaaaaattagccgggcgtggtgtcaggcgcctgtagtcccagctactcaggaggctgaggcaggagaatggcatgaacccaggaggcggagcttgcagtgagccaagattgcgccactgcactccagcctggtgacagatcgagactcaaaaaaaaaaaaaaaaaaaagaagcggggtcttttggaggtgggtaggtcatgaaggtgacaccctcgagatgaccagaatcagcgccctcataaaagggaccccggagagctccctcgctcctcctgccaggtgaggagtcaagggaagtccacaacccagaagagccctcgccagaacccagccatgctggcgtcccgacctcggacttcgagcctccagagctgtgaggcatgaatgccacccgtccagggtcctttgcacagcagtcctggtcggactgagacaggctccttggagagaggctgattccaggtgtggggcagggaaggcagggacgcactcaaaacacatcaggagctggttacgaagacacagaagccgtgctggaggggcgcctgctggaggggcaccgctggctggacctcaggccatctgagcataagacaacagtggattgtgcgttatgaatggttaacgtgataaatgttacatagattttaccaccatcaaaaaattttaaaagagccagatgcagtggctcacccctgtaatcccaacactctgggaggctgaagtgggagaatcccttgagctcaggagttgaagaccagcctgggcaatatagcaagaccctatctatacaaaaataaaaataaaaattagtcgtgtgtggtggcacatgcctgtaaggaggctgaggcaggaggatcacttgagcccaggagttggaggctgcagtgagctatgattgcaccaccacactccagcctgggtgacagagcaagaccctgtctcaaaataagtaattaaaagatgacagtaatgcatgttaacacattaatttttttaaacctgcaagtctgtactgatagactttttaaagtggaggggcccttggtgagagagaaatgccagccagtagatgcagaaatggaatagaggcaggaaatggccattttgcagctgctggccctgggtgacgggggtcggggggcgcggccacgcagcacccagattgcgttcccacatctaagggagggagaactgggcctcaaccaggcggccacattcagcatcacctgctgagggacagatggacacctggaggtgaccgacacagcgtgtcccagtgctgctccggccaaaaatgtccaacctgcatccagccaggaggaaatgaagacacatccagagctcagcctgggcctgcggagcctgtccccctggaagggcaagaacgccaaggctggggacggctcagaggggccccggggaaggcagcaagacacaaggagtgcctcgtggttggatcctggatttttatttcctttttttgtttgtttgtttgagacagagtctcactctgtcgctgaggctggaatgcagtggcacaacctcagctcaccgcaacctccacctcccaggttcaagcgattctcctgcctcagcctcccgagtagctgggattacaggcatgtgccaccacacccggctaattttgtattttcagtagagacagggtttctccatattggtcagcctggtcttgaactcccaacctcaagtgatccacccgcctcggcctctcaaagtgctgggattacaggtgtgagcaaccatgcccagccttttctttctttcttttttttttttttttgagacggagtctcactctgtcacccaggctggagcgctgctcactgcaacctccgcctcccagattctagtgattctcctgcctcagtctcccatgtagctgggattacaggcgctacaatgcccagctaattttgtatatttagtagagatggggtttcgccatgttggccaagctgaactcctgatttcaggtgacctgcctacctcagcctctcaaagtgctgggatgacaggcttgagccacagcacctggctgatcctggttttttggaaaaactctaaagagcatgcctagggccgggtgcagtggctcacatctgtcatcccagcactttgggaggccgaggctgggagatcacctgaggttgggagttcgagaccagcctggccaacatggtgaaacccccatctctactaaaaatacaaaaattggtcaggcacggtggctcacgcctgcaatctcaacactttgagaggccgaggctaggcgatcacctgaggtcaggagttcaagaccagcctggccaacatggtgaaaccccatctctactaaaaatacaaaaattggctgggcatggtggcacacatctgtaatcccaacactttgagaggccaaggctgggtgatcacctgaggtcaggagttcgagactgtgggcggcaagctacccaggcaccaaggcaagagaccgaggacatgagctgttccagtataataaaatataaaacaagaatagttataccagatatagaacttagatatgattatatatgaatatcattaatcattagtttgtagcaattactttttattccaatattataataatcctcgctctataatcatagcctaggaaaaaccaggccatacagagataggagctgaggggacatagtgaggtgtgaccggaagacaagagtgcgagccttctgttatgcccggacagggccaccagagggctccttggtctagcggtgacgccagcgtctgggaagacgcccgttgccaggcggaccgtggtccagcggtagcaaaaggtgtcaaggaacaacacccgctacttagcagaccaggaaagggagtctccctgtccccgggggagtttagagaagactctgctccacctcttgtggagggcctgacatcagtcagacctgcccgcagttatccggaggcctaaccgtctcctgtgatgctgtgcttcagtggtcacgctcctagtccgccttcatgttccatcctgtacacctggctctgccttctagatagcagtagtcaattagtgaaaatactaatagtccctgatatgcagaaataatggcataagctgtctttctctctgtctcttctctctctctctgccttggctgccaggcagggaagggcccccgtccagtggacacgtgacccacgtgaccttacctatcattggagatggctcacactccttatcctgccccttctgccttgtatccaataaataacagtgcagccagacattcggggccactactggtctccacgcattggtgttagtggtcccccgggcccagctgtcttttatctctttgtcttgtgtctttatttctacactgtctcgtcaccgcacatggggagagacccaccgaccctgtggggctggtccctacacgagaccaacctggccaacatggtgaaaccccatctctactaaaaatacaaaaattggccaggcgcggtggttcacacctgtcatcccagcactttggaaggctgaggctggggcaatcacctgaggtcaggagttagagaccagcctggccaacatggtgaaacctcatctctactaaaaacacacacacacacacaaaaatcagccgggcatggtgatgcgcgcctgtagtcctagctacgcaggaggctgaggcaggagaatggtgtgaacccgggaggcggagcttgcagtgagccgagattgtgccccactccagcctgggcaagagagtgagactccgtctcctcaaacaaataataataaaaaataaaaaagggcatgcctgggccaccggggccctgaaaagccttgctgtaccctttgttaactctgggctaccctggcggctcttgggggaaggaggctgcagggccggggctggcaggtcacagctgcttgctttcacatggggcagcacaaaagtgggtagagcgacggtgcgtgtggcaagatttcacaggcgcatcggctgaagatgcggcgtgcgctctgctattctcgcaactttcctgaaagtttaaaatgttctttttgctgttgttttgagacagagtctcactctgtcatccaggctggagtgcaatggcacgatcttggctcactgcagcctctacctgccaggttcaagtgattcttctgcctcagcctcccgagcagctgggaatacaggcgcccaccaccacacccagctaatttttgtagttttagtagagatggggtttcaccatgttggccaggctggtctcgaactcctgacctcagatgatccacctgcctcggcctcccgaagtgctgggattacaggcgtgagccaccgtgctcggcggaaaatgttctgaggaagatgctggggggtgtgtttgctttcaatgctgcattacacatcatgaaaatgaaacctctagggacgatgcccccgtgaactgtgtcagtctgtgggcggctgtccaggtccagcctggcctggtcctgcgcgcagggtctccctgggcctcggctgggccgtgttcctttctcgacctctttctgccatgattcagcccctacagttgcaggacggaggctgctgcggcctcctgccttctggcggctcccccacgcatttcccttggccgaccaccaaacccacaccagcccctccagtgagccactgttcctctcggttcttccagagtgaaccgcccccagggcccaggacagcttcaccccagtgacccagcctctcagggactccagcatggtcatcccactgcctctcaggtggtcacagtgagtgcctcataggaacccaagtggatgtgttggcccagcccacccagtgccctcaagcccatgggcccctcccctgttgtcccccatgtggcaccagccctcagtgagtccaccctctaccctcctgaggagccttgaaacggcctaaggcaagagtctgaacttggcccagatcacggggcgtgagctctgggggccattcatgcccctcccccatctcctgcccacagtgtgccaggctccaccgctgatgagcctcaaagcttccaggtcctgcctccctggggccttggcctgtgccctgccctctggctgggatgcccttcccttaaggaatcttcacagacttcggtctcctcctggaggtcgcctcttcctggaagccctcgctgtcccttccatgacacggagacagcctagcccaggctgctgcaggccccacgtgggcagcaaggggtgaaggaggcttagagagggcaggtggacgggaagatgaaggctaaggggaagggggccgggagcaacccctgagggtgggatgagggggacagtgaaccatggtgaaccaccctgcctcagtttccctcctccagaccgacccagccaccccctgccagcacctgtgcctgaggggcagggccttctggagcgctaacccacctgatgcgcccatcctccccacccttcccaacccacacacgcagacccgcagacattttgtttatttatttaaaacaaacatctgtgcgctatgtacaggcccggctcccagggaggtgggcgggcagggggccaagctgggtgggagagcgatggcagctgggggttggggggggtctggccccttgcctggccagcagggtcagcttctccattcctgccacctgccagctggcccaagctgatggcttcccgcaggacagccacctccctgcaggagagcagggccagaggagcctcttctcaaagcaaaataaatacgggactgacccagctccgcccacagcccgctctcggcatcagccttcatcgtaagagagaaaagctggttccgaggccgggcaggagaaaggccagcagtgcctggtccagccggcgtcgccttgggcggtgagcagtgccaggcaggggcgaggggccgggcagaccccgaggctttaaggcaaagcagggcaagggtgtacgcagcccgggccgggtcagcctttggcacaattaggggcggcaaccgcagtgaccacagggcatggccgagtacaggggctggaggaccagaagccccttggtcctgaacctccactccaggccctggcaggcactgggggacttctgtccccattgttgagtccctggcccagctctgggtggtcagtggagcgtgtcctccctggcccagctctgggtggtcagcagagcgtgtccgtgttgaaggacagctgggcctgtgcacaggggaggtcaggcttatggggcatcctgtgccaccccctgctggggctgaggacacttgtgctggcccgccccggccctcctgcaggctgggcctggacgcagggtctccccacgagctccctctgtgtctgggctctcccgggcctccgtctgccgagtctgggggccactgagtctacatcggtcccctgttccccggctctggtcccctctgccccacccttgctctgtgcccctcaaagactctagcaagtctggaccatgcagttacgtctctccaggcctatctgcaagtgtccctcgcccactctgcccccttgacctctggacagcaagcatcctggggccagttctcccccgaccccacccgcggctggagccaccaggcagcctgggtccagtgggcagagccctggacagccatgagagcagcctgctcacccgctcctcctcgaagctgatgaggccctcgtcctccgtgtccaggtcctcgggctcgtctgccacaagtgcccggagctccgtgggggcagaccggggccggagcaggctgagcaagcagccgagaggggactgcagtgcggatggcggctccgtctcctgctgctccaggttgtcactctgcttcttggcaaagttcacgaacacctggtgggtggcgcaggcgtgtggggagggggctggtctggggtgaggaggggcagggcgggtgaggggaggggcaggtgtggtgcgcagtgcccttggggcgctcacattgtccagtgtggtctggctgaccgagtagtcctcgatgcccagcacgccagacacctgctccatcttgctgaacacctgggccagcgagatgtgctccgacttgagctggtactgcacctttgtgtggtgccgctcctgcagggggggaggtcagaggcctggcagcgcccccccaccccgtagcgccccctccacaaccctgcccgggacggcgcaccttgagcatggcttccgggaagttgcggttgaagaaccgcaccacgtccttcacactctggctgctcttggtccgcaccgtgatcatgtagccatctccaaacctggtgggacaggccggtggcccggagccctgcgccgcccagccagagccccagccccccagcctcccagccctacagcccccacaggcaccccaggaagccccatagcctcccacagccccccaaccccacagcccccacagccctccaggctcctcccctggccccactgccccagtccccccagccccagtgcccccagcccccctggccccacagccctcacagccctgcagccacccccactcctggccccgctgcctggccgccccccccgggcccgccccagcccacccctggccctgccccggctcaccggttcttcaggtgctggatgctgcccaggcaccgcaggcgaccgttcaccatgatggccagccgcgtgcacagcgcctcgcactcctccatgctgtgggacatgcacaggctggcaccggaaggggtgctgtggggtgggggcacaaagagggggtgggggcgccctcacctgtgtgatgtcagcaccactgaacgccctgtcttgatgaggtcaaggatgaggttccagaggaagcgccgggccttggggtccatgcctgtggtgggctcgtcctggggatgggtggcaggctcagctgctgccaggcccacacaccccagcctgaacgctgcccctgcccgtgctcaccaggaagtcaaaggccaggcagccaccccccacccacccaggacttaccaggaagatgaaggctgggtacccaatgagggcgatggccgtggagagcttccgcttgttgccgccgctgtaggtgccagccggcttgtctgcgtacttggtcagctccagcttctccagagcccacttcaccacctggccagggaacgcaggtgtcagtggaggcagggccacccagcgtgctgactccctgccccgccccacagatcctcacccgggcctcgtccttccaggagatcccacgcagccgcgtgtacagctgcaggtgctcccgggccgtgagctcgtcgaacagcgcgtcacactgcgggcagtagccgaggctctgctgcacctggagcagctccttcagcacgctggggacacggcagctgtcagcgcgtgaggacgcggcggccccgcccacccagggctcccgccccacctgtgtccattgacgaaggcctcgccccccgtcgtgctctcgtcgccggtcagcatcttgaaggtgctggtcttgcccgcaccgttgacgcccaggagcccgaagcactcgccaggacgcacacccaggcacaggcggtcaacggccaggatacggccaatcttccgggacttgtagacctggccaggagcctgcccactcagcggggcatcctgcccccaccctgcccctctggccccaccccacccagaccctgccccacctccagagcccagggggccacgtgccccacagccccaccccatgcaggccccacccccagagctcagggccctgcccacccaggctccacctccactgctggggccccacccccctggccctggcctaccccacccaggccccaccctacatgcccagagcccaccttggtcaggttctcaatcttgaccatgtcattgtcggcgtctccccggagcactcgctgccgctcactggccacgtccacatcatcctccacaggcttggtagacacaggcatgcgccttgggggacagggtggacagtgtccagcagctcgccacccccactgcccctccctgccaccagcctcgcatcctctggctgtggcatgtaagaagggtgggcaggcccctctgctgtcccctgcctcaccccctcctgccccatccctgcccccacccccgcccctaccctgccccacccccgaacccatccctgctcccgccccgcccccgccccaccccgccccccactcactgtggccgccgcaggaagttgtactggcacatgatggtcaggaggaagcccacgacgccctcaaccgccatggccaccagtccgcgggtgacaatgtcccactcgaacggggacttcatcttgtcaaactggcctgcggggagacagctcagggcctgtgctctgggccttgcggggcccccaccgccttccccgccccacgggccccctcaccaatcttggcgtagtactcgttgatgtactcgttgtaggccatctccatgagcccgtggcccaggttgtagttggggaaaatgaggaagcagcttttcaggtaactgttgacaaccttcaggtcctgcggggtggccggggtcaggggcacaggggtggccggggtgaggggcacagcctccgcagggtccgccacccccaccatgtcgtcaccgccccaccttgtcgtgctcgaagagctgtagcaggaaggtggccacggtggcggtgatgccgatgaagagattgatgacaatgaggaacacgtaggcggagctggggacctcgaaccagaaggaggccgggtacatgatgggcgtgatggaccacctgcgggcaggtggcgggcagtggtcaccaggcagccccggtcccacctgaggccgctcccccctccgcttccgcttacccatagagcaggaagagggagaggacggcagggaagttggtgggcgacgtgtaggccggcaggtcgaacacaaacaggatgatgacacagcaggtagcggggaccaggtagttgagctgcaggggtgggggcggctggtgagagacccggggcagggcggggatgggggatgagaagggccggggcaccccatggccacgccgggcgcaccatgtcccacacgtagttcgccagccagtagatgatggggttgcagccgctgacaaactgcaggtgcttggccttggtggacttctcggccacgaggaagacaacgaagctggccggcacgaaggacatggccacgatgatgaagatggcgatgacgacatccgtgccctgcagcctggggcaaggaagccctcagtcctcacggccggggctgcagtgcccacctgccccacctcatcccccactggccacacttacaggtaatccagggagaggctggcgctggtcttattcatggggtggttggtgacggtgatgcctgcacacggcggggcgggggcggcagcttcaggccccagctcctccccgccccggccccagctcctccccgccccgccccgccctgcctatgtcagctcaccgtaagccgccgggttgcccttgctcttgggcaggttggcacgcaggatggcgttgttgaggctgttgaggtaggtgggcatgctgtgatagcccttgttgttgtagaaaacctgcagaaggaagaggacacagaaaggccccaggacctcagacctgggtccctgcagacctcgggcggcgctacacacagcggggcccaggcccgcagcctcgctcacctgggcagccctgcgcaccgcgatcttccgcaccatgggtggggccctggtgccaaatgaggctgggatggacttcaggacgtttccaaaggtgatggccccatacctgggcaggcaggtgggaggggcggtgaggctaggcaggcagtgaggctagaggggcaggagttgagactaggtggctggtggccggccaccctcacccacagcctccccacccagctcaccggtgcagtcggaagcggtcggaggtgaagagcaggtactcagagacattgtggccggtgatgtcggtcaggatgtcgcctgtgaccacccgcatctggggcgggtgcccgcccacactgctggggcaggagaagccggtgccctgcgcagagcaggtgcagcggacgggctcccgtaccaggcgcggcagggagggtgccgacgtccacatttctgtgggcacagcatggtgcggtgagaaggacccctcactgcccctgcccccccagcaggccccctgaaccactacctggcccagcggtgggcggcagggagacgttccaggcctgcaggtcctcatccggggacgctggcgagtcagatggggcgggcgagggtgggggtggcacgaaattggacagtggcagcccctgtgtgaaggactccagacacatgctgtcgaagaaccgagccgccagcaggcgcgactccccgctgctcaggttcaacgtgggccccagcgagccgttggcgggagacttgagcacgcaggtggcacccacccccgacggcagccggaacgtgctcacgagctgctgggggctggcgtcgggcgatagccgcagcctgcgggcaccgacagtgtgaggtggggctgccagtctccgcccctcgccagccccgccccctcgcccgcctggcccaccaaggctgtccccgccccttcactcgccccacccaccaaggctgcccccgctggaggcctcaccggtactcgcggcgctcctcgttggcgtaggggatgaaattgccacggggctgggtgtagttgtggtactgggaaggtgacaggaccagcgggggcagatcacctggcagggcgagcagggaggcctgagcaggttctgccctctggccagcggcccccaagcctcggtccccttcccccaaccccaagggatccacgcctggggtctgggacccgaggagacaggactcccggatgaaccccggtgcgtgcccagcctcaggtgtggggtgaggcccagagtcaggaagctcaggagtgggcatcatcagggctcccagcgggcggtggggggaggcaagcccagcacccctgtccagccggtggcctaccaatctccgggacggacagggccacggtcatggccacgcagacgaagaaggctggcagcaagatctgggagaagagtgccttggagttgcggcgggcgcagtggaagcgtttgaccagcagcccgtggaactggcgcaccttcagccacccgccgtccagcttgcggctgccctggccgaccctcgacagggcctctgcctccacctctgtgcagagaggtagaggctgagcaggtggttgcacgctaccctctccctactggctgccctcatgccgctcccccgcaaccctgctccccctcccttgctgtcccagcctcaccctgccacccccaccttgcaggctgacattgtctgggtcctgtgggttatcaaagagggggcggtagtcgccatagacgtcggtgtagccagctccctcgtcgccacgggcagagcccacagatgacgccgactgcagcgatgcctgcgactgggtcagctccgagcaccgggccagattgccagcgtgaccctccccagacgccgggccctccgccccagggagcacatccttcctggactccttcacatctgccgcagtggaagggccgaggggacactcagggctactggcccctaggcctgcccaggacccccatccccggtcttgaccccagttcccaggctcatacacctgtccgggacctctggccaccaggaccacccacctaggaccgcaggctaaccccggggcgtcccctggcttccacccaggaccagggtggcgcccccagacaccaggcaggagtgacagcgcaggcccgagctggggccttgtgggtggggtgggctgagcaagtggtccaggcccctcaccggcctcactgttctccagcgactgatcctcctccgacaccttgaggaacacttcctccagggtcgtgtccatcagcccgaagctgctgaggtgcagtgcatccaggctgcgctccaggtgctgcaggggcggtggagggggaggctgcggcagggacgcccaggcaggagtgcgcccacctccaccacctgcaactgccccccgacccgtgcgccctcacacctggaagaggcgctcgaaagcccccttcttggcggcctcgctgggcaggatgtaggagagctccgtgcttgtgtctgagaccagcaggcaggaggccacatgcttgcggatgaactgggacacctggagctcggagcagctgctcagcggggcccgacctggggggctggatgccagccctggctctgtgggggacgtgggagcaggaaggaattcactcaggggctgggaggagggacccccaatgggaacccaactgggtcaagatatgggcattggagaggaagaaccaggccccagcaggtatcctgggcccagggggtgacgctgaggacccagcctctccaagatacgggcgttgcagagggcgggccaggccccagcaggcatcctgggcccagcgggtgacggtgagggcccagcctctccattgtggattctcaggtgggggtcccggggagaaggtggcccgaagccagctcaggcagcttcaacacagaccttgggggccccccggctcggcgggccgcttgaccagcgtgaggcggtacccgtcgccataggtgcccttgaggaagagcggggagccgcagcacttgagcttcccatgggagatgatggcaatgcggtccccaagcaggtcagcctcatccatgtggtgggtggacagaaggatggtgcggcctaggacaaggccagacccagggtcagggggcaggggaggcgccgcccgcacccctgcccacacggcaccccactcacctggcttgtacttcaggatgaggtcccagatggcgcggcgcgcgtaggggtccacgcccgccgtgggctcgtccaggatgatggcgcgagagccgcccacgaaggcgatggccacggacagcttgcgcttcatgccacccgacaatgtctgcaccagtgagtgccgtttgttggagagctccaggtcctcgatcatcctgggacagggaggtggggcatggggctgctgctatgcagagccccagggcctccgcccacctgccccgccccccgcccagcccacccacttgtccatctctctgcggatctcctcctgagccatgctcttgagccgtgagtagaaccagaggtgttcctccaccgtgagccggtcaaagagcacattgtgctgcgggcacatgcccaggttcttgcggatctcatccatctccgtgcggatgtcgtgcccgtagatggtggcggaacccgacgttggagggaacaggccggtcaggatggacctgggtaggtgggcggggtcatgaccccacgccctctgcaggggccccaccctgccctgactaggactcctgctctggtcagcagatgcccaccgccctgcccctccgacactcacatggtggtggtcttgcccgccccgttgtggcccaagaaggagaccacctggttctcgtagaggttcaggctcagcttgttcagggccagcttcttgtcgtccttgtagaccttggtgagtttgtccacgcagacaaccagaggcaggtgggtgggctcctcctccatgccacgggtctcctctgcaccagggctgtggatcagcagggtgggggcggcgccaaggccacccaggactctgaacccagcgcccaccccagccaccattctgatgccagcctcaccaaagcgccggctctccatggcacaggcctggtcctcctccatgacactgaggcggggggtgcgtgcccacggccagctccactcccaggcttctgtccgcccactgcccagccagtaggacttctgcagtgggaagtaccagggccggggcagcccgtacatgcctgggggtcggggaggggaggggaggctgacctagggcctggggtgaccatccaccacgtgggccacgtgcccacccagggagccacccgtgctgcatccaggagtggacacagactgctggtccccaaccctggctggggacccctgcctctcccctgccctccaagggctggccagtacctgggtgcacagcctcaatgtaccacgtgaggatgccatagaccacggcgtccaccatcagcatggtgacagccaggagcaagttgaagtcgtccccctccaccggggactggctgaaggtgtgccactggatgcccacgccggccacctcatacagcgcgaagtacttagagcccagaccaaaggccgtcgtggacatgagggactgagaaggcagtggtgtcagcacgtggggtggcccggcaccccagccgcccgcctgcccgcgaccctcaccgcgatgcacttctcgaaggccgtgatcttatcatgcgccacctcctctcggatcgccacgtacatgtagggcacgtagctcaggaagtagatgatgccaccgcaggccgaggccagcttggccttggagtacagcacagacaccaggaagctgggtgggcaggggccacgcgcaccgtcatccacccgcacgcccggcctcctgggcaggcccgtgccagggtccagggggctctgagaggatgtggggtgagcttgctgggcaagtgcctgccccaggtccctcctaccatggcccgcgctcaccagaacatgatggtggccaccgcgtagactgccaggaagagccagatgatgaccacgtggctgtgcataagcacctggccgtacttcaggatggcggtgagtgctgtcacggagatggacagctgcacaaagccggtgatgaaccaggccacccagtgcaccgcgttgttcaggcccatggtcttcatcacctgcgggtgggccaggggcttggggcaggccccggggaggacgccgcccctccctgccagcccgcgcctccagggagagtcccggcccgcgcacctccttgagccggtgctccttctccgccacgatgtgctggatggtcatggccacggagtagacccaggagatcaccatgcacagcggcatcatgtgctcaatgacaaacaggaagctgcggggaggccgcgctcaggcgccactcagccccagccccagccccagccccgggcgcccagcactcactcatcgcgtgtgtagcaggggtaggggaacatctgcacgtagctgcctggctccaccacatcgtgccccacaaaagtgtcgatgatggcgcgctccatcatgtctgtgggtgggggcagccatcaggtgccgggcaggccctctcgtcctcacacctgtcctcccccatgaatcctccagccggtcttccgggcctgctcctcaccctggatccagacgaagccgtagaggaagtagaagcggccgccagtattgggcccaggccgccagtaggcgcggcggatctcgttggttttctcggtgaagctggagttctggcggatcttgtagtgcacgtgaggcgggagcgagccgtccttccgggtctggaagatcacacctggggccgggaggttggggcggggccaagatgcaggggcgggaccaaggcgtggtgggggggaaagcaaggcacgggggcggggccaaggtgtgggggcggggacaggagggtccagggaaaggtgggacagggctggggtgggggccccaggggaaaggtgggcagaagtggggaggtgcagggagggggcgggttgtgggttggggccgtttggaaggggcaggggtggggaggggaagtggcgggtgaggggggaaggccagggcgcggccaaggagtgggagggcacagggggacgggtggggctgggctggggaggaagaggtctgtggggggctggggcggggcggggagggcagctcactggcaaaaacagtgacgttgtcctggtaggcctggttgagggtgtagttgacaatgctctcctcgtcgtggaagcccttgaagatgtccacgctcacctagcgggaggggcatcgctggagcccgccgtgggcatgtgcgaggcagggggtgtcgtgggttggctcggaggccccaccgctcaccttggacatgaactggatccagccgcaggccgcgttgtcaatggtatccagctgctgcaggagggccatgccactgggcagcgagaagttgtcctgtctcagggccggcggcagctcatccagtgacaggttcagtgcctcggggtgcagccgcagctctgctacatacttggggtggaggggcggctcagagggggacctgcgcctgccgagccgggcagagaggggctccccacaccacccacagccgcctccctcgcgggcacccttggcacctgctgcagccagcgcaggtgttgctgcagcctgccctgctccaggaagctgcggatctccgccgagatgttgagccagacctgggcatagtgagtcacgttgcccacaaaagcaaaagtctcgttggcctgcagggggtgaggcaggggcatggagtttctggacggacccccaccgacttgggggctctcaccccactcacctccccagtggctggtccattgccaacaactaaccctccccacctttttttttttttttttcctgagacagggtctcagtcacccacgctggagtgcagtggtgcagtcccagctcactgcagcctccacctcccaggctcaagggatcctcccgcctcagccctccaagtagctgggattacaggtgcccaccaccacgcctggctaattttgtatttttggtagagacgggcttccgctatgttgctcgggcttgtctcaaactcctgagctcaagcgatcctcccaccatggcttcccaaagtgctgggatttcaagcgtgagtcccacgcccgggctctccactcctttctgcggcgctcaggtgaaacctgctttgccctccactcccagggcagcacggcctccggacccccaactgcccagctgtgcccaccagctcctttgctggacctgtctccatgtgtcccttaagcacccaatgctccaccctcatctgtcccaccctcatcctagggaccccctctacacccaggattggcctcgtccacaggccctcccctcccaggccaatgtccagccctggcctctgcttgttccagacaggacccctcacccagaacccaaactgcccagctgcccgcccacgagacactctggaaggtctctggacacacccctcctccaccagcactgccctggaccggccacccccagccggaggaccctgccagagcagactctccagtgccttcccacagcagcccctggagctcccgaaaggaaaagcgaccccctggtcccccacctgcagagcctgtgtcccatccgaagctgcaccccgtacccctcccgtgtcaattctgccgacaccctctgcccaggggtcccaggcctgcagagaccccctcccactctgcctgtcaaacatggagcgtcccagacccgtgcaccttgaggatgacgcggtcgacctcagagcccgcaggcgcgtacaggattttggggttgctggtcatgaggtgcacgaggaggcccaggttccgctgctccttgctcgtgaagcccagggagctcatgttgccccgccgcagcgcctcgggttcaatggtgctggggtaggggacagggggccgggccaggccgttagggggcagggccgcgagagtgggaggggcatcgggatggggcaggacttcggggcacagggcagggcgccaaatgagacctccagagccagagcctagattcagggctcacgccctgcccctggctgtcctcctcacccccattcccctgccgcccacctaccggttgttgccacacaagatgggctgcaggccggcccagagctgtacgaaggctgagcactggccctgcagcgtgtccggggtggccagtgctgcagcagagggtgcgccctcctcagcggtggcgttggggcccatgactgcccctgccccagtgccattggccgccccacccgcaccactggctgggggtccgggggtccggccagtgcaggcaccctggggcagtagcagggccagggccgacaggacatccacatcctgcagaaccttctgggcatccagcaggtcccccagaagcgcctgcagcctccgtgggggtggcgcctgtggcgaggagtccgagccgttgggggcatccaggcccagctgaggggaaacaggcacgtgggcagtgcggggtgagatggactgcaggtgggtgataggtcaggagtggagcagggagacagcagcagggagacacaagctaggggtgctgggagggagtctgcagcctgggtaacgggagcccaggacaggagctgggatggtgagcaggagtggggcaccagccatggtgccattggatacccacccacaggcagcatcccacgcacagcctgggcccaggagccctgagctctccaagcggtcccagcccctccttcaactcaggcagcaagcagcgcagcgggcagtgggcaggcagggcctcacctgctgggagaccttggccacgtccagctggttccggagctcagcagacagcccagagaagcgcctggcacgcgcagcagcctgcccactgcagacagcatcccggtagccctgcagggctcccttctgactctcaggcacagtgaggatccggcccagctcccccgagcccggcgtgcaggtgagctgctccaggagggcaggagccagcagcagctcctgggatgggcacaggggtccgtggagccacggcaaggactttgtccccaaccactagggcctcaggcctcaccctgccccacccactggctggctctggggctgcctgggtcccacgacatgcctctacccctcatgcctgccatagacccctgggaccctccccctctcccaggaggagctccaagtcaccaaaggggccctttcctcacccacggagcagaagcacccccagaggcaggcagcactccaggcccatcccacacatggatgccctcacctccatccggaacaggggattgccccctaggcggctccagggctcctgacccttgtggaggccagactgtgaatccagggcagatgagggaccaaagagcaggtggtagacctaggaggtgtgggggaatggctcagatggggtgtggggggcgtggctcagatggtgggggcgtggctccgatggacgtgtgggggcgtggcttagatggtgggggcgtggctcagagagtgggggcgtggctcagatggtgggggcgtggctccgatgtaggtgtgggggcgtggctcagatggtgggggcatggctcagagagtgggggcgtggctcagatggtgggggcaaggttcagacggtctgggcgtgactcaggctgagcatcctgaggatggctcagcaaccagggggcgtggctggggcagaagggagtggccagggctgggagctgtccctgccttacctcgggcgggtccacacgggcggccaagagtgcttgggccgtgctattgggcagcgacaagttttgcgtcaggaaacgccagagctcctgcgggtttctggccaccgagtccagagagaaggaagacactggacaggcaggaaggcgaggctgagaggccgctgcaccttggcaaggtgcccccacatgcgctcggagccgagcccaacaccacagctctgccactgcagcctgtgcgtggctgggaactcagtgcaggtggaggggcccagagtggatgtgggcttcagcccagtgacagcagagctttgcccgcagccctgccccccaacttccctgcacagggcacacctgtggatctgtccaggtggctccccgaggtgcccgggcccgcactgagggcctccagatgctggcgtagggcctcgagctctgagcccaggctgggccgcgctgggtcaaacaggttgccttcctccaccacgcggtccaggcgctcaagcagctgcgtgaccctgcaccatggcggatgtcactcactggatgggctggggaggggtgggtgctccgaggggcgggtgggcactcacgtggagttggcgtactgcaggaagccgaactcgtctcgctggccgtccgggcacagcgattgcatgacaggcaggatgccggcagacgtcaggggcgccgctgtgtagaaggctggcagacccacgggagagggcagggtcgggggtgaaaggggagagagagagagaggaatccagaaggggagggagacagaggccgagaggagaaatttagagaaagtcaggaaggagaagcagcgttagggagaaggcggcacagagccctggccccagctgggctacaggccaagcgttctggggcgaatgactccagcaggtcagaggtcaaagagccactcaccaccccttctgccataactcccagagcattcctttcctttcagccagtgcaggcccacatgccctggcactctccccccgaaaacgtttcaggtgtggcactgcctacagagcccaggggaggacaaaggaccccctctgggcagtgacctctgacctctggccagctggttagcagagtgagtgcaagagcctgaaggagtatgaagggagagtagccaggccgctccagccccagcccaggccagcccagcctcagcccagactcagcccagaagccgaggcaccccagccctagaaggcaaggccaggcagagagatgccgcctcagcttgacccaggcaccagctgtgcctttaggtggccgggcctttcactccctaccacctcccacttcactgcctgccaccccccatctggagccagctgttcctgaggccggcagggggcccgggagggctgttaatgcaagcggggagggcgctcaagccaggacggcccatgggccccccgcagctgctgcccaggccagccaggaggaggtggccgctcacttacagactgcatgccagccgaggacaagagaccatgcggggagggagggggatcaaaacagaacagaggagaccagtgagtgcccacatcaccaggaagaggcgttggcatcatcattcgcggccacaggccagccccgacctccacagcccagccaggaggcacggcccaggaccacacaggggagcaggcaccgcacctcagggactccgggagcaggacacccgtgtgcagatgtgcacacacagcgcaggcgtgcgaggtgccgcgctcccccggctgtgcctggggcctcctgccgcactcaccttccttcacggagatggtgggcttcttctgtcgcagccccagcaggataaagaacagcaccagggggatgaagatctcgaaggccaggacccactggaaagggtgggcccagtgagggataggacagacctgtgctcgcctaggccctccccagcctcccatagggctggcccagcccagacaggaccacgtgctccctggggccagggaaggtgggcacaggcccttcggaaccactgaaggtctgagccccttccagggcactgagggtaaggattgtctggctcagcaaatcaggtttcccgtccccagcccacactgggcctacgtgccctctgaggagcctcagggcctacagggacaaatcggccagcttgtggtctactctgacccatgtatatcccagctcatcttctccctccccacctccagggctacctgggcaaaatcttggggaccatctgagccactagccccgcctacacttcccacactgccccgggttcaccttcctcccacttcctccccaccaataccggggcctggggagatgaggaggcctggttgagaggcttggcctgcgcccagggccctgagcctcggagaagacctggtaaggggtctaacagccccagtccctgaagcaaaggcacctttttttttttttttttttgagacggagtctcactctgtcacccaggctggagcacagtggtgcgatctcagctcactgcaagctccgtcccccaagttcacaccattctcttgcctcagcctctcgagtagctgggactacaggcgcccgccaccatgcccagctaattttttgtatttttagtagagacggggtttcaccgtgttagccaggatggtgtcgatctcctgacctcgtgatccgcccacctgggcgtgagccaccacacctggcccaaaggcacctctttctgccctgtcccctctcctgacccggggcagccagtcttgggccttggagctcagtttccccaggtcggctcctgctaacccaggctgggcaccaaggtgagccctagtgggacctgcgtggagtgagaaagaggtgctttgctcacttcacctgaaaaccaaggactttaccggttcttgtgtcccagcccccagctcagggaggaggaggagcttgagccagctaccctccagagagccctcggcagaccagccctctctgagacccacaggacagaggggccctgccctccctagcccgagggcgagcacccagctcggaggcatcctttgtcctcatccccatcccaaaacccttcagagcccccagtgtgctgtgtggcccgggccgagtccccggtccctggggtgggggcggctgctgtgtttactgtgcttggacaatagggctttgtggccaggaacatcatgctgtgggtgtcccatgcccgccccagcccgtgccagcctccacccgctccctgagccaggacggagcccagggttcgccaaggcactgtgggcaccaacaggcaccagggcgagggtggctgcaggagtgaggcaatgtcagaggcaggggtcacagcacggggcgccagccccgcccacacccggcctgctatgggcactgtaactgcagcaacaggcccggctgcctcccccattgctatagcaacggcctcgcacgagctactgggaggaggaggagagtcctggctggcaggcggcgggcgccacagcagcatctggttacaggcggcagcacaggtctagcacgccctgggtgccccacacaggtgcctccaggtggcccaacctccgtccctcgagaccagcccagtgccttcacatcgcctggaggcctagatgccttctctgggcatgacccctccctgtagctcccgcctactgtgtcggggggagaacaggtgagacccgagggtggcgctgccatctgccatcccagtgacttcatgacagtgaccctgtccctgcaccaagagcagcctgtagcccaagggtagacccaagtccagctaactaagaggagataggccacactcacagacagggaaactgaggcaaagagcttggaggagcctgctagcagcacagaggtccttggcacccaccctccagaccctgagctctgcccagggtggagctctgcccagggtgcacccctgccccagcagggcgcatggcacacagggcaaacctctgtcatccaagcttggccccaagagtccagctctgatgtccaagatccttcccaggaaagtggggacccagcaggagtgtgcccagtgtccagccagccccagccccacatcacaagcctggcaaggactcagcctccctgggggaaacagttccccacctgctccagccatgggctaaggacctccactgtggcccagtgggcctctgggagccctgtagggtggggacccaaaaaggtcctggggggcagcccaaaccagcagctgggagtcactcttgcggtcaggacagtgcacacctcccacctgcttgccagctgccctcataggccacactcccttccctgagcattgtccccactggaacaggggccaccattccagcctctgctcccaagcccagtggggaccttcctgacaaccacccccggggactaatactaatgcatgccacatgccacatccctgttcccttggccctgctctgctgtccccagtgactcaatgccaggggctgcaggcctgatccatgggaccccactcagccagctccaggtgcctggccagggcatgtacctaacccaggctccccgccaaggccaggtgcccaggggaattctgccagccatggtgatgatggccaccccagctgactgcagcctgggtttcctgcagtgcatgttgaaagataaacaggcacggactggtgcagcccaaggggtcccgcccgggccctggctgggcaagaggatgtctgccttaggcccccacctgctctgagccctggcctggacaatcccaagggccttcagaaacctaagctggtccaggcctgtggcctgggaggtgtcccttcccttcccaggctggagccaagctggccagctgggggtatggcaggacacccatatccccaagcccctcgctccacgaaggacttctgtccctgacagccatgtgtcctgcaccctcaggtccactggctgcccaggcagtgctgggaaagccggggttcacagctccaaacagtagacccagcccccagagcaggtggggggaccaggaggcaacagagtggatcaggctcggggagaactgaccccaaaggacaaatgggtgcagagattcaggctggccaaggctggcacaaggacattcccagtggcgagagcatgagcaagggtcacggatgtgccaggaggggaggcggagagatgcctgggaccaacctctatggcaggccgcggcccaagggcaggggaggggtggacggagggaagggacagggtctcctccgggaccccagggaggctgggcccaaggaccatggagcctcgcagctgaatggagccccccaggcctgccttctgtcctgggaaccagggcctccctcgagccagagtcctgagcgccgcttgccccccgcccacagcggccccagcgagcgcgctgcagagggcgcgggtgccgtgactcagccgagcaccgcgatgtcagcggacgcgggaccggactggacacgaccgagccacctccccggaggccgcagcgccggcaggcgagggcagggcccggcggggagggggctcgggcccgcgccgcccccagcgcccgccggggtctgcgcgcgcccggccgtccgcacgtgcgcgcggggagcgcgcctctggccgcggtgcgcgcggcctcgggctgagggcgggcgcgtggggtgggctcaccgggctccggcgtttgagcgtcacgttcttccagagcagcagctgcagctggtgcaggaagcccatggcggggccacgctccgccgcctcagcgccgcggcccgctcctctgcgcgccccgccgggccccgcagcccgccgcgccgctgggcatcgcccgcgcgggggcggggcgctcgggcgtccgggacccgatccgcgctggctccgccccggcggccgcggcgacagcgactctgcccgcgccccgcccgcccccgcttaaaggcgccgcgctccgtccgcgcccgccaggaggcgcccgccgcccgcgccgcgcccgggaccgacccgggcccgagaccctgcgcgcgccgccgccgggaagcctccgggccgcccctcgccgggcgtcacgcgacgcgcccacatcgaatccgagaccccggcttagccttcgtaggccgggggaccctcgggcgctgcgctcttctcccagaggcatccggctgcgcccaccgcgctggcgactctgcagaggcgccccaagccttcactgtccccggggcgcgccgagcggacgctggcgaggggccagctcacccccgtaagggtctcctgtgtgctttgtaaaccagcacttggagtccaggtggtgcccacctggaagggaggcagggcggccaggtgggtccgtcccgcgattccgagcagccagcggaaggggggaaactcgaggccccaggaacgctcgccgtgagcggagcaggcaggggaccgaggcggcccctgctgcacgcggctcgtttttctccccatattcgggcgagtctggtctctgcacagggagttcgggatcaggcggttctgcggctgtggcttggcacctgctggggcgccccgggaggtggggcagttcctccgcgtggcctgtagagagcgacagaggacaggctgaccccatgggtggctctgacggcgcttcccagactcagtttcccccctgtgaatggggtggagtagcgctgtgtggtgtccagtgtcagggcgcacatagaaggcgcatcctcaagtgaatgaagacctccgaggccacagctccccactcctcccagctcctttgcagcaggaaggtgaccctgggctagtgagtgagggatcagcttcccaccccagcccgcagcctcaaggcacttgcttttctctgctcagtccacagggctgggtcagggcaggaagctaccagcaggtctttcccacaagccacagccatgggtgaggggggcttcctgccctcaacctgcccacccctacctggggtagggacaagccctgtgccccagccccgggggcttagcctgttggggccctggtcagcaccacccgtgggttggcctctctcctcctcgccccactctccaccgtccactacaggggctccctggctgcagccgcatccccagtgcctccccagcactggccaccagagggagctacaaggcacaggtcagaccctgtcaccccagacaccctccagcctgcgggcctgggagatgggcgatttcagcctggccaggcctctgacgtccgttccctactcttccccaaccttggcctgttttggtttttgttttgagacagggtctcattctgttgcccaggctggagtgctgtggtgtgatcacggctcactgaagcttcaacctcctgggctcaagccatcctctcacctcagtatcccaagtagctgagaccacaagcgtgagccaccacgccctgctaattcttgtatttttggtagagatgagatttcactacactgcccaggctggtctcgaactcctgggctcatcgccttggccttttgggggacacagaaggctctctgataaggggccgtctggcggaggctgtaggaactggggtagccagtgggcagcccggcacagggagggctctcaggcggagggtgagcaaaggcccagaagtcaggcgacaggaccccccgtggggaacaagcagccccatggccgtgggggcgacatgtcaggggagggcagatgcaggctctgtggccctgcacggaggtgacccatgagacactggccagacccacgaggcactgctcagatgtttattgtccaccgccctccctccctgagcccagaacaagctggtttgctccccgtggtctcctgggccccgccccagcctacacacagggacctcagaactatggacgtggcagggacccgtgcctgtgtctcggggaccacagggcctctgctaccgaggaagctcggggtcccaggtttggcccccacaaacttcaggctggggtgccccccagccccaagggccctgcctttcaccctcttccagccaggccttcacccacccaagatttgttcagggtggggagggtcctcggcagcctttcccctcccgtctgccgcagcaggcacccgttacctccctcccactctcacctcctctgcatgctccagtgcccacctgcaccccccacccctgcttcctgacctctgtgcccagcctcccgttagcccgctgcttgccggtaagggccggatgcctggtggtttgatttcgacacccagcccttccacccacacccacctcccccggccagcggatctcaggcctgaaaccaaccctcaaggtcctcatagacttggctgcggggtaggtgtgggtagcggtcacagatggcacagaaacgttcccgccagtcggtgaacagtcgcacgcggagcctgtcacgccaggcaaagaagcgttggtatcggctctcattcatgccagtgaggaaagccgccagctctcgggctgagccaaagtcatccacatgcacgaaggcgtcagccggcacgaaggcctcataggtggcccgtgggggccccagcaccactggcacagtgccagccaccagtgcgttgcgccagaatttctccgtaatgtagtcgcggtgctgagagttctcaaaggacaggtagaagcggtactgggccacggtgggcaccaggcagctggcgcacagtggccgtccattggcacggccaaagacatccacccgcagatgaggcgccagctgccggtacagcctggcacgcagctgccgctcctggaagttgctgaccacccaggcggccaccctgctcttggctggcagcggtggcgagggcccccagtggggctccaggcggccatagggcacaaagatgtccgagtcgcgccggtagctcagcacccagttgaagatgcctcggaggtggctgaggccgtgggtgtggctaggagactccatggaggcccacacccagggctgccctcgcggccgctgggccaggggcaggtgggaccgccgggtctgcagctcgcggtggtggaagaccacggcgtcggcgctggccagcaggcttcggttggcactcaggtggcagcgggcgatgccgtagcgggtgcaggtgtcgctgggcagctctgggggctggtcagtgaagggccagtgccagacaaggatggtgatcgtgggctggggtgccggggtaccccgaggggctgaccccagcagccacaggagccagagggcagcgagcagagccaccccggccaggacccccaagcctcgcagcctccgggtggggccgtgccctgcagcagcacgagggaggggaggctctgtcacttgggctcagggacatccacacgccccactcagcgccaaccccgtcctcccctcccatgggctcagggacacccacatgccccactcagcgccacccccgtcctcccctcccatgggctcagggacaccgacatgccccactcagcgccacccccgtcctcccctcccaggttgcctagctgtccccagcttgggcctccccgagggccagacactcaccagcattattcatccacagtctcccaggatcagtcagccaagagacccgagattctcaaatcacggcagccgccagaggtgcccctgaaatcacagctacgccctagctcagccccgcctggaactgtgctccttttatctctgcccaaggtgagggaactcaggggaccttcctgctcctgccccgcccctgcccccacaacctttggcatcaaccactgtccccacccccatctcggggacttgctagtcctggggctgctgggaggggtacagccacaagagggatgccaagccagggcaatatgacgcccccacagcccaccccactggtctccagagaggcccagagatgtccagctgggcaggcagaggacagagaggctcgggcaggcttggcccagggcagagaaggcccaggtgcaggcaccctgagcacagatggccccccagcccccacccagctacccaggcctgggcgctgcagacagcgagtgcacttccccagagggccaggtggctcctcccacggcagtatcacccacttcccccagctcaccaccagctgggccctggtctcccaggagaatcttacacattgaagatgtactgtgctcagctctttgccggaagctaaagctcccaattgggccatcccaccccactctgccacctctgccatctaggaacccagatgcccggagaggaggtctgtcctggggcccttagtgtcttcccacaggagcccagcgcgtgcctgcaagggcctggtcccggaatgaactgtggatggaggctgctttgtccttttccccgtccagatccatgcccatagacaccgctgactataggctgggcccagggtcccttcctccagcctgcagcagaggggctttccaggctggaaagggaaggagtccttttgtccctgacgcaagcgggttgggggccagcacccgctccaggaagaggaagggatccagcctgaagtccagactccccgctccctctaagccagggcctggagcctggaggccaggttccttcttctacaccagcccacgttgggtgccagccaggctgggatggccctgcggggtcaccctgagccccagccaaccaacaccccactctcagccacagtgggaggccccatcagcctcttcacccaaccacgttgccactctgctgcacgggaccttgtgtggtcccaggcgtggccagacccagacgtcctggagatctcaatgcaggtcaggcttggtttgtttgtttgtttgtttgtttgttttttgagagggagtcttgcactatcgcccaggctgtaatcccagcattttgggaggccaaggcttgtggatcacctgaagtcaggatcaagtggtgcgatcttggctcactgcaacctccaccttccgggttcaagtgattctcctgtctcagcctcccaagtagctgggattatgggtgcctgccaccacgcccagctaatttttgtatttttagtagagatggggttttcccatgttggccaggctggtctcaaactcctgacttcaggtgatccacaagtttcagcctcccaaagtgttgggattacaggcatgagccaccgcgcccagccaagtttgcttttttgtgtgtgggtttttgttttttgttttttgagacagggtcttgctctgttgcccaggctggagtgcagtggcgcagtcacggtttgctgcagcctcaacctcctgggctcaagcaatgctcccacctcagcctcccaaggagctgggtctatgggtgtgcactaccatgcctggttaattttttaaaattttttgtagaggcagagtcttgttatgttgtccaggctagtttcaaactcctggctcaagcagtcctcccacctcggcctcccaaaatgctgggatgctgggaatgaggacgcgtctgtcctgtcaggtcttttgggggctcagatcgtgtgtcctgggaggaatggcaaccatgaactgttgtccagacctttgccccagcaccctcagagggggcctgcctcccaccacccctgtccctgtcctgttctacttttgggccccaggggctgctggcctctccccggccccacagtgaggacaaggctgccttgggaggggaaccaggcagctggagactgaagtgggaggatcccactgtggggacagaggcaagactgggacagggtggtagtcagaggcccccacccctgtggcgcagtgtagcctctgagctgagctttgctgcggaacttgtgcaacggctggagggaggggggctggagggagggggacttggagggagggggcttgggaggggggctggagagaggggggtttggagggagggggctggagggaggggagcttggaggggagcttggagggaggggggtttggagggaggggtgcctgtgggcgccacgggaaactgtcagtgcctgagctgcttggcttaggggctggcaccagagtgggcagctgcctccagccccgcctttccagcctcccatgttttcggtgatgaccacagtggcacctgggcctttaatcccaccccagcgttcctcctctggcagggggcccccggggagccacaccttggcttcagcctcacaccaccccatctcttctccttgaaacagacacccggcggcagttcctgcaggaaggaggctgtcctgccacgcctgcgggtgacccggcctctggtgccagagcctgccatccttcctgtttgtgctgccaggctggcagggtcccttgccaccgacctcagccgcagccacagcctgctccctccctgggtggatttgaaggagcctcccccaccctccgcccctagcttgctccttgaggaccctgggcagggtggctgccatggggcccaatcgtgcgtgggaacctgcgagctggcaaacggggctcgggggttttgcccagaaatgggtcagaacgaaagcctctcagaggaaagaaaagggcatgagtcaaagagaaagtcggggggcaggggctccccctcatctcaccccacccaggcctcctgactccctgggtttgtgcggacccaggcaggcagccaaccccagctccgtggtgtgtgagcatcgtgatgatcaggacacaagctcttccccgctgagccttcactgtgggccagcttcccggtggatgcccactgaagaggcctcaacccagtgggccccactccagaccaagagcagaccattggccagctgccccctgcagacagcggcacccggggcagcagcaaggtgaggggcacccagccccagccccaggggcgtctcagggagcgggctgagcctggctgtcttcctgagccccacctgcttcatgggttggcttgagcaaggcagtccagatgcgtgtctcgagcgctccctggcggcatgctgcaaagctacatggctccggcaacaaggaagactgcccttattctcagtaacaggtggagctgggggctggagagcccctcggacctcgccttgggaaagctgggtgggtgcacggagcctggcaggtggccaaggggacccccaagtggagggattggtcgaggggcagcacagggtggtgcagtgggtgagctcagcccctcccctccaactctcatcccattga

SEQ ID NO: 47 - DNA, 159650 bp, Homo sapiens
gctttacccaaaccgcttataaggttggggggaaccgagtgcctgtctctccccgcttttttttttgagtggagtctcgctctgtcacccaggctggagcacagtggcgcgatcttggctcactgcaacctcagcctcctgagtagctgggactacaggcgcccgccgccacgcccggctaattttttgtatttttaatagagacggggtttcaccgtgttagccaggatggtcccgaactcctgatctcatgatctgcccacctcggcctcccaaagtgctgagattacaggcgtgagagttgtagttcgttgagagggagacagacctcgaggaaatgcttggtgtgcctgccgggtgactgctcgctctccttgtctgctcactctgcccagtgaatgggtctaggcatcctcattgttcccttcctctgtcctcaacatcagcccaaccctgaccaggccccttcctgaggttcccacacaacaggggctccatgttcagaaggggagagagaaacccacctggggatgctctgtaaggagagcagagcccagtggagtctctgcccgggacgctgagggaggaagagctgcggttaattcaaaaggaagggtgaggtgcaggtattggctggatgatgctcagagaagcaggaagagtgggcatggcactgagtggctgaggccatcactggtggccttggtgcttaggcagaaggagagggcatggtgcagggcgctgaggccgtctgtggctgccttggtggggcttactgagttctagtggacagcaaggtgccagggcagggctggcacatggagggctctgaaggccatgtgtatcgtctgaagtgagggaaacccgtggtagctaaagggaatgcactagccagccccaggtgcgccacattcctgctctaggggctggagggaaacccgtggtagctaaagggaatgcactagccagccccaggtgtgctacgttccgctctcggggctggaggggaacccgtggtagctaaagggagtgcactaggcagccccaggtgtgctacgttcccgctctcggggctggagggaaacccgtggtagctaaagggaatgcactaggcagccccaggtgtgctacgttcccgctctcagggctggaggggaacccgtggtagctaaagggagtgcactagccagctccaggtgtgctacgttccgctctcggggctggaggggaacccgtggtagctatagggagtgcactagccagcctcaggtgtgctacgttcccgctctcggggctggaggggaacccgtggtagctaaagggagtgcactagccagcctcaggtgtgctacgttcccgctctcggggctggaggggaatccgtggtagctatagggagtgcactagccagcctcagatgtgctacgttcccgctctcagggctggaggggaacccgtggtagctaaagggagtgcactagccagctccaggtgtgctacattcccgctctcggggctggaggggaacccgtggtagctaaagggagtgcactagccagccccaggtgtgctacattcccgctctaggggctggtctggcggcatggctctctcctgagtgccttcagagcctgagtgccagcaggcaggcgtctcctgcccagtgggtttggtaagatatatttcagaaggcatccaccactctaaaacatgcttattgcaggaaccatgggggagaccaaagggcctagagccttgagaacctctgaccattagtgttaacaggaaggcagcctgttcccctagctggggagggggttgtgcgtggcaggaagcccgtgcgtctgtgtctctttggagctgtgggttggttgtgtggatgccagctgtgtggtccccagcctcactgagcctgagtttccatactagcggcgggagatgggactagagggtctccaaggctccctgaagctctgcgattctgcttctctgagtcttgaccgcaggtcagtggggacccggcccctcaccatcgcctgctactgatcaccattggtttggttttgtctcgaggactgttctggaattgaggtgtaacgtgctgtgtgttcttccttagggctttgttcgcgggggtcacagctctcatggctgcagctagcgtgaccccccctggctccctggagttgctacagcccggcttctccaagaccctcctggggaccaagctggaagccaagtacctgtgctccgcctgcagaaacgtcctccgcaggcccttccaggcgcagtgtggccaccggtactgctccttctgcctggccagcatcctcaggtgcatggggcctgcaggctgggaggaggggcaggcaggctaggctggttttagagccacgctgcccagcctggtagctcccagcagagccgggtccagcttagatgtgctccagttatcgatactccctggatttcggaggtttaccacaaagaatgtaaaattaataattttaaaatagcaatttgaaatacgattttggatacatggggttaaatatagtacgtcattacagttaattttatctttttattatttttaatgtgagtactggaaagtttaaagtgccacctactgctcactttttggctgctctaggcagctaagacagccgccttccttgcagcgagtggtctgagaggtgtggcctgtgcacatcggcagcagctcggcctgtcgggagagccggcaatacctgagttactgcagcagatgtccttggcggttcaggcgtgccttcctcacaaacggagtgataaaaacagtgtgctgtgaatactggggtttaaaacatgtcctgttaacatttgcctgctgttggtttcactaaggatgagaaagtttaaactgtggtgtggaggtaggtttttgaactgaagcaaatggtgtttgttttttgcattaggtttcacagtgggttgttttttgccttttttccccactagctctgggcctcagaactgtgctgcctgtgttcacgagggcatatatgaagaaggcatttctattttagaaagcagttcggtaagtaaaatgtcttgaagctaaaaatgttgaacagaaaatgtcttaatttcctttacaacatgggtggggctgggcacagtggctcacacctgtaatcccagcactttgggaggcccaggtagggggattgcttgagtccaggagtttgagaccagcctgggcaacatagtgagaccctgtctctacaaaaagcaaaaaacttaccaggggccgggctcagtgtctcacacctgtaatcccagcactttgcagggccaaagtgggtggatcacctgaggtaaggagttcgagaccagcctggcgcacatggtgaaaccccatctctaccagaaatacaaaaaattagccgggtgtggtggcgcacgcctatagtcccagccacttgggaggctgaagtgggaggattgcttgaggctgggaggcggaggttgcagtgagccaagatcgcatgccactgcactccaacctgggttacaaagtgagacccctcctttaaaaaaaaaaaaagaataaagggccgccagaagttgtcccttagcagactcctgaagtttagggtttggaaactttggcatcaaggtgagtccaaaaataaaaaggaatcagagagtcatcctctgctcctggagtggcctggaaaggcgatgtgacgcagtattggttggtttggacgtgtggtctgtgttccttggttgctgcagggagtctgggaggaggtttaacccgagggatattcctctccccaggccttcccagataatgctgcccgcagggaggtggagagcctgccggccgtctgtcccagtgatggatgcacctggaaggggaccctgaaagaatacgaggtaaagatgcctgcgtgtggcatggtgacagaagctccagcagtcgggagtcgtccacgctccccaagcagttatgaccttgtcctgcacgttcctctcactggggctgaagcctgtctgatgtctgtggaggaagagacggagctgctccttagagtatgtccatttagaaactcaagtagtgcagagcacagacctgcaccatggagcttgggctgtgtgacctcgggcgaggtatttaccctctctgtgcctcaggtttcttgtctgtcgatgggggtgcaggatcccaccatcgtggggtggctgtgagggttggaggtgcctgtgtgagccctgggaatgccatggttatctgagcagtagcatttcctgggaatgaaggggagatcgctgtgcaccaggacctgcagctttcaagtttggtgggggtttttgttgtgtctcttgtatccacaaaggattgcttattttgaattgtgttgacactggaaattgcagaaataatggacacacttgtcctgtggtcacagcaacataggcagtggcccgcacttcacttggctgtggtttgtccctgtgtgctgggcgagccgtgcacgccttcctgcactggggatttcagtgtgattctcacgtcaccttttaggcatttggaaacttcacctgtagtgtagaggccaggaggtgccgagagagctcgtcgaggccactacagctcgccaagttatgcagtcttccttcttgtaatgaatgccctttaagaggtttctctctgggatccttgtacaggattcctggagtaacactgtccacagagcccaaaggtagaggcagcccagtgtctgcggatgaatggataaacacgggaagtgtgatctgtgcacacagtgggatatgattcagccttaaaaaggaaggcgattcggacacacacaccccagggatgaactctgaggacagtgtgctgagtgacatgagccagttaccaaaggacagatcctctgtgattccacttaggggccacccttagagtcatcagatccatgggtacaggaagtagaatggaggagacaggggtcattgttcagtgagtaccgagtcatacattggaatgaggcagtaccttgatgccatccaatccagccccaggttggtgaggctgtgagggctgtttgctcagaatcctggctttctgcacttaggggagcttcctgcccgggccagagctgggatctcctgctcagccggaccctggggtgttaccggctgggttggaattggacctgcattactgtgtgtttctcctctcctgctccccgccctgtgagcctggccacgcctccctcttctcctcgcccactccccaccctgtgagcctggccacacctcccacgatcttttgacagactctgctttgtggtctttgggctccaagtttcgttttttcagaagaactgccccagctgtgtctggggtgaacaagatgtgctttcctccctagcacggggattgcgtcctggacacggagcggtagctccagggcactgccctagagtgagactcctacctctgtgggcagagatgccagaccgccctcagccacgacgtgcgatgcaaagctttctaggctcctgtgtggctctgccgcacaaacggctgtggcgcatggcattgtaccccccactccctgctccttgaaagagatgcagcttggtcattgcccagtgctgtctgcaagggagatggctccctggggaggtggcccagggtcagggtctccctgggagggttggggtaccagctggctgcagggagtaggggtgctatgcgccatgccaccctttgagaggactgaggagtgtctgggggacaggtgggataatagtttccagctctgcactggaccctgagtcctctggggtctctgccacctccaggctcatgggatgccacattgacaattatgagggcctccggctgagggccaaggactatagccagcccctggcctggggcgccacgcggtcctgcaggcacgcagggtggaaagtccctggctgcacctttgagagctctggaaagtccctgagaggagccgggtttggtcatgtgggaggggcgggcactgctctggaataacttggctgtggcctttgattttgttgataaaacctctcactggctgtaaatgtcacacatggggacggaaatcaacccgtctatacagttgggagccgctctgcccctcggagccgcctctctttgctctccgggtgctcggagtgtgctgctagttggggccttattgtaaacacagtacggaggctaaggctgcctttcctccttgatggtcggaactttattggaaaaggggaaaatcctgcttagcttttgaatgtttgtcctttgcaatgatgcctttctaggaactgaatgattttatttatttatttttatttttttgagacggtcttgctctgttgtccaggctagagtgcagtggcgtgacctcggctcactgcagcctccacctcccaggttcaagtgattcttctgcctcagcctacaggcgcctgccaccacatccggctaattttttatatttctagtagagatggggttttaccacgttggccaggctggtcttgaactccttacctcaagtgatccatccaccttggcctcccaaagtgctgagattcctggcataagccactgcacctggccaaatcgaataattttaaaactttaggtaaatgttgatggagtgcttgctgagtgccaatagcagaactgaattccccagtgggcccctgagctactcgttctggcagctggatgcgggggtgcggggagactttccagagaggacataggctggctgcacgagcagcggaaaggccaggaaaagccaagtatgctcggcctcatggacattctagtgacattcagagggatgacgactgtatttgcgtcaaatgtgtagtttgaattctggctgaataaatattgatttttttttttttaaactgtgtctgctgtgggtggggagaagactgagacagatggtgctggtgtagatgtatctgctgcaggacaaccctggtcccactggagatttcaagtaccgagtgccaagagaaaggttttttttgtttgtttgtttgttgttttttgcgatggagtctcactctgtcacccagactggagtgcagtggtgcgatctcggctcactgcaagctccgcctcccgggttcacaccattcttcctgcctcagcctcctgagtagctgggactacaggcgcccccaccactcccggctaatttttttgtatttttagtagagatggggtttcaccatgttagccaggatggtctcgatctcctgacctcgtgatccgcctgcctcggcctcccaaagtgctgggattacaggcgtgagccaccgcgcccagccaagaaagattttatttttgacatttcgagcatgcagcgcatctgagcagtgaggctgagagtagaggtgtgccgctgccccacaggcctacatgctgccccgcagcacctgccagccttcgccagcctactttcagcccttcaaccccccacacacatttttttcttttctggcttattttaaagcaaatgaagatgtcatatcatttcacctatgagcattttattactattatttttagaaatagagtctcgctctgttgcctaggctagcgtgtagtggtgggatcatagctcactgcagcctcaaactcctgggctcaagtgatcctcccaccttggtctcctaaagtgctgggattacaggtgggaacccactgtgcccggccattttactatgttttaaagaacagtcttttttatttttatttttttatttatttgagatggagtctcactctgtcgcccaggctggagtgcagtggcacgatcccggctcactgcaagctccacctcccacgttcacgccattcttctgcctcagcctcccgagtagctaggactacaggcgctcaccaccactctcggctaattttttttgtatttttagtagagacggggtttcactgtgttagccaggatggtctcaatctcctgagctcgtgatccacccgcctcggcctcccaaagtgctgggattacaaggcgttagccaccgcgcctggcctaaagaacagtcttttaattaaatctaagaacattgactatttgtgctttcgtttttaggtttcataagccagaatagttgctgaggctcctctttgattcagcttgatggtggcttgttacacactagtgtggccgagggctgggtcctgtcccgtcagtgggtagcagagtgcaaggcgctgttgggttcagggagttggttcctttagcaggcttagcttgggccagtgccgctggaggtcttggagggctgggcccatgttccctggggcgcctctaaggagtagttgctgtgcctgtgtgaaggtttgggaggaacactccctggggaggttgaatggaagccagcccaagtgcctgtgctgtccagagcagggtctcccctcttgggggaagtagcattaacctttcctgagtcacttggggctcctgagctgtagccagctctctatggagctgctgacccccactccccaccccatgaagggccccgcagccaggtcctctgctgccctggcctctcaggaaccttcctctcagcacattgtcctcctctctccgggttgtgcccatcggtacagaatatgctctagtctctcctgtctcaaaacttagtgttgtgctcagtgagctaagctaggcacaagaagataaagactgcgtgaattcactgacagagtccccggagtggtcaaattgagagccaatagatggtgctgggggctggagcaggggaatggggagttagggtttaacagggacagggtttcaggtttctacaatgggaaagcgtgatggaggtagatggtggtgatggttacataacatcagtgaaatgtacttaataccacagaactgtgcacttgaaaatggttaagatgatacattttatgtttatcatgattgaagaaacagcagattttcaacttcctgttcctttgacttccattccctttctctgttcccagtcatagcagacttctcccaaaagacgtgtttaactctggccaggcacaggggctcatgcctgtaatcccagtactttgggaggcttaggtgggcagattgcttgagctcaggagttcaagaccagcctgggtaagatggctctaccgccgggcgcggtggctcacacctgtaatcccagcactttgggaggccaaggcaggtgaatcacgaggtcaggagattgagaccatcctggctaacacggtgaaaccctgtctgtactaaaaatacaaaaaaattagccgggtgtggtggcgggcgcccgtagtcccagctactcaggaggctgaggcagaagaatggcgtgaacccaggaggtggaggttgctggttgcagtgagccgagatcgcgccactgcacgacagagcaagattccatctcaaaacaaaaacaaaaaaccaagatggctctgccaaaaatacaaagaaatttagctgggtgtggtggtgcgtgcctgtattcctatagtcccagctatgtgggtgctgatgtcgaggctgcagtgacctgtattcttacccctgcactccagcctaggtaactgtatcagtccattttcatactactataaagaaatacccgagacttgggtagtttataaagaaaaagaggttgaatggactcatagttccatgtgcctggggaggcctcacaatcatggaggaaggcaaaggaggagaaaggcacgtctcacatggcagcaggcaagagagcatgtgcaggggaactgccctttatcaaaccatcagatcccatgagacttactatcacgagagcagcacgggaaaaacccaccccatgattcaatgacctcccaccaggcccctcccacaacacatggggattatgggagttgcaattcaagatgagatttgggtggggacacagccaaaccatatcagtgacaaagtgagaccctgtctcaaaaaacaaaacaaaacaaaaagccctgtttagttttatttctgtacctcaccagccccttatggaggcaggtgggacctcctgtggcttgggccagaggcctgagagtccttcttgacttctctgtgttcctgtaagcggcacgttcagtctgccggcaggtccacgtggctccccagacacatcctgaatccggccctctctcccgttacactagcacctttgtagtgcctgccaccccgttcttcctcctgtgactgctgcggcttcccaaccttagagtctgtgagaggtgcagctgccaggcagtcctggaagggttcagccacatcccgtcaccttgctgtcctgacccctcacattcgggcagagccctcaagacggtcggggaagccctgcctggggcagcagtgggctggagaggtggctgggttctgcatcctacattcttgattcttcctggcctgggtgtggcgaggagctggcaccgcctcccttccctctgtgtccttttcccttgccaccctggccatctgtggacgtccacagtcctctgcctcgcctgacgcttagcctgcggcaccggctcccgcttccctagtctgcagtctgcatcttgtggcaccttccccggccctgcctccactgcctgccttccctggtgttctggcactggtggtcactaccaggttgtcagctccaggagggcagggcctctgcccagctcctgggtggctcagtgtgtgggaacgtgtaggtgcctgagtgaccttcctgtgtgtcactggccctcgcctgtcttcctcgcagcttcggccctttcagatgcgtgtgctgtgcagctagacccagctcctggcaccttggcctggtgggcttgtgcctcaggcctttgctggcttcctggtgctggaggcagaggccagctgcccgcatgctatctcccgtgcgtgttccctacctcttcacacctcccacctgcaatgaggatggggctgggactggcaagactcagcctggaccgcgttgggcttggtcatcagatcgagcgtggcctgctttctcggttaggagctggtgtgtgtggcagggacccgctggcgcagagcagggactgtgcacttggctgtttcagggggcagatcggggagcctggtggtggcaaggcatccacacagagacccccatggcagagcatcccctcagctcagtgtgcggtgaagagagtggagacgaggacacactgatctgatctcctcctgccctcccacctgtgggagccctgagagctatctgcagagggcggcccccaggaccagcatgcggacaccaagccagcgctacatcgccttgtgtccccgggtgaagctgtggctgcccaaatgtcccacgcgagttctactgacgcttcctcctttcgttgctagagctgccacgaaggccgctgcccgctcatgctgaccgaatgtcccgcgtgcaaaggcctggtccgccttggtgaaaaggagcgccacctggagcacgagtgcccggagagaagcctgagctgccggcattgccgggcaccctgctgcggagcagacgtgaaggtgcgtggggtggagcagcagcctgtgtggctgcagccatgcggggctgagctggggagctgcgtgctggccactgcggctgcgtcggcccctttgcactcgttccaccccctcggccctttccctggagacacgcgggcggatgtttcttggcagaactgggaatgggtgtgaagttaatgccgaggcctttcaaaagcatttttgtaagccgggcacggcggctcacgcctgtaatcccagcgctttgggaggctgaggcgggcggatcacgaggtccggagttgaagaccagcctggccaacatggtgaaaccccgtctctactaaaaatgcaaaaagttagccaggagtggccaggtgcggcggttcatgcctgtaatcccagcactttgggaggccgaggcgggcagatcacgaggtcaggagctcgagaccatcctggctaacatggtgaaaccctgtctctactaaaaatacaaaaacaaaattagctgggcatggtggcgggcgcctgcagtcccagctactcaggaggctaaggcgggagaatggcgtgaacccaggaggcggagcttgcagtgagccgagattgcgccactgcactccagcccaggcgacagagcgagattccgtctcggaaaaaaaaaaaaaaaaaaaagccaggcacggtggcgagtgcctgtaattccagctactcgggaggctgaggcaggagaattgcttgaacccaggaggcagaggttgcagcgagccaagactgcaccactgcacactagcctgggcaacagaggaagactctgtctcaaaaaaaaaaaaaagaaaaaaaatttttaaaaaaagtttgtttttaggacaaaaaagcatttttgtcttagaaaagtctaaatgcatcaggtagagagtgcggtggtgggtgtgcgtccgtcctcgccaggcctgggctttgctctcaagacagttgctcaagtctgacttcgccttccccaaagcgttggtgagaatagcgccatgtctgagatgcagctgtgactgctcacatggcctgcagcctgtgtctgcgtccctgttgtctgtctttgccttggtgtatctgaatcacgatccatacagggttcctgcctttggtggaaatgtctctgggtctctctctgcctctggggcccatggcatcttttttcctgggctcttgtccttcaggagccccacttccctgagacccatctgcacttccctgtaaactgtcagatggacgggcctgaccatagcacatctggggtgccaagccctccgcagcagcatgtcagggtctgtcttggagacgtcccgcatgccgccagccctgcccatccgccaggccctcccaccggcctcgcctcccagcgggagcagcgtttccccatcttcaccggggccgttgtttcacgtggcttccaaatctcctctggtggcttgggtctccctcgcattgccctgagctggcagaacaaacaaagcgttaagatctccgaggctcctgggtggtgctggcaggatcctgcccgggaggagcactgtccttcgaggctggagggtgaccacgtgctcctgcggcccctcggcgctgcccagcctgagcactgtgtgccgccctccacccgcgcctggcattggcgtccaccctcacactcctgatcccttcttttgaaggcgcaccacgaggtctgccccaagttccccttaacttgtgacggctgcggcaagaagaagatcccccgggagaaggtgagtgtccttcacctccttggaggaccgcagggcggggcccatgtgttggacgtgagggtcccgtgggtgggggtggggcaggttatgacccttgtgcccaaaggaacagcagtgcaaagcccctgtaacgttgggtcatggatgcgttcagggtggcggccgctctcctgagtgggccgggggccaggtggctgagtcccgagccctcttcctcatcctccagtgtacatagctgcttacttttcagcaggtcacttcctagttatcctgaaaatgaaacattaaagttctcatcgccctccatgtgctgcttatgagaaatgttgttactgactttgaagctgaatgtttgcagcaagcggttggggtggagactgggcgccctagtctggtctgctgccacagccgtgaaatgtgggtggctcgcctggcagaactttgtccctggtgtccttacttctttcaggaaaatggtttctctcccagttgagagttaactgctgcagatgacacctttaggaaaggaagctgggaaataatacgcatggaaacattttcccaaactgcctcccttgttggaggtgtgagggtagctcatccagagaggctgaagctctggaaggggcacctgctctgtgtgtcagaggtccaatgtggaggcctcacaggtggcagcccccatctgggcagctacaggaggggtcaggctggccaggcctgcccgcgggctcagcctgacaggtgtgtgcctgtctttctgatttgcttctgtttaaatataggtcacagcccaagtcctgaaatgggtagggctgggggacgggacagggctgtctcctcacctctttccacttgtctgttaaatgtcccgcactgtgagcttggccgagtgctgtctgaaagcatcctttcccttcacctggagactggagcgccatagaggctatggctgctgccatgcccccttcagaggccaggacgcctgcctggggcccgtgtctgtgaggctgtgtcccctgctggtggggcctggaggtgcccccgagaggtgccctctgcgtgtgccccagtctgtgtcagcccttgtctgtcctgagggggttgtacagaggagttaggaggtgattctttccttgagactgtttccagagtgaaagacgaagacgggcgcccacgcagcgcggtggtgtctggtgggttttgtccccacccatcactgtgaacacggggctttctctgtgcatggtgcattttcatccttcccgtcttttttttttttttttttttggagacagagtttcgctcttgttgcccaggagtgcaatggtgtgatctcggctcactgcaacctctgcctcctgggttcaggtgattctcctgcctcagcttcccgagtagctgggattgcaggtatgcaccaccacacccagctaattttgtattttcagtagagatggggtttctccatgttggtcagtctggttcttgaactcccaactttaggtgatccacctgcctcagcctcccaaagtgctgggattacaggcgtgagccactgccccagcccattgcatctttattttgatgttcacagggcctcatcttcagactgaggggcctttcaggctctctgagaatgaatctcttgggccccgcctgcttcctcagggcagtcctgtctaggcatggaactctggcccttcaatgcaggccgacatataggggctgcatgtatgtgcagggtgtcctggggctgtctgtgccccctggcccgttccagaggagaatgctgagagtgctctcaggtgtttctaatgtgtgtggcgtgcttgggattttctcttatctctttttttttttttttttttttgagatggagtctcgctctgtcacccaggctggagggcagtggcgagatctcggttcactgcaagctccgcctcctgggttcacgccattctcctgcctcagcctcccgagtagctgggactacaggcgcctgccaccatgcccggctaattttgtttttgtatttttagtacagatggggtttcaccgtgttgaccaggatggtgtcgatctcctgacctcgtgatctgcccacctcggctcccaaagtgctgggattacaggcgtgagccactgcgtctggccctttttttttttttttttttttttttttggagacagagtctcactctgtcgtcaggctggaagtgcagtggcgcaatctcggctcattgcaacttctgcctcctgggttcaagcagttctctgcctcagcctcctgagtatctgggattactggcacctgccactccacctagctaatttttgtatttttagtagagacagggtttcaccatcttggccaggctggtcttgaactcctgacctggtggtccacccatctcggcctcccaaagtactgggattacaggcgtgagccactgtgcctggcctctcttatctttttttagtgttgcaaatcttggttcctaacactggtaacgtatttgttttatgttatatatagagtaggtttaaaattaaaaatacctactgagcatggtggctcactcctgtaataccagcattttaggaggctgaggcgggaggatcacttgaggccagttcgagaccagcctggccaacgtggtgaaactccgtctctactgaaaatacaaaaattagctgggcatggtggtgcacacctgtagtcccagctccttgagaggctgaggtgcgaaaattgcttgaacccaggaggtggaggttgcagtgagctgagatcgcaccactgcactccagcctgggtgacagagtgagagcctgtctaaaaaaacaagtcaaggccagttgtggtggctcacatctgcaatcccagcactttgggaagccaaggcaggtggatcacctgaggtcaggagatcaaaaccagcctgtccaacatggcaaaaccccttctctactaaaaatacaaaaattagccaggtgtggtggcacaggcactcctgtaatcccagctacttgggaagctgagacaggagaatcgcctgaacccgggaggcacaggttgcagtcgcagtgagccaagatcgcgccagtgcgctccagcctgggccacagagtgaaactccatctcaaaaaaaaacaataaacaaaaaccagcaacatggcttctgatgatgaggccactgatgatgaggccacctgtttcttcgaagctctttttgttcttggaagtacatcttatgaagatgtggggtccacataccatgttcttattataaaggaattttttttttttttttttttttgagatggagtctctctgccgcccaggctggagtgcagtggcgcaatctcggttcactgcaacctctgcctcctggattcaagtgattctcctgcctcagcgtccctagtagctgggattacaggtgcccaccaccatgcccggctaattttttgtatttttagtagagacggggtttcactatgttggccaggctggtctcaaactcctgacctcgtgatccacctgcctcggcctcccaaagtgctgggattacaagtgtgagccaccgtgcccggctacatactatgttctgaggtgaactggaatacattttttctttgagtttatgtcagctgtggtatatagttcatttgcttcaggttcttttaaaatgtgagggttttttttaaagatttgcttttgttctttgacgatgtaaactattggcctgctgtcttatcagtcagagctgtgcagaggcacaggccccatctcatcctcccagcccctcctctccatctttgctggttttgctggagcctttctcggtgaccatgctcccagggcttggtcgggttcctcaccactgcctgggacatgtgcagggctgagccgagcatggggcggcgtatgttgggacctggtcctttggaggctgacctgtggggctcgctggataggagaagtgggcctgggcctcatggccaaacagcccagaagccttggcagtgacggacacctcgtgtttgataaggtgtttgccccttcatggtgatgctggcaggaaccacagacgggcagtgtttagtgtttcctgggggcctgggggttgccctcctgccctcacaggaaccctagggcaccctttatcagatgaggaaattgaggtttacagaggccaggcgcccagctggcttccagttccatggacggccctgccgtgggcagcctgggggacttgtctcctcgcttccagcagtgccttctcccacacctaccctacctgggcgatcgcaccccccattcccagcatgctgcgcacatgccaggttcctggcctcttctccttcagcttcctgtggtggaaatttctgagcctggacagatgagagagagcacattagaacttggggccctgctgtggctcaagatggggggtgcccagtgacagttctgtttcattcctgcctccacttcttcccgcagcccagtgtttcatccgaaaatacttcagtgacagcagagggatccttgctttattttaagagaaaatacattgtgggttcacacggatgtttgcatttcagattcttacccaacttccatgttgctgtctcctttctacagaaagtcgtggttcctgttgacattgctatacataagaacggtgtcagtagcactgagtctgatccatggcaaattatgtgatgacgaagttctctttctagttctctttgcttttagagtctgtattgagttgctgtgtcataagtcattcgaagcagcgtctctgggcaggcggctgtctcagtattccacggaggcccatttgtttcattttgcttttgagttttaaagattgccctttaaaaaaaaaaaggccgggtgcggtggctcatgcctgttatcccagcactttgaaaggcggaggcgagcggatcacctgagctcaggagtttgagacctgcctgaccaaaatgcagaaaccccgtctctactaaaaatacaaaattagccgggtgtggtagcgcatgcctgtaatcccagctactcgggaggctgaggcaggagaatcacttgaacctgggaggcagaggttgcggtgagctgaaatcatgccattgtactccagcctgggcaacaagagagaaactccgtctcaaaaaaaagttttgtaattttgtaaaatggttacatggcaccaaagcgaaaactacaaaaaaggtgcattctgagacgtcagagggaaatgtgtcaggctccccgtccgcagcgccgtgcggtcgttcagaaatttgcattcccataagcattgtgggagcaccgtctcccgagacttgccagcacagtgtggtgtgaaggttggacgtgccactgtgatgtgtgagaaacacatcagtcctctgtatcgggggtccacgccgtggatccagccaaccgtaggttggaaatgttcaggtaaaaatgcactgaacacgcgcggacattttttattgacacagcgttcacgttgtattggtcatgagtcaccgagagctgatttcaggtatgagggagggtgtgcttaggctctgtgcaaacactctgccatcttccatcagggactcgagcatccttgggtttcagggaccctgagaccaacctcctatgggtggcaagggacagcagagcctcgaggcggttctgacgggcgtttcccaagctgtggtgtgaccgagcccatctgtgcttctcttgctgttcatgactcctgcccactgaatagtgtttttggtttttgtttgttttgggggaaattgttcaaggttcttatgtgactgtttctggaaactgattcacagttacggccgtttccctccttccgggtatgaaatcttgtgctgcgtctggcatgtgtgggtttggttttctcacactcagagccgcgacacacctgccatgtcacctgggaaatggaggaggaacttggggttcatgtttttcctcgggctgttcctgcatccatagacccatgtcagataccacagtgttagtctctgtttcttccctggttcgatgttcctgttgtatgtgagtgtctgtgtgcacttggcccctttctggattttacgttttgcttcatgtcgtgtctgtgtcatcctgtaccaccacgcaccgggtgagcagtgggcgtttgattctgggttttgaacccaggccctgaggcctcagcaccgcatgtcctgtggactgtgatagagggacaggcgtgccatgtgacacacaagctggggtctccacaggtgtcccgaaatgcttgcccatctcagttactggcacagtgtgcatgtttgcacgtgtgtgtgcacaggtgtgtgagcgtgtcgctttggaaatgggctgttgggtttcattcagtgtgagagtgaagaggccaacggggcaggtcatgtaacctctgtgtcagtcagtgtggtccatgtggaagtgctgaaatgcatcagaacagagaaagatggctctgtgacgtcactcccttgtagtttcaggaccacgtcaagacttgtggcaagtgtcgagtcccttgcagattccacgccatcggctgcctcgagacggtgagtcggggggtctgaggttgggggccacccctcatcctgggtgtggtcttcactgcctccagcccagtgcttcctggtttccttccagctgctcctcagccacctctgcagcactgcctcctcctgccccggctgtccgagtgttcccagcttggtctctgggctggcagccctgtccactccctcctggtggcattgtagtgcctggctttgactgccacctgtctctgaggatgcccagtgtgtgtgcccacctgtcgccttgagcctccctgggtgttgagtgcacgtctcagatgtacccggccggctcgccacgaccactccttggccgctgtctccctgcccccatctcacacagaaaagggcagcactctaacccagcggctgtcgctgagccctccgccaccagcaggcactcgggcccctcctctcgcctcatgcttcacgttcgggctgacagaggtctcgtctaccctcaaatggtccccccagccgtcactgccctgtccacatcatcctcatctctcactgggacccaggctcaggcgcttatgggacccccgttcttttccgttctggcctgttcacagatggaaatcgatcacagctcttcctcatggcttctcattcagagtggcctgctcctgtgatctttccctcccctcagctatctcctctgccctgctcgctggcctgagcttccttgggcatgcccacttgtgcccaccccaggcacttgggcactggcacaatggccaggcgcctgggtctctccaggtggacccccctgctccacccctgcagactctgcccctctgtcgccagcacctcgtgtctttgtctcttgtccgtcttgccctgtacaacaggagccccttgaggtcaggaccctcgaggagtactgggcccagaggtggtccccagctgaggtgtgtgcctgatggatggagaggggcaggccgtgggtgcagaccctcccctggccagctcactgggcgggcaccttccttgcttgaagacagggatgtcttgacggcatttgtggtagagtcagttgctgacttgattctatgtggccttaggtattgtgtttttttcctaatggtgaaaaggagcgtggctgcttccattttctttgtctgcgttggatagtcttctgctgtccgtgttcttgtctgtttcctgctctgacgtggcatctgccatctctaggaagcccaggcttcccgtgcgggaggttgcgtagtgaccacccgggcctcagtggtgcttgctgccgccaccgtgctccttgtttctgggcctcttggtgttgagaaatgagagagaacacagcgtgagtctgtggcgatgctcgcttcccgtttgcacaaaggatctccccgtgctggcacacccaccccaggctcagccagggcctgctttttccacgccgcgcacagcatggtcccaacagcagcactctctgagaaaatgcagggcgagctctcgtccagctgtttgtgtcttgagtgcccttctgctctctgggtggtcatgcctctagctgggtacacatgtaggtccatttgtttcttttactgtaatttttttagagtgttttgtttatatatatatatatatatatatatatatatttatttaattaattaatttatttatttttgaggttgagtcttgctttgtcgcccaggctggagtgcagtggcatgatctcagctcactgcaacctctgcctcccgggttcaaacaattcttgtgcctcagcctcccaagtaggtgataaaaggcccaagtagctgtgatcacagctgtgtgccaccacacccggctaatttttgtatttttagtagagatgaggtttcaccatgttgcccaggctggtctcgaacttctgacctcaagtgatcctcctgcctcagcctcctaaagtgctgggattacaggcatgaccgcgcctggcctcattttcaaattttgttgtggaaatttgaaaataatttaattgcaaagtcaagtctataaaatgaggtatgtttaaggaggcctagcttccagccctgtgttttcaccttcccctgtgggtggctttttatttcttattttattttgttttatttcattttatttttgagacagagtcttgctctgtcacccaggctggagtgcagtggcgccatctcggctcactgcagcctccacctcctgggttcaagtactctcctgcctcagccttccgggaagctgggattacaagcacacaccaccaggcccagctaatttttgtatttttagtagagatagggttttgccatgttgaccaggctagtctcaaactcctgacctcaggtgatccgcccacttcagcctcccaaagtactgggattacaggtgtgagccactgcacctggcctattttaatatttatttatttatttatttatttatttattttcgaaacagagtctcgctctgttggccaggctggaagtgcagtggcaccatctcagctcactacagcctccctctcctgggttcaaactattctcatgcctcagtctcccgagtagctggaattacagacatgtgccaccatgcccagctaatttttgtagctttactagagacagggtttcaccatgttgcccaggcttctctggaacttgtgggtggcttttttttttttttttttttgagacagagtttcgctcttgttgcccagactagagtacagtggcgcgatctcggctcaccacaacctccacctcccgggttcaaacagttctgcctcagcctcccaagtagctgggattacaggcgtgcaccaccacgccctgctaattttgtatttttagtagagacagggtttctccatgttggtcaggctagtctcgaactcccgacctcaggtgatcctcccaccttggcctcccaaagtgctgggattacaggcgggagccaccatgcccagtcatgagtagcttttttaaaatggtgtgttgcttttatttttcttttctcttcctttctgtccctccccctccttctttccctccccttcttcccttcatcccttcatctcgtcctgtcccgtcccttttttcttttcttccaaacagggttttgctgtgtcagccaggcagggatgcagtggtatgatctcggctcactgcagcgtcaacctcctgggctcaagtgatcctcccacctcagcctcctgagtagctggaaccactggcacacaccaccatgcccagctaatttttaaaaattttttgtagacgtggggttttgccatgttgccccagctagtctccaactcctgggcccaaatgatcctcccgctttggccttctgaagtgctggaatcacagttgctagctactgtgcctggctgcaactaagttctatagcttcacgttctttaaacacacctgactttcagtctgtcatacacaagaaggatcagccatgaccaggccacccaggcatccctatctatgaccctggcctgtctcctcagctcagctgaggcccacgtcttggtggccgtccccgggtgggagccgaatggtggatggagccagcagcctccctgccctgtgtccgcaggtagagggtgagaaacagcaggagcacgaggtgcagtggctgcgggagcacctggccatgctactgagctcggtgctggaggcaaagcccctcttgggagaccagagccacgcggggtcagagctcctgcagaggtgcgagagcctggagaagaagacggccacttttgagaacattgtctgcgtcctgaaccgggaggtggagagggtggccatgactgccgaggcctgcagccggcagcaccggctggaccaagacaagattgaagccctgagtagcaaggtttgtgcctgccgggtggccagccatgaggaggacagtgtaaagggggatagtgttcgtgccccagcaggttctagcaggtcctggagctttagagcccggacaatgtagaactccatctgcaaaccccagtccagtgtggtttaggggaggctctggcccccttcatttctgagtcctgtcatctaaggggcccaaaccctggaaggtcctagaggccaggccgtgggcaggagcctcttctctctgatgggagggcagagtcagccatggatggggatgtgcatggcctggtgtggcttctgagcacgcttgctggcccggagcttctgtgtggacttggagccaccacctcttggcgagggtggggttgggttcttgtgtgcagggagtggacatgagaaacatggagcccaggggtgcccaagagcactgtcctgctggagatcggtgggtgtgggaggcaggggctcgtgcccgcacccctcctgtaagagggaaggtggtcttggcacccggcaggtgcagcagctggagaggagcattggcctcaaggacctggcgatggctgacttggagcagaaggtcttggagatggaggcatccacctacgatggggtcttcatctggaagatctcagacttcgccaggaagcgccaggaagctgtggctggccgcatacccgccatcttctccccaggtgtggttctaggacccccacctcactgcagctgctgtttacttggcacctgggtcccctcacccctgtgaccacataggatggctcccaagggtggggctgggatacgacccccagtgataccgggagcagctacacctccctgagtggcaagtggggtagctgaatatgggctggccggtgggtgccctcgggcaggggtcggggtaggggggttgggccggctgccctcctgccgtgccagccctcgaggtgtgcccctcgtcacccacagcctggtcctctggcacacagccctaaagcagacattacatcaacaggctctcctgcctgatcacagctcccaggaagacagggcgggtgggggtggctgtgggggtgggacatggctctcagggccttggagctgagctagtctgatccctcccaggttcattttccacacggagctcagggagggtgtttctcacactcccccaccttttttttttttaaaccccaactatggggtctcttgagagggtgctcgtggggtctcccctggagggcactgctggagagggggtggggtggtggctgcccagctgcaggctcctgccaggactgtgcttctgggcgctgcagtccagaggcggcccccctgctgtccctcgaggccctggctgaccttgtggcggccccagccatcatctcggccccaactcagtcactcccttcttgggctttgttgccatggctcagaacacgccctcgtgcagactttatttttaggctgagttggtgaacctgctgatagaatcttaggttctaggatcaaggccgagatgctgtaggcacctttcctgtttgaatttagcctggcactgctcgtgaaactcagcactgggggccatggcagtcctgtgctctggcgccctcgaggcggaaagagacccaagcgtcatctggaggggccgccacattgtgtggtgcctgctgccaaggccttcagcagggaccagaaacaaaactcacactctttcttctctgagttgagactggaaaaatgaaagattgttttaggggaaacttgagggaacagtctgggcagcctgcagggcatggccctgttcctccagggctgggaaagtcagcactgctttctggtggcgaccttccctctgcagctgctggctcagccgattgtatatgctgggagctctgcactaagcgttgggtgaagggtcagcattgtggaggccctgccacggaggtggtcttcttgggagctgcactcaggcaagaggacctgtttgtgtggaacatctgctttaagcaatgctggtgaacacagcttgtgtgcggcacgcgtgcaggctgaggacaggcagaatgggcctgggggcacggtggaggacgaggatggggaggatgggcctgggggcacggtggaggacgaggatggggaggatgggcctgggggcgtgtggaggacagggatggggaggatgggcctgggcacgtggtggaggacggggacggggaggatgggcctgggcatgtggtggaggactaggacggggggaggatgggcctgggggcatgtggaggacgaggatggggaggatgggtctgggggcacgtggtggaggacgaggatggggaggatgggcctgggggcacgaggtggagaggactaggacagggaggatgggcttgggggcacgcggtggaggacgaggatggggaggatgggcctgggggcacgcggtggaggacgaggacggaagggtggtcctggtgctgccacagtggggtccctgcgtgcagacctttgcacacagtgttctgtcatgtgacttggaaagcagcctctgccgggttctggctgtcactcacgtctgtgtcttgttgggtgggaaggaagtcgactcttcttgttttggggttcactctagccagtgcctcttctgaggcaggcttggggcccaacctaagccctgggccggtcagggctccctctgtggctctgccgaggtcccaaccactgcatttagtggatctcgccatgtggctctgctcatcttcttaagttttgggggttacatttgggattcttagaaatgctttttctggctgggcacagtggctcacacctgtaatcccagcactttgtgaggccaacacgtgtggatcgcctgagggcaggagtttgagaccatcctggccaacatggtaaaaccccatctctactaaaaatacaaaaattagccaggtgtggtgtcgagcgtctgtaatctcagctactcaggaggctgaggcaggagaatcgcttgatcccaggaggtggaggttgcagtgagctgagattgcgccactgcactcagcctgggcaacaagagtgagactccatctcaaaaaaaaaaaaaaaaaaaaaaaaactttttctaagtactacctttttttttgtaatgaaatttgttttcattggaaactaactgcatagtttgagggaaaaaaaacttttctttgcaccccagaacctgaatgtttctttgtaggtgtttttgtccctgggggagggcagccaggcaggaagagccctgccccgcccttgctgagtgtcagctcaccaggcacccctcctgcctccccagccttctacaccagcaggtacggctacaagatgtgtctgcgtatctacctgaacggcgacggcaccgggcgaggaacacacctgtccctcttctttgtggtgatgaagggcccgaatgacgccctgctgcggtggcccttcaaccagaaggtgaggccgtccctgcaggcttcgctagggccgcacctgggagtccctctgggcagtgcagcttctgtggtgcagggttgtgcgggacaaggtggcttgggctcgctggaccaggtgtctgcagcaggcacgtcaccctgtgatgctgtgtcacgcggtggagagctctggcagtttgttgtttccatgatttctgagcactggtccgtgacacaagcacctggcttcctgacctgtcagataaatataaatatgactaagaaaaagcacaaggccgagtgggcggggagtatgtatccctgtgatcccagcactttgggaggctgaggtgggaggattgcttgaacccaggagtttgagatcagcctgggcaacatagtgagaacccatgtctacaaaaaaaatagaaaaattagccgggcatggtggtgtgcacctgtattcccagctattcgggaggctaaggcaggagcattgcttgagcccagtaggttgaggctgcagtgagccgagatcacgctactgcactgcagcctgggcaacagagcaagagggggctctaaataaatgaacaaaaggacaaagcacaaaataatgcaagtttgggggtgcccagctttagcccaggactccagatgttgatgggcatctggaccagtagtttgaaaaccctgccctggagagagagtgcagaggaaggaacacagcttcggagccctcttcgtcggaggtgtcatttatttatttacttattgttaagacggagtcttgctctgtcgcccaggctggagtgcagtggcatgatctcggctcactgcaacctcccctcctgggttcaagcgattctcctgcctcagcctcctgagtagctgggactacaggcatgcaccaccacgcccagctaatttttgtatttttagtagagatggggtttctccatgttggccaggctggtcttgatctcctgaccttgtgatccgcccaccttggcctcccaaagtgctgggattgtaggcgtgagccactgtgcctggcctattttgaaaatcagaatctattattttgtggaattgaagatgcagagactagactggaatgagagaaggtcccttccttttgccacagttggcccagacttgctacttcccccaccccctatagctagtggagtaggcagagcagagttgggtgggggagggggtgtggagggcccacaggcccttgtctgtcctggggcatccaggttcacagtcctgacagaggcagactcaggttctccctgaaaagtgctcttcacgagtgggcagtgggtgcttcatgatctctttggcaagaaaatgtctttgccagatgtgttattttttgcattttcctaataataattcaagttcaggagtggtaagctttagtctaggactccagatgtcagtggacaggaaaggccagaatggacacagattccccagagagaagcggaatgccggtggctggggagggctggggagcccgggcgctgtggcaggagcaaggccgcccaccacgtggtctcggctgggcctcagcctctggcctgggtcctgggatggcctcctgctggtggccctgccagtgtccagaccctcgggagccagagagagacggcccacagacctgtgtcccctccctggggctctctcctccaggtgaccttaatgctgctcgaccagaataaccgggagcacgtgattgacgccttcaggcccgacgtgacttcatcctcttttcagaggccagtcaacgacatgaacatcgcaagcggctgccccctcttctgccccgtctccaagatggaggcaaagaattcctacgtgcgggacgatgccatcttcatcaaggccattgtggacctgacagggctctaactgccccctactggtgtctgggggttgggggcagccaggcacagccggctcacggaggggccaccacgctgggccagggtctcactgtacaagtgggcaggggccgcgcttgggcgcttgggagggtgtcggcctgcagccaagttcactgtcacgggggaaggagccaccagccagtcctcagatttcagagactgcggaggggcttggcagacggtcttagccaagggctgtggtggcattggccgagggtcttcgggtgcttcccagcacaagctgcccttgctgtcctgtgcagtgaagggagaggccctgggtgggggacactcagagtgggagcacatcccagcagtgcccatgtagcaggagcacagtggatggccttgtgtccctcgggcatgacaggcagaaacgagggctgctccaggagaagggcctcctgctggccagagcaaggaaggctgagcagcttggttctcccctctggcccctggagagaagggagcattcctagacccctgggtgcttgtctgcacagagctctggtctgtgccaccttggccaggctggctgtgggagagggtctggtcccacgccgcctctgctcagaccactgtgtgggaggtgcacagcacagcctgcgggtaaagtgtgagagcttgccatccagctcacgaagacagagttattaaaccattcaaatctctgtggtcagtggcatccatttgattccaggttgcctgcggcttccagccttggcagtggtgaccctctgcgggtcctcctggcctctcctctcacagacccctccccacggggtgcctagcccctgcctgcttctctagctagccaggctgtgttctctgttcctcacctgatgtaagctccctcttctcgagccttgttccctcttctggaatgttcttccctgtccatctcctctcctgggcctccccagggactcctgtgagagcagaatgaggatgagccagccctggtcctgcctttctgtgcacaggctccaccgagcatcctggctgcacccggggggtcctggccacaccgagggtcctggctgcaccgcccctgtggtgtgtttttgggacagtgcaggcaggcgtaggcacggcttcacactcggtgtcagggcagccgtgctgggacctactgggcatctgtatcggggtccaggataaagtgctgtcccctctcgacgtcttcacgcactgctgtagtttgagaagttgaccacagaaaagtacagaaaataactcaggcacggagctgaccgacgggcattgtctgtgttccgtgagtgtgtactgggcctaaagagcaagcattgcagagccctgctgttccctttcccggcctcacctcagctccccaggccacgtggcgggaattgaggcgttccggttctctttgggctttagaattttgcatctgtacgtttctgtattcacaaataagaatattgcattaaaaatgcagaaaccatccactgggtcagctgcaggtagctgggcttttgactcagcctggctacttttaatgcatcttgtgctgggcactctacatggtggattctgactgccgtgtgtgagttccctagagagcaccttccagtctcttcccgtgtcttcagggtttggtgactggagatagccagacctgctctcgtgggtctcctgtcaacctggaaggagggttggtggtttctaggcctcccctttttagcagttgccagcttgctttgcagaggggctgcatccggtccttccaccagcaccagggggagggttcccatcactcccatccctcccatccctgcccgtgcttcgtgttgttggaattgagatgctgcagcgtgctgtgtgtgaagtgaagtggcatcgctgtcacgtgcgtttctctgatgactcggcggagtcaggcgtctttaccacgcttacctctcccttggattctctcccgtgcgaattgcctgttgatgtctttttctcatttttcttctggttgttggtctgggtcttattctgctggttggtaggagttcctgatattcctgattacggattctcggttgtgtctttgaactgcgtttctgttgctcctgatgtgcagaagcttaagccttacacatgatcagctgatcttatcctttatgaatggtgctatttccgaccgactcagaacatcctgaccttccctgaggctggaaaccactgtcatgttttcgtctaatgattgtgaagttttgtctttaacatactgggcttctatatttggggatttgtttgtatgtgacaggttttgctgggtcactgcagtttgttaaaacagattgattgaggtcatctcttctcacttaaaacgaaatggaactgtgaaatgagaggaatggaccaaaaaaaaatcctcccccagggacaaagatggggaagaagccaacatcccacaaaggatttgaacccattttggaaggtgggaagtgggttggtgggtggctgctgagcagaagagggctgagggggaagctggccacaccgggaggccctggcatggagcagagtctaaaagtggatcaactgaaagacggggcagagcagctaccttggaggtcctttgccagagcagccggatggtcctcctggccctcacctccctgcagtggagatggaggtctggagaacctggggaagagctgaggaccgcaccccccacgcagtgagagcagcatcgggctccaggctgcagaaggggcagaggtctgcactcggaacaattccctaggcactggctgccacaccaagaggctcccacgaagcagaccaaggcccttgagggacaaaatgctctggagcagccccgtgggcaggcctggcccagccgcctcatggccttctggggaagtgacaggctctgtgcaaacccacagaggtaccatcgtcactacctaattttgggacatttcatcaccctgcagagaaaccttcccttagcagtcactgttccctcccgctcagcccctgacagccagccataaacctaccttctgtctctatagatttgcctactcaggacattcatgtgaatgtggcctttgcttttactcagcaagatattttcatggttcctgtgtgttgcagcatgcattggagtttcattccttctaatggctgaataatctcttgtatggatgcaccacaccttatttatccattcatccgttgctggacatttgggtggtttctactttttggctactctgaaaatgctgctgtgaacatttgtgaacaagtttttatggggacgtgtatttgttttcatttctcttgaatatttataccgaggagtagagctgctgggccgcttgttcagctcttggaggaattgccgaacttttgtgtcaccttacatctccctcaggaagtgttttttttttttttttttttttttgagacggaatctcgttctgtcttcctggctggaatacaatggcacaatctcggctcactgcagcctccgcctcccaggttcaagcaattctcctgcctcagcttcctgagtagctgggattacagctgtgagccaccacgcctggctaatttttgtatttttagtagagacagggctttaccatgttggccaggctggtctcgaactgctgacctcaggtgatctgcccacctcagcctcccaaagtgctgggattgcaggtgttgcacctggcccctaataacatttttaaatttcacgtagtaaaattgatttgttcttttgttttgttcatggaacattcaattccatggatgttcacacctgtgcagatgtgggtaagcaccatacctgggagacaggcgagccctgccatctcagaagactgttccactttccccatagtcaccaccccgacccgtggcagccacacacctgtcctccaccactgtagttatgtctttccaagaaggtcccataatggagtcctacaatgcgtggctgggagcagcgagatctgcagaacgccgctgagactgatcaggatgcgtgcatcagcatttgttttctctcttttttttttgttttttttggagtagtgctctatggatggatcagtttgtctcgtcacctgttgaagggtgtttgggttgtttctaatgttttgcaggtctgaatagagctgctataaacatttgtgtacaggttgttgagcaagtttttatttcattaaggtagttagcagtggggctgctggatcacacagtaagtgtatttttaaattcaaaagaaactgccaagcactttccagaatagctgtagcctgttgtggaatgccagcatgagccacagttcccgctgctccacatccttgtgggcactttgtgttgtcagcattcttttttaatttctttttaagatatagggtcttgctctgtcacccaggctggagcgcaatggcgcagtcctacctcactgcagcctcaaacccctgagctccagtgatcctcccacctaggcctcccaagtagctgcgactacaggttcacaccatcgtgctcagcttattttctttaatttttgtagagacagaatatcactatgttgcccagggtggtctcagactcctggtctcacactgtcctgtcttggactcccaaagtgctgggattataggcatgtgtcactgtacctggccaaactttattcttgtttctctttttctttttttcctttttcctccctccctccttccttttttcttttcgttttcttttctcttttttttcgtttgccctgccctgccctttttttttttttttttttttttttttttttaaagacagtcacagtctcgttctgttgcctaggctggagtgcagtggtacaaatcctacctcactgcaccctcgagacctcaggctcaagcaggtcttcccacctcaagcatcccaagtagctgggaccacaggcacaccaccacactcggttaattttttaaatttttagtagagatagagttttttttttttttttttttttttttttttttttgagacagactctcgctctgtcaccagactggagtacagtgacccatcttggctcactgcaacctctgactccttggttcaagcgattctcctgccccagccttccaagtatttgggattacaggtgcatgccaccacacccaggtaatttttttgtatttttagtagagtcggggtttcaccatgttggccagtatggtctcgatcttctgacctcagatctgcctacctcgacctcccagagtgctgggattacaggcatgagccactgcacccagccggagacagggtctctctgttgtccaggctggcctgaaactcctgggctcaagtgatccgcctgcctcagcttcccaaagtgatgggattacaggcattagccaccacgcccagccagttgttgtttttcagaattgttttccctatttttgtttgtttgacagtacatatatatttcacagtcaactacaaaaaaattctgggattttgattggaattgcgttaagtctacacatcagtttggggagaattgacatctgtgttgagtcagacaatccatgaacatagtctatctctattctttatcagcgttttgtagtatttcatatgtatgttgaactggctggaatgcagtggcatgatcgcagctcactgtggctttgacctcctgggctcaatggatcttcccacctcagcctcctaagtagctgggactacaagtgtgtgccaccacgcccggctaatttttgtattttttgtagagatagggttttgccatgttgcctgggctggtgtcctggactcaagtgattcacccacctctgccttccaaagtgctgggattatgggcataaaagtcaccacacccagccagtatacatatcttgtacatgttttagtaggtttatgcttcagtgtttcttttacttatttattgcttcctatcccacagcttactttgtttcttgagctgttgtaagaggttgttttttgaattttggtttctgactgtatatttccagtgtttaaaaacaaaactgatttttatgtgttgttcttatacctcataaccttgatgaattcacttactggttgtaggagattaggattttgtttgtttttatagatttggggggattttatgtgtgaacaatatgtcatccattaataaggacagttttatttctttttattcaatctctatgccttttatttcttttgcttgccttgttccattggctgacttcccgtttataaggttgaatagtaatggtaagagtctatagcctttcctcattcccactcttggggaaagctttcttgctttcacaattatgtatcatgttacccacggggatttttggtgatgctgttttatcaggttgagcaagttcccttctacttctagtttgcttctagggttttttttttttttttttatcatgactagacattttatcaagatgtttttcaatggctgggtttggtggctcatgcctataatcccagcactttgggaggccgaggcaggcggatcaccttaggtcaggagtttgagaccagcttggccaacatggtgaaaacccatctctattaaaaacaaaaattagctgggcatggtggtgcactcctgtaatcccagctacttgggaggctgaggcaggagaattgcttgaactgggagacggaggtgacagtgagctgagatcgtgccattgcactctaacctgggcaacaaggaaactgtcttccaaaaaaaaaaaaaaaaagatgctttttctataccaagtgatatgttcatgtggtttttctcctgtacagttaatatggtgacttatgttgatcttcaaatattggaccaaccttgcattcctggaataaaccctacctggttatggtgcactatcacttttatatattgctggatttgatttaaattttttttgaggattttgcatctctgttcatgaaggacatttgtctataattgtcttttgtattgtctttgtctggtttttggtatcagggtgctgtgggcagaaaatcgagaccaggagtgggtttgttgtcatcacaaatgctcgaaaaatgtggaagcagctttggaactgggtagtaggcagaggccagaagagtttggaggagcgagaagaagcttagatgccattcatggagtgtaaagggtgattttgttgagggctcagaagagaactgtagggaaagtctgaagcttctttgagaatacttaaagtggtcatggtcagaatgttggtagaaatctggacagtgaaggccattctggtaagatctcagacagaaatgaagaacaaggtgtcagaaactggaggaatgaccatcctagttataaagtggcagagaacgtggctgaacggtgtccatgcccagtccttcctttgtggaaggaactgggatatctggctgaagaaatactcagggtgtggcatgttttcttctaactgcagagagtaagatgtgagaagagaaatgaattaaagatggaatttataattaacaaggaaagaatagggatcgtaaggattttcagcctgcccatttagggagtaaataagatgtctttaggagaacagaccaagtgtgtggccaagcaacttagtatggacagaacgaagccagaggctgctcatcaggacagtgggaaaatggccccagaggcatttcagattcctggtgctgcccctcccaccacaggcccagagtgccaaggcctttgggaaggaaatatgtcaaaagagaggtgtagggtgtggaccttagagcctgctggccagggccaccccaagtcttggctgtctgcattccagtgcagaccccctaagccactccagcctgtctcatgtggacccagggaaggtacaagtcataagccttggtggtgtcgattctgcagccttgcaggagctgtggggacatggcttcatccactgggtgtcacacaggatgtcacaagtctccaggccagagccatggcagagagcccacactagggcaatatgtggtagagccttggggataaggccacccctgagaccccagaactggagagcctctagtgttcattgccagcctgggagagctgaaggcacgagactccaacctaagagagttgtgtgaggtctgagcccagcaaagctctaggggtgaggttcccaagagcctgaggacccagccgcaccccacggcgtgcagaaggcaggatttggagtcaaagatgatgattctcaagccttaggatttagtagtattctccctgttggactttggacatgcttttgaggcctgttattcctttcctctttataatttatccctttggaatggaaatgtctgttctatgcctgccctaccattgtattttggaagcacgtaacttgtttaatttcacaggctcatagtggagggaaagttgcctcaggatgaatcatgccttgagtctcacccatgtttgatttagacgagactctgggctttggacttttgaatggggccattgggatggaatgagtatattttgtatgtgaaaagaacatgaattggtgtaggggcagggatggaatgctacggtttgaatgtttttatctcccaaactcatgttaatatttaattgtcattgtaacagtgttaagaggtgggatccttaaagggtgattaggtcagagggaagataggctggaattggtgctggtataataagatgagcttggccctctcttgcccttccaccttccacagtgacacaacaagaaggattgcaccagacgctggcaccttactctgggacttcccagcccccagaactgtgagccaataaatttctattccttataaattatctggtctcaggtattcggttatagcagcaaaaacagactaagagaagacaatgtttgtgccccccccacccaatttcctgtgttgaaacataatctccaatgtgatggtacttggaggcaggactttttagatcatgagggtgcaacacttgtggatgggattcgtgcccttaaaaagaggctgcagcccagtatggtggctcacgccgtaatcccagcacttacggaagccgaggcaggcggatcacttcagcctaggagttcaaaaccagcctggacaacatggcaaaaccccatctctacaaaaaatataaaaattagctgggtgtggtggtgcatgcctgtggtcccagctacttgagaggctgaggtgggaggatcacttgagcctgaaggtcgaagctgcagtaagtcatgactgtactggtgactcaaggctgggcaacagagtgagaacctgtctttttttttttttttttttttgagatggagtcttgctctgtcgcccaggctggagtgcagtggcgcgatctcggctcactgcaagctccgcctcctgggttcacgccattctgcctcagcctcccgagtagctggaacttggtctcgatcctcctgaccttgtgatctgcccacctcggcctcccaaagtgctgggattaacaagcgtgagccaccgcacacggcctttttttttttgtatttttagtagagacgggattttaccatgttggccaggctggtcttgaactcctgacctcaggtgatctgcccgccttggcctcccaaaatgttagggttacaggcgtaagccaccgtgcccagcctttttccttctctttttatagatacctaatcttggtatgaatggtcctttttacatcttctatttttttgctgagactttcatatttttacatccattgcaaaatgtttgtgattgcttgctctggcatatttatagtagctactttaaagcccttgtcagataatttcagcatctgtgtctgtgtcacttcctcccaagcctggcgtttggttggtgaggacttgcaggttccccctgcatatcgggaagtgtgagtttttgttcagggtgcatctacctggggccatggcataatgttcatctgcaatgattgtaaggtgttcagattttgtaaatccaaataaaactgttttaaagaacacaatcctcagccgggcatggtggctcatgcctggaatcccagcactttgggaggccgaggcgggcggatcacgaggtcaggagatcgagaccatcctggccaacacagtgaaaccccgtctccactaaaataatacaaaaaaattagccgggcatggtggcgggcgcctgtagtcccagctactcgggaggctggggcaggagaatggcatgaacctggtaggcagagcctgcagtgagctgagatcgcgccactgcactccagcctgggcgacagagcaagactctgtctcaaaaaaaaaaaaaaaaaaaaaaaatctctctctcctacattgctgtctgcaaaacaatggaggttatggatgttagattgcatctcgatgttaaacctttgctaatgtacttatgggaatcacaaagattctgtttgtaaatacagaagtgaattgtagacataaaatggttgtgccatgtggataatggcaggcactaggtgacatttatgtagtaactaatgacaaaaattcatggctagtggcatataaaatactctttgcagtaaaatatttccttgattaatgttatagaagggggacataacaaggaactcacagttggtgtggcagctagcctcaaagactgtctttcatttggtttcagcacctcctgtttggggttattagcatcttagaagagcacggtggccttgtctgatgaagccgaattgtgctggtctgttccgagctggtttaagtgttctgatgggcagctgtggatgttggggttcagagcttagtcatcgttgcctgaaatggcactagactctacaatttctgccttggagaacactcagttcttacttgtgatttctggtagaacaagctttatttttctagcctagtaatgatcttgaagcagaggaatcccagtgccttttaagaattgtgttggccggtgcggtggctcacgcctgtaatcccagcacttctggaggccgaggctggaagattacttgagcccaggagtttgagaccagcctgggcaacatagacctcatttctacaaaaattaaaaaataataaaaatttgttgtgtggttttttaaaaaagctactaattgtttttgggaaatagaatttatgggtctttacctttgcacattgaatcttttattttttatttttattttttagaaacagggtctctgtcacccaggctggagtgcagcggcccggtgattgctccctgcagccgtggcctcccagggaactagggtttcaggtgtgagccgcggtgcccagctgcaagttgaaatgttgtggttcttcgtgtgtcaagcaattttgggctatattctagacattttgaatatgactttatgagatctgggtcatgtttgaatcctgtgggaaatgttgaagtctggttagcaggcacttggtcctgtgaaggttgggcccacattgttcctgcccgcatgagtatctttggttagcaggcacttggtcctgggatggtcaggcccacactgctcccacctgcgtgggtgtctttggttagcaggcacttggtcctgtgagggttgggcccacactgctcccacctgcgtggactcctgtcttcagagctgctggtctttggtctgggacccaaggctggtctgcagttccccacgtccatggtgtgatcattagacccatgtgtctgcatgtgagctgagcccggcatccacagccaccccatgtgggtgcttcccaagctccccacgctgggtttggttgctgggctcactcactgtcagttcagacagtgacatgcccttgactgggccgcgttggagtctatgtggcaggaggacaggggaggaaagctaatgggggtggtcccaccctcaatacagccgcactgagctgtgagggactttctggccccaagtttggctctgatgggttcctgtagccaccactcccactgccatcagggtcacaaaagaatggagaagagggtaaacccagggcattgcctcactgaccctgcgcatcggcgtgggttcctttccctggcccttagggctgctctgggctttctgcctggccccagcactcacgtccggtgttgcggctgcgtggagttcaggtcatggatgttaggtcaagcaccagttctgcgaaacttgggatcttgctgctgctccctgacccagctctctggcagctgctccaggccccgtgcacaagtttcatagctgcagtttcacagagttcactctgtcgcccaggctggagtgcagtggcgcaatctcagctcattcccgggttcaatgaattctcctgcctcagtcccctgagtagctgggattagaggtgtgtgccaccacgctcggctaattttttttttttttttttttaagtacaaaaggggtttcaccgtgttggccaggctggtcttgatctcctgacctcaagtgatccgcctcggcctcccaaagtgctaggattacaggcatgaaccaccacgcccggcctgacctcagcatatgttttctgaggacttctgttcttttgctaattcagtcactttctctttaaacactgggtctccacccctgccccgtagatggggtgggggcatgcatgccgctccattcccctcccagggctgtgtttctttcgtctcctctgtgccatcttctgctgcctggtcctctcgtcgagtctgtctggtccagcactttccacatatcaagatttttttttttttcttttccttttttgagacagagtcttgttctgtcgcccaggctggagtgcagtggtgcaatctcggctcactgcaagctccgcctcccaggttcacgccattctcctacctcagtctctcgagtagctgagactacaggcgtccgccaccgcgcccggctaattttttgtatttttagtagagacagggtttcaccttgttagccaggatggcctcgatctgacctcgtgatctgcccacctcggcctcccaaagtactgggattacaggcgtgagccaccgcgcccggcctacgtatcaagcttttgatgcagtcactcgccctgtcattttccagtgtctaattggctccctttttattttgaaatgtccaagtcctcttgatttctgtccccacttttgttttatggtgcataggaatgtttttgttagtctccttgaatgtgaacgtaggtaagtccttttcaggaaattgctcaattctttggagcctgcccgtggtgtgcttgcatttacagaatctgtcagctcccttctgagggtgttagtctcagggcagcttatcttgtctgggggtctttggtgtgtcttccttcctttccttgttctcgcccacgttgggggttttattatgaactgcagtggtccccagggcttcccagctggagaccaggagttggcagggcagaggctccgtccctctgggtggcgcagcctctctcggtggtgctgtccctgatcccgtcggtgctcgagctcagccccagggtctctacctgcggcccacgtggctcaggggaaccatcacctcgacactcactcgtctcctctgcgtcctttctctgtacggggttgcttgctgccatgtttggagccacaagctctgtgtgcttcctataatgggcagctgacccgagtgccaggctctactcctgccatcttccttgtcaccaccatcgccccgggcccccgagctcccggtgcagttccaacaaagcctgtggggtccagctggagctccacctctgctcccacttctgggcccctggtcccatcctcgccggcctgaactgactgtggagaccgccctggcactgggagcgacacggcctgccgactctggacccagcagccgagggactccctcaaggacgggactgtggggggccgccctggcactgggagtgacgcagcctgccaactctggacccagcagccgaggaactcccttaaggatgggactgactgtgggggctgccctggcactgggagcgacgcagcctgccgactctggacccagcagctgaggaactccctcaaggacgggactgactgggggggctgccctggcactgggagtgacgtggcctactgaccctggacccagacggcaggccctgcatgctgccagccccggcacatgtgccaggcatctccctggaggtcatggaggacagggcagtgtgacaaagtctggcaccagcacatgacctcagacgcacatgtcacctgtcagcagtgactgcaacattcactccagtaggaccactgtgccagcaataacagcgtcacccgtcagcagtgaccatgaggtccactccactgtgccagcagtgcccacagtctccctccctgcagacagagactggacaacaatgtgctgttgccaactgtttattcagggccctgaacgggtggtgcgtggacatgcaacacactcgggcccacagcagcgtgaccggccgctcccaagccccgggcgcacaaccacagccaggagcagcccctgccaccactgggccaccgtccagggccccacaggaccagccgaaggtgccccgggccgaggccagctgggtcaggtgtacccctagcctggggttgagtgaggagcggcacccccagtatcctgtgtaccccaagttgcccaggaggccgagggggccttgggctccatctgcactggccaccccgtgccaagcatcacagctgcgtgagcaggtttgtgtgtgagcgtgtggcggggcctggttgtccccttcctaaggcgtaactgctataagcatctccacctctcccgctcgggaaaaagccacagagcctggcgatgtcctcaaggggtcccggtggctccagtgcacccagcacacctcagcgcctctggctggcaagccaggagaagaaggtgcgaggccgtgggcgaggtgcctggaggacgcgcatggtgcgtggggagcgccaggctttgatggtggcgtcgtcgctggccgtgagcagcagctcctgctcctggggactgaagaccactgagttgaccacatcctcgtgccgcagcctggccagacagatgttgtagtggcggtcccagatgtagccgtgccggtcctccgccccgctgcagaacagcgcctgggtgagccggccgcccgcccgctgctgcccacacccgccctgcaccacgccgcgccctgcacctggccacgaagtccctgctgacgtccaggaagatgaagaagcactcgtcgttgggcgtgtaggcgcggtgcgcacgcagagcccgcctcacctcccgcatggtcttgaggtcgaacaccagcaggtcaatctcctccgcgattggtggcggctgcatggggtcggccaccaccgcaccgttgggccaggcgcggctgttcacgtacaggtacctgggcgaggggcactgtgctaggtgtgggccgcctgcgggcaccccgcctgggacactggcaagaggcccacctgttgtcgggcgacaggcccatgccgatgatgtgtccgtgtatgtctatgacgtggtccagcgcgtcgaagaaggcatcggagccccggccctcacccagcacgggccctgccgtggtcatctggtgtggcaggatctgcttgatgcctgcagggagggctacggtgagggtccctgtccaatgccccaaggacatcactccagggcagcttcctacctcagtggtgtctctggggctgtgagcaccacagaggtccgtgggcactgcctgctccgggggccccagacctgaatcaggcccgtcggttgcttgctggccagcggccctgcctgcgtttgttttcactgctcatcccacaggccccaggtctgggcttgtgaccccaggggcgagtgaacgatcccagctttgcctgtggacttgcttgctgtctgcccctcaggacccctgcccggcctcccccaagctcctaggaccgaggcgggcagcatggcggcaggggtgtaccgatctggtgtggggagtaggtgaggcagccagtggtgaagatgaggtacttgctcttggcgcctgtggcactgcgctcgggtggcttggtgtggccctgggccagcagctcggccaccttggtctctagcatgcgctccgacagctgtggctgcgcccgcccctccagcacgcggtccagaaagtgccgcaagccctccttggcgtgggcgggggccgggccagccaccacctcctcgttgtcgctgcccaggtcaaagatgcggcagggggacgtggccgggtcaccggcttccagcagcaggtcagggctgtcgaagcggctgcagtcggccaccatcaccgtgcggacggtgctggcattgaggttctggatcttgaacagccgcttcaccacgttgacgttctctgactccacatcctgggggcgggggcacgtgccaggtgggcgccgggcgccaggccccaggagggcagccccgcccctagccccgcacgcacctggaaggcattgttgagccacagcaccgagcaggaggtgatatctccgatgcggtgcaggttccccgagatgaggctggtctcggtgagccaacagccaaacacgtcatagggcttgttccgcacgcgggacagcagcgcgaaggagtctgtggggaggccggggctggacaggctgtcggcgtggggcgggggcagggtcaacccgccgcccgtgctcacctaggctgatgacagcaatctcgccggatgaggagttgtgcggccccaggaacacccccgaggccagcagtagcgagtcgtccttgttgaactgggagaactgggtgtagctccagttgtagggccgcatgtccgcgctgtgcagcagcgagatggtcaggtcgttgctccagatctgttcggcaggggcggctgtagtgatcgcctggccaggtcgcggggcgggggcctgctactacacagccatgaggccccagctctgccagccctactcagaggccaccagggagcagggaccccttccagccactgtcatccactcggggggcattggtatagagcggaggagcctgcccctgaagcaggcggctgtgtgtgggaccctctcctcagcactcagggccaccctgcaccgctcctgatcctctgtggtccctccgctggatgcagggaggctgctgtcacctctggcctgacccacccccccccccaccaccacctggttggaacgcctgggtcctgggacctccgtgctgcggcagagctgggtggggtgtgcaggacacctggccgtcctcaccttcacagtgcagtccttggagcaggacgcgaactggtacccggaatgggagaagctgaggtgcaggacctggtctgtgtgttcccgcagcgtctgcacctccacgcagggcaccgtgtcatacagccgctggaactcctcgtaccaggacatggccgctgcgggtgggcagttgtcagtcctgggcccgggccttcctcgcagtcacggccatgagccgagtgtggccccagcagtcctggcaggccccgtggtgcccctggaacccactagtcatggcataggcctcggctgggggattcaaccctgtagctcacagagacccctgtaccccccaccccccaagtgacccaatgaaccctctggcctccaagctctgaggggcgcctgcgctgtgtcctgacaggcctctatcagggtgtgggggggtgagcatggacacgcggggccgcggggcgggcccccagccaggctgacccccaagcgcaggggcccggggccctggctgcagaacgtgggtaggggccccacacgccactgacctgggtgtcggggcacgtcgcgggccacctggtagtagcggtagaactgctccctccacaggaactcgtcccgcgacacggcctgccattggcggcacaccagcccggcggccagcacgtcggccgggcccaggctcaggaagatctggtagaccaggctgtcggggagcaggggcgtgccgccctcgtccatcgtgacattctgcccaggcggccctgaaacccaccaacggctgccctcagcccaggcccgggaagggaggccgagagcgggcgtcctgttcctccagccccaaccgtcccgccgggagttccacggggctgcgtgtctgcaggggacgcccgggtaccgccgcccaaccaaggacccggcagctccgggcgggccgggccggcccctctccgccgcgtcatcccccggcctcctgcggccggcagcgggcgcccctcagcccgccagggcccggaccgccgcacgcgaggcacggggacaccaggcgccgtccggggacgggcttccgccgagaggaagctcggggcggccaggcagtggcctccgccctgcggccctggagcagctctgcccggcgggctcggggcggacggcggggacgagcgcacgggcggcctcggggctcctgcactcgcccaaggcgggcggggacgacaaggcgggacccccgagggccgcaggcgcactcaccacggccgcctccgcccgctgcgccgcccccgccctgcgcgacccggacccgcttccgctgccgcagccgctcggaccgccgcccccgcccaacggggagcccgccaggcccgacgccacgagccccgaggcatcgatggccgaggaaggcagagcgcgcgggtagcccgcatccgcccctcgtgcgcctgcgccttgggctccggcggcctggccggcttttctttgtgcgcctgcgcgcactcgggcgcattgggaacagcgccccttgtggccagcgggcggcggtcgtgggcggggttgcaggcgaggctcaacgaacgctggttcgggacccgcctccggcgctccctgttgccgggccctgagcaagtggcttcatgaaccccgtgacgttggccatggagataagaccactgggtgatggtttaaggaagataacgtgtaaagggctaaggactgtcggtggaaatcaggggtgcaggagaaatggataaacagccagaggtcaactcggactttgtacataggacatggtgccagggccctgccaggaagtgcagatcgaagctaggctcacgaggaggctggaggtggggggtggggaggcaacggatggacatggacttcctgggctgggctctgtgacagcagagtagactctgtcctgggacttggtggtgctacccttggcctcccacagtcctgccaccctgctgccgccaccatgctgccccctgggactgcgaccctcttgactctgctcctggcagctggctcgctgggccagaagcctcagaggccacgccggcccgcatcccccatcagcaccatccagcccaaggccaattttgatgctcagcaggtagaagttggggggggtagagggaggcaggtagaagttgtgggaggggtagagggagacaggtagaagttgttgcgggggagagggaagcaggtgaagttgtggggggtgtagagggaagcaggtgaggggccctcccacagtgccctcgagttctcccatggtctgcccccagtttgcagggacctggctccttgtggctgtgggctccgcttgccgtttcctgcaggagcagggccaccgggccgaggccaccacactgcatgtggctccccagggcacagccatggctgtcagtaccttccgaaagctgtgagtcccagagcagccctgcaccctaaccccaaccctcctctcagcccccggacttcagccctgctctggcccctgaccccaccccggctgtggcctggactaggattcctggttggggtctcccagcctgtggtgcctcctccccgcccccccagggatgggatctgctggcaggtgcgccagctctatggagacacaggggtcctcggccgcttcctgcttcaaggtgaggcaggggctgcagggcatgtgggtgggggatgacgcagccactgtggctctctgacatggctactgtggctctgccccagcccgagacgcccgaggggctgtgcacgtggttgtcgctgagaccgactaccagagtttcgctgtcctgtacctggagcgggcggggcagctgtcagtgaagctctacggtatgtgggggccagcctctgtgaccaggcaggcgctcaagctctgcacactcactgggccaccccgaggggctgggtgagcccatggggacacacttcctttctcccatcctgatcctcctgctaagcaggggcccagggagtagtgacagacaggcctggtgtgggagcagggagagggccccgagggggcaggggacacacagaccccgtttccagagccctccacgccgcctggtgccaggaccccaggaaccctgtctgccctgcagcccgctcgctccctgtgagcgactcggtcctgagtgggtttgagcagcgggtccaggaggcccacctgactgaggaccagatcttctacttccccaagtacggtgagtgtccccagcaggtccccagctcagccacccccactctctgggctgatgtccagcctgacccctgccttgggcccccaggcttctgcgaggctgcagaccagttccacgtcctggacggtgagtgcacagcggggcaagcatggcggcgtggtgaggggggccactgccaccggctgagtctcgtctctgctgcagaagtgaggaggtgaggccggcacacagctccagtgctgagaagtcagtgccccgagagacgaccccaccagtggggtgcccgctgcctgtcctccgtgaaaccagcctcagatcagggccctgccacccagggcaggggatcttctgccggctgccccagaggacagtgggtggagtggtacctacttattaaatgtctcagacccctctctgactcttctgtccactctggaccggcgccagtaccaccaaggccctctctgcccccaccccgcctctttaaaagcccggcgctccctgttggctggagtccacgcagtgggcactgggccgatttcagcggctcttgggatttgggaggggagatcctctctggcatatgcccatcttgtgccctgctgggacctgggggcgtccagcctcactccaaggctgctcttgcctgggccattgtcctgcagcccccgggctgctcttccgcccccgtgggaggccagctgtctcccgtcactgcccattttggcctcttccgagccgagctggcaccagctggcccgtgttggtggcagcagttggtgctgtccacccacagccactgcactctctgcacacctcatccactcccacgtcccccgtgaaaccaggaagcagaagagaatgtgggggtgggccagctctgccctcggggcagcccctgggctagggccggagaatcaggaacccggcatggcttgaccatgctgggcctggacctggccgctaagctgctcctctcaggccctgcctgcggccactggcatttgtttgataagcatttctgaaggcccactgtgtgctgggccctgggaccaccaggtgggctggtccctccccctaggaacttacaagtccagggatcagccaccaatcggccacagtgggcagggatgggaggagaaggcaccttggagttggtcccaaagcacacggcctgggtgggggcagggaggagccagcagctgcttcaggggggtccccatcccacgggcggggctccccctgccgtgcccacctgttcactaagctgctagaccccaggagggcaggcaagtcaggtggtgggaaggggaggcaggggccctgactgccgggacctgggaaggagaagggcccaggaggtcgtacccttgcatcgccttcccccactccagctccatgtcccagagacccatgagatagcagggcgcagcagaagggctcagggttcagagctggcaacgccgggaagactctaggcctgagccccaggaaagcctcctccatgcctggccccacatcccccaaacagaaagtgagggtctcatctgggggcaggaggagtcgggtagctggccacggtcacaagcttcagggagggctgaatgtccgaggggtggcgccagagacccacccgatgaccttgggtgctgtggttggtggcagagtggcccagcctgaccctccacgcctctgactgcagggctgggtgggttcccgcactgagtgaagtgcgtggccacttggctgtgtgctctgggaccagaggatgtgcagcgcaaggattacaaggcatttcattttcacagaagcattgaatgagctctagttaaatttcaaacactacataaaatcacgatagctctgtgtgaatcattgttctttaaaatagtttgcataatttggctgggcgtggtggcttacgcctataatcccagcactttgggaggctgaggcgggtggatcacttgaggccaggagttcaagaccagcctgtccaacatggtgaaaccttgtctctactaaaaatacaaaaattagctggtcatggtggcaggcgcctgtaatcccagctactccagaggctgaggcaggagaattgcttgaacccaggaggcagaggttgtggtgacccgggatcatgccactgcctccagtctgggcgacagtgagactctgtctcaaaaaaaaaaaaaaaaaaaaaatctatggaaatggctgggcgctgtggctcacgcctgtaattctagcactttgggaggctgaggcgggcagatcacttgaggtcaggagtttgaaaccagcctggccaacatggtgaaaccccgtctctactaaaaatacaaaaaaaattagccaggcgtggtggtgggcgcctgtaatcctagctacccaggaggctcaggcaggagaatcgcttgaatccaggggacagaggttgccgtgagccgagatcgcgccattgcactccagcccgggtgacagagcgagactctgtctcaatttatttaaaaaacaacaacaaacaacaacaaaactatgcaaactggctgggcacagtggctcacacctttaatctcagcactttgagaggctgaggcaggaggatcgcttgaggccaggagttcaagatctgactgggtgggcaacatagtgagacctcatctctatttaaaaaaaaagttttttcatctatagaaactaacatttaattgttagcagtcttgcccaagacctgcggggtcaggagtccaggactgtcctgggtgcccccgccttgcctggacgtgagagtgctgtgtggggccccgggagcccctggtcccacaggcagggccgacaggcaggtgccgtgcccgtcctccctgcccacgcaggtgctcagagggacaggtgggccaggactcctccatgtggggacgaggcaccctcctccccagccacgccccaaccacccctggccccccaccccacccccaaggggcctcccagcgcccaggaccgtgtctgggaaaaggtctttgcccggagagtgggaagagagaggggagggtgagcagaggacaggccgggagttttccgggaacggaggaagagcagtggagggtaagtctgtccttgttgctgtggggaggccgagatgaaggcgatgggttgggggtgggggtgccggggagcgaagcagagggaagagaggacctgatgggaggggtcaatgggagaggccccagggaccggtccccacggtgggctgggggtccagggtgctgagtggaagcggcggtttccctcccgcctctcaaggacgccttgcagaaggcgcggctgctcctccccgtggcacgcaagctcccgggcaccgcctcccgcctcggcctcccaaagcgctgggctcactggcgtgtgctgccgcgcccggcccgcccaccccaggcggtatggaaggccgaggtcagagccaggactcccccgggagccccgcaggtgcctcaaggcccgcgtcctgcacggcccgttccagcgccgccggcccagccaggcaaaggcacctgcagggccctgattgggcggcggaggtcacgtgcccaccctccaccaatcacgttagacgggaggagcagcacctgcgtctgccccgcggtggggggaggaggcgcgccgaacccattgtcgtgtccgggaggctcctgcaggggacgtggggggcacagaggttaacggcagcagccagtggctacctggaggcacacacagaccccccagggcggcaggagtgggtctgggggagggagcatggggcctgaggcgctgcttggagccgagggaccctcctctgtgtcgaggactcggcccacccgacctctgctgctcagtctctgtgggtctcgggctggccagggaaggcccggttttcctcccgcagggccctgcatgggcggggtccgtagcggggactgtcctgtacatgggctgtgtgctgtgatcccaaatctccccagtgccctgcgataagacgggctccgggaggggtgcctgctgcgctgagagcgggaccctggggctgcggacaggcgctcctaggctggctggggccagggggatggtggagagtcgaaggcgccttggggagttcaggggaatgaacagattatttccaacttttccttccctgggccagcctcctgaaacgctagcgttgtgctggtgagacaaggcacagcaagctgcccttctacgtgggcagtgaggcctgggacagagcccagccctggagccctgaagtcctgggggctgggctcttcgagtggccaggctggggctgccacccagggcaggctgccgaggcccagggcacctcctgggatgagcctaagtcccttgtaagcagggctggatgaggggaggaggtggccaggacagggaatctggggtgggagggggcagccaggacagggacctggggggcctggacagaggctcacaggccaggcacacggtgagtgggaggcacctggctcacccttggtgacccctaacatggagtccagcacccagaggcttcagctacctgtgaggatgggaggagaggtcaggaaggggactccactccctagccccatcgtccaaggggtgccagggcagctagaagccccaagcctgccattgccctccctgccagccctctgtttacattttatttttatatttttagagatgagatctcagtcttgcccaggctggagtccagtggcacaatcatagcttactgcaggctcaaactcctgggctaaagcaatcctcccacctcagcctctcaagtagctgggaccacaggtgtgcaccaccacccccagctaacttttaaatttttttgtagagatggagtctcgctatgttgtccagggtgatgtcaaactcctgggcttgagagatcctcccaccttggccccccaaagtgctgggattataggcatgagcctctgtgcctggcctactaatcctttcttttaggcaggaccagcatggggtgcccactcccattagtggggcttcccagccctgcccctccctctgggcagagactgcgtttaaaatgccccagctgtcctcaccaggttgcctgggtgctctgcaggccccagcctccctcctcgcctgctcgggccacctccaccccggcctcatggccacagggcccctccctggtcctgttcttgctccagggccacggcccacgctgcggttcaggcatgtgtggagccaggcagggtgggggtaggggggcggctggcaggcccaggccctgcagggggaatgcccgggtttggccacagctgggccctgtcccttatggctgcggcaggtcacgctgtctgcctgggacgcaacattctgtgacagggaggaaggctggggcaggctgcgtggggcctctgaacccccagcatggggcacttggaagggggctgaagggggcagggcctcagaaatgagaagaagaggtggaaggtggacctgggggcccctcctaccccacctggctggaacccaagagaccgcaggtgggtgggtgggacctgaggagagcccacaccaagcctgccctgggcaccacctctcctgccagtcctgaggagggaggcagaggggcacacccccttgggaggggcacctgctgggtatgtgcatgaagaggtgggtctctgggtcacctgcccatggccacttccttctctctgtccctgtgggcccagcagctgccaggatgaggctgctgtgtggcctgtggctgtggctctccttgctgaaagtcctgcaggcccagaccccaacccccctgccactcccgcccccgatgcagagcttccaaggaaaccaggtacaggggttttgacggaaggagaagcagccggctgggtctgagtgcagggagaggctggtggctgagcaggcctggggatgctgcccagagagccaggaccagccgtgcttccaggagcccccaggcgggcccctgacctccagcagaggagggcccagcgcagaccttcctggcacccattccctgccgtcagcccagcccatcgctccctctgtgcgtgaggggaaacaggctcgggaaggccgcacagccactggccagggtcaccatgtccctgccagacccagagtaggctctggttcttgccagtgtccctggcgccggcccagccaggagcactgctctgtgaggggtccagaagctgccagggagggcgggagggggctcctgaccctgcccactgccacccctgcccaccgccgcccctgcccaccaccgcctctgtagttccagggggaatggttcgtcctgggcctggcgggcaacagcttcaggccggagcacagggcgctgctgaacgctttcaccgcaacttttgagctaagtgatgatggccgctttgaggtgtggaatgcgatgactcggtgagtggctgtccctgccgttccaagcgggtgaggaggatcccgggcctgggtcccagccgccagtggctcaggtgcgccatgggccctgtcccagcacaggcagcttcatgactctgcctgccaatgaccaaacccagctggggagtatacaaaaaagtgtgggcagctgggcgcgctggctcacacctgtaatcctagcacttcgggggccgggtgcgctggctcacacctgtaatcccagcacttccggggctgggcgcgctggctcacacctgtaatcccaggacttcaggggccgggcgcgctggctcacacctgtaatcctagcactttgggggccgggcgcggtcgcgcacacctgtaatcctagcactttgggggccgggcgcggtggcgcacacctgtaatcccagcactttaggggccgggcgcagtggcgcacacctgtaatcccagtacttcaggaggcagaggcagaaggatcacttgaactcaggagtttgagaccagcctgagcaacatagttagacaccatctccactcatgacgcttggccactcccgccgtgggtccctctgaataagtggctgaaatctcctgaggggcccacctcagcatggacctgccagcttccggagccttccgcctccacctgtcccctcctacagaggccagcactgtgacacatggtcttatgtgctgataccggcagcccagcctgggcagttcactgtggaccacggtgtgggtaagccagtcacaggagggagggacggggtgctggcccacagggatgtgacgtctgtgccgcctcagagcccggggcggacagagaggagacccgggtggtggacagcgactacacccagttcgccctgatgctgtcccgcagacacacgagcaggctggccgtcctcaggatcagcctgctgggtgagcctcccaccccgtcctgggcccgtgtgtggccctggaggcacctccttccaggctttgggtcagaccctgcctccccaccccgcctggagtgacttgggggtacagatagttcaatctcccacctacccagcccccaaccccctgccaagtgcacagacccatgctgggctccctgggctgcaggcaggagctggttgctgcctcccgggacgctggaccagttcatctgcctgggcagagctcagggcctctcggatgacaacatcgtcttcccagatgtgactggtaacatggttcacctgcaggcatgctgggcagtaggcacggggcccgcaggaatgagtttggttgaccctagaggagctggacccagtgtctacccagggagctcagccccagcctgcgctcaggggtctccaggctcctgggtccctgtgctcaacccaggctctgagccacctcctgccgccccgggtcccctgtcctgggccacctcctcccaccccgggtctcctgtcccgggccacctcctcccgccccaggtcccctgtcccgggccacctccccctgcccctcccgccccaggtcccctgtcccggcccacctcctcccaccccgggtctcctgtcctgggctacctcctcccaccccaggtcccctgtcccgggccatctcctccctctgggtcccctgtcctgggccacctcctcccctcacccatccctgctcacaaggagcttggactcatcccaggaggtgccctggacctcagcagcctgccctgggtggcagccccagcctgaccactcagacagccgcggcccccaaggcctgactcttcttgtgggagggcgaggtcagcctgagtccctcctcttcctggagggatgcccaccgtgcccttctgattcccgcctctggtcctttacatgtgcataaccacatgcacacacactcacgcatgagcaaacgtgtacagactggcacatgcctccacatgcgaacacccacttacacacacgccactcacactggcacacatgctgtctacccgtgcacaggcacacgtgctggtctgcacacacctgcacacacctgcacactcgctatgccaggcctcctgggtctgcagtgagtctgggggcccatggggacagggacaggtgaggggcttcctgaggacctggggctgttgggagccgctgtgggccacatcttctgccccttctcagcctccctcaccccagccccttcccctagacccactgctggtcccctttctccctcctgcttctcacctgaagccacctgcccctcctttgtgccctcccttgcttcctcctgggctctgtcccctgctccccctttgtcctccatcccgactccatctcccccaccaggctggtcaccccaggccagcgtctgttgaaggatgaagcagctcctgtccggcccagccctgcctcacagctgtgcgagctctgccctcctcagctctcaaacctgaataaatgcaccaagcccagagccccagagtgtgaccactatgaccttgggttgggcaaagagacaggagcaaggcgaccgctgaccctgcagggctgcaacagctccttctctgggcacactatggccccccagccggctgtctctggccagtgtgtgtgactctgtcagtgagggcatgcacatgtatgttcatgcatgagtctttgcccatggttgcaggttgtacaaggtcgttcccaggccaaggcccctccatccctgccccttgggcccttggctgtgggagttcgcaggctcttctccacctccaccctggtcagcactcggggctgccataccagatgcagccgggctggagcttgccccggaaacactcagaccccgagctgtcccaggcagcggctgttctgtcagggaagctggcctggagctaccagggtcccagaacaggaggaggccctggtgcagatgccccaggcctgggagaggggaggcggtgacaagcagcctcgggctggagcctgctgggcacagagacacaaagggtctgaggtcacaacccagacacccactcccagcctgagccccccaaccctgactgtacacccctgcaagatgtctgtattcggacgcccacccccaccggccagccagagcaactcatttctcagccctccgatgtctgtgtccatctcagcccccactgtcctccgggcagggagagcaggacaccacccagggcggccatggaccctagtggtctctggccttgctagagagtaaagagcatccagagacccccaacctggtgcctaaccttcacccaccaggagcaccccgctactcagaagcatggcccttgtttagaatccttctgccatcatgtgcacctcctgctgggcaggctgtacaggatccaagcagattctggaactggaagacggacagagacagcagacagactggaattcctccctgccctgacggccccaacgagatggatccccatgatcaagtcaaacgacaccagctgtggtgcttactgcagccacaattcaaccttttctgtgtgtctgactccccaacacacaactcccacaagggcaggcacaggcctgctttgtccatcactctatcccacattccaacatggcgcctgacacagagaaagctgctgaaggatggatggatggatggatggatggatgatgggtgcatggatggatggatggatggttagataatggttgcgtgggtggatggatggacagatgagcagatgaatggataaatggaaggatgggtagatgggtgggtggatggatgggtagattaatggataaatggatggatgaagggctgggtggacggatgatggatagatgtttggatgatggatgggtggatagacggttagatggatagatggatggttggatattgggtggatggatggatgggtagatggatggatggttggatgatgggtagatggtggatggttggatattgggtgggtgggtggatggctggttggatgatgggtggatggatggatagatggttggatgatgggtagatggtggatggttggatattgggtgggtgggtggatggatggttggatgatgggtgggtggatggatggttggatattgggtggatggatggttggatgatgggtgggtggatggatggttggatattgggtggatggatggttggatgatgggtgggtggatggatggttggatgatgggtgggtgggtggatggatggatgatgggtgggtggatggatggatggttggatgatgggtgggtgggtggatggttggataatgggtgggtgggtggatggatggttggagatgggtgggtggatggatggttggatgatgggtgggtggatggatggttggatgatgggtcggtggatggatggttggatgatgggtgggtggatggatggttggatggtgggtgggtggatggatggttggatgatgggtgggtgggtggatggttggatgatgggtgggtgggtggatggatggttggatgatgggtgggtggatggatggttggatgacgggtgggtggatggatggttggatgatgggtgggtgggtggatggatggttggatgatgggtaggtgggtggatggatggatgaagggtgggtggatggatagttggatggatgatgcttttttgctctttttttcttgtgccctagatggggaggctgaggttaaaagcagcaagtttggttgtgtctggattgggagatattctatactgtgtggttgtgaggacacaagcctgggtgtcagaaatcctggaccacagcctggcatatattggatttaaccctaggaaggttgagagtgaaggtggctgtcttttggcagaaagggcttgttgggtgttctttcctgaacgcgtcaaggaggtgtccctcaaccctggggtgggggtcagacacaaggtcccccagagcaatggcctcactctctactctcttagtcctttccctcatccctcctcctactgggccacggtgtccccatgggtgagactcactctacagggccaggacttgggccttcaccagcctggggcctgggccacgccctcacccgatgcctggctgcagcaggggatggcttctgcatggggtccaggcacaggacctaggccaaaagagaggagtggcctaaagaggctcagcttgagaagagagccctgccctgcccctgacaatctaagagagactccgcaggccaccttctccctcttgacctggcacagcctttgccagcggaaattcttttcagtccctctgcacagatggggaaactgtgaggttcaggaaggctggctggtcacttggcagggtcaccttgcccctgccagcttccctcccccaaggcagggaacataaccccggctgcaagatcatgaccaccatgtgctggtgggagccaccgccttcctggcacccagctgtaccctccagtggtgaccagctccccggacaaaggcacaagcagagactaagactccctggcggtgccctcctcctccctggcggtgcctctgcaaagcccagcgcactccccttccctccgtatcagctcctggctggggagacaggagatgctgcctaggcctgcattccttcccagctcttatggggagggcgggcttcaggcctggctggatccagggccccagccacccccttctgtgtcactggccctggccggagtggctgtgcagtcccattggcccacttcactcccacctgggttgcagatggtctctctcccagaagtcctcagtcctgggtggaggctgtgttcccccatcagtggtcaggggacccctccacacagccctccctctcttggactccagctaccacagcccccctcatcccatctttcctggggtgatacaactctctctggccctggtggtagcgggccctgtgtgaacctcctccccgcaagtcccccaggggcaccagcccttcctggctgaagaccctttccccatgtctgcaccaggggacggggctgggagctggcggcgtggagccgaggccaggagaggccaggcaggtggtccaggcatgtctgccggcatgtgagcccagaggcctggggctggacacagaccagagagggagcccgcctgcccacctgtctgcttgctggagtcaagccaggctggcccagtggggtggggtgtcctgctggcccctacccccatgccccaagcacggcagcccaggcccctgtgggtggccagattgaatctctttaccctggcctgaatctctttacatctgggcctgctgggtctgggaacagcctgtgcctgcccctcccacagaacagggtcagcggggttgggaagcaggtaagttctggtgggtggaggggctggacccagggctggcttccgtgcctccagtggccaccaccacctcccggatcagcccctgcggtggcagagggggcctttccccgaaggccagctgtggtccctctcagccttgtccagggcccaccacagccacacagagcctgtgcctgcgacggtgaccacaggagactgtgacagtgacggtgaccacagacaggccacccagggctcaggctgggtatggtgggctctggtgggaagcagctcccgcacggctcacggtggggagggtcccttccggtcctcaccccgcgataccccttcgcagagctcatgccccctcggggcactctacccaccgggtaccttccctgggctgccccacaggtcaagcgctccacccacgccctctcagacaccaagaggcagcctgggaggggctgggcaggcgggaatggaattttcgggtctgggccaggctgtccacaggcccaggagggggaccaggcccagctcctcttcacacttctcagacctggggcgaccggaggctcctgggtatccaccccagcaccccagaccaggaaagtgaggcacaggtggtagaagacctgccagagccgcccagcacctgggcccacactgctttcccaggatcaggctgcagagcccctgggcggagtgggaagcacagggtccccttagcgttgttctgtctttgtgggtcctgggcctgctcccgtgcagaccttcatctgagggcgtgtagtgtgtggtggggaggtggacacagctgtgccctgacctcaagagtggcctgacctgggtgcggggctgggtctgtgtccaaaaacagacacaaaaggccacacattatgtgattccatttatgaagttctagaacaggccaagctcctctccactattagaaatcaggtctgtggctgctgcgtccggggtggggacactgtggggtggggtggaatgttctgtggccaggggtgagggtgctacctgcagctgggtggcgggggggtagaatgttctgtggccaggggtgagggtgctgcctgcagctgggaggggtagaatgttctgtggccaggggtgagggtgctgcctgcagctgggggcgggggttgaatgttctatggccagggtgagggtacagcctgcagctgcggggtgggtagaatgttctgtggccgggggcgagggtgctgcctgcagttggtgggggtagaatgttctgtggccgggggcgagggtgctgcctgcagtgggtgggggtagaatgttctgtggtcaggggtgagggtgctgcctgcagctgggggggtgtggaatgttggaatgttctgtgttggggatcggagcgctgcctgcagctggcaggaggtggagggggtctggaatgttccacgtcaggatcaggttttgctcacgtgggtgttcatcgaggtgtgcgactcaggtgcccgtattgctgtgagacggctcccacggtgggacatggtgatgccacgctggatgcccccacgtgcacctcttgccgtgtgtgggtgaaactcctcccgctgagtgctgggctcccgggtctgggtctgggggtgcagcacacgttcatgttcgcattctcagaacacccactgaccctctcccaccaggcagagcccaccctccctgccttcatgtctgcagggcctggcgcggagcacgaggccgctgggcactgactatggagctcagagctgtgttggtggaccaggcatcccgtgaggccacggatggtggccgtggatctaccctgcctggcccacttctcctccacactccccttcacagcgcatgactaggcagccagggccctgagccctgcaggaggagttgaggggtacacaccaggactggaaagcctggggctgttgcacagagatgagcggggaggccaggctcctcaggaactcgagtggaagccccacccaccagggcctgcagggacagggctgcgaggggactgcctgcagggctgctgggaatgggacctggagccttggctgagcagggcgggggctcctgctggctcctgagcccagggccgcccagctcagctgggcccagcactccctgtccctcaggccctgcctgatccggtctctttatcttggccgagagcagcgccctcccggccaccatctgggcctgctgggccaggaccagctgcctggggctttccagcgctgcctctgcatgttttctgcaggaggaagaaggagggttgggggcagagtcatccagggactgagtgggcggcatggggggccagacctgtggtgcagagctgagctggagaccccctcagaccctaggccctgctacctttcccccggtccctgggaagcacgttttcccagtaacctcctggcgtgagaaacttggccccggctcgccgattccccgagactcaccccacgtgccccatacatacaatgcggggactcggggctcctggcaggacggcccacagagtcaggacagccaccagggcccccacacagggggacaggtgggctgaggggcccctctctaatcctagggtgtggggaggatctggcctcccagtccccagggcccctctgctggaaacggggtgctatgatatgaacgtgtccctagatttcacatgttgacatttcatccccaaatccacttttttttgtttttaagacaaggtctagctcagtcgcccaggctggagcagagtggcgcaacctctgctgactgcagcctcgacctccctggctcaagcgatcctcccacttcagcctctcaagtagctgggaccgaaggtgcgccaccacgtctggctaatttttaagttttttgtagagatggggtttctccatgttggccaactggtctcgaactcctgggctcaagtgatcctcctgccttggcctcccaaactgctaggattacaggcgtgaaccaccttgcccggccctcaaattcacatgttggttggaggtggggcctctgggaggtgattagggttagataaggtcctcagggttgggcccatggtggacttggtggctttatgagaaaagagagacctcagctggcagctcttgccctctgccacactgcaacttggccccttgacgttggacttctcagcctcctgaactgtaagaaataaatttactttctttgtacatttccaatgtcaggtattcagttatagccacagaaagctgactaagacgaagggggtgaagtttgtggggggcttgtgcaggggcagcccagggtcctcagagccaaccccaggcagctccacccaccccaggggctctcctgaggtgggccattgggggagccacctcctagtgtcctcttggcaaaccagaactaggagtgggctggggctgtgggatctcaaagaaggagtggctgtgggtacagtcaccatggtgagggagcagcagctgcccaggatgtatcagggaggttgaaacattgtctccatctctgtgcaccgcctgcctaggcgtacacatgccagatacatgtgaacacacagaggcacacacgtgtgcacacaggcacacacaggcacacgtgtacacacacaggcactcacaggcacacccatgcatgcacacacgcacacacgtgcacaggtacacacatgcacacaggcacacacaggcacatatacacacacgcgcgcatgcacacagggcctttgctctgtgatacagtctcccttgtttcttctgaaacatctcccaagggatgtggacgtgtgggccccgttggagaggaatgctggtggaaaaagctattttgttttgcaggaaattgtcttatttcttaggtttgtgtggattaactgggatttgggttttttccatccagccagcaactgtgcacttcagtggtgatcagagcgggtccctggctctgtccccacggggactctgccctgggagggggctcagggttgtagggatcctcaggccggaccccgagttggctgggaggatgccgatgagcgtcttgccccgtccctgcctgactcgggacacagagcccagggcctgggagtgctcagggcaggagacgcggcagatgccagcatgaggacggcccagcctggcagacagatgtcagacagaggaagaggaggcagtccacatgccagtggggccagaggccagcacagagcacccttcccatggggtctgagtccttgtgggatgaaagaaccccacactggatggtgaagccggcgggtccttccgcattcaaggcaggcgtcctctttctgtcgatggggccccaggcctgccctggagccatcgctgacctcccaaaccaggaaaggccacgagcccaggagatggggccggctgggggcagggaggaggagagggctgggctctaaggccgggctgaggatgtgggcctggggtctgggggttgctgttccggagccagcggaagcccctggatgaggggagaacagactccaccgctgggcggcaaggcgaggcacggggtgggtgggctgcagggctggggctgggggtcagctcagggagcagcaagcaggctcggggaaccccttcagaggcacctgggagttgggggagggggcccatctcatacccacactgtcctgtgacccttccaggggggaccatcccaggcctggcaggggagagggagcaccgtgcccaccctggccctggaggtggttctggggcttggggtagtttctcttctgctctccccctcccctcaggctggacagcgccggggttcagccccctgtgaccgtggggcaccctgggcagacgctcgctgaccaggggccctgcaggcctggcgctgacctcagacgggcagggggtctgtgaacccaacgattgctgccttgggcagctgtaggcgtggcagtgccccagggttcagcacctgcctgaccacacggcatcaaagccgcctgtcctccccagcccccgcacaacctgccactccctgctcggcagaggaaggagactcgggccacacccagggagggacctcctctggctcgacatggaaacctaggctgtagctccctgcttccccggctgtgtttgtgtggcctggtggctgaatctgcacagagagcaggacgccaggtgcgctcccgggaagctgtcctagagaggggccggaccgcacacctggcgctggaagcctccatgactggatgtttgcaagaaacagaaagaaacttctgtccagtctcagccacaggcacgccaggtcctctgctgccttgccgcaagctcgggggtttcagtgagaccctctcccactcccacggcctcgagtggaccaggtagccctggtgttgctccctgggtgctcttgaccccccaaggcggctacaggaaggagaaaggcctatcttgaaaggactggaaaacagtgcgtcagtattttaaaaattaagctacaccatcataggacctggctattgccttcctgggtatttacccaaaagagatatagcacacacccacgcacgatgcgtgtgcccacggcggctttatctgtaatggccccaaactggaaacacccccaggtccacccacaggtgaaggagaacaaatcgtgatgtatctgtgcaacgcgacactgcccagcagtgaacgaaggagctactgatgctctcaacaacctgcaagccccaaaataaccgcgtggggcagagggcggagggcggagggcggagggcggagggcgtcaggcagcgagaaaggtggtgcacgtggactggacgcgaagccccagaaagccaggctcatctccagcgacggaaacacagcagtggcctgggggcaggggaggtggtggaaagaggagggagggagggactccaggggggctcagggaatctttagggcgaccaacacagctgccccctgattgcaatgatagtttcgtgggtgtgtgcgtcaaaccatatcgcagaggccgggcgcggtggctcacgcctgtaatcccagcgctttgggaggcagaggcgggcggatcacctgaggtcgggagttcaagaccagcctggccaacatggagaaaccccgtctctactaaaagatacaaaaattagccaggtgtggtggcgggtatctgtagtcccagctactcaggaggctgaggcaggagaatcacttgaacccaggaggcggaggttgcggtgagcccagatcccaccactgcactccagcctggcgacaagagcaaaactccatctcaaaaaaaaaaaaaaaaaaaccatttcgcagagaaggacgcagaagccaatggaaaagctgccagtagctgcagctggcctgatgtgagccacaaaaccggatgtgacagtagggtgtgagccaaagtgtaaaacacctgaggtccacacggatgtcagtgaagggctgtgcccacccatgggagagcagagacaaatgatctcggtgcagcaaagttgcaaatgtgtgtggattccccttccgggggaggtgagggccacacacagggacttcatccagagaggacagttcaaaaagaaaaagacggagaggtgcagggttagggtgggggaacctcagccaggtgaccaaggtcaacatgggcagtgaaggtcgcgctgatggtgtcccccatgtgatgtggtgggaggaagccccgcccccattctcttcctcccgaccatcaccggattcagcgtgagaaactcagcagacggagcccaactgagggacgccccacaaacacccgagcagcgcccctcaaggctgctgaggtcatcaaggaccgggaaaagctgagaaacgtcactcaggaggagcccgtggaagagagacagaatgtcacgtggtgtcctggagagaaagggaccttcagtaactaagggaatctggagaaagcctggatgtcagctgactcgacgtcccaacactggctcactgattgtgacaaagggaccatgagaattaggacgccagcgagagggaaactgggggaggggcacgcaggaactccctgatctgtcttcacattttttttctgtaaatataaaacattctacactgggtgcagtggctcatgcctgtaatcccagcactttgggaggctgaggcaggcagatcacctgaggtcagcagtttgagaccatcctggccaacatagagaaaccacgtctctactaaaaatacaaaaattagccaggcatggtggcaggtgcctgtaatcccagctactcaagaggctgaggcaggggaatcacttgaacccgggaggggaggttgcagtgagctgagatcgcaccactgcgctccagcctgggcaacacagcaagactccgtctctctctctctctctctctctctctctctctctctctctctctctatatatatatatatatatatatatatatatatatatatatatatttctaaagtaactgttttttttttttaatttttatttatttatttatttttgagacagagttttgctcttgttgcccaggctggagtgcaatggtgcgattttggctcactgcaacctctgcctcctgggttcaagcgattctcctgcctcagcctcccgagtagctgggattacaggcacccgccatctatgtccggctaatttgtgtattttagtagagacggggtttcaccatgttggccaggctggtcttgaactcctgacctcatgtgatccacctgccttggcttcccaaagtgctgggattacaggcgtgaaccactgcgcccggccctatgttagttttttatagttttaaactatattagttttttccaagagtcagcttttgacttggatcttcctattacatctttgtttctgtttgtttttgtttgtttgttttttgagagagtctcactctgtcacccaagttggagtgtagtggctcgatctcggctcactgcaagctccacctcccgggttcacgccattctcctgcctcagcctcccaagtagctgggactacaggcgtctaccacccctgaacccggaagttgcagtgagccaagatcatgccactgcactccagcctgggcgacagtggaagatactatatccaaaaaataataataataataaaagtttacattcaataaataaaatttttaaaaggatatttacatcagtgtagtatgtgaagtaaacaagaaaaagataaaactcactttttaagtaaaaacaatgagtcatgttcttgaagtatgttgtaatctttaaatatcagaaaattaagggaagttaatttttattattactattatttttttttgagacacagtcttgctgtcgcctaggctggagtgcagtggtacgctctccgctcactgcaagctctgcctcccaggttcacgtcattctcctgcctcagcctcccgagtagctgggactacaggtgtccgccaccacgcccagctaattttttgtatttttagtagagacggggtttcaccatgttagccaggatggtctcaatctcctgacctcgtgatgtgcctgtctcagcctcccaaagtgctgagattacaggcatgagccaccgcacccggcccctattacatctttgtttctatttgtttaattctcggtctggtgagggtcagcccccaccaagggtcctggcagtttcccttctaggctcgcccctcccctgcccacgccccggcagccctcaccccagcgtggctgggcgggtgggggaggggcttcttcctgggagggaggggcccctgagccccctgcacaccagccgggccccatctgtgacctctttgccacgcctctaataccgctcgcttgctcagagggcacatggccggggggtccttgggagtctgtgcaaagccttagtcacatggagggacctgagggaggctggatgtggaggagacagtgagagaaggtgaggtccccgtgtcatgtcacccaccacctgccggccaccaggttcctgcctgggacagctgagccctgacagccctcggcgaggaggcccgggctctctagcaacctggctgcagctcctgacacaggctgggctgcccttggcccagggccctccagagataacccaagtgccctgtgagcaggcctgagggagggtgggtagcccaggacagggcacctgggggtgaggcagagaccaaagacccacaagatgctccccaatgcaggctgagctccagggagctgctgggatcctggaagaggacagaggccccccaaggccttagaggaacccagagactgctgggcccagtgggaggtgtctggaccctccagcctgcgcccacgtcctctggcccacctgcccatcgtgcctctgccaacgggcccagagctgacgcacccccacagcccagcgcccgggtcaccaagtcctgaactcagaaatgcacatattccctgggacccctgagaattgggctgtggccaggccaaggccaaggtcctctggggaagccccagctaaggtcagcagcggcctcccagggtcagccatccccaggggcctcattacaggaccagggtggtaagaagtccgcagccccgcacagcagctgtcgaggggaggcagatgggctgagggccctgggggagtggggccaagacctgctgcacccaggagagaggaggcttggaggacaggggtggggctgcatctgggaggtcctggcccagactggacccgtgggcagagcagggtgggtgccagcagcctcagcacagacacactccgtcccacccaccaccagcgctctggagcctgccccgggccagggaacagcttggcctgatcctgctgacgcctcagggcaggacagggcagggaggctccaggcggccacccatgctgggcacacagtggactctcgcacggtgtcttctgccgtcacaccctgacccagggctggccgggagccttcggggcgacagctccgaggatggacgtaggggtacgagggcagggacccgggctttgggaatcagagctgaggcctggggcctccctgggagctggtggtctctgcgggtgcccaccctcagcccacatttccaccccgcttcccctcccaaggttgagaccagggaatggtgggcaccagtggaaggcacgctcctcaatctttgctgggctgagtccaaggagggccccctgcctccccagcccagcctccctctgccctgcctcgccccttagccccgctgctgaggagggagaggggcaaaatctcacccttcctgcacttggagaaaaagaggttgcttgtcctggggtgggggccagcaggggacctcgttactagggggtcccagcccagaccctcacccacccccttccccacccccatcctcaccccctgccaggccagctgctgccccagagtcctgccccctgcagccctgtgtggagccctgggactcctgtgggtgggcctcaccctgctggggacggtccagccacagcgccagggcccccagaggggcctgaacttgcctttccacaagatctgtctccagcctggcctcagaaaggagcgggtgagtggcctccaggatggggaaggaggaaggagggtgcagctgggccgatgggcctgactgccacagtgagcatggccctcatggccctggagaaccctgccaggtgggaagagctcacgccctctgtgcaggtggagaaagtgaggctcaggaaggctgcccacccactggccagggtcacccatccctgtcagatccggactcctgccagagtcacgggtgccagcccagcctggaacccctgcctggggagggggtcctggccctgcccactgccagcccctgcagttctgggggagtggtgcgtcctggggctggcggtcaacactttcaggccggagcgcaggtcccaattcaggatgttggtggcagccgtggtcatgtccagcctgctcacctgaggctgggtgcccagagcccctgccgggtgatgggactgcccggggaggggagacggagggctgtggggtggagacccttcatacagacaggcaggtgggtggaccccgtgggtggaaggaggcagcgcctgccttgagggagctcacccacaccctcagcacagctgtggggcccctgcttctcccccggggcctgcagtttggaggaggagcctgtcctgagacccaggggcaggggaagatcagggcagggtgcagggcccagggacatggtggctgtggctgggacatcccaattccatgcatccagtgagaacttccacggggaggggacgtggtcagaggcggggacaggcaggctgccaggaagagcagcctcaggaagagtggggagcaggaccctccgggaggccaggaagcctcccctccccagctcatccgacctgcccctccccaaagccttcaccccagcctctccccaccacaacctcctcccacagggacccaccctgcaaacgctgggccaggacccctgtcccggagaagcagccagctcagaacccccttggaggccgggagggtgagtcttccctgcctgacaccccaagaaaggcccagaactgccccaggttaaggtcactccacatctgtaatcccagcatttagggaggccgaggcaggaggatcaactggggccaagagttcgggaccaggctgggcaacatggggagagcccatctctacaaaaataaaattgaaaaattagctgggtgtggtggtgcatgcctgtagtcccagctacttgggaggctaaggagggaggattgcttgggcccaggaggctgcattgagctgtgaccgtgccactgcactccagcctgggcgacaaagcaagaccctgactcgaaaaacataaataaattaaaatggacactccagggaaggtcttggtgtggccccagagggggcatgatcagcagcctgtccccagcagtagggtcctgagccctgcctgacccgcctgctccgtgcagaagtggggttggaaaatgacgagatggaggctacgccgagaccaagcgccaggagaagggacccaggccaagctgctcggtgaggccctgagcacggcgggaaggggccatgcaggaccccctgagggctgggctggggagggaggggtctccccagggctcaccccccttcttggcacagggcaggggaaggagctggatttagacctgagggagaaatttatcagatttgaccagatcctgggcatcagccttgaccacattcccttcctgccccagactggccccggcaggccttgggggtgtggggtaggcaagcagagaccacactgatgcggggaggttggcccagagccctgcaggccaaagcctggggccgggcagcagtgtccgccgaggagagggtgtctggtgcctgaatgacacaacctgagaggcaccagccccaatcctgtccgtgcagcccagcggggaggactgcccaggagaccataggggtccggaggtcaaggccaggtgccagagggtcctggcaggacccggggtcactggaggcaccccacgtacacggcaggcggaggggacggcagtgccggaggaggggctgcagggaagcccttgtcagcccccatttctgacccaagggccttggccgggaaggccaagcttgaggcaagagggttctgagctggaagaggccaggccccccagacgcaggggccccgtgggaagagggaggccatgagctgaggccacagcagctgaggctctgagagctgagagtgagctggggccctgccggagcctcgctaccaactgctccaggtgtgggggacactgcggggcccaaacctggacacacctgcggcctggagtgtcccccccacccaacccagggcctctgagggtctctgcccaagctcctgggtcccctgtactgggccacctgcagctcccaaggcagccctgggggcaggcaggagcccccgggtcagaggtcgtgcgaccctggccttggacccttgggcctctgaccagcactcctgcctcacagaagagcccgtggtgagccacgagtgtgactgccaggggtcctgggggtcccgggccactctgggatccacgaggccctccttcctcctggccctggcaccccctccacccctctctctcctgcaggtctctgcttctccctcctctcactctagcccctccgtgattctctgcctgggccggccaccctctgtcctgaggacgctggagcctggcccggcccttggcagccccaccctcaccgcccatcccagcctcgctggtgccccctccacgtgggaggctcagccacacctgcccccacgaccccatcagaaataaacagtctgtgccaggagaagccggatccgactgtccttgagcactgggtgatgggtgggcagggcctcggggagcagcccaggttccaggcccaggaggagctgagctcggacatttgtcctcatctaacccccagtggctgcctccctcccagctgggtgctctcctggcccgtcccacgctctctggtgaacagagccagattcatcctcaaacataggccaccctccatggcgcccagcagaaactgccctaggctggagggctgggaccgtggggtgacagaggctgcggaggcctgtgaccaagggtccctgcccagctccacagcacctggcagcccttgcccctgctaggagcgccctttcctcaccgctggctcttctcagatctgtggccccatccccctgggttgcctcaaaggaaccccagagtgagaggcaggagcccccatctcaggggcgtgggcccaggctccctgtgtgccaccccacgttcccccgatgggaggcaggagtccctgaagatccaggcccagccctgaccgggggtgggcacagaggtggggagcagcctctgggatcgggtctccacctgtgccctgccggagccagcccctgcgctgaatggtacttccggcttctggtctctgtggggagcggtgcccagcctggtgctacagtgacccaggggtccttaggcgaggccctcccaggcttggcccctgcccagaccctgccctcctggggagctcccgcccagcccctaaatgggtgaggtggggacactttagccctgaccttccatggccgagctgggcgcttcctgaagccagactgggcctcagaggtccactgcaccgggatcctggagctgagcttctcgaggccaggggtgtgggtgtggtgtcgggtgtgggtgcgggtgtggtgttgggggttgggccgccccctcctcccggccctgctacctttgggatgcggcagcctctgaccagcctgctggaccccacattggacagatcgttcagcacccccaaattgccatctgtcccccacagacagccagcctagccctggctccaaagctgcagaattggctgaggcttggccataaccgtctttggaccccatggccagcaatgcacatatgagcctcaagtcccagggacatatctgctcccctatcctctggcttgtcccgggctgccctgtcctctgcgccgtccccggctgctgggcgggcctgacctccagggtggtgctgggagaggtggccagaggcagccagaaagggtgagcggagaggtggccgtcccccatgtcagtgaacacccaaacagacaggcacagagaggagggctgggtgaagagtgggtcccatgtgctttgagcagctcagagatgccctgaggaggggctgtcccacgtggcccgtccactcaggcctccttcaatcacagagcagctcccttgacgcagggaggccttggggagaatttcttgcccctagaggagccctgagctgcccccaccgcacccggccctggtctccccggctacaatctcaggggtgctcctgctctgcccctgacttgtccagaacactccacagcgtctcagtgatcccgggcactgcccttccctatggaagatcctcagcggggcagctctggcaggagtgagcctctggggccgtgaggcttgggtacctctgaaaggtggggtgtagaggctgcccctccccagtcccaggctgggggagttgatcccaggctgcaggtgggtggggctcacgaggtccccatgagtttatttgaggctggtggacactcagtcgagctcagctcccaccagtcactgggacagcctcggccctcaagggcaaaccattggtggggatgctggacagggtcatcactgcccccggaggatgctggccggggccccagggtggagacagcttccctccaggaaaaggttggggtcagttctgggagcttaggcccaggccaccaggcttgtccatgacctgcctgggccgcaggcagggggatggccttggtgacctcttagggtggaggccaagtctttgcattttgtgactcaaagagactggttcccagagagcagggtggggcggccagccttcttcctgcccagccctccgccaggctccactaaggtcctgcctggcagccaagctcagagcaaagggaagggcacagagagtgtgcagggtggtccttgtccctgcccaagctgcaagaggctctgcgaaggtccctcctgcccctgtccaccttgcacagtcctagccgggggaggaggggagaaatctggcgtgccaggagctggcaactgcccagcccttcctggatgtggtgagagatgaatctccagccctcgggtgggcccaggtgcacccatgaatcagggctcgtgggcagctcccactcactggtcctcactcagccgtgtctggggagtgtctctgaccacctgctggccatcttgaccacagggactgaggagtccgtcctgaaccgaagcatgatcctgttagctcttccagctctccaggcgccaacgaccatatggtctcggtaacgactggtcagggaggagaagggacatgggacctgctgggctttctgcagcccactagaaaatggggaagaggaggggcttggtccctgttccaggcactgggtttgagggctggacacccgagatccctgggaacccctctggctatgggaggacccggccccatcagacttcagagtccctccctggcaggtgacccaggcctgcccagacggaagccattcagacccagagccacgtgtcctgggtctccctgccccgggccacccgccaccacaccccagagcttgctcaccaccgggaggcgctcttgtcctggaccagcctagcctgggttgggacctccagccaggccagtcagcgagccaccagccccaccagagtggaatgacagccaggactcagctggcagcgggcaggaggccagtcttgtggtgatatcccagccgcaactctcttcctgcccctcccctgtcctgacggcagcccccagctctgtagctgagccaggcttgcgggccacgcggggtcccgggtttaggcaccccacccctatctgttccaacagactctccctctcagcccatggcacagatggcatctgagctagcagcacgctgctgcttcaggcaggggttgataggaggtccaggtggaggagtgggttctcaggactgccttggcccccctgcaccgctgccctccttctccctgcctctcaggtgcctcccggctccctgggactcactccctcaccttggcctctgcctgggatgctacccggccacccccaccagccctgacaccagtgctgcccactagcccctgctgctacataggcatgcgcctcccccagtctgggctccttgacccccgggcactggggaaggggaacaaggaagcagtccacaccagcccactcccagggctcgtgcgcccccagcaagggatgggccacagaatccaggaagaagacgggctccggcccccagtggtcgccagcagccccgtagaagctcaccaccccaccccatccgactcactcctgctctcatgtacatttcccagctccccacccgggctcaccttcagaccagcggcagcgctcacccaccacgcctgccagggaagctcagtcccaacagaatccagagagggcccaccacatgtgcctgcctgtgacggcctgtgacagggccccagccagggccaacgagctggaggggcccaaggagctgggtgcagcgctggggtaacaggacagccccacggggtgctcccgagtctggaccagactcggggtggggaggcccagactcggcggggggcagacttggggtggggggattgctgggggaagttggggcctctggcaagggatagggcctgtgctcaagcccaaaggtgccccaggctgaaatgggcacccaggggtcactatcagagccccaacagctggccatgggggaagccatgcccagcaaacctggccctcgggaccctgcgggccagatcaagtttctctaccttggcctgagcttctcatcaacacttcacttgctgggcgtttcaggaccaaactctcagggtggaagtggggcttgtgtccccttctggggtggcagggctcggaaagggaatgatggtaggggctgtgagatgtgggtcctggcccccagtgggaagtcaccagaggcctcggaggcgggcatggctgaggaacacagcccctgccctatcagggccgctgggttggtgggccctgccagcaggaggagggtgggcaaggtccctgccagctctgtctctgggaccagtgggcaggggcctctgcctcacccccacgctgcctcagctggggcagcaggcccaggcctcttgcataagcgccctgtgggggacgaggctgcagctgtgcctggccaccccatcccccagcatcacgagtgttcagtgggctgtccccgggccctgggtggaggccaagcctggcccataaataggggtctcctcagtgccctccgctcctcctgcacacctccctcgctctcccacaccactggcaccaggccccggacacccgctctgctgcaggagaatggctactcatcacacactgtggatgggactggccctgctgggggtgctgggcgacctgcaggcagcaccggaggcccaggtctccgtgcagcccaacttccagcaggacaaggtgaggggctttcctgcgtcatccccaagggctacaggaccctgtcaggggaagggcactttccggctgggtcttccccctgggaggagtgagcgaagtcccgcagtgccgggcagtgccggccagggactgagcgggcgcgcaggaaggaggctgggtagccgcccgaggaggctgcccgcgagaagccctccctgggcaccgcgtcccgtctcccctgatgggccacgcagacaccgggccacacacgcgcccacgccagccagacacgtccacccctgtgggcacgcgacccccagaggacacacgagcgcacgttccacacctgggtgccaggacacgggcgggtggggcacagggatggcgacaaacactccgtgcgcggtgggggttgggagggacgcgcaccgcacagacagccggcgacgcgcgctctcgcccgggagctgctcggggaagcgccggagcgcgggtccccgcgccgcgcgcccctccctggcgtcgaggagaaccccagcggtccgcagagctgagccgaagacccgccccgatccccgccaggaatgcgacgtcctctgccgcccgctgtatgggccaggcgctcagccagggcacagaatcgggaccgggggcggaggggccgaagctggctggtgggcggcgtgcgagggtgagggactgtcctcgggaggggcgtggccagacgggggtgctgggtgtcaggggcgtggccagcttctggggctgaggcgtgaggggcggggccatctccgggggagggggaagtggggcgtggtcatctcctggggcggggcgtgaggggcggggccacctcccggggcggggcgggggcctgatgggcgtggtcagctcctggggcggggacgtgaggggcggggtcagctcctaggggggcatggggcgtgaggggcgcggtcagttccctggttgtggacatgaagggcggggccagctcttggggcggggtcgtgaggggcgtggtcagctcctggggcggggatgtgaggggcggggtcatctcctggggcggggatgtgaggggcgtggtcagctcctggggcggagatgtgaggggcggggtcatctcctggggcggggattgaggggcgggggtcagttcctggggcggggcgtgaggggcgtggctgctcgggggattgggcgtgggggcggggccgggttggagaccggaggagtagacggcagaggcgcccccgcaggtaggcgcaggtgggtccggagggtcctggccgacgcgggtgggggtcgctcgccgcagttcctggggcgctggttcagcgcgggcctcgcctccaactcgagctggctccgggagaagaaggcggcgttgtccatgtgcaagtctgtggtggcccctgccacggatggtggcctcaacctgacctccaccttcctcaggtgggacagcgggcaggtgggtttctgggacggagaggtccagggacaccctcgggcctaacccctgaccctgaggtcacccacctacaggaaaaaccagtgtgagacccgaaccatgctgctgcagcccgcggggtccctcggctcctacagctaccggagtccccgtgagtggggcctccaccggccccctgggcccagcctgggggcgacacttgccgggacgactctgggccagccccctgccgcggagatccatggggtgggaggtgatggctgccccaccagcgtcagaggcaaaggccaggcctgggcgtgactacccatgcacaagtgttagggacagagagacccttcctccagggggttggatcctctctggagcccaccattgtcttgtcaggccccttccctgccctctggagttttccccacataagcagccccccaaggcccctccatatgcctcctcccaattctcctccccaggacccaggggtttcctcactcccacctggggaatggctcccacggggaaacctcttcacttccggttctggcagcgacttctgcggctgcaccaggaatcctggttttctgagcctggctcccccagattctggtttggggacagggttcacaggctgtgcaggcgagagcagggcactggctggagagcagccgggtgggggagcatcccgggccagccgaggggctgagtgcccccaaagcccacaggtgcaccccttccctgaagcagaggtgaggtttggggggctgagtccccgacagggttgtctcttgggttcccagactggggcagcacctactccgtgtcagtggtggagaccgactacgaccagtacgcgctgctgtacagccagggcagcaagggccctggcgaggacttccgcatggccaccctctacagtacgtgccccgtggacgccgcccacacgcaggcctgaccagagggggctccccaagacccagggcagggcacacagcatcccccccgctgaggccagctccgtctccaccctgtcccaggccgaacccagacccccagggctgagttaaaggagaaattcaccgccttctgcaaggcccagggcttcacagaggataccattgtcttcctgccccaaaccggtgaggggtcctaatctgatggggagaggatcaaggtcagattagaggcaggcaggcagtctcctgactgggggaggcagaggggaggaggtggccccgccctgctcgaggcctgggccagggacagagggggtgagtgttcaagtcagaacctccctcccgcagccccttcatgaggagccccctccatgggggacatggagaccaggcgcccactctgtgccaggccccagcagctcccaggatgtggggcttcagcctggtggggggcatagggtagagggtgcccatgggggatacaggggaaccaaccatactgggctcaggcacagcctcctaggggtggacagcctgctcttggcagaggtggagaaagaccctctctttgtttccagtgcccagggagaggtgggaggtgatgggggatctgtgcagtttgggggctcagtcaagacgagctctgcgttacgggaggaacaggaagcccagtgggaaaattggcctaagtctggggttctgacgacagcccctggcttctttcttggcagataagtgcatgacggaacaataggtgagccactccattcattcattcattcattcattcattcattcattcaacacacatccacccaacccactctgcgatgggatggatcagggccccaggacagcctggtgctgcagacccatccttcccgatggctgcagtccagggccgggcgggagacactggggctgcccacattgatgggtgcacaggtgtgaggctcagaaggaaaacctgtcccagtggctggaacagggctgactcctgaaggctcatggttggggggtgcaggtgcgaggccccaggcagacaaggccaaggggctataccacagggaccacctggcagcaagggtgtctggctcctgggctaggaggaaaccagggtgggggagacaggatgggagggaacaggggatggaaggggagggccaaggacgctacatggatgccgtgggacagctcggagagcaggctcagggcggattcacccaccacccccaggagggaggcctaggctggagctggagtctgtggaccctggggctgggaagggtggagtctgtagaccctggggcagcggggatccaagccccagggatggatcttgctctctcagcggggctcagtggggctgggggcagagaaaagtccccgtagcccgcacctgctccatcgactggagtggaggtgggctggggtagactgcagtcctccatcctagcctttcggtcacacccctcaggactccccagggctgaagctgggatcccggccagccaggtgacccccacgctctggatgtctctgctctgttccttccccgagcccctgccccggctccccgccaaagcaaccctgcccactcaggcttcatcctgcacaataaactccggaagcaagtcagtagagctggctcctggctgtctgcgctgtcatcacccgtcctgggcctggccctggccacccggacctccccctctaaaatctcagcctgacgtcaacaaaggaacaggccctctagtgtttgctcccagtggggtcttgagtcaggacagctaggagggggtgtccctcactgtctcccacccaccccacacagtcgtgtgcccctgccccacagccccacacgtcgagccataccccctcagctgccactgccaccaggccggtgctgagctgggggtcagtgactcagctaatcccttaggcaggtgccctgcacccccaacgccaccctgtcaccccctcagcagtaaaggcctgaggctcgaggccccagaggagctttggacctgttgggtatcttgaggtgtgggattaacgcactgagattgggcagagataagggtttcaggggacaaaaagaaacatttgtttgaaacatgccagagtgtctccaccccgcatcaggacagactgacagagtgggctggggacaggctaccccatatcccttctggctccctgtgcgccccctgccctctgacctgggcctccagatcacagccttgtccactcaccagagccctggcaccacggccacaccatgcccggccagtgccctgcccaaccctgctcccttccagattcccacccaggcagccattctcaggtacacaatgtgcaggactcactgtgacctgcccaccaggcccccccgaggcagaccctgcagaggcaccaagcattttgaggctcggaggtgagggtgagcttctgggtggccttcccggagaagggggcttagggctgtgcctgagctcaaggtaggggggattccaacatcccagaggggctgcagaaggccgaagaggcaggatgggtgagctgcaggccccctagcccagaggcccgtcagaactaccctcagctgccaggcatccggccccaccccggaggaaaggcaacggatggctggggttgggtggagggagccaggccagagcgctgcagggtgcaacttgatcagaagcctgtcacagtgggtgcagtcccaggccagccgccccagggcacctcaggggcgtaaagcctacagaggagccacctcagctctgccctgctcccgtgtccggaggagatgccatcttgctgcatgatgcttcgggctctgctgatcagttccctccttgccctgctctgggcatccccaggccaggcccaggtccccatccaggccaactttgatgccagccaggtgtgcccagccctgtttcctcctcatctccaatgagtcctcccggctttggtgctgcaccccgggtccctgtccacaccctctttgatccaggctcagcagggctaggggcaggggaaacccccacctcacccgctccgtctgactggagtaggggttggctggggaagactgcagcctccatcctaccttttcagttgcatcccccaacaatccccagggcccaaaatagggacaagttggttgcctgtgcctcactgtcccccacccaccccacaaagacctgtgaccttgccacagccccacccatccagccgtaccccctgggtgccagctgcagacaggccggtgctgggctggtgggggccagttgctcatgtactgaggcccccctccctcagttctgcatcggggtcgagatgtgtacagcagcccctgccgtggccaggaagcagctgtgtcggggcagaatgtggtgggctcaggcccagggcacaggggcggcctcccagccttccctgcacttgccctgcagttccagggcacctggtacatggtcggggtggtgtcagatgaccaggacttcctggactccaaggacaccatgaagatggctgtggtcttagtgacccccttggggaatggtgacctggccctcaagtttggataccccacgtaagtgaccacacgagcccatcagactcagcctcagaggatggccagcatgaggccacatgaaggtccagagggaccatggtgtccccagcacattgaggtcagaccacgggtcctcgacggctctgtgcggcagagccccagatggcagccacacggagtccagagggacccaggccctggaggaagcactgcctgaggcctggtgttgagaaaagtgtctgcatgtctgtgtctgtgtgtgtatcactgtatgtggctgtgtctctgtgtatgtgtgtctatttctgcatgtgtgtgtgtctgtgtgtgcgtgtgtatgcatgtgtgtctttgtagatgtgtacctctgagtgtgtatgtgtgtatcactgtatgcgtctgtgtgtctgtgtgtctgtgtatctgtgtctggctgtgtgtgtctatctctgtgtgtgtcttgtgtgcgtgtctatgtgtgtgtctgtcagtgtgtctgtgtctgtgtctatctccgtgtgtgtgcatgtgtgtatgtgtgtgtcttctgtgtgtctgtgtctggaagggggacctggaggccctgcattctaggctgtgtgcctgtgaacaggtacttaatacccaccccacccccagcaggagtgtccccacctctaaggtcatcctaaagtcccatgtcctctaaggattgtgagggtgaacaggggaccctgggctcagagacagcaaggtaggctctaggcctgggcgctgggcaggggtggccactcaggggattggggctctttctccccaggccccatggcgggtgccagaaaatggacacgaccttcaccgagggtgctgtaccggggcagttcagcaacccaggtgaggtggggcagcaggcagggctgtggcgtgggggccctggaggctgcatggactgctggattggcacctggggccggggcgtgaggggtgccacgctcgggggggaggtgccctgggcctggggtcagcggctctcgctcctccagccatggccctgagtgacatccgagtggccttctccgactaccagcactttgccttgctgtacttggagatgcggaaagggggcctgcggaaccagtggctgcagctctacggtgggcgggctgcggggcggagacccagacacccccgcttcgggtctgggatgtcacccctgtgcctgcaccagccctttctgcacgcggaaggtggaaccgctggctcctggtgtctgtggccgcgggtcccggcccctccctgcccctctctccctctcttcgcccctccagccccttccctttagcttacccgccctccccaccttcagctcgagcgcccgagctgtttcccgaaggcgcccagaagatgcagctactggcgccccaagtgggcctgagccccagccagggcgtcctgctgccgaagtcgggtgagcggtgccggcagccctgctgggagggccaggccccgggtcacacccctgctggaagggccaggccctggtcactccactgatctcagattcgggacagaagtgcccggggcagacccagcctgtctgggtcgggggagggcgagacgttgcccaggccggtgttcccaggaggagatcgccttggggcaggtcgggggcctccgtcccagggaagggggcgcggggtggcgcctcaggctcgatctctctgcagaccagtgtgcgggcgcgctctcccgggtgagtagaccatggccatgcggagccgcggaccatgggccctcccagctcggtgggctgcaccgcggggccctctaccttcggggcagctagggacgacagcgggggtgatggggcacccgggcggatccgagccgcagcagcctggggaaccgcggggctgcgcgtcgggagggggcggaggcaggggacgccgcccacctgctccttgttttgcagtgaggggtccagcccctgagtgcccgcaggggtcagctgctccgtgcgcccagccctgcccaaagagccccctccctccacaccctggccccaagcgcaataaacaccctgaatgcctgtggcgctgtgcgtttcttgggggcagggaggggtggcgggggggcggccaggtacatgggcgccctgggggaggggccgggtcaccccctgttgcccctctgggtaggcgttagcccaggagggaccgagcctcggctccgtggcagggaggttcctcaggacgggccccagccccagctctgggacttttctacctccgcacggacccagacccccagactgggggcgccgggagggcgggacacggacaccacgcggcgcgcgccccaggcttcagcggacaccgccgcgcgacgtggccttccgggtcctcccaagcggctgccccagtcagtgtcggcggcttccatccccaggcgcccctccgggtcccccagctccccagcccctgactcctggctccaggacccgccccagaggcctggctgttccggagaccaacgaagcgctcccaactctgacccagggcctgtccacggagagtggagggcgaggaggacaggaggagccgcataaaactctgccctgcctggagtctatgtaggacagtgttgtcttttacagacaagtctcgaagaatttgaaggaaaatagcctactagctgtaatgtacctagttcagcaaaataataataaaaatactggttgcaaatctgtgaatatttggatagtgtttaatctgggtgatgggtctacggggtgcagtatgctctgatttctccttctcagttggtcagagttttgtttgtttgtttttttgagatggagtctcgctctgtcgcccaagctggagtgcagtggtgcgatctcggctcactgcaagctccacctgccaggttcaagtgattcttctgcctcagcctcccaagtagctgggattacaggtgatcgccaccacgccctgctaatttttgtatttttagtagagacaggttttgccatgttggccaggctggtctcaaactcctgacctcaagcgatccacccaccttggcctcccaaagtgctgggattacgggcgtgagccactgggcccagcccagaaaatttgttattaaaaaacaccactcgggccgggcccagcactttgggaagctgaggcgggcggatcatgaggtcaggatatcgagaccatcctggctgacacggtgaaaccccgtctctactaaaaatacaaaaaatcagccgggtgtggtggcgggcgcctgtagtcccagctactcgggaggctgaggcaggagaatggcgtgaacctgggagacggagcttgcagtgagccaagattgtgccactgcactccagcctgggccacagagcgagactctgcctcagaaaaaaaacaaaacaaaacaaaaaaacaccactcggcggagcacagtggctctgcatcccccctgcattcccaggaagattccgagccgggaaatgcaggttgccctccacagcctcagggatgccctttccttccttccagggtggggcagcctctgggggtggctgtgggtccagctgtggtcagcccccaatcccttgcagacgcatcgagtccctcacctcccacgctcagccctttctccacctagaagcccaggggatggattcacaagatgtgtcagatcaggcccccctgctcagcaccccacagtgggtcccattgcactgagagtaaaggcctaagtctttttttttggaacgaagtttcgctcttgttgctcaggctggagtgcagtggcgcgatcttggctcactgcaacctctgcctcccgggttcaagcgattctcctgcctcagcctcctgagtagctgggattataggtgcccgccaccacgcccagctaatttttgtatatttagtagagacggggtttcaccatgttgaccaggttggtcttgaacttctgacctcaggtgatccacccacctcggcctcccaaagtgctgggattacagccgtgaaccgccatgcccggcctcaggcctaagtcttgatggtggccaacaaggtcttctcttttaggctttcctttgacccaccatccactcccctccctccgtcctgctgccagcccctcacgtgtctcagggcctttgcccaggtcacccctgcctggactgcccttctcccagtgccactcagtgcactcactcccgtctctgaagtcttgctcaaatacctcccttggttgttgacctctgctaccccaaaacttgactggcccccactcccctagagctcgttctccggaccttttgctcctctttttggcccagcttccaggtgctctatgccttgggaaaggtcagccctttccctcccctgttctgcctccatcaccgacttcaagtgtgtgcgtggggactttgtaatccctctccttctgcttgcaaagctccactaaccttatatctcatacactgtattaatgtatcctacattaaagaaaattgctcccatggctgggtgcagtggctcatgcctgtaatctcagagctttgagaggccgaggcaggcggatcacctgaggtaggaggtcgggagttcgagaccagcctgaccaacatggagaaaccctgtctctactaaaaaatacaaaaattagccaggtgtggtggtgggcatctgtagtcccagctactcgggaggctgaggcaggagaatcgcttgaacctggaaggcagaggttgcggtgagccgagatcgcaccactgcactccagcctgggcgacagagcgaaactccgtctcaaaaaaaaaaaaaaaaaaaaagtataaaaaagtatctcagagaaggacgtggtggaagccagtggaaaagctgctgccagtagatgaagctggcccgatgtgagccacgaaacagaacatgacaccagggtgtgagccaaagtgtaaaataaacacctgaggtccacacggacccagcctgaggctagttaaatgaaggttttgcagttttctcgtcatgttttggaactaatctttgtttctggtcttgtgtcagttcctacagctgccacaaattatcacaaacttgtagcttgaagccagagttcaaaatcagtttaatagggtcgaggtatcagccgggctgtgctccctccgagggctctaggggagaaaccttccttgcctcttctagcttctttgtcttctttttttgttgttgttgagacagagtcttgctctgatgtccaggccagagtactatggcgcgatcagatcactgaagccttgaactcctgggctcaagcagtcctcctgcctcagcctcctaagtagctgggactacaggcatgcatcgctatgcctggctaatgttttctttttagagatgggtcttgctgtcttgctcaggctggccttgaactcctggcctcaagcagtcctcccactctgaactcccaaagcactgggattgcaggcatgagccactgggcctggcctcttctggtgggataccctaccttgtttccacctgagtgaccctctcctggcagagagagagccggacacactccattttagtttcttcacctgcggccccctttcaccttcctccctgaaggcatagctagtgtaaactgactcaaagcacgtccaggaatgcacctactgataagacattgaggcaagctgcaccagcagctcctggggacacgcgtggtggatggcacccaaaacccctgcatttatctctttgtgatagtttaagcctctgcacctggaactgtttattttttgtaactgcatttgtaaccaattaatttttttaactttttgccagttctgcttccgtaaaaattgcttcagctaaaatcccccctcccctatttagaccacggtataaaaacaaaactagccccttcctcggggccgagagaattttgagcgttagctgcctctcagtcgcggctaataacggactctttaatttgtctcaaagtgtggcgtttctgtataactcgcttggtcacaacactggcttctgatagcagcctgtaatccttggcttgtgggctgcatcgctccagttcctccctccatgccatgctgccttcttttctgtctcaaagcttcctctgcctcacttttaaaaggcccttgagatggcactgagggcctccctgggcaatccaggataatcaccccatctcaagggaatatctgcaaacactcctttcttttctttcctttttttggggggaaggggagacaggatctcactctgttgcccaggctggaatgcagtgcccagcatcttccatagacaatagcattcacaggtcccagggattagggcctgatatctggggcctgctacagccagcatctcagagttcacatgacaaagaagaggccccccagtcctctccaaatctgccccaccccagtcatcttggggatgaatctcccctttccactcttcccaaatgccagggccatccttgattgttctttgtctcctcctccctccacctccagtccgagcccatggtccacccctctcctctgcagcccccgtcctctctcctcacagcacagaatacggacttcacacacataagtcagacgtgccacttcccatccacccctgcttaaacctccaacagccaccaccccccattcattcattcacaatgtttattcagtgtctgtatgtgccagccattgtgtaagcgctgaagagacggatacactggcaggtaaaacagacagaaatccctgccctcatggacctcctggggtgatggacaataagcagggtaaataagtgtattggtggtcacttactgcagagtgacaggttaccccaaatgcagctgcttaaccagcaggcatgcattatctcccagtgtcagccaggcaggactctgggcctttgacacaaagtttcaggaggctgtggtcaagctgccggccgatgatgtggtctcatgggaaggctcagctggggcgtcagcttcccggttcccttgctggccatggtcatccccttagggctgcctcatgtcacacccagcaattcaagagcaattttgtcctattctagttgccagaagcaagtcattaataaagtccagcccaaggggaggggagtgcagaaaagtctaaacccaggagggtataacagggagctagctgccagaataaagcaagccaaagtgtactttctacagtgagaagtgtgaaaaatagggaaatgacaggagagagggatgtgagagctgggcagcatgctgcaatgtcagaacaacaccagggaaggtctcactaaagtgacttttgagtaaagacctgaaggaagcatgtgagtctggggaaaggatgtgccaggcagaaacagcagcatgtgcagaggcccagggggcaggagccaggactgggagtgaactgggaagcaggaggaggtgaggcaggcttgctgtgggagcactccgatatggaagcgtagcttacagacccactggccctccccacagcaccatgctgccaacctggccttcttgccgagccttgaacagaaccattatttatgtggccaggcctccgcctgggatctccctgtccctggtgggagccatcctcttcctcctgccctcatagcacccgctgcagtttctcctggcgcttggccctgcctgagagtgtggtgtctctcctattggatcctagaagctccagggagtcagagaccttgtctgttgatcgatatccaggcctaggacaacaggcacgtaggaggagctggaggaataccatgcgcgggacagagagcgcagaagccttcttccctggagatcgctctgtactgtgacttctttttttgtttgtttgagacagagtctcgctctgttgcccaggctggaatgcagtggcgcgatctcggctcactgcaacctccacctccctggttcaagcaattcccctgcctcacaggcgtgcgccaccacacctggctaatttttttgtatttttagtagagacggggtttcaccatgttggccagactggtctcgaactcctgacctcaggcaatctgcccgcctcggcctcccaaagtgctgggattacaggcgtgagtcaccttgccggaccaaccgtaacttcttacgattagagttaggaagcttccggtttgtgtgtgaagacgatggaagggcggggctccaggatgtatccgcagagccacggagggaacctggactcggctggacttggagccggggcgggggcgggagggggcgaggttcgagtggggctgctcgcgggcgcgagggccagagcccgggatcgcgccgtggagcccacgaccggcgaggccagcgctgggggcagggcctctggatccctgacccaggacgccctgctccggcccgccccgcgcactaaactcggcctctagtcgcctgaagcccgcgcgggtaccgggtccgcgcggcccggcctgtgcctttagccccgccccgaatccccccaccctcataaccccgcccctaaccccgcctccacacacagaccccgcccccaaccagactccgccccgcgcaagctccctaagcccgcgactggcctgcacccggctccggaagtcgttcttccgcgcaggagccctgagcccgcacagccccgcccctcccggcgcccaagccccgccccgccgggttcccgctcgcccggcgccatggatccgctgtcgccgccgctctgcacgctgccgccgggccccgagccgccccgcttcgtgtgctactgcgaaggggaggaaagcggggagggggaccgcggcggcttcaacctctagtgagtgggggtccgcggggaggtaggggtgcagggagctccgcgggcggccccgcctgacaggccttctcccccagcgtgaccgacgccgcggagctttggagcacctgcttcacgccggacagcctggcggccctcgtgggtaactgggcgggtctgggagccgccacacccctccttgcagtgcagatcgtctatggggcgacagacatctgggattccccagaaggctctgacaccctctgcccgccctgtagctgtagtcctcccattggctagggctctggggtcgggcaggtttcgggtgcccccagtgggcctcgggttccaggcagctcgtgacaagcccctgtgctctctagaaagcccgttttggcctgagtgcggctgaggacatcaccccccggttcaggtgagacccaagcagggaggaaggacgggtggggaggaggagggtctgccacagctctccgcacctctcctctcccagggcagcctgtgagcagcaagctgtggctctgactctgcaggaggacagagcatccctgacgctttcaggggggccctcggcactggcctttgacctctccaaggtaccaggcccagaggcagcccccaggctgcgggcgctgacactgggcctggcaaaacgcgtgtggagcctggagcggcgactggcaggtaggattgggggtgggcacctcataccttcactggggtcccctgctcttgcccccactcctggcactgagtggggttcccatgggctttcctccccagctgcagaagagacagctgtcagcccgaggaagagcccccggcctgcagggcctcagctcttcttaccaggtaaggcatgtccgcctgtgactcaagtagggctgtgctctttaacctggaactcagtttccccccaaacaagactcacgctccagagagaatgcctatctattcggagaaggttgtggttgggatgctgccaggttcaggagctgcccctgtcctgttttcccccagacccagatccccagagaggtggccctggacctggagtcaggaggcggtgtccaggagagtcgctcatcaaccccgggttcaagaggtaccctcccacagcccccttcctgcgcccagggtccaatcctggaccccacccctttctccacaccatagtgccatagtgacacccctcttccctcccagtaagaaaccagctggtggcgtggacttcgatgagacctgaaggtgcagcacaagcgtggccccgcggggagtccgcctatgaggggagaggcagtctttgaggcccccatcagagaccccccgccaccacctccacctgcctgtcctgggccaggactaacacggctcctcaaattccttccctgtcaaataaacagctcccttggttggaggctctggtggggctctgactcctggcactggcctgggaagggatcagggaacacccctgggcctgtgttctgggtgtagggccacaggatgtgaacagatgctgcagcctctcagctccctggagacttccttgctgggccggagggaggtgagcactctcagaccgtccagctattccagccctgccagcccaggagctgagaggggcccagccaggcagggccagggctccccaaggcttagaactttgttcccaccctcccaggccgcacccaggtagggcacggagccccgtgggaggatgcagacagaagtcccgtgtagaccctgagacactggaagtgccctgcggggaggggagcgcctgccccgggacaggattgaggaatgtgccagcccccatccacctggggcaccccgccccaccccggcctgactggtttgggagcccagtccggtcctggagatccctgaggccaccggttgcaggaggcctggagtctgcgccttcttagcgtggaggatgggaccggcccgacccccggcgctcctgcccctgtggttctgggctatcgggctgagcgtcccaccctggggtttggggatgggaagtgatcccgagacctctggcccttcagatgtcaggacaccctcactcccgacaaagatgcctttattgggcgacagacgcggggtggggcgctagcgggggtgcacggcgggccggtaggccgccaggatctcggcgctgtgcggacacgtgtatttgaactctttctcctgcatcgcgctgtccaggtagcggcgtacgccgcgcagctccgcggggatgggcgcctggcggaagtgcgcgcacaccgtctgcgggcaggatcgcggggcgcggtcaggacctgccgtcccccaggcgcgccgcggtcaccctcccgcccgcccaccttccgtgctcacgtcgacgatgtgcagcttgggcaggaggctgcagtcggccagcgtgagcctgtcgccgtccaggaagcggcggcgggactcgcgcagctgcggctcccccgccagctcgtgctccaggggcgcgcgcaggtagctgtccagcctggcgagggcgcgcagcagctgctggtacagggctagggggcaggcggcgcggtgaggaccaggcccagggcgccctcccgcctgggcacccgaccccctgaccccgcttcaccttcgtcctgcgcgggcaccgggttcttgatgaacgcggagaacttgtggaaaacgtcgttgccggcggtgttggactccctgtaacgaggcgccaggctggggaagctgcgggatgagggggtgggactccattagactgggggcagccccgtcccggccccacagtacccccacagcgccttcctgggctctgtcttgcgcgcgtcctccctgggcccccctcttttcccctcccaccctgccggggctctcactcgggcggccccagcgtctcctccagaaagtcctcgatctgcagcgtgtctgtcttggcgtcgctgtcatagagcaggatgggcagctgcgagccgggggcgaagtccttcagcacgtccggggacctgcgggcagcagcggggtgggaggaggccggcccaccagtgtgcgaggccaggcgggggtccacaggatggggcctcacctgcgcgtgtccaccgtggtgagggtgaaaggtacgcccttgaggagcaggaccatgaagagccgctggcaggaggggcagtgacccacgctctccccgtcctcactcgcctgggtgggtggagcgggggtggggggtcagggctggaagcagacccaggcatcctgccgccaggctgggcgggacccgcctcccactgccagtgggattggagggacgccagggctccagcttggtcggcgcgacttccaagtgcccagtgagggcccttgacttggtccccagaacgtggggaggggggcagagctgctgggagccttgaggcctggggcaggcttggcccctggaatcttgtcagagcctggacagaggccaggcccctgggctcagtccccaaaagctggttgcaggggtggggtgggcctcacaagctgttttctgagtgattcacacatgagactgggcactgtggccaacagcacatcagtcccccaccccagtccccgacctgagagctgatggggctgcctggcccagcaccccccatcctggaacaccgaccgtaagctccactgttggcagcctgcttggtacctccccaccaaggagctctcctccagaagactgggctgggcccaggagccaaggctgggagcaggaccagggccactgacccctctctgggtgactcgctgggtcccactttactcagcctctgtagggctgcctgagtccccctagccacccacaggaaggggctcagacattactgggaggcccaccccacagcctgccacagaaagcaaagcccagaaaagcgcttcctcccagacaccctccccgcagctgagtccgccctgcaccttgacaaacagctggagcttggtctccgccatggtgggagctgccgcggtcaggcgcgggtggggacctggggagctctttaagtctccctgtgcgccccgccctccctggccgaggggcccgccccgtggagccacctaggcgggcagatgaagctgcccagcgcgcagaaccagctgcctgagcaacgccagcccggccccggggtgtctgagcctgagggtgtgacctcagggtggcggaatggtgtggggggctgccctggacttgagtctggtgtgcacggagatccgcccacccggtactgagtgtgctgggagccagcgtggtgggtggagaccagggggcagggcatagggagagcctacaggccagaagggtgcagggggtgtcacctgggaagggggcggctctgggtcaggaccacctccaccgtgaacccagctcagaccctgccctatggctctcccttccgcaaataccccttgtcagggctcccagcccagaaagccagtgggtgtgggtgagcaggagaaatggcctgcccagcctggcttcagttccccatctgcagcaccagggcatcgggagggtgataagcccacctgggggagccgccccttcccagctacggagcagtcaggcagggccctccccgctcagggcagggctcaaattccagacctgcccgcaacagggcggggaggccagcctggctttggtgtttggccggcagtgcaggtctccaccccacctcccatccctcccactggcgctcagcgcaggtttcttacccccaaccccttaacctttaaaaagaagcagcaggagaggggttagaagccacagcctgcgtggctggaagaaagaggccaggggagggtggtggtccacaggtgtgagcctgcgctgagcctcctggcgtgattggaacccacagttcagtctggccctttggggtcgccaactgtgccttcctcccacctggccctgacgctttagggtgcagccccagggaggtacaccgaggggagattccacccagagacctggggtgcccacaggattggcctggccacacctcccccaggcggtgtggtgcctcaccagcctggacagggcagctgaggtggcactgctctcctgctcaccttctccccagggccttggtacgggcccctcatccgtccccggtggaacacactccagtgctgccccagtcagcccagcctgatgcttctctggataccacgccagtcggggctcctggacacagagccttggaaataccatgtggctgccccatcctttggtgtcctgaacctcaatttccctccatccggcctccacctcgattccaagccctagtatttcagctctttctggacactgtggttatagctccgcttgctggtttcccacatccctggcaggcaaatggccaaccacagagaagccccaggcccccagccccctctgctgccccggcatcctgtgtctttaacaccgacagacgcaccctcacaaacccacaggaaaaatgacggcacggacagaggccgtgaaccggtggctcagaaggaaaaagaaaacaagacacaggaagaccattcacctcacgcccgtctcaagaaacaaaccaacaagactcggttcaccgctgcagcggccccactgcgttctgtgggcgtgggctgtggactgtggagcggcagtggccatccaacacccccctgtgccctcgccacctgggaatcagcccggtggcttccttttttttttatggtttaatcaattcatttatttactagaaacagggtcctgccatgttgcccaggctggtctccacctcatgggctcaagtgacccacctgccttggtctcccacagtgctggaactacaggcgcgagctgccacacccggccggtttccctgtgaagggcaagtgagtgctggctgccccactgcgtggcgtggcgtggcgtggcgtggctccgtggcacggccaccaccctgtctatgggagactccagttgtgtccagggagaaggacggaaaaggtgactccatgcatgcccactgcagggagggcctgagattaggtaaatggcgtggcttgtgtccccttaaatttaaattcttaggctggagtcctaacccctagtgcctcagaatgtgaccttatatgggccgggcacggtgactcatgcctgtaatcccagcagtctgggaggccgaggggggtggatcacctgaggtcaggagtttgagaccagcctgaccaacatggtgaaaccccgtctctactaaaaatacaaaaattagccaggcatagtggcaggcacctgtaatcccagctactcgggaagctgaggcaggagaagtgcttgaacccgggagacagagttgcagtgagcagagatagtgccactgcattccagcctgggcaacagagcaagactccatcttggaaaaaaaataaagaatgtgaccttatgtggaaacaggggctttttaacattttttttgagacagagtcttgctctgttgcccaggctggaatgcagtggtgcaatctcggctcactgcaacttctgcctcctgggttcaagcaattctactttctcagcctctggagtagctgggattacaggtacacgtcaccacgctgagctttttttttttttccttgtatttgtagtagagacagggtttcaccatgttgatcaggctggtctcgaactcctgacctcagaagatctacccaccttggcctcccaaaatgctgggaatacaggtgtgagccaccgcacccggctgaaatagggtctttatagaagttatcaagttaaaatgtggtgagtaggatgtgccctgatccaatatgactgatgtcagtatagaaaggcgagtttggacacagatgcacagggagggccgcaggcagaaatcagggtggcacatctgtaagcctgggagccaagcggatgctctccaaggcccttgggaggaagcagccctgcccaagcctaggtgctatgtctgacctccagactgctaggcagtgagcttctgttttttttgttttttttttttaatgagatgcagtcttgctctgtcgcccaggctggagtgcagtggcacaatctcggctcactgcaagttctgcctccccaggttcacgccattctcctgtctcagcctcccaagtagctgggactacaggcgcccgctaccacacctggctaatttttgtatttttagtagagacggggtttcactgcgttagccaggatggtctcgatctcctgacctcgtgatccgctcgcctcggcctcccaaagtgctgggattacaggcgtgagctcccgcgccccgcggtgttgttgttttaagatggagtctcactgtcacccaggctggagtgcaatggctcaatctcggctcattgcaacccgcgcctcaccggctgaagcgattctcctgccccagcctcccgagtagctgggattacaggcgcccaccaccacgcctggctaatttttgtatttttagtagagacggggtttcaccatgttggtcaggctggtctcaaactcctgacctcaagtgatccgcccacctcggcctcccaaagtcagtttctgttgttttaaacccctcactttgtggtcctttgcatggcagcgccagcaagctaataagtaaagcagggagaagccaggaaatggaagaaaatcagcattaggatctgtcattctgagtctctacttgaacagagctgaaaaaagacgcaaggagctgtctgtgggatgacccctgacaggcagaaacaggctttcagttttgcttcctgtctgtccacactgtttgcattttctaccacatttttgtaataccacattttctaccacaatttcataatgttttgaagtaagaacagtatcacagccactaaccttaactagaccctggtccccgaggccacggggttatccctaaacctcccgtcccctgcagcccctgctcctgattcatagagccagcgttagaggggcccaagctgaggtcccgaggctgctgctctgggactgactgactggtgggttagaactctctccctccccaacacccctccctgtaggccccttccaaggggctctttttttttttttttttttttttttttgagacagggtttcactctgtcacccaggctggagtgcaatggcgcagtcatagctcactgcagcctccacctcctgggctccagtgatcctcctgcctccgcctgcacagggccacaccccagtgacatttgagcagctctgttctgaagggagacacacacctgtttggggggccggagggctgggggcattggggtattggtgcaaacttgtgcagagatttatctgctctgtgcatggagagagcctagaagcagtgagacctcgggagcggtgagacctcgggggcggcgagacatcgggggcggcgtgacctcgggggcggcgagacctcgggggcggcgggacctcgggggcggcgggacctcgggggcagcgagacctcgggagcagtgtgcagaccagagctcagattctggtcccaaagcccatcttccctaaaaggaaccagggttctgctagggactgaatgtgtcctccccaaaatttgtgtgttgaaaccctggcccctaggccaggcacatggctcacgcctgtaatcccagcactttgggaggccgaggtgagtggatcacctgaggttgggagttccagaccagccagaccaaaatggggaaaccctgtctctactaaaaatgcaaaattagccgggcgtggtggcacatgcctgtaatcccagctactcgggaggctaaggcaggagaatcgcttgaacctgggaggcaaagtttccggtgagccgagatcactccattgcactccagcctgggtgacaaagcgagactctgtctcaaaaaaaaaaaaaaaaacaaaacaaaaccctgtctcctgcaaggtgatggtgttaagaagtggggttggctgggcgcggtggctcaagcctgtaatcccagcaccttgggaggccgaggcaggcggatcacaaggtcaggagatcgagaccatcctggctaacatggtgaaaccccatctctactaaaaatacaaaaaattagccgggcgtggtgtcaggcgcctgtagtcccagctactcaggaggctgaggcaggagaatggcatgaacccaggaggcggagcttgcagtgagccaagattgcgccactgcactccagcctggtgacagatcgagactcaaaaaaaaaaaaaaaaaaaagaagcggggtcttttggaggtgggtaggtcatgaaggtgacaccctcgagatgaccagaatcagcgccctcataaaagggaccccggagagctccctcgctcctcctgccaggtgaggagtcaagggaagtccacaacccagaagagccctcgccagaacccagccatgctggcgtcccgacctcggacttcgagcctccagagctgtgaggcatgaatgccacccgtccagggtcctttgcacagcagtcctggtcggactgagacaggctccttggagagaggctgattccaggtgtggggcagggaaggcagggacgcactcaaaacacatcaggagctggttacgaagacacagaagccgtgctggaggggcgcctgctggaggggcaccgctggctggacctcaggccatctgagcataagacaacagtggattgtgcgttatgaatggttaacgtgataaatgttacatagattttaccaccatcaaaaaattttaaaagagccagatgcagtggctcacccctgtaatcccaacactctgggaggctgaagtgggagaatcccttgagctcaggagttgaagaccagcctgggcaatatagcaagaccctatctatacaaaaataaaaataaaaattagtcgtgtgtggtggcacatgcctgtaaggaggctgaggcaggaggatcacttgagcccaggagttggaggctgcagtgagctatgattgcaccaccacactccagcctgggtgacagagcaagaccctgtctcaaaataagtaattaaaagatgacagtaatgcatgttaacacattaatttttttaaacctgcaagtctgtactgatagactttttaaagtggaggggcccttggtgagagagaaatgccagccagtagatgcagaaatggaatagaggcaggaaatggccattttgcagctgctggccctgggtgacgggggtcggggggcgcggccacgcagcacccagattgcgttcccacatctaagggagggagaactgggcctcaaccaggcggccacattcagcatcacctgctgagggacagatggacacctggaggtgaccgacacagcgtgtcccagtgctgctccggccaaaaatgtccaacctgcatccagccaggaggaaatgaagacacatccagagctcagcctgggcctgcggagcctgtccccctggaagggcaagaacgccaaggctggggacggctcagaggggccccggggaaggcagcaagacacaaggagtgcctcgtggttggatcctggatttttatttcctttttttgtttgtttgtttgagacagagtctcactctgtcgctgaggctggaatgcagtggcacaacctcagctcaccgcaacctccacctcccaggttcaagcgattctcctgcctcagcctcccgagtagctgggattacaggcatgtgccaccacacccggctaattttgtattttcagtagagacagggtttctccatattggtcagcctggtcttgaactcccaacctcaagtgatccacccgcctcggcctctcaaagtgctgggattacaggtgtgagcaaccatgcccagccttttctttctttcttttttttttttttttgagacggagtctcactctgtcacccaggctggagcgctgctcactgcaacctccgcctcccagattctagtgattctcctgcctcagtctcccatgtagctgggattacaggcgctacaatgcccagctaattttgtatatttagtagagatggggtttcgccatgttggccaagctgaactcctgatttcaggtgacctgcctacctcagcctctcaaagtgctgggatgacaggcttgagccacagcacctggctgatcctggttttttggaaaaactctaaagagcatgcctagggccgggtgcagtggctcacatctgtcatcccagcactttgggaggccgaggctgggagatcacctgaggttgggagttcgagaccagcctggccaacatggtgaaacccccatctctactaaaaatacaaaaattggtcaggcacggtggctcacgcctgcaatctcaacactttgagaggccgaggctaggcgatcacctgaggtcaggagttcaagaccagcctggccaacatggtgaaaccccatctctactaaaaatacaaaaattggctgggcatggtggcacacatctgtaatcccaacactttgagaggccaaggctgggtgatcacctgaggtcaggagttcgagactgtgggcggcaagctacccaggcaccaaggcaagagaccgaggacatgagctgttccagtataataaaatataaaacaagaatagttataccagatatagaacttagatatgattatatatgaatatcattaatcattagtttgtagcaattactttttattccaatattataataatcctcgctctataatcatagcctaggaaaaaccaggccatacagagataggagctgaggggacatagtgaggtgtgaccggaagacaagagtgcgagccttctgttatgcccggacagggccaccagagggctccttggtctagcggtgacgccagcgtctgggaagacgcccgttgccaggcggaccgtggtccagcggtagcaaaaggtgtcaaggaacaacacccgctacttagcagaccaggaaagggagtctccctgtccccgggggagtttagagaagactctgctccacctcttgtggagggcctgacatcagtcagacctgcccgcagttatccggaggcctaaccgtctcctgtgatgctgtgcttcagtggtcacgctcctagtccgccttcatgttccatcctgtacacctggctctgccttctagatagcagtagtcaattagtgaaaatactaatagtccctgatatgcagaaataatggcataagctgtctttctctctgtctcttctctctctctctgccttggctgccaggcagggaagggcccccgtccagtggacacgtgacccacgtgaccttacctatcattggagatggctcacactccttatcctgccccttctgccttgtatccaataaataacagtgcagccagacattcggggccactactggtctccacgcattggtgttagtggtcccccgggcccagctgtcttttatctctttgtcttgtgtctttatttctacactgtctcgtcaccgcacatggggagagacccaccgaccctgtggggctggtccctacacgagaccaacctggccaacatggtgaaaccccatctctactaaaaatacaaaaattggccaggcgcggtggttcacacctgtcatcccagcactttggaaggctgaggctggggcaatcacctgaggtcaggagttagagaccagcctggccaacatggtgaaacctcatctctactaaaaacacacacacacacacaaaaatcagccgggcatggtgatgcgcgcctgtagtcctagctacgcaggaggctgaggcaggagaatggtgtgaacccgggaggcggagcttgcagtgagccgagattgtgccccactccagcctgggcaagagagtgagactccgtctcctcaaacaaataataataaaaaataaaaaagggcatgcctgggccaccggggccctgaaaagccttgctgtaccctttgttaactctgggctaccctggcggctcttgggggaaggaggctgcagggccggggctggcaggtcacagctgcttgctttcacatggggcagcacaaaagtgggtagagcgacggtgcgtgtggcaagatttcacaggcgcatcggctgaagatgcggcgtgcgctctgctattctcgcaactttcctgaaagtttaaaatgttctttttgctgttgttttgagacagagtctcactctgtcatccaggctggagtgcaatggcacgatcttggctcactgcagcctctacctgccaggttcaagtgattcttctgcctcagcctcccgagcagctgggaatacaggcgcccaccaccacacccagctaatttttgtagttttagtagagatggggtttcaccatgttggccaggctggtctcgaactcctgacctcagatgatccacctgcctcggcctcccgaagtgctgggattacaggcgtgagccaccgtgctcggcggaaaatgttctgaggaagatgctggggggtgtgtttgctttcaatgctgcattacacatcatgaaaatgaaacctctagggacgatgcccccgtgaactgtgtcagtctgtgggcggctgtccaggtccagcctggcctggtcctgcgcgcagggtctccctgggcctcggctgggccgtgttcctttctcgacctctttctgccatgattcagcccctacagttgcaggacggaggctgctgcggcctcctgccttctggcggctcccccacgcatttcccttggccgaccaccaaacccacaccagcccctccagtgagccactgttcctctcggttcttccagagtgaaccgcccccagggcccaggacagcttcaccccagtgacccagcctctcagggactccagcatggtcatcccactgcctctcaggtggtcacagtgagtgcctcataggaacccaagtggatgtgttggcccagcccacccagtgccctcaagcccatgggcccctcccctgttgtcccccatgtggcaccagccctcagtgagtccaccctctaccctcctgaggagccttgaaacggcctaaggcaagagtctgaacttggcccagatcacggggcgtgagctctgggggccattcatgcccctcccccatctcctgcccacagtgtgccaggctccaccgctgatgagcctcaaagcttccaggtcctgcctccctggggccttggcctgtgccctgccctctggctgggatgcccttcccttaaggaatcttcacagacttcggtctcctcctggaggtcgcctcttcctggaagccctcgctgtcccttccatgacacggagacagcctagcccaggctgctgcaggccccacgtgggcagcaaggggtgaaggaggcttagagagggcaggtggacgggaagatgaaggctaaggggaagggggccgggagcaacccctgagggtgggatgagggggacagtgaaccatggtgaaccaccctgcctcagtttccctcctccagaccgacccagccaccccctgccagcacctgtgcctgaggggcagggccttctggagcgctaacccacctgatgcgcccatcctccccacccttcccaacccacacacgcagacccgcagacattttgtttatttatttaaaacaaacatctgtgcgctatgtacaggcccggctcccagggaggtgggcgggcagggggccaagctgggtgggagagcgatggcagctgggggttggggggggtctggccccttgcctggccagcagggtcagcttctccattcctgccacctgccagctggcccaagctgatggcttcccgcaggacagccacctccctgcaggagagcagggccagaggagcctcttctcaaagcaaaataaatacgggactgacccagctccgcccacagcccgctctcggcatcagccttcatcgtaagagagaaaagctggttccgaggccgggcaggagaaaggccagcagtgcctggtccagccggcgtcgccttgggcggtgagcagtgccaggcaggggcgaggggccgggcagaccccgaggctttaaggcaaagcagggcaagggtgtacgcagcccgggccgggtcagcctttggcacaattaggggcggcaaccgcagtgaccacagggcatggccgagtacaggggctggaggaccagaagccccttggtcctgaacctccactccaggccctggcaggcactgggggacttctgtccccattgttgagtccctggcccagctctgggtggtcagtggagcgtgtcctccctggcccagctctgggtggtcagcagagcgtgtccgtgttgaaggacagctgggcctgtgcacaggggaggtcaggcttatggggcatcctgtgccaccccctgctggggctgaggacacttgtgctggcccgccccggccctcctgcaggctgggcctggacgcagggtctccccacgagctccctctgtgtctgggctctcccgggcctccgtctgccgagtctgggggccactgagtctacatcggtcccctgttccccggctctggtcccctctgccccacccttgctctgtgcccctcaaagactctagcaagtctggaccatgcagttacgtctctccaggcctatctgcaagtgtccctcgcccactctgcccccttgacctctggacagcaagcatcctggggccagttctcccccgaccccacccgcggctggagccaccaggcagcctgggtccagtgggcagagccctggacagccatgagagcagcctgctcacccgctcctcctcgaagctgatgaggccctcgtcctccgtgtccaggtcctcgggctcgtctgccacaagtgcccggagctccgtgggggcagaccggggccggagcaggctgagcaagcagccgagaggggactgcagtgcggatggcggctccgtctcctgctgctccaggttgtcactctgcttcttggcaaagttcacgaacacctggtgggtggcgcaggcgtgtggggagggggctggtctggggtgaggaggggcagggcgggtgaggggaggggcaggtgtggtgcgcagtgcccttggggcgctcacattgtccagtgtggtctggctgaccgagtagtcctcgatgcccagcacgccagacacctgctccatcttgctgaacacctgggccagcgagatgtgctccgacttgagctggtactgcacctttgtgtggtgccgctcctgcagggggggaggtcagaggcctggcagcgcccccccaccccgtagcgccccctccacaaccctgcccgggacggcgcaccttgagcatggcttccgggaagttgcggttgaagaaccgcaccacgtccttcacactctggctgctcttggtccgcaccgtgatcatgtagccatctccaaacctggtgggacaggccggtggcccggagccctgcgccgcccagccagagccccagccccccagcctcccagccctacagcccccacaggcaccccaggaagccccatagcctcccacagccccccaaccccacagcccccacagccctccaggctcctcccctggccccactgccccagtccccccagccccagtgcccccagcccccctggccccacagccctcacagccctgcagccacccccactcctggccccgctgcctggccgccccccccgggcccgccccagcccacccctggccctgccccggctcaccggttcttcaggtgctggatgctgcccaggcaccgcaggcgaccgttcaccatgatggccagccgcgtgcacagcgcctcgcactcctccatgctgtgggacatgcacaggctggcaccggaaggggtgctgtggggtgggggcacaaagagggggtgggggcgccctcacctgtgtgatgtcagcaccactgaacgccctgtcttgatgaggtcaaggatgaggttccagaggaagcgccgggccttggggtccatgcctgtggtgggctcgtcctggggatgggtggcaggctcagctgctgccaggcccacacaccccagcctgaacgctgcccctgcccgtgctcaccaggaagtcaaaggccaggcagccaccccccacccacccaggacttaccaggaagatgaaggctgggtacccaatgagggcgatggccgtggagagcttccgcttgttgccgccgctgtaggtgccagccggcttgtctgcgtacttggtcagctccagcttctccagagcccacttcaccacctggccagggaacgcaggtgtcagtggaggcagggccacccagcgtgctgactccctgccccgccccacagatcctcacccgggcctcgtccttccaggagatcccacgcagccgcgtgtacagctgcaggtgctcccgggccgtgagctcgtcgaacagcgcgtcacactgcgggcagtagccgaggctctgctgcacctggagcagctccttcagcacgctggggacacggcagctgtcagcgcgtgaggacgcggcggccccgcccacccagggctcccgccccacctgtgtccattgacgaaggcctcgccccccgtcgtgctctcgtcgccggtcagcatcttgaaggtgctggtcttgcccgcaccgttgacgcccaggagcccgaagcactcgccaggacgcacacccaggcacaggcggtcaacggccaggatacggccaatcttccgggacttgtagacctggccaggagcctgcccactcagcggggcatcctgcccccaccctgcccctctggccccaccccacccagaccctgccccacctccagagcccagggggccacgtgccccacagccccaccccatgcaggccccacccccagagctcagggccctgcccacccaggctccacctccactgctggggccccacccccctggccctggcctaccccacccaggccccaccctacatgcccagagcccaccttggtcaggttctcaatcttgaccatgtcattgtcggcgtctccccggagcactcgctgccgctcactggccacgtccacatcatcctccacaggcttggtagacacaggcatgcgccttgggggacagggtggacagtgtccagcagctcgccacccccactgcccctccctgccaccagcctcgcatcctctggctgtggcatgtaagaagggtgggcaggcccctctgctgtcccctgcctcaccccctcctgccccatccctgcccccacccccgcccctaccctgccccacccccgaacccatccctgctcccgccccgcccccgccccaccccgccccccactcactgtggccgccgcaggaagttgtactggcacatgatggtcaggaggaagcccacgacgccctcaaccgccatggccaccagtccgcgggtgacaatgtcccactcgaacggggacttcatcttgtcaaactggcctgcggggagacagctcagggcctgtgctctgggccttgcggggcccccaccgccttccccgccccacgggccccctcaccaatcttggcgtagtactcgttgatgtactcgttgtaggccatctccatgagcccgtggcccaggttgtagttggggaaaatgaggaagcagcttttcaggtaactgttgacaaccttcaggtcctgcggggtggccggggtcaggggcacaggggtggccggggtgaggggcacagcctccgcagggtccgccacccccaccatgtcgtcaccgccccaccttgtcgtgctcgaagagctgtagcaggaaggtggccacggtggcggtgatgccgatgaagagattgatgacaatgaggaacacgtaggcggagctggggacctcgaaccagaaggaggccgggtacatgatgggcgtgatggaccacctgcgggcaggtggcgggcagtggtcaccaggcagccccggtcccacctgaggccgctcccccctccgcttccgcttacccatagagcaggaagagggagaggacggcagggaagttggtgggcgacgtgtaggccggcaggtcgaacacaaacaggatgatgacacagcaggtagcggggaccaggtagttgagctgcaggggtgggggcggctggtgagagacccggggcagggcggggatgggggatgagaagggccggggcaccccatggccacgccgggcgcaccatgtcccacacgtagttcgccagccagtagatgatggggttgcagccgctgacaaactgcaggtgcttggccttggtggacttctcggccacgaggaagacaacgaagctggccggcacgaaggacatggccacgatgatgaagatggcgatgacgacatccgtgccctgcagcctggggcaaggaagccctcagtcctcacggccggggctgcagtgcccacctgccccacctcatcccccactggccacacttacaggtaatccagggagaggctggcgctggtcttattcatggggtggttggtgacggtgatgcctgcacacggcggggcgggggcggcagcttcaggccccagctcctccccgccccggccccagctcctccccgccccgccccgccctgcctatgtcagctcaccgtaagccgccgggttgcccttgctcttgggcaggttggcacgcaggatggcgttgttgaggctgttgaggtaggtgggcatgctgtgatagcccttgttgttgtagaaaacctgcagaaggaagaggacacagaaaggccccaggacctcagacctgggtccctgcagacctcgggcggcgctacacacagcggggcccaggcccgcagcctcgctcacctgggcagccctgcgcaccgcgatcttccgcaccatgggtggggccctggtgccaaatgaggctgggatggacttcaggacgtttccaaaggtgatggccccatacctgggcaggcaggtgggaggggcggtgaggctaggcaggcagtgaggctagaggggcaggagttgagactaggtggctggtggccggccaccctcacccacagcctccccacccagctcaccggtgcagtcggaagcggtcggaggtgaagagcaggtactcagagacattgtggccggtgatgtcggtcaggatgtcgcctgtgaccacccgcatctggggcgggtgcccgcccacactgctggggcaggagaagccggtgccctgcgcagagcaggtgcagcggacgggctcccgtaccaggcgcggcagggagggtgccgacgtccacatttctgtgggcacagcatggtgcggtgagaaggacccctcactgcccctgcccccccagcaggccccctgaaccactacctggcccagcggtgggcggcagggagacgttccaggcctgcaggtcctcatccggggacgctggcgagtcagatggggcgggcgagggtgggggtggcacgaaattggacagtggcagcccctgtgtgaaggactccagacacatgctgtcgaagaaccgagccgccagcaggcgcgactccccgctgctcaggttcaacgtgggccccagcgagccgttggcgggagacttgagcacgcaggtggcacccacccccgacggcagccggaacgtgctcacgagctgctgggggctggcgtcgggcgatagccgcagcctgcgggcaccgacagtgtgaggtggggctgccagtctccgcccctcgccagccccgccccctcgcccgcctggcccaccaaggctgtccccgccccttcactcgccccacccaccaaggctgcccccgctggaggcctcaccggtactcgcggcgctcctcgttggcgtaggggatgaaattgccacggggctgggtgtagttgtggtactgggaaggtgacaggaccagcgggggcagatcacctggcagggcgagcagggaggcctgagcaggttctgccctctggccagcggcccccaagcctcggtccccttcccccaaccccaagggatccacgcctggggtctgggacccgaggagacaggactcccggatgaaccccggtgcgtgcccagcctcaggtgtggggtgaggcccagagtcaggaagctcaggagtgggcatcatcagggctcccagcgggcggtggggggaggcaagcccagcacccctgtccagccggtggcctaccaatctccgggacggacagggccacggtcatggccacgcagacgaagaaggctggcagcaagatctgggagaagagtgccttggagttgcggcgggcgcagtggaagcgtttgaccagcagcccgtggaactggcgcaccttcagccacccgccgtccagcttgcggctgccctggccgaccctcgacagggcctctgcctccacctctgtgcagagaggtagaggctgagcaggtggttgcacgctaccctctccctactggctgccctcatgccgctcccccgcaaccctgctccccctcccttgctgtcccagcctcaccctgccacccccaccttgcaggctgacattgtctgggtcctgtgggttatcaaagagggggcggtagtcgccatagacgtcggtgtagccagctccctcgtcgccacgggcagagcccacagatgacgccgactgcagcgatgcctgcgactgggtcagctccgagcaccgggccagattgccagcgtgaccctccccagacgccgggccctccgccccagggagcacatccttcctggactccttcacatctgccgcagtggaagggccgaggggacactcagggctactggcccctaggcctgcccaggacccccatccccggtcttgaccccagttcccaggctcatacacctgtccgggacctctggccaccaggaccacccacctaggaccgcaggctaaccccggggcgtcccctggcttccacccaggaccagggtggcgcccccagacaccaggcaggagtgacagcgcaggcccgagctggggccttgtgggtggggtgggctgagcaagtggtccaggcccctcaccggcctcactgttctccagcgactgatcctcctccgacaccttgaggaacacttcctccagggtcgtgtccatcagcccgaagctgctgaggtgcagtgcatccaggctgcgctccaggtgctgcaggggcggtggagggggaggctgcggcagggacgcccaggcaggagtgcgcccacctccaccacctgcaactgccccccgacccgtgcgccctcacacctggaagaggcgctcgaaagcccccttcttggcggcctcgctgggcaggatgtaggagagctccgtgcttgtgtctgagaccagcaggcaggaggccacatgcttgcggatgaactgggacacctggagctcggagcagctgctcagcggggcccgacctggggggctggatgccagccctggctctgtgggggacgtgggagcaggaaggaattcactcaggggctgggaggagggacccccaatgggaacccaactgggtcaagatatgggcattggagaggaagaaccaggccccagcaggtatcctgggcccagggggtgacgctgaggacccagcctctccaagatacgggcgttgcagagggcgggccaggccccagcaggcatcctgggcccagcgggtgacggtgagggcccagcctctccattgtggattctcaggtgggggtcccggggagaaggtggcccgaagccagctcaggcagcttcaacacagaccttgggggccccccggctcggcgggccgcttgaccagcgtgaggcggtacccgtcgccataggtgcccttgaggaagagcggggagccgcagcacttgagcttcccatgggagatgatggcaatgcggtccccaagcaggtcagcctcatccatgtggtgggtggacagaaggatggtgcggcctaggacaaggccagacccagggtcagggggcaggggaggcgccgcccgcacccctgcccacacggcaccccactcacctggcttgtacttcaggatgaggtcccagatggcgcggcgcgcgtaggggtccacgcccgccgtgggctcgtccaggatgatggcgcgagagccgcccacgaaggcgatggccacggacagcttgcgcttcatgccacccgacaatgtctgcaccagtgagtgccgtttgttggagagctccaggtcctcgatcatcctgggacagggaggtggggcatggggctgctgctatgcagagccccagggcctccgcccacctgccccgccccccgcccagcccacccacttgtccatctctctgcggatctcctcctgagccatgctcttgagccgtgagtagaaccagaggtgttcctccaccgtgagccggtcaaagagcacattgtgctgcgggcacatgcccaggttcttgcggatctcatccatctccgtgcggatgtcgtgcccgtagatggtggcggaacccgacgttggagggaacaggccggtcaggatggacctgggtaggtgggcggggtcatgaccccacgccctctgcaggggccccaccctgccctgactaggactcctgctctggtcagcagatgcccaccgccctgcccctccgacactcacatggtggtggtcttgcccgccccgttgtggcccaagaaggagaccacctggttctcgtagaggttcaggctcagcttgttcagggccagcttcttgtcgtccttgtagaccttggtgagtttgtccacgcagacaaccagaggcaggtgggtgggctcctcctccatgccacgggtctcctctgcaccagggctgtggatcagcagggtgggggcggcgccaaggccacccaggactctgaacccagcgcccaccccagccaccattctgatgccagcctcaccaaagcgccggctctccatggcacaggcctggtcctcctccatgacactgaggcggggggtgcgtgcccacggccagctccactcccaggcttctgtccgcccactgcccagccagtaggacttctgcagtgggaagtaccagggccggggcagcccgtacatgcctgggggtcggggaggggaggggaggctgacctagggcctggggtgaccatccaccacgtgggccacgtgcccacccagggagccacccgtgctgcatccaggagtggacacagactgctggtccccaaccctggctggggacccctgcctctcccctgccctccaagggctggccagtacctgggtgcacagcctcaatgtaccacgtgaggatgccatagaccacggcgtccaccatcagcatggtgacagccaggagcaagttgaagtcgtccccctccaccggggactggctgaaggtgtgccactggatgcccacgccggccacctcatacagcgcgaagtacttagagcccagaccaaaggccgtcgtggacatgagggactgagaaggcagtggtgtcagcacgtggggtggcccggcaccccagccgcccgcctgcccgcgaccctcaccgcgatgcacttctcgaaggccgtgatcttatcatgcgccacctcctctcggatcgccacgtacatgtagggcacgtagctcaggaagtagatgatgccaccgcaggccgaggccagcttggccttggagtacagcacagacaccaggaagctgggtgggcaggggccacgcgcaccgtcatccacccgcacgcccggcctcctgggcaggcccgtgccagggtccagggggctctgagaggatgtggggtgagcttgctgggcaagtgcctgccccaggtccctcctaccatggcccgcgctcaccagaacatgatggtggccaccgcgtagactgccaggaagagccagatgatgaccacgtggctgtgcataagcacctggccgtacttcaggatggcggtgagtgctgtcacggagatggacagctgcacaaagccggtgatgaaccaggccacccagtgcaccgcgttgttcaggcccatggtcttcatcacctgcgggtgggccaggggcttggggcaggccccggggaggacgccgcccctccctgccagcccgcgcctccagggagagtcccggcccgcgcacctccttgagccggtgctccttctccgccacgatgtgctggatggtcatggccacggagtagacccaggagatcaccatgcacagcggcatcatgtgctcaatgacaaacaggaagctgcggggaggccgcgctcaggcgccactcagccccagccccagccccagccccgggcgcccagcactcactcatcgcgtgtgtagcaggggtaggggaacatctgcacgtagctgcctggctccaccacatcgtgccccacaaaagtgtcgatgatggcgcgctccatcatgtctgtgggtgggggcagccatcaggtgccgggcaggccctctcgtcctcacacctgtcctcccccatgaatcctccagccggtcttccgggcctgctcctcaccctggatccagacgaagccgtagaggaagtagaagcggccgccagtattgggcccaggccgccagtaggcgcggcggatctcgttggttttctcggtgaagctggagttctggcggatcttgtagtgcacgtgaggcgggagcgagccgtccttccgggtctggaagatcacacctggggccgggaggttggggcggggccaagatgcaggggcgggaccaaggcgtggtgggggggaaagcaaggcacgggggcggggccaaggtgtgggggcggggacaggagggtccagggaaaggtgggacagggctggggtgggggccccaggggaaaggtgggcagaagtggggaggtgcagggagggggcgggttgtgggttggggccgtttggaaggggcaggggtggggaggggaagtggcgggtgaggggggaaggccagggcgcggccaaggagtgggagggcacagggggacgggtggggctgggctggggaggaagaggtctgtggggggctggggcggggcggggagggcagctcactggcaaaaacagtgacgttgtcctggtaggcctggttgagggtgtagttgacaatgctctcctcgtcgtggaagcccttgaagatgtccacgctcacctagcgggaggggcatcgctggagcccgccgtgggcatgtgcgaggcagggggtgtcgtgggttggctcggaggccccaccgctcaccttggacatgaactggatccagccgcaggccgcgttgtcaatggtatccagctgctgcaggagggccatgccactgggcagcgagaagttgtcctgtctcagggccggcggcagctcatccagtgacaggttcagtgcctcggggtgcagccgcagctctgctacatacttggggtggaggggcggctcagagggggacctgcgcctgccgagccgggcagagaggggctccccacaccacccacagccgcctccctcgcgggcacccttggcacctgctgcagccagcgcaggtgttgctgcagcctgccctgctccaggaagctgcggatctccgccgagatgttgagccagacctgggcatagtgagtcacgttgcccacaaaagcaaaagtctcgttggcctgcagggggtgaggcaggggcatggagtttctggacggacccccaccgacttgggggctctcaccccactcacctccccagtggctggtccattgccaacaactaaccctccccacctttttttttttttttttcctgagacagggtctcagtcacccacgctggagtgcagtggtgcagtcccagctcactgcagcctccacctcccaggctcaagggatcctcccgcctcagccctccaagtagctgggattacaggtgcccaccaccacgcctggctaattttgtatttttggtagagacgggcttccgctatgttgctcgggcttgtctcaaactcctgagctcaagcgatcctcccaccatggcttcccaaagtgctgggatttcaagcgtgagtcccacgcccgggctctccactcctttctgcggcgctcaggtgaaacctgctttgccctccactcccagggcagcacggcctccggacccccaactgcccagctgtgcccaccagctcctttgctggacctgtctccatgtgtcccttaagcacccaatgctccaccctcatctgtcccaccctcatcctagggaccccctctacacccaggattggcctcgtccacaggccctcccctcccaggccaatgtccagccctggcctctgcttgttccagacaggacccctcacccagaacccaaactgcccagctgcccgcccacgagacactctggaaggtctctggacacacccctcctccaccagcactgccctggaccggccacccccagccggaggaccctgccagagcagactctccagtgccttcccacagcagcccctggagctcccgaaaggaaaagcgaccccctggtcccccacctgcagagcctgtgtcccatccgaagctgcaccccgtacccctcccgtgtcaattctgccgacaccctctgcccaggggtcccaggcctgcagagaccccctcccactctgcctgtcaaacatggagcgtcccagacccgtgcaccttgaggatgacgcggtcgacctcagagcccgcaggcgcgtacaggattttggggttgctggtcatgaggtgcacgaggaggcccaggttccgctgctccttgctcgtgaagcccagggagctcatgttgccccgccgcagcgcctcgggttcaatggtgctggggtaggggacagggggccgggccaggccgttagggggcagggccgcgagagtgggaggggcatcgggatggggcaggacttcggggcacagggcagggcgccaaatgagacctccagagccagagcctagattcagggctcacgccctgcccctggctgtcctcctcacccccattcccctgccgcccacctaccggttgttgccacacaagatgggctgcaggccggcccagagctgtacgaaggctgagcactggccctgcagcgtgtccggggtggccagtgctgcagcagagggtgcgccctcctcagcggtggcgttggggcccatgactgcccctgccccagtgccattggccgccccacccgcaccactggctgggggtccgggggtccggccagtgcaggcaccctggggcagtagcagggccagggccgacaggacatccacatcctgcagaaccttctgggcatccagcaggtcccccagaagcgcctgcagcctccgtgggggtggcgcctgtggcgaggagtccgagccgttgggggcatccaggcccagctgaggggaaacaggcacgtgggcagtgcggggtgagatggactgcaggtgggtgataggtcaggagtggagcagggagacagcagcagggagacacaagctaggggtgctgggagggagtctgcagcctgggtaacgggagcccaggacaggagctgggatggtgagcaggagtggggcaccagccatggtgccattggatacccacccacaggcagcatcccacgcacagcctgggcccaggagccctgagctctccaagcggtcccagcccctccttcaactcaggcagcaagcagcgcagcgggcagtgggcaggcagggcctcacctgctgggagaccttggccacgtccagctggttccggagctcagcagacagcccagagaagcgcctggcacgcgcagcagcctgcccactgcagacagcatcccggtagccctgcagggctcccttctgactctcaggcacagtgaggatccggcccagctcccccgagcccggcgtgcaggtgagctgctccaggagggcaggagccagcagcagctcctgggatgggcacaggggtccgtggagccacggcaaggactttgtccccaaccactagggcctcaggcctcaccctgccccacccactggctggctctggggctgcctgggtcccacgacatgcctctacccctcatgcctgccatagacccctgggaccctccccctctcccaggaggagctccaagtcaccaaaggggccctttcctcacccacggagcagaagcacccccagaggcaggcagcactccaggcccatcccacacatggatgccctcacctccatccggaacaggggattgccccctaggcggctccagggctcctgacccttgtggaggccagactgtgaatccagggcagatgagggaccaaagagcaggtggtagacctaggaggtgtgggggaatggctcagatggggtgtggggggcgtggctcagatggtgggggcgtggctccgatggacgtgtgggggcgtggcttagatggtgggggcgtggctcagagagtgggggcgtggctcagatggtgggggcgtggctccgatgtaggtgtgggggcgtggctcagatggtgggggcatggctcagagagtgggggcgtggctcagatggtgggggcaaggttcagacggtctgggcgtgactcaggctgagcatcctgaggatggctcagcaaccagggggcgtggctggggcagaagggagtggccagggctgggagctgtccctgccttacctcgggcgggtccacacgggcggccaagagtgcttgggccgtgctattgggcagcgacaagttttgcgtcaggaaacgccagagctcctgcgggtttctggccaccgagtccagagagaaggaagacactggacaggcaggaaggcgaggctgagaggccgctgcaccttggcaaggtgcccccacatgcgctcggagccgagcccaacaccacagctctgccactgcagcctgtgcgtggctgggaactcagtgcaggtggaggggcccagagtggatgtgggcttcagcccagtgacagcagagctttgcccgcagccctgccccccaacttccctgcacagggcacacctgtggatctgtccaggtggctccccgaggtgcccgggcccgcactgagggcctccagatgctggcgtagggcctcgagctctgagcccaggctgggccgcgctgggtcaaacaggttgccttcctccaccacgcggtccaggcgctcaagcagctgcgtgaccctgcaccatggcggatgtcactcactggatgggctggggaggggtgggtgctccgaggggcgggtgggcactcacgtggagttggcgtactgcaggaagccgaactcgtctcgctggccgtccgggcacagcgattgcatgacaggcaggatgccggcagacgtcaggggcgccgctgtgtagaaggctggcagacccacgggagagggcagggtcgggggtgaaaggggagagagagagagaggaatccagaaggggagggagacagaggccgagaggagaaatttagagaaagtcaggaaggagaagcagcgttagggagaaggcggcacagagccctggccccagctgggctacaggccaagcgttctggggcgaatgactccagcaggtcagaggtcaaagagccactcaccaccccttctgccataactcccagagcattcctttcctttcagccagtgcaggcccacatgccctggcactctccccccgaaaacgtttcaggtgtggcactgcctacagagcccaggggaggacaaaggaccccctctgggcagtgacctctgacctctggccagctggttagcagagtgagtgcaagagcctgaaggagtatgaagggagagtagccaggccgctccagccccagcccaggccagcccagcctcagcccagactcagcccagaagccgaggcaccccagccctagaaggcaaggccaggcagagagatgccgcctcagcttgacccaggcaccagctgtgcctttaggtggccgggcctttcactccctaccacctcccacttcactgcctgccaccccccatctggagccagctgttcctgaggccggcagggggcccgggagggctgttaatgcaagcggggagggcgctcaagccaggacggcccatgggccccccgcagctgctgcccaggccagccaggaggaggtggccgctcacttacagactgcatgccagccgaggacaagagaccatgcggggagggagggggatcaaaacagaacagaggagaccagtgagtgcccacatcaccaggaagaggcgttggcatcatcattcgcggccacaggccagccccgacctccacagcccagccaggaggcacggcccaggaccacacaggggagcaggcaccgcacctcagggactccgggagcaggacacccgtgtgcagatgtgcacacacagcgcaggcgtgcgaggtgccgcgctcccccggctgtgcctggggcctcctgccgcactcaccttccttcacggagatggtgggcttcttctgtcgcagccccagcaggataaagaacagcaccagggggatgaagatctcgaaggccaggacccactggaaagggtgggcccagtgagggataggacagacctgtgctcgcctaggccctccccagcctcccatagggctggcccagcccagacaggaccacgtgctccctggggccagggaaggtgggcacaggcccttcggaaccactgaaggtctgagccccttccagggcactgagggtaaggattgtctggctcagcaaatcaggtttcccgtccccagcccacactgggcctacgtgccctctgaggagcctcagggcctacagggacaaatcggccagcttgtggtctactctgacccatgtatatcccagctcatcttctccctccccacctccagggctacctgggcaaaatcttggggaccatctgagccactagccccgcctacacttcccacactgccccgggttcaccttcctcccacttcctccccaccaataccggggcctggggagatgaggaggcctggttgagaggcttggcctgcgcccagggccctgagcctcggagaagacctggtaaggggtctaacagccccagtccctgaagcaaaggcacctttttttttttttttttttgagacggagtctcactctgtcacccaggctggagcacagtggtgcgatctcagctcactgcaagctccgtcccccaagttcacaccattctcttgcctcagcctctcgagtagctgggactacaggcgcccgccaccatgcccagctaattttttgtatttttagtagagacggggtttcaccgtgttagccaggatggtgtcgatctcctgacctcgtgatccgcccacctgggcgtgagccaccacacctggcccaaaggcacctctttctgccctgtcccctctcctgacccggggcagccagtcttgggccttggagctcagtttccccaggtcggctcctgctaacccaggctgggcaccaaggtgagccctagtgggacctgcgtggagtgagaaagaggtgctttgctcacttcacctgaaaaccaaggactttaccggttcttgtgtcccagcccccagctcagggaggaggaggagcttgagccagctaccctccagagagccctcggcagaccagccctctctgagacccacaggacagaggggccctgccctccctagcccgagggcgagcacccagctcggaggcatcctttgtcctcatccccatcccaaaacccttcagagcccccagtgtgctgtgtggcccgggccgagtccccggtccctggggtgggggcggctgctgtgtttactgtgcttggacaatagggctttgtggccaggaacatcatgctgtgggtgtcccatgcccgccccagcccgtgccagcctccacccgctccctgagccaggacggagcccagggttcgccaaggcactgtgggcaccaacaggcaccagggcgagggtggctgcaggagtgaggcaatgtcagaggcaggggtcacagcacggggcgccagccccgcccacacccggcctgctatgggcactgtaactgcagcaacaggcccggctgcctcccccattgctatagcaacggcctcgcacgagctactgggaggaggaggagagtcctggctggcaggcggcgggcgccacagcagcatctggttacaggcggcagcacaggtctagcacgccctgggtgccccacacaggtgcctccaggtggcccaacctccgtccctcgagaccagcccagtgccttcacatcgcctggaggcctagatgccttctctgggcatgacccctccctgtagctcccgcctactgtgtcggggggagaacaggtgagacccgagggtggcgctgccatctgccatcccagtgacttcatgacagtgaccctgtccctgcaccaagagcagcctgtagcccaagggtagacccaagtccagctaactaagaggagataggccacactcacagacagggaaactgaggcaaagagcttggaggagcctgctagcagcacagaggtccttggcacccaccctccagaccctgagctctgcccagggtggagctctgcccagggtgcacccctgccccagcagggcgcatggcacacagggcaaacctctgtcatccaagcttggccccaagagtccagctctgatgtccaagatccttcccaggaaagtggggacccagcaggagtgtgcccagtgtccagccagccccagccccacatcacaagcctggcaaggactcagcctccctgggggaaacagttccccacctgctccagccatgggctaaggacctccactgtggcccagtgggcctctgggagccctgtagggtggggacccaaaaaggtcctggggggcagcccaaaccagcagctgggagtcactcttgcggtcaggacagtgcacacctcccacctgcttgccagctgccctcataggccacactcccttccctgagcattgtccccactggaacaggggccaccattccagcctctgctcccaagcccagtggggaccttcctgacaaccacccccggggactaatactaatgcatgccacatgccacatccctgttcccttggccctgctctgctgtccccagtgactcaatgccaggggctgcaggcctgatccatgggaccccactcagccagctccaggtgcctggccagggcatgtacctaacccaggctccccgccaaggccaggtgcccaggggaattctgccagccatggtgatgatggccaccccagctgactgcagcctgggtttcctgcagtgcatgttgaaagataaacaggcacggactggtgcagcccaaggggtcccgcccgggccctggctgggcaagaggatgtctgccttaggcccccacctgctctgagccctggcctggacaatcccaagggccttcagaaacctaagctggtccaggcctgtggcctgggaggtgtcccttcccttcccaggctggagccaagctggccagctgggggtatggcaggacacccatatccccaagcccctcgctccacgaaggacttctgtccctgacagccatgtgtcctgcaccctcaggtccactggctgcccaggcagtgctgggaaagccggggttcacagctccaaacagtagacccagcccccagagcaggtggggggaccaggaggcaacagagtggatcaggctcggggagaactgaccccaaaggacaaatgggtgcagagattcaggctggccaaggctggcacaaggacattcccagtggcgagagcatgagcaagggtcacggatgtgccaggaggggaggcggagagatgcctgggaccaacctctatggcaggccgcggcccaagggcaggggaggggtggacggagggaagggacagggtctcctccgggaccccagggaggctgggcccaaggaccatggagcctcgcagctgaatggagccccccaggcctgccttctgtcctgggaaccagggcctccctcgagccagagtcctgagcgccgcttgccccccgcccacagcggccccagcgagcgcgctgcagagggcgcgggtgccgtgactcagccgagcaccgcgatgtcagcggacgcgggaccggactggacacgaccgagccacctccccggaggccgcagcgccggcaggcgagggcagggcccggcggggagggggctcgggcccgcgccgcccccagcgcccgccggggtctgcgcgcgcccggccgtccgcacgtgcgcgcggggagcgcgcctctggccgcggtgcgcgcggcctcgggctgagggcgggcgcgtggggtgggctcaccgggctccggcgtttgagcgtcacgttcttccagagcagcagctgcagctggtgcaggaagcccatggcggggccacgctccgccgcctcagcgccgcggcccgctcctctgcgcgccccgccgggccccgcagcccgccgcgccgctgggcatcgcccgcgcgggggcggggcgctcgggcgtccgggacccgatccgcgctggctccgccccggcggccgcggcgacagcgactctgcccgcgccccgcccgcccccgcttaaaggcgccgcgctccgtccgcgcccgccaggaggcgcccgccgcccgcgccgcgcccgggaccgacccgggcccgagaccctgcgcgcgccgccgccgggaagcctccgggccgcccctcgccgggcgtcacgcgacgcgcccacatcgaatccgagaccccggcttagccttcgtaggccgggggaccctcgggcgctgcgctcttctcccagaggcatccggctgcgcccaccgcgctggcgactctgcagaggcgccccaagccttcactgtccccggggcgcgccgagcggacgctggcgaggggccagctcacccccgtaagggtctcctgtgtgctttgtaaaccagcacttggagtccaggtggtgcccacctggaagggaggcagggcggccaggtgggtccgtcccgcgattccgagcagccagcggaaggggggaaactcgaggccccaggaacgctcgccgtgagcggagcaggcaggggaccgaggcggcccctgctgcacgcggctcgtttttctccccatattcgggcgagtctggtctctgcacagggagttcgggatcaggcggttctgcggctgtggcttggcacctgctggggcgccccgggaggtggggcagttcctccgcgtggcctgtagagagcgacagaggacaggctgaccccatgggtggctctgacggcgcttcccagactcagtttcccccctgtgaatggggtggagtagcgctgtgtggtgtccagtgtcagggcgcacatagaaggcgcatcctcaagtgaatgaagacctccgaggccacagctccccactcctcccagctcctttgcagcaggaaggtgaccctgggctagtgagtgagggatcagcttcccaccccagcccgcagcctcaaggcacttgcttttctctgctcagtccacagggctgggtcagggcaggaagctaccagcaggtctttcccacaagccacagccatgggtgaggggggcttcctgccctcaacctgcccacccctacctggggtagggacaagccctgtgccccagccccgggggcttagcctgttggggccctggtcagcaccacccgtgggttggcctctctcctcctcgccccactctccaccgtccactacaggggctccctggctgcagccgcatccccagtgcctccccagcactggccaccagagggagctacaaggcacaggtcagaccctgtcaccccagacaccctccagcctgcgggcctgggagatgggcgatttcagcctggccaggcctctgacgtccgttccctactcttccccaaccttggcctgttttggtttttgttttgagacagggtctcattctgttgcccaggctggagtgctgtggtgtgatcacggctcactgaagcttcaacctcctgggctcaagccatcctctcacctcagtatcccaagtagctgagaccacaagcgtgagccaccacgccctgctaattcttgtatttttggtagagatgagatttcactacactgcccaggctggtctcgaactcctgggctcatcgccttggccttttgggggacacagaaggctctctgataaggggccgtctggcggaggctgtaggaactggggtagccagtgggcagcccggcacagggagggctctcaggcggagggtgagcaaaggcccagaagtcaggcgacaggaccccccgtggggaacaagcagccccatggccgtgggggcgacatgtcaggggagggcagatgcaggctctgtggccctgcacggaggtgacccatgagacactggccagacccacgaggcactgctcagatgtttattgtccaccgccctccctccctgagcccagaacaagctggtttgctccccgtggtctcctgggccccgccccagcctacacacagggacctcagaactatggacgtggcagggacccgtgcctgtgtctcggggaccacagggcctctgctaccgaggaagctcggggtcccaggtttggcccccacaaacttcaggctggggtgccccccagccccaagggccctgcctttcaccctcttccagccaggccttcacccacccaagatttgttcagggtggggagggtcctcggcagcctttcccctcccgtctgccgcagcaggcacccgttacctccctcccactctcacctcctctgcatgctccagtgcccacctgcaccccccacccctgcttcctgacctctgtgcccagcctcccgttagcccgctgcttgccggtaagggccggatgcctggtggtttgatttcgacacccagcccttccacccacacccacctcccccggccagcggatctcaggcctgaaaccaaccctcaaggtcctcatagacttggctgcggggtaggtgtgggtagcggtcacagatggcacagaaacgttcccgccagtcggtgaacagtcgcacgcggagcctgtcacgccaggcaaagaagcgttggtatcggctctcattcatgccagtgaggaaagccgccagctctcgggctgagccaaagtcatccacatgcacgaaggcgtcagccggcacgaaggcctcataggtggcccgtgggggccccagcaccactggcacagtgccagccaccagtgcgttgcgccagaatttctccgtaatgtagtcgcggtgctgagagttctcaaaggacaggtagaagcggtactgggccacggtgggcaccaggcagctggcgcacagtggccgtccattggcacggccaaagacatccacccgcagatgaggcgccagctgccggtacagcctggcacgcagctgccgctcctggaagttgctgaccacccaggcggccaccctgctcttggctggcagcggtggcgagggcccccagtggggctccaggcggccatagggcacaaagatgtccgagtcgcgccggtagctcagcacccagttgaagatgcctcggaggtggctgaggccgtgggtgtggctaggagactccatggaggcccacacccagggctgccctcgcggccgctgggccaggggcaggtgggaccgccgggtctgcagctcgcggtggtggaagaccacggcgtcggcgctggccagcaggcttcggttggcactcaggtggcagcgggcgatgccgtagcgggtgcaggtgtcgctgggcagctctgggggctggtcagtgaagggccagtgccagacaaggatggtgatcgtgggctggggtgccggggtaccccgaggggctgaccccagcagccacaggagccagagggcagcgagcagagccaccccggccaggacccccaagcctcgcagcctccgggtggggccgtgccctgcagcagcacgagggaggggaggctctgtcacttgggctcagggacatccacacgccccactcagcgccaaccccgtcctcccctcccatgggctcagggacacccacatgccccactcagcgccacccccgtcctcccctcccatgggctcagggacaccgacatgccccactcagcgccacccccgtcctcccctcccaggttgcctagctgtccccagcttgggcctccccgagggccagacactcaccagcattattcatccacagtctcccaggatcagtcagccaagagacccgagattctcaaatcacggcagccgccagaggtgcccctgaaatcacagctacgccctagctcagccccgcctggaactgtgctccttttatctctgcccaaggtgagggaactcaggggaccttcctgctcctgccccgcccctgcccccacaacctttggcatcaaccactgtccccacccccatctcggggacttgctagtcctggggctgctgggaggggtacagccacaagagggatgccaagccagggcaatatgacgcccccacagcccaccccactggtctccagagaggcccagagatgtccagctgggcaggcagaggacagagaggctcgggcaggcttggcccagggcagagaaggcccaggtgcaggcaccctgagcacagatggccccccagcccccacccagctacccaggcctgggcgctgcagacagcgagtgcacttccccagagggccaggtggctcctcccacggcagtatcacccacttcccccagctcaccaccagctgggccctggtctcccaggagaatcttacacattgaagatgtactgtgctcagctctttgccggaagctaaagctcccaattgggccatcccaccccactctgccacctctgccatctaggaacccagatgcccggagaggaggtctgtcctggggcccttagtgtcttcccacaggagcccagcgcgtgcctgcaagggcctggtcccggaatgaactgtggatggaggctgctttgtccttttccccgtccagatccatgcccatagacaccgctgactataggctgggcccagggtcccttcctccagcctgcagcagaggggctttccaggctggaaagggaaggagtccttttgtccctgacgcaagcgggttgggggccagcacccgctccaggaagaggaagggatccagcctgaagtccagactccccgctccctctaagccagggcctggagcctggaggccaggttccttcttctacaccagcccacgttgggtgccagccaggctgggatggccctgcggggtcaccctgagccccagccaaccaacaccccactctcagccacagtgggaggccccatcagcctcttcacccaaccacgttgccactctgctgcacgggaccttgtgtggtcccaggcgtggccagacccagacgtcctggagatctcaatgcaggtcaggcttggtttgtttgtttgtttgtttgtttgttttttgagagggagtcttgcactatcgcccaggctgtaatcccagcattttgggaggccaaggcttgtggatcacctgaagtcaggatcaagtggtgcgatcttggctcactgcaacctccaccttccgggttcaagtgattctcctgtctcagcctcccaagtagctgggattatgggtgcctgccaccacgcccagctaatttttgtatttttagtagagatggggttttcccatgttggccaggctggtctcaaactcctgacttcaggtgatccacaagtttcagcctcccaaagtgttgggattacaggcatgagccaccgcgcccagccaagtttgcttttttgtgtgtgggtttttgttttttgttttttgagacagggtcttgctctgttgcccaggctggagtgcagtggcgcagtcacggtttgctgcagcctcaacctcctgggctcaagcaatgctcccacctcagcctcccaaggagctgggtctatgggtgtgcactaccatgcctggttaattttttaaaattttttgtagaggcagagtcttgttatgttgtccaggctagtttcaaactcctggctcaagcagtcctcccacctcggcctcccaaaatgctgggatgctgggaatgaggacgcgtctgtcctgtcaggtcttttgggggctcagatcgtgtgtcctgggaggaatggcaaccatgaactgttgtccagacctttgccccagcaccctcagagggggcctgcctcccaccacccctgtccctgtcctgttctacttttgggccccaggggctgctggcctctccccggccccacagtgaggacaaggctgccttgggaggggaaccaggcagctggagactgaagtgggaggatcccactgtggggacagaggcaagactgggacagggtggtagtcagaggcccccacccctgtggcgcagtgtagcctctgagctgagctttgctgcggaacttgtgcaacggctggagggaggggggctggagggagggggacttggagggagggggcttgggaggggggctggagagaggggggtttggagggagggggctggagggaggggagcttggaggggagcttggagggaggggggtttggagggaggggtgcctgtgggcgccacgggaaactgtcagtgcctgagctgcttggcttaggggctggcaccagagtgggcagctgcctccagccccgcctttccagcctcccatgttttcggtgatgaccacagtggcacctgggcctttaatcccaccccagcgttcctcctctggcagggggcccccggggagccacaccttggcttcagcctcacaccaccccatctcttctccttgaaacagacacccggcggcagttcctgcaggaaggaggctgtcctgccacgcctgcgggtgacccggcctctggtgccagagcctgccatccttcctgtttgtgctgccaggctggcagggtcccttgccaccgacctcagccgcagccacagcctgctccctccctgggtggatttgaaggagcctcccccaccctccgcccctagcttgctccttgaggaccctgggcagggtggctgccatggggcccaatcgtgcgtgggaacctgcgagctggcaaacggggctcgggggttttgcccagaaatgggtcagaacgaaagcctctcagaggaaagaaaagggcatgagtcaaagagaaagtcggggggcaggggctccccctcatctcaccccacccaggcctcctgactccctgggtttgtgcggacccaggcaggcagccaaccccagctccgtggtgtgtgagcatcgtgatgatcaggacacaagctcttccccgctgagccttcactgtgggccagcttcccggtggatgcccactgaagaggcctcaacccagtgggccccactccagaccaagagcagaccattggccagctgccccctgcagacagcggcacccggggcagcagcaaggtgaggggcacccagccccagccccaggggcgtctcagggagcgggctgagcctggctgtcttcctgagccccacctgcttcatgggttggcttgagcaaggcagtccagatgcgtgtctcgagcgctccctggcggcatgctgcaaagctacatggctccggcaacaaggaagactgcccttattctcagtaacaggtggagctgggggctggagagcccctcggacctcgccttgggaaagctgggtgggtgcacggagcctggcaggtggccaaggggacccccaagtggagggattggtcgaggggcagcacagggtggtgcagtgggtgagctcagcccctcccctccaactctcatcccattgagccccaaggcgtggggggatcacgtctgtccttgttctcctccaggtggagctgctgggtggggctctggtcctccagggacccactctgcaccccaagttttgccgggacccgctcctctgtgttgtgtggctgtaggggagggctgcagccagggactctgaacccggggccggcccacccagccacccagggtggggaacaagatcgcctcccagggccagaagctggggatgtccttgcttcctaggatgttggctaggggatcacacgccccacattctgggtcaagcatggtcctgccccagcatcttgctgggttgggggcatctctgcacagatgagtgccaccccagcgtctccgccagggtctgggcatgtcactcttgggcatctgtgctcaggaggtcaccaggtgtgggcagggcaccaagcagggaggtagccgaggctggaagatgcacatcagtgccccgctgggcttcctcaagtgggaactggtggagggggcgctaggctgccgggccagggtcagcaggctcaggccggctcagggctcagagttgagccagaaaccaaggtgaaatctgcctcttactgccgccagggcccttgggacagggacaggaacagcagaaggtaaagtggaaaggaattgagtaatgggcccccaggcaaggctgagccaggccccaagcccaggattggggtctccagagtccctgggggccccagggcagctcacccacagcctggggcctatgggagcaagggggctcctgatgggtgggggcaggagcttggacaaagttgaaggccttctgtctgaattggccaggggccaatgaaagccaaaaagctggtgtggtggcttatgcctgtaatcccactttgggaggccaaggcgggtggatcacctgaggtcaggagttcgagaccagcctggtcaacatggtgaaaccccatctccactaaaaatagctgggcgtggtggcaggcacctgtatgtaatcccaaatactcgggaggctgaggcaggagaatcacttgaacctgggagatggaggttgcagagagccaagatcatatcactgcactccagcctggctgacagagtgagaatctgtctcaaaaaaaaaaaaaacaattccaaaaaggcgagtggggagcagggtgctaggctgcatgggggcctatgcccccaccggaggacctagccccctgccaacccttccccagctcaggcccaccagctcccttctcacacagctgctctgggagggagtccttccttgccaatacctaagagaatgggcagcagggaccctgaggacaggttggggacacccagaacaagaagaagatgggacacactaggaggctcttgggcccctgcgtcaggccagcaggataggtgtgtattgtgacctgagggactgaacgtggagctccaggggaacctcccagccagtgacacgctggccttgggccagacgctgccctgcgcccttgagtgacgctcgggcctccctgcacccacccgctttccctgtggctaatggcttagagtgaaggatggtgggcgtgggcgtgccacgtgggctcagcgtccaccctgccccatgcacgcaggcacccatcacaccagggcccacacacaggctcccatcacaccctgccccatcacagcagtgcccagagggacatggggctcccagctgagggccagcccaaggtcacaggtgaggagtgagaggtgagaggcaagggggcttcctggtctgggtgggctgtggcccccaaaacatgttgcttaggtcaagccagtctcccccagcaggggtgaacaattttcccccagcctgcctggcccaccctttctccagggacggtgcccagtgggccttatcttccccatgccaggtgtgatggttaatactgtcaatttaattggattgaaggatacaaagtattgatgctgggtgtgtctgagagggtgttgccaaaagagattaacactagagtcagtgggctgcggaaggcagacccacccttcatctggtgggcaccatctaatcagctgccagcgaatgtcaaccagaaaaacgtgaaaaggagacgacaggcctcgcctcccagcctacatctttctcctgtgctggacgcttcctgccctcgaacatcggactccaagttcagctttgagactcgggctggctctccatgctcctcagcttgcagacggcctattgtgggaccttgtgatcgtgtgagttaatacttaataaactccccttcatatatatatgtatttctttttttttttttaacacagtcttgctgtctctaggctggagtgcggtggtgcaatcttggctcactgcaacctccgcctcctgggttcaagcgattctcctgcctcagcctccagatagctgggactacaggcacacgctgccatgcttggctaatttcttgtattttagtagagacgggggttttactgtgttgcccaggctggtctcgaactcctgagctcgggcaatccgcccgcctcagcttcccaaagtgctgggattacaggcatgagccactgcacctggcccccctctctctctctctctatatatatatatctcctattagttctgtttctctaagagaacctgactggccgtgtgtggtgactcacgcctgtaatcccagcactttgggagaccgaggtgggcagatcatctgaggtcgggaattccagaccagcctggccaacatggagaaacctcgtctctactaaaaatacaaaattagtcaggtgtggtggcgcacacctgcaatcccagctactcgggaggctgaggcaggagaatcgcttgaacctgagaggcggaggttgcagtgagccgagatcacgccattgcactccaacctgggcaacaagagtgaaactacgtctcaaaaataaataaataaataaataaataaataaataaataaataaaaagagatccctgattaataacacgaacacgccagggctgtctaggtgcctggacctccagactcctaacaaccactgaggggcttctgaacccagtcctcctacgtccccagcatcagtgggacagagagtttcagcccccgcacgctgacctggtactggcctgatctgggcacttttgaccacatgattccccttcctccctcggggccttcttgctccaaatttaggagtggccaagtcccagctccaggcgtccaggcccctcccatcacacccctcacctggccccctgggtccacctggctctgcatagctggtatcacacaggtacctctgcctgccatccctcctccgtgtgctgcagggcctggcggccgtggtccccatgagaaacccagactcaatgtctgcattgttttccttctgcctggaggtggtgggcacccacatccaggtgcgtgtggactatcacctgctccagccctctttatcacacaggatggggtcttccgggccgcagagccaaccctgggctggcccagccctacactacacccttcccctctcccacctgcgtagaagggtctgcaggggtgaggcctggctgaggagggtggggatgatcccgtggcctctcctccagctccacgggatgggaaggtcctcctaatgagcgaacagaaaggcctcctccctctgggggtgcaagagcagaccccaggccccccactcaggggtccgtctaccagggccccaaatgggagatgaggcggtggaagattaacccaagctggcaacacaggcagaagccgcaggtctgaaatggactttaattggcttttgtctctagaattacccacccgttcctgcgctctacggttctccatgccccctccagtttgggggtctaaaccgaacaggagaggtgcaggggaccaggaggtgtcctggcacaaaggttcgggggtctccctggcaaggggtcccagggcctggagcccgaggcccagccaaaagcacacagcatcaaaacatgtttttagtgggaagctccaggccctgcccctccccgggggcctcgaggtcggggagcaggtgggcgtctgtctgcctccaggtcatggcagtgcaggcggtgagctgggggccggcaggggcgcggacagtgcggcgtggtcgaacagagggttgcgcacctccatttccccggtctgcgaatgtgggtgtcaggctgggcagtgggtgggctggggggatacttgctgggagggaaccccaggagatggttcgcccctccctgcaccctgaggcactcaccggggccaggcccgggcactcgtacaccgtgaagtctccgtcctcattctcctcatccgaggaggccgtgtccagctccttgggtggctctttatgcctgggtggggggggatcgctgggtcctccccatgccctcgaggtgccagtggcccagtctggaagtgggcactcagcccacctcagccctggggtggcaggggagcacagcccagggtgaagttggccaggggaggtgagggtgcagggcggcgggggaggtgaaggttagcgtgcaggtgagggtggcagggcctggggtaaagttggccaggggaggtggaaatggaggtggaggtggggatggggggtgggtgggtgggggtggcagtgccggggcggccactcaccgctccaggcacagcatctgttgccgttggtgctggtagtggtacatctccgcgctctgtgccagccgctggtccccaggctgtgggaaggaggaggcgagggtcagttggcggccagagttgggcgggagcctcagggctgaagggggccacacaccgagatccggggagctgcaggtgagccaggggccttcgcagtggcgtagtcggccttctgagtcaggcggatctcacgctgcagcctgtggggagtggggcctgagacctctgagcgtgtggcaccctccctgccctgcccgcggccactggctcacctgcaccagcagagggaggctacggagagggcggctgcaccggccacacagaacgccaggatcagcactgcaggagggggcgtgtgagggcggccttctgcagggcgccctgctgcccctgcccacccccgaccaagacctaccaagggcgaggccgtcgccttgccctccccggggctccaggggcgacatgtgcaccgggtcggatgacacaggggagcccagggaggtgtggggcgtgggcgtgggggttcctggagtggaggggaggcccagctccagcccctgcccccgtgccgagaagcccagggtggctgcgagagaggacaggttagaatgagagcactgggctagggacagggccgtggggcaggggaagcgggggtctcaccaggctccgggagccgctgtcggtccttgggtaggggcggagttgagtgtccagactccttccgggcaagctcctgggccaggaagtcaatctcatcttccagtctgggctggggccggcccccgcctggggagggtgaggggccatcaggtggaggggtccgtccaggaggtagccccaggcccggcctccccgcttctggcaggttcctcccaggagcctgaggactgggtacacgcctggaggccctctccctcccagattgccatggtgacagcgcgggcgcttcctgtgaggggcagtgcttcccggaaagtggaggcagggcaagggaggaggcgctagggaaacgtccaaagaccgggcacggggaggaaggagtggggtctctcgccccaacccatgtccataaagggctggccagcacagccccttctgcttccccacctccaagcaccttctcgggtagaggggcagggactccccaaggagtggggggaagccgaaggaagccaagcacccgggacccctccccaggtcattgggagaacgggggcagctgtcaggggtggggctggtggcagggctccaccggtacccactgtgggctgcacagtctgggtggacgctcccaggttggcaggaggtgcatccacacagacccttacagccacttctcggtgctcctctcaacacctcctccaggaagccgctgctgctcccacccccagcacctctgagcaaagccctcaccacacctgaagtcactcagtgactggccatcccgacagatgcggctcaggctggcgagcggggcatccccagcacccagccagtgctggcacccttcaacatttgccaacaggcggacaggacagtgagtggtggaaaagagcaagctgcctggggacggggaagtgggggcctggagggcttctgggcagaccctgcagagcccaggcccggggagaatgggcccttcctctcccgtggccatcccagcatttcacatcgtgcagcccttctcctgggagggcctgactgccccaggcctgggcccacctccatttggaaaggatgggaggcttcgtggagagtgaatgaggatctcccaggccttggacccaacaccccacaaggtccaggggccccaagaccacctggcacaggcctgggcattgaggctgcaggctgctgcttttttttttttgaggcggagtctcgctctgccgcccaggctggagtgcagtggcgcgatctcggctcactgcaagctctgcctcccgggttcacgccattctcctgccttagcttcccgagtagctgggactacaggcgcccgccgccacgcccggctaattttgtttttgtatttttagtacagatggggtttcaccgtgttagccaggatggtctcgatctcctgaccttatgatgtgcccgcctcggcctcccaaagtgctgggattacaggcgtgagccactgctcccggccttctttttttttttttttttttttgagacagagtctcgcactgtcgcccaggctggagtgcagtggtgaatcggctcactgcaagctccgcctcccgggttaaagcaattctcctgcctcagcctcctgagtagctgggactacaggtgtgtgccaccacacccggctactttgtatttttagtagagacggggtttcaccatgttggccaggctggtcttgaactcctgacctcatgagatccaacagcctgggcctcccacagtgctgggattacaggcatgagccaccgcgcccagccggccgcttcttacagggagaggttcatgcagggacatccccccatcgacttccccctttgctctcgtacctggaggccggcgcatcctgggcacacagagcccttgctggtcctcctggaagggctgaaggcagggcccacaggcatgtgcaccaggaggacaccttgcccgcctcttcagggcacagtccaggctcccgggacaggcggctacatctgggaaggaagcagaaggcagggccggctcacggccccgcagggctcggcccctgcacacggcagcgctgccccagccacccgcccccgtcaccccccgagctggccgggcctggttctggccattgttctggacatgcccttcctccctgacgccagggctcagaacccggaagcgaacagtcctaggacttatcagaactaccctgccccacccctccccagggtccacttccaggcctgatagagccctcagctcagaagctgagtctcgccgtccaggcagtgctgagttctcctgggcagggccgtgcagccccacaagcccagcctccggcctcaacatgccccacagcaagccaggaaccccgtccagattgggagtcccagagggaagggcccaggtctgtctctggggagcagcaaacgatgccgccagcgacctctccttcccgtgcggctctccccagaacccggcactgacaagtgtgcagcctggaagggatgctgctcctccagcctctggcttgtcccccaggcaccgaggacacctaagatggagtctgctgacctcactggcctcagacacagaacccaggcaggtcactcccaaagccaccacaccaggggctgcagtcaggggccaggtggcacccgagggcctcaggaggccgaggttggcagtgctggggatggcaggccaggccctagttccctagttcctaaccacactttcatctcgctgatgaggggcccaggccacggtgccagctgacacatgtggctaatcagtcttatcctggtgctggagaacggggcgagggggcaatggccctctgcctcagtttcccctctgggatatagctgagttgcctcaaagctaaggaatgtccccagtcacagcaagccagtggagccaggggaaccccagcagggccatcaaccctgcctggggagtctgcggtggcacctctggctaaccaggactcttcctctctgcccagccccacactgcacactgcaggcagggccacgggggccacacggggcatcatccttctccagaccttggttggctggtttggtttccttggtaacctgacactcagggccctcaggctgtccgccttccttcaaggcagttccagcagccgcagtggcaggtgggcacaggagccaacgccaggcaccgcacaccctccacaacctggggcagcagcctccagtatcagtgggccgggacttgggcacgttaaacattaaacctgtgccagcaggtccacctgggcccacccgccaacttggcacctggggagtgaggcagtccccgctcctgtgctgataccccaccgtccaccacgccaaaggcaggggcctgaggtacaaagctggctctagggtctgggttccaggcccctcctagcccttttccccagcccaggagcctccatcccccacttcctcctcctgaaaagaggtcgcaggaacaagagcagctggacggtggctggcacacccccctccacccgccaacgtctgggctgcctgagggccctcccttccaagcactgggcactgggaatgggaggagttgcctagggagggccctgccaggtctcccggtgaggcagacacgaagctgcagaggccggtgaactgaggactggcacctgccacccacccgggctcagcacagcagctgcagccccgtttcctgaataggtggcctccgcctttcctggctgagcacactctgattctcggaagcctctcctgttcatgcccacctcccatccaggggcactgagcccaggaggaagccggcctcactctggccccttgaggccacacacacagaaccaggctgcccaggacagcgcctcagctgtgccacaatccacttaacttctccatgcctcggattccttgcctgtaaaacgggctcacagcacctcttctgcagggctgccaggagtactgtacgaatgcagtcgcaaagtctcccagttcagtccccccagaaaaacgtcagctttgcatcctgggttcctgcagggagctctgctctctggaccctcaggacccatctgtgcaggtgagagggtgtcccaggaccctgggcttatcaccctcctccggagtccacctgcagccctcagtcccaaagacagaatgccagtgccctcgagggcaggggatgcaggcggaggctctgaggctgcaacagtctccctcctattgaagctagaacagcaccccgagcctgcgccataagtgcccccagaacttcagcgcccaccatggcgcacaaggccggtgcccagcgccacccaaggcgtgaggacaggcagagcagcactgaggccccgaccccgggacgcgcaccggcagcgaagccggcgggcactcagggccagccccacacccgcaggagccccgaacacggagacacagagacgcacacaggcagactcccggcgggcccgcccagagccagatggccgcggcgcggaggcctgagccagacgcgctcccggcggaagaagccatgaatgtaaggtacgcctctgggaaccggcagaagccccatccggcgcggccttttggaggctccgcgctgcgccctccggccaggcctgtttattccatcgtgggcgaggcggggcccccgccaccagcggaccaggcctgcagggcctgcgggcctgggcaggacgagggcggcggcgcccggcaacccggtccccgcccggcgatcccggccccggggcgccccgcggcctgcgcccagcgcgctcgctcacccgggtggccggcggcggctccacgcagggcggcgccgaggacgaggccggagagcagcagccgcagcagccgcaggtgccgcggggagggcggaggcagcggcgtcgccatccttcagcgccgccgccggggcagcatggcaccgcgaggccaggggctcggcgcgggctccgggctccgcgtcgggagcagcggaggcagcgggggaggacgcaggaggaagaagaggcggatgccaaggaggaggaggaggaagaggaaaggcacgggcggcggcgctgacgctgcagcaaggatccgggatggaggcgccggcgaggcgcgcacgcggagactgcgcctgcgcgctccacctgagggggcgggagggcggctccagactgcgccccctccccctgctccagttctggtcccctctccgggcctcgctggacctctctcggcctcagggtgtctcggcacctgcggtctctggggccggtgcggttcccagaagtccggctgggtttgggccgcgggtgggcttctccaggatgcgctcccttctggcctcttcccggtaggactccgagcccctcacccgcacccgcgatggggcagaggacctgtgtgggcctagcctcgcgagcgcacagagacacaggagcgccgggcgcacgcagacaggtgctcacgagctgggcaggtgcacaggaaggcacaggtgtgcccacagaggcaggggcacccccactcgcgggaaaagcaaatacaggaacacagaacggccccggccccgactgcagctttggctggagccgcggcggccgcgctcagtgaggccaccagggggcaagagtgatccggagccactgaggaccggagctgggagctgtccaaggtgttcagggtccccaggtgacagccctttagctccctcaggacaatgggcatctttttttttttttttctttgagacagcgtctctgtcgcctagcctggagtgcagtggtgccatttcggcccactgcaacctccacctctcgggttcaagtgattctcgtgcctctgcctcctgagtagctgggattacaggcgcgtgccaccatgctgggctaatttttgtattcttagtacagacggggtttcaccatgttgcctcagctggtcttgaactcctgacctcaggtgatacgccagcctcagcctcccaaagtgctgggattacaggcgtgagccactgtgcccagctgacaacgggcatctctgatgccccccttgcacctcacctgttgcctcccaagagcacgcccaccccatcccactagaaacctcctttgactagtcattcagagaacaagagtgagacctccaacccggggtgtccccttggtccttccagtctcagaactccaaagctggggctggctgccctcaggtttatcaaatgactttaaaaaaaaatggtgaagaggggagggaagagcagaataagaaccaccaccctcctcgccagggcactgagcatagagacagtgtctaagctcacttcccaggaaggtgaggaggcgagtgggcaagaccaggccttcccatcctggagaaaactggcttggggaggggctgcagggcctggctggggctgcaggatgccttttggaggtgcaggacactcagtcccaggtgagaagggcaaggtgccctgtgccattgcatggctcagctccacagccaggttctgtgcaagattcctgcctatgggtcctggtcctgatctcatctcccacccctgtgccacctcctgatgtgggcctgccctcccgccagtctctaccagcactgactgccccctaggaagccgcctggctggctgccacccactctccgccacctccctgacctctaccctcacccccaggctcactgtaccaggacccaaccttcagtctggccttggtcaccaacgcagatctggatgtgatggttttggggaactctgctggccagagaagactcaagggcccaggaacattccctcgggccagccatcctgcagctactctaggctgccacggcacaccagggcagcagccagtgccccaggcctggctccagagcagaaggcagtagggagggatggtgtccaccctcaggaccaagggcaggcccgtgcggctagaacagcgggaaggtgggggcacaggccacagcaaggatgccccaccccacagacactctcctttcacgtctctaggaaaaactttttattacaaaatttttacaagtaggtgctgggctggctgccagcccgtgggctgtgaccctccccagtacagacccagactacacagaaggagcctctaagggctgattctcaggaccaaggccccactctctggagacccagccctgaggaggaggaggaggagcacggggcctgcagtgatgcccaggctgaagcgggctggaggggttcaaggagctggattgagcgctctttgcccacccaggctcctgtgggtaccagagtctcagttcctatttcctgggctgccttaggggcagagacgctgagggtggggtggaaggatggagaagacagtggtggggtggagcggtgggggatagagggtgggtggaggaatgcaggatacaggggcggggagagaggttgggagaggggtgggtggaggggtggggatacaggggtgggaggtacaggggttgtgggaggggtgggagtacggggtggggatacaggggttgggggagggatggggcagctgcccccgtcggcccctaaatggtgcttggcagcttggcggagtgcacctgacgcagcagcaggacaagcgcagccaggagcgcggaggcgaagagcagcaggaggacgacccaggagctgaagtctgtgcccttgcgcagccccggcgggtcggcggggatcaggttggtcaggttcagcatgtagccgagcgcccagcccactgcagtgtccgcggcctgcggggaagggcgtggcctcagctcccgagaggccccgccccgcaaggtcggccccgccccgccccgccccagcccaccttcttctggaagatcacgccgccgaaggcgcgctcgtcgaagccgtagccgcgactcagcagctgctgcacgaacatggccccggcgcagtagtcggccaggcgggcccgttgccctggcacccgagcttgcagctgggacgcgggcgggacaccgtcaggcaggcgaccaccaggaggtctcggccccacggggagagggggccggcggcgtgcttcacccctccccagacacacacgggccgtgcgaggccagagaccaccacacaggcccggacacgaatggcaagaccgagtccgaggggcacccccggcagggcacgcttccatccctccccagccagcgcccatgcctggaaggccagtgaggagggacagcaggcatggccaccagggagcaggaggcagcaacaccttggtgtgtggccaggggaacaggacgagctccaggcctgagtctgcccgctggctcgccgcctgtccccacctccctcaccccagtctgtctgagactaggccctgggaggacaaaatggggcctcgctcaccaccccggtcctgggacgactcgtacgtttctcttggagtctccggtgggcacactcccggtgcccagacccacttccatcttcccttgtgtggtaccatggagggaaccagtggcagaagccagaaacctgggcaccggcctccccctgccctccagatctgggatgagggtcgggcctggcgaagcttctccaacccgcccgacttgttcacagcctaccggccacagccacgccacctctggagtcagcctaatgcctgccatcgcccccactgcagcgggtgctccgagaggcctgtccatgcagggctggggaggcatgcggaggcggaggctgagcccttccgcacagccctgaaggagtgggagcggggctcacctgagcccaggtctggttgcagacattcactgcggctgcctccagctgctgcagggtggccacgggcagccccatcgaagtccgcaaaaagtccacagtgtagaagaaggcagagaaggcctgtagggggcgcagtcacactgtgaccgaaccccagcggctcagagcacctgctgccacccgcctgtccctactcacgacaaagttcccagccacccgcctgcccttacccacgacaaagttcccagccacccgcctatccctactcacgacaaagttcccagccacccgcctgtccctacccacgacaaagttcccagccacccgcctgtccctacccacgacaaagttcccagccacccgcctgtccctacccacgacaaagttcccagccacccgcctgcccctactcaccacaaagttcccagccactgggggctggaagaccccattgaaagagcatcgggagaaggggcaggaggagaagctgaagagcccagaaaccagatctcggcagaggtgggggtcactgctccctgacaggctgaccctggcactgctgttgaagttctggggccgctgggccatggtgcatggtgactggtacacatccccgagcagcacttgggtggaaaagcccctcggccagcaggggtggaagccgtgggtctgggggaatcaccagcgtgacagggtggcaccaccaccgctccagaggaccagcctgacaaacctcccacaggtctcactctggcaacttcacttttgtgctcaggggcaatccatggctccccactgcctgcttgacagatcccaacgcccctgaccaggctccctctgagagccgtccctggccctcccttctccaggcccagcccagccactgggcctttgctcatgctctgaccctcccacctgtctttccagccaattaaagcccagcctggagaagccttccacagcacagtggctgtccaggctctgctccaggagggaacagtgcagtgcaggtgagccagggtggaggggcacctggagggcgctggccagcagcctctggaggacctggtcacggccatagcagaggaagctgtgggtgtagactcggtagtgctggccgtagagatgcagctggacctcgctggctctgtcctcagctggactggttgtctcaaaagtgatctgggtagaggcaccccccaggtccatggcccccagtgtccccttccgtggccggaaccaccggcccacccagccgtactgtggagaggggagtgtggggtcaaccaggggccgagggcgcccacgccccctggctctttggctggctgctgggcccaccttgatgaagttctccagcaggtagttggcagtcacccagccaaacaccccctcttcctggcccgagaggatgcgtgcaccccggaagtcaaaggggtactgggtcagtgtgtgagtcactgccatgagcacactggtcgaggcctctggattggtcaggctgcaaaacacagagaactccaagaggccttctccccaggtggctgtgagcctgctgtaggggtgctcggagtccgccctgcaaggggtcacagccaaaggccatcatggggacagggccagggcacaggcacactcacttgagcaggcgcatacccgctgtggctcccaggtagaggggtgtgcccgcgtgtctctctttgggcacatcctgaagcgcctgttcgaggcatccaacaagactctggctggccccagaagggttgtctgcatagctggagatgcccccacctagagggaggcagagagatgagcctatgcctcacgggcagcccctaggtgggccgtaggccaggagagtgagggtgggggtgggggccgtgggctcccagaccaggtggcacaccttccctgcttaagcccccagaaacgcccaggttggagacaaaggggcccaggtgccacccggagaccaaggctgctgcctgctgagagggtgtgggtgcaggtgctaggacaaagccctgggcatggtcaacccaggttggcctcctgaggcctgcctgggtgtgtccgccaggcccccagacctcctcctgctccatctggggcacagaagccaatactgggcccggcgaggctcaaacctccccacctgctgcctaggcttcctttctagaatgcaaacgactcctggccccactcaggcgcaggggcaccagcctctctctttccagggcttctgcctggagtgagccccacccaacactaagcagaaggacctgcactggctaaggctggagagggtcccagagaccctgcagtgagtgggcgtcctggctgggctgggctgggcctcacctggaacatcacaggagctgtgctggcccacaatgcctgtgtcgttctccttgtctgccggccacttgtagataaacatggacgtgtgtgaagaaccagcgtccaggacgatgccatactgcgggggagggggagggagtcagcctggggtgtccgggggccctgacaccctgacaccaaacgtgaagttgggttcctccagtttgccaccgctcccccccccacccagtcatgtgccaagcctcatgctgaagctcagaggaggccagggcctcctctgaggccgtggttggaaggagaacagggaggtggtggggaggtgactcttccctcctgactacctgaagccagcatgccagggtctgggcagcagccttcctggcaagggcagactgagggactgagtcagggacagagggacagagggtccccagggacttttccctggggcacaagtttcccaggctcagggagaggaagctcctctgcaagaggagctccctagagtccctcttccttcctcccctcttccttcctcctctgtctccttccagctcctctgacggcagcccaacctgaggatgcaggaggcagggccccaggtgaagaaggtccaccgaggctggccgtgggcctcagagccaggtcagctctaaagacactctccctaggcctccaagccagggccagagagagaggctggccctgccttgttgggggtgctgggtgggccttcctgcagacctgagtggcacgagcttgtaaatgcccttttccagctcctgccccagcatcctggatccacctggaaagctggggaccagcctcccaggcccgggcgccaattccagcctccgagagggccgcaccagtccatcccgaccaaggcttccccagagcccagagcatcaacaggtcagcgcgtgcaccgccacatggccgtcctgcagggccgcagagctccctgcttctgactccccatcaggctgggggacttggctctccaccccacccccctacaagcccaataaagggttaaaggggccgaccaggaggtccctgggcctgctggagtggagatccaggctagcctgctccaaccttttgaggaccggccagggctgctccggtcaagccctcctgtctttctgggccactctcgtgtcctggcgggggccctgggtcctggggcttgtggatccccatctgggctgaatacccagtcgatgtggctctaaccgcaccctccggggcggcggcacagggcagaagtggcccggagtgcccctgggggcccgcacaggcctgggggcgggcgtccggcagcacccagggggcatcgctgggctatcccgggagcggggacacagcccctgggctgcgttgacggactcggcggcgggcgcggaactcccgggacttgttccttcagcaccgcgtcgccctggaagcgccaccgccccccgccccctccgcgtacccggtcggggagcgcagagcgcggaacccgggaccccacccagcccgccaggagcagagcacggtgggggtcccgggctgatcctgctcaggttcccagccgcaccccctccccggctccaagcccggcccgctgctccccagacgtgcgctgggtgcccgggcgcgcaccttgagggcgggcggctcccggacgtcgcgggtggggacgcacagcagtaggaggccggcgaggcccgcggcggccagcagcagcggcggcagcagtgaccgcaccttcccggccatgggcgggcgggcgcgcgggaggacgatgcgtggacccggagagtgcggggagccggaggcggaggcgggcggggccgcgggaccgcggggtaggggccccggggcgggacgaggggcgggaggccgggcgggcccgcccatcaccggccacgcccacgggcggacaggtttcgcctccgctcccaagcttccgccgtccggcccgcgcaggtgagagacgcgggcgcggctgagtcaccagcaccgccccccggctcccgggtctgagcccgggcgccccgcggctatggcccaccttccccttcccgcccactcagcaaggggatcccccggccgtggaggcaggagacctggcgtgggggtgggcgggcgaggctggctcggagggtcctgtgctggagagccgcgcttttcccgggcccgggaaaggaggccagactcgcttgcaggaatgaggcactgtcggctgcggagccacgcggggcccgggctggggactcaggaggaagccgagggtcagcacctgtttgtggagcagggccctgagcgccaactcccagggctggtgaggaccaggctggcctgcgggatgccctcccggccagcaaggatccgccagcctgcggcgctgagccagcgcaggtcagctccagagacacgcagctgacccaggccagaactacccttgaggcccagtcagatccacctcacctgggccctgtactgaggtgaaggtgaggacgcaggaacggggaaggggagggacggcccaggtcacaccgagccgagaaacaggagaagcagcacagaccgggccaaaggtccatacctcccagcccagggcctcagccgcgcctgctgccccctcggcctgaggggaacagaggcttgggctgcggaggccagaggaggcttccccaggacggaaacaggtggggcctctacgtggcctgaaaggcaaggaagagggtccccaggccaagcttggggtgcgggtcagcaacaggcttctggggacggctggggcaggcgaagcgcagctggccccagacgcaagccctgctcctccgtcccacgacatggctggcctttcggctctgcagcctcacaggccccgcatcccagcccggccaggggccaccccctttgcgcctgctgcaaagtgggaattcttgtcccaataattccagccacacagcgtcagggagccacgaggcaaggccaccagggagtgcaggctgctggggcccaaagggcagccccatggggcagggtccagaccatgcccggccttctggaacgggcagtgacaattgtgctgggattgctgcctgggctgagggtctggcgccacaggcccagtaaaggcatctttcttccagctcaggaccccaaagggaggggtgggaaccctgggaagcctctctgctgcctcagcctcacagcccagcctggcggggctccagcaggcaatctctgggtgttgccggtgctaagctccaggccccaggccccagtttccccccacacaccccaggcctttcttccacccctgaccgcccagaggagggagaggcacgcacagtgcacatcatgcctgaaaaggaaggaacaaaggccgcccagaggcagggtgctgcgacccccactggcctgcggtaccccgcttccctccaggcccagcggggcttcctggtgttctggactcttttcatggacaaaaagctcaagccagggagtgggaggtctgccaggcctgagaggatggggagggagaggggagctggactctgccccggggagacaggctcatggccgagtgcccagcttcgcctgcggagggagaggcagggagcccagagcggccaggacaaaggctgaggctgagctctctttgagacggagtgagggcgggggaacgccccttcctggcatggactcagggaccctggaaggcagacttgggagagcgtcagagggaagctggcaggagctgaaggggtggaggggcctctgggtggggcagctctcggcttccaggaccctctcggggatggggcctccagatgtgctgcacatgaccccggctgagctgggaacatgcggatgcagagaggttaggggagaacccctgggggagggaactcggagcctcccgcccacgcagggctcagacctcccagggaggggggctttcctgaggcctgctgacatcttggctgccctgcctcagtctccacatcaga

SEQ ID NO: 48 - skipped

SEQ ID NO: 49 - DNA, 206739 bp, Homo sapiens
agtgaaaactttatgtgttgatatgtaatgctctacaagacatattaagtgaaaaaacacaatgtgccagaaaagtgcacatagctggctactatttactttttataaatatacatatttgctgtatatgcacaaatctctattaaaagttaaacaactgacaatgctggttgcctctaggtcatctgcctggatagggatcagcttcaggagactgtgtacttttgcataaaacttgagttttgaacactgtaaagtactgtctatttacacacacatttaaaaaactagtaaaaagcctgggtgtggtggctcatgcctgtaatcccagcactttgggaggctgaggcaggcagatcatgaggtcaagagatcaagaccatcctagccaacgtggtgaaatgctgtctctactaaaaacacaaaaattagttggcagtggtggcgcacacctgtagtcccagctactcaggaggctgaggcaggagtcacctgaacccgggaggtggatgttgcagtgacccgagatcgtgccactgcactccagcctgacaacagagtgagacaccatctcaaaacaaaaacagaaacaaaaagactagcaaaaaaaaaaaaaacaaaaaaaaacattaacccacagaaaaattctaattctatacaagagtaaataactatctttcaaagtttaaaatacagagcgacaagcttttctaggatagaatcatgtatctaaccaaactggacatatccagttataccttataaagttgaactaaatacaatatgtatacatacatttgcacacaccagaatttctagattctttttcttttttttttttttttttgagatggagtcttgctctatcacccaggctggcgtgcagtggtgcagtcttggctcactgcaacctccgcctcccaggttcaagtgattctcctgtctcagcctcccgagtagctgggactacaggcacgtgccaccacacccagctaatttttgtatttttagtagagatggggtttcaccatgttggccaggctggtctccaactcctgacctcaagtgctccacctgccacagcctccccaagtgctgggattacaggcgtgagccaccatgcccggccagaatttctagcttctgaggccatactgcacaattaggtagccattacctacatgtggttaattattaatattaaataaagtttaaaatttatttccttggttgcacaagccacaatatccaaatgctcaattaccatgtacagccagtggctactgtattggacagtaaaaaataccctttccattatctcagaaagttctcctggacagactttttctagtagaatcctcaaaaaattgtaattgggcaatttggaaaggggaatgaggtggttggggaagataggcaggagataggttttccacattagacagaacttagcctgtgccagataatgtccttaatatgactcatgctaattcaatccttgttgtacttcagtataaattggtttcctttgtaaacctatgcattttatgtaatacatgttaaaacattcttttttcttttttttttttgagacggagtttcactcttgttgcccaggctggatgcaatggcaccatctcggctcactgcaacctccacctcccaggttcaagcaattctcttgcctcagccttagctgggactacaggcacccatgaacacgctcggctaatttttgtatttttagtaaagataaggtttcaccattttggccaggctggtctcgaactcctgatctcaggtgattcgcccatctcagcctcccaaagtgctgggattacaagcatgaaccactgtgcctggcctgcattttaaaacactctaagataggggctataggctttaccaaattgctattttggaccatgagtatgtaactaagtcaaagaaaaaaaacaaaaaataaagaaaagctaaataccatgatgtataaaccaacatccaaaacagattttacaatccacaacatggtaacaaagtatacaagttcaaatgaaaaaaatttaaccctcctaatcccaccatccataaaccatctggcatattctttcagttagaattttacacttatttgtgtacctacgcatcagtatcaaccctaacatacaagttttactgaaggatggactttagttttggttgaatttgttcctctttttacacaagatagtaataaagcttgacactcaggtttgagttctctctcacttatgttaattatgagttctataaaaataacttgccttgctaaaaattaaaaaaaaattttatattcaagtgctattccttttgcggcaccaaaactttgtatgtaacacttaaggaactatgtgaccgtggtagaaagttaaaaatcacttgaaatatgaattcctcacctataaagtattcatttattcatcagaaaaagaactataagaaaaaatatacatttcacatatcaattaaaatatcaaactttcttgccttagttaatacttctgaccagattttgtgccaacataggcttactgccccataagaagtttcacggcaatactaatatgttgacatatatatgtagacatatatatcaaaattagttacaatatttttttctgtgctctgctcattacaatgacagtaatggagtgcaatgtcatcatctcggctcactgcaacctccacctcccaggttgaagcaattctcttgcttcagtctcccaagtagctaggactacaggcacccgtgaccacgcttggctaatttttgtatttttagtagagattacaatgacagtaatgagcagagcacagaaaaaaatattacaactaatttctgtatagcattttgtagtaacaagcttaaaatacaccaagaaacacgtatgtgtacattttagcttaaactttttcaaaacaactgttttaccctttgccagacttatcaccaaaattactaaaagtactaaggtagttaagtctagaataaatccaaaattcacaaacttttaaaaatgtactaaaacttttttcactagcaaaatattttaactgggaaatcatacgaactagcaaatgccagaaatcaaattagaaagggggagaaggttaagtgtccatccactttctttagaaatccacaaagttctcaattagttactaaaacacgattggtgtaattgcttggtttagtcctcaagattatatatttttgttatctaacattgtaatataacagggcctaaaaataaatgcccacacgttttattttatagctgtagcaaaacacatagtaagcttatcaaaacacatctccccttctgaagtcacccaagcaaagcacattacatgcctacttgaaagagtgcaacggttaagaatatacactctgcactttggctgctttaatttaaactccaccccaccacttaatagctgtgtgattttggagcaagttagtcacacaatgttacttcatctgtactgttaagaattaaatgagttagcctggcgcggtggctcacgcctgtaatcccagcactttgggaggctgaggtgggcggatcacgaggtcaggagttcgagaccagcctggccaatatggtgaaaccccatctctactataaatacaaaaattagccgggcgtggtggcacgtgcctgtagtcccagctactcaggaggctgaagcaggagaatcacttgaacccaggaggcggaggttgcagtgagccgagatcgcgccactgtactctagctgggacaacagtgagacgctgtctcaaaaaaaaaaaaaaaagaaataaatgagttaatatatgtaaagcattcagtgtggtacttaacatagaataagtgctatgtgtagcaattacaaataacgatctttctacattaaaaatagctgttacaaacaaggtatgtttataaggtttttttagttagttgcttacaactataaatccatatccttaattccatatccctataaatccaatgctggttagatttgtaatgattccacaaaaatttactgaatatagtgtgactaaacttcattttcctgttttttcttttttctttttttttttttttgagaaggagtttcagtcttgttgcccaggctggagtgcgatggcagacataggctcaccgcaacctccacctcccaggttcaaacgattcttctgcctcagcctcccaagaagctggggttacaggcatgtgccaccatacccagctaattttgtaattttgttaagtagagacagggtttctccatgctggtcaggctggtctcgaactcccgacctcaggtgatccgcccacctcagcctcccaaagtgtcgggattacaggcgtgagccaccacgcccggcccattttcctactgtttctatggaataatgtatcaaaagttccaactggggaaacaaaaaaaaaaaaaccccttatatttctgaccacattctcaggttccagaagtgcccagaaatgactattagtattttagacacacacacacacacgcaaaatcattttctttttctttttttttttggtgagatagggtctctttctgtcacccaggctggaatgcagtggtgtgatcacagctcactgcagctctgacctcccaggctcaggggatcctcccatttcagcctcctgaggctaggacacaggtgtgcaccaccatattcagctaattttttaattttttggagagacagggtctcgccatgttggccaggctggtctcaaactccgggctcaagtgatcctcctgcctttgtctcccaaagcctcggattacatgtgtgggccaccaagcccagcccctttctttttctggagacatgattagggacttttgaaggaacactagtgatttttatggtagggataggagtgggaagaacatcttaggattgtgaatcacaggctttgcatttcttgctaatggctaaggattgataattaaaaagcagcaatgtgaatttccaagaaaagagggaaaatagtatgtaaatgcatggatatacatgagtataaaacattcatggaatgtcaactttagtcccttacagttgacaaactgtcacctttgaatactgcatttaaaaattgaaatcaccgtaatatatcttattccgactttcagctgacttagaaatttcagtcttcaagatcactcagatattaagatgagactataacccatgctcatttccacttctcaaaaaagtctctatgactaagatggtgcaactcaccggtactaatagattaaggaaacttcttttgtttattttttttttttttgagacggagtctcgctctgtcacccaggttggagtgcagtggcacaatctcagctcactacaacctccgcctcccaggttcaagagcttctcctgcctcagcctcctgagtaccttgggattacaagcacgcatcaccacgcccagctaagttttgtatttttagtagaggtggggtttcaccatgttgatcaggctggtctcaaactactgacctggtgatctacccacctcggcctcccaaagtgctgggattacaggcatgagccaccgcacccggcccatattcttaactttatgtaaattaaacaatattttacttaaatgttttttgcctacagttttctgtccaaactagagtaagcttacataattcattttgcatattatccctctgcaacttctgtgtataaactgtgtgtctacattgaatttctctaagtctaataatcatgctcattaactcagattataaaatgaagtgtgaaatttgtttctgtttttttttttattctttttgatggagtcttgctctgtcgcccaggctgaagtacagtggtaccatctcggttcactgcaacctccacctccaggttcaagcgattctcctgccttggcctccccagtagctgggattacaggcgcctgccaccaggcctggctaatttttgtatttttagtagagacagggtttcaccattttggccaggctggtctcgaacacctgacctcaagtgatccccacccgcctcggcctcccaaagtgctgagattacaggcgtgagccaccgcactcagcaagtatatttttttcttttaattgaagaaatctggaatatgaaccccagagccaaatttacgtggattatcgaggaactctgatatagtgggttctttcattaagcaaaaagtccactaatttgcatagtctggttggcattcaattgttcattaatatgaattatatagtacaacaaatatttgtcaatatgtatataaaccttatttactcttattaataagctgtgtagtacagagcatgtttccaaagtataaaaaaggaagcattaaattagctgattgtccaagttgattcacttatgaaattagcgtggtttcaaaaaattcaagagctacaatgtaaaaacaagtaaaattatacactttcagttaagctaaagaaatcaaaattaatctcttacctcaaaaggaactacaagtcaaaaaaaaatttttttaattctaataatgaacgatgtagaatgaagataaagctacaaagaaacacgacctactggaggtaagatggccttgccattttcacagactaatattaaacctaattttgacccagccacaattcaaatgccgatagaataacatcagagtaccgtttgccctaacgttcaaatttttgccaaattatccgttaagaggtaaaatgtttcccttaattttccctttcaagcttctcaacaaatttaatatttgtgggccacatcttcatgtaactcaactcatacaaagagaaaaccacacaataatatcaaactgaaaatgatattttatgtaatgtccatagacaaaaatcatccagatacctatgcatgatgggataagcaggaaaagcccatggctctttttaagtgtttatgattatgcacagcagaaaaccattatggaagctcacaaactagctgaagtaagaaaaaacatgatttttgcagccttcagcaggggtatctcaagtacaatccaattctaatcagttgcttcaaaaaaaaatccaggcgaggctcggtggctcacgcctgtaacccaacatattgagaggccaaggtgggaggaccacttgagtccaggagtttgagaccagcctgggtaaccatcgcgagattccatctctacaaaaagtttaaaaattatccgggcgtggtggcctgctcctgtagtgcttgctacaccagaggctgagatggaagcatctcttgagcccaggagtttgaggctgcagtgagctatgatcgcgccactgcactccagccccagcaacagagcaagatcctgcacccctacacacaaaatccaactatttaaaactgtcaaaaataattccacataactagcctgtgcacaagggtatattaaaagtactaaaaattttcaggccaggcgcggtggctcatgcctgtaatcccaccactttgggaggccaagacgggcggatcacctgaggtcgggagttgaagaccagcctgaccaacatggagaaaccccatctctactaaaagtacaaaattagccgggcgtggtggcacatgcctgtaatcccagctactcggaaggctgaggcaggagaatcgattgaacccaggaggcggaggttgcggtgagccaagatcgcgccattgcactccagcctgggcaacaagagtgaaagtcagtatcgaaaaaaaaaaaattcatttctcactaaaactaaacacttcgatactattttacatatattctcaaaatactttagtttccagcttcacacactttgtttttaggttcccctactccccaaatttaaacataacatccaaatctcccaaagtctgtaccagaacaaatactgtatcactaaccacatccctaggaattaagttccttaagggtttacattcaacaagactcacatcttgtataactttgtatcctaaagaacacttggtacaacaccctggatatatcaggagctattaatatttactaactcaaaatatagtccttcatcactttgcagttccgctctgtgctgctgaaacaaaactgcataaactctgcaaaactcaagggacctaaatgtgacagaaacctcacagaactccttattgttttatagtttacagtctcgtagccttgcccctattaccagatgtaatgctttttactgacactagtgtagtggggtaggaacagatctagacaaaagtggacatcagaacctgtcaaggggtttaaaatgtatattttacatacttattcttcattagtgttatgtaatattaatgtcctaaagtcagttaactgtagcaacaacttatgagtttttcagtcaatttaattcccaggaacataaatgaaaactggtgccaataaaaaaacaagtaagcaagcagagaagctgccttgaattttgacaaggtaaggatagtttacaccaacgcaatgaaaaataagcctttgtgtagtctataagagtttttgaaatagttttataaaagtctttaaaagtgccgggtgctgtggctcacgcctgtaatcccagcactttgggaggctgaggcgggaggatcacttgaggtcaggagtttcagaccagcctggccaacatggtggaaccccgtctctactaaaaatacaaaaattagccaggcacggttgtgcgcacctgtaatcccagctactcaagaggctgaagcaggagaatcgcttgaacccggaggcggaggttgcagtgagccgagatcacgccactgcactccagcctgggcgacaaagcaagactccatctcaaaaaaaaaaaaaaaaaaaaaaaaaaaaaaaagtctttaaaagtcaaagcaaactggtaaaccattagcaaaaccacaagctaccatgaaaagatacacaaaagtatctggcaaccaaggtctagagctggttccagagtgtgaaaggttttctgattgctaataaaccccattatgcacacaagatatcttcacttagctgtgtcgtttctaaaaaggcaacagggcccagaagtttcagtgagccagtcctggcaaacccaaattatgaaaaatataccctctgcttaaagattaactacaaacctaccctgggaccagcttgcttcagttaagtttaaaatggtgcctaaattgaaatgaaagtctgtagcatagataaagagaaaaaaaaagtcaaatggaaaagtaaatttaaaagtttctatttccaataaactgcgtctcagaaatcttccaggagataaagactcggaagaacagagggattgagacccattcgcattctctgaggcgtgcgcactacgcggaaaggatgaatgaatggaagacgggcgcgtgtgaaatgcagcaggtccggccggcaagccgaccggctacagcgatctgtaggcctcgctcctcccccttccctcctccatgacagcccagtcccaagcatggaggggcgaggacaatgtgataccccttctcaccaccaccatccctcattctacttggagagcttcaccgtgacacacgagtgttccttcccaccccagacctttctcgcttcccctggcgcaaacaccggcaactctccggcgcgctggattaacagacgctcgcccctctcaactcccctaagcgaggtcgaagctcctccgcgcgtgccgcggcaccactcccgcctaacccaccctccggcaacactcgcccaccagctccccagtccaccggtctaaggaagacgtgcgcgcgccccgcacccgagccccggagctggggttctgcagggagggaaaggctgctccagggctccctcctccatctcactccaggccggctcgccgcccaccctgcctgcggatcccagtactcgctgggagccggccctgcgccttcctatcatgaagacaccatcctcgcatacccagcccagaaccccagctaccctccaccctgtagacacctcgcggttccgcaggaggcgccacgccgcccctcccccacaccgctcccccagttctcgggcccccaccagaaagtgtgcgctacacgccgcctcggccatcctccgggacgtccccacttgtccgcgggaggtcaggtccaacatgaaggggaaggggcggcaaggggtacagtgcgcgccgggaacgccgtcccgcggagtcccccagtcagaaggaagacggagcgcggggacccgtgggggtgggggccaaaggcaatactcaccggttcgacagtcgccatcttagatcgatctgatcgcacaaccgctccagaagggggggtaagaggaaaaaaatgagattcaaaccggattggccagcttctggccacgtgacggatatgtccgtttggccctggcggcacctgcgcaagactgcggctgcgtgagtaacgagaggcttctgggaagtggagtctctcccccaccttttttttttttttttttttaaggtaaagaaattttttttaaaaaggactggtcacgtggccgatgggtagggtgcgcggttctcaacgcggcggacactcgcttgctggagggtggtttcagtcctctgctcttccgcctggatagctgcggtcacacttactgccaggcaagcctactgtgccctttgtcgccctgtcctcccatcttccccggaaggttgggaactgcaggctcagcacacacaataaggcttcatttgcttagttgaggtcccaggacaagttgcctgtgtgtttatttagttttcttttgatctcccaccattttctcttagtttcaaaaagaggcggcgatgcagagtcgtttaggcaatcaaccctcccacgtcccctggctcagctaatgctggtggtcattcgttgccatttctgcgaaaggggacggacggaaccgcccgcagtacccgcttgccaccggctggacgagggggagggacgacagcttttactgtcccaaatcctgagattaagacctcagggctaaatcttgcgtggcggtaaaaattatttggaagttctgtgcaaccgttccaatattccgcttttacgtgcacggaaatagcctaagtccagatgccagccagggaagccactccgggccccgctgactaagccctggactgatggtctggagtctttaggccgggtcaactatgactcttgacgttgactcattctccttaggcgagtgacttaatcgctcggcgtctcagcttttttatttatgaaccaaaggtgatgatacacttacctcacaagggtgtgcttcgtaatgactgtaaccggctttgaaaatgcatcggactctagaaatgattcataataagcaactgcgtgccttcctaaagatcaagtgcttctgctttttttttttagcaaagtttaaatttttttctgtttactttgtttgattatgatgtacaccagtgtagttttaaatgttcaggaccattttttttcctttacaactgcagctgccctcaatagaggctttaatgttcatgaaattattgttatgctcacaacaatcactggcaatcagaaatttgtccccacactggcatcctacatttcctttccctctaagatactgtgctgtcatttctcaagaccgtgttttttgcacagtttggctactaataacaacaaatagagatgaagaaatctagtagactcctaaggttctaatgaagaagacactgtctcattactatttcccatgcttttaaataatgttgacaccaggaaaaggagtgtatgcaggctgcctgtgcctgtctgcttatagtgttaatgaggtccagagctgtgtcatacctattattgagtacataatggatgcttgagttgactaacacataattgaggctgtatgagaactcaaagccattgcctgttcatatgttttggtttacctgaatatcagaagtgattaatgaaagcttttgtctagtgggcttagctctactaggttttaaagtagatagaattaacaggccaggcgcagtggcccacgcctgtaatcacagccctttgggaggccaaggcgggcggatcacctgaggtcaggagttcgagaccagcctgaccaacatggtgaaaccctgtctctactaaaaatacaaaaattagccaggcatagtggcacctgcctgtagtctcagctactcaggaggctgaggcaggagaatcacttgaacctgggaggtggaggttgcagtgagccaagatcccgccactgcactccagtctgggcgacacagtgagactccatttccaaaaaaaaaaaaaaaatgataataaacggataagtggatttctacttacagagactatctactgttacttagactatccaaaataattctgttgaccgcgttgttattttctgctggttagaagtggtgtcaggttaccttctttgaagagaaaaagacagcatagatgtcctattttccccttccccacccttccccacccttcctctcccttccctacccttcccctcccttcccttcccttctcttcccctcccctcccctgtcctcccctcccctccctcccctcccctcccattctctctctctctctctcttccttccttccttccttccttccttccttccttcctttctttttgtcttttcagggtgttgctctgttacccaggctggagtgcagtggcatgattatggctcactgcagccttgaccttctgggttcaaggggtcctcccaccttagcttcccaagtagctaggactacaggcatgggccaccatgcctagctaatttttttatattttgcagagacaggagcgtctagctatgttccccaggctggtctcaaactcctgggctcaagcggtccccctacctgggcctcccaaagtgctgagattgcaggcatgagccaccattcctggccagatgtcctattttcatgaagctgttatataacagcaaaaaatcaatgagattggcaagaaaatacctataggactgaaagccagtgatgttcttaaaactttttttaaacaacagtttccatttttattaaattttctgttaatcaaaaaactcgggccgggcacggtggctcatgcctgtaatcccagcactttgggaggccaagacgggcggatcacgaggtcaggagatcgagaccatcctggctaacacggtgaaaccccgtctctactaaaaatacaaaaattagctgggcatggtggcaggcgcctgtagtcccagctacgcggcaggctgaggcaggagaaaggagtgaacccaggaggtggagcttgcagtgagcggacatcgcgccactgcactccctcagtctcaaaaaaaaaaaaaaaaaaaaaactccctcttgtcaaccaagactcatacttttacaatacttatggatgctctattctttatggtttagtttctttccattttttacatagttttcaacaatttttctttataattttcaagcacagagtttcaggaaaatctccatttttgtatatactttgttgtgtgtgttttatgaccattaatgtgtctttgcctatttgagattctaccatttcaaagatttaacgattaggtttttatgtatgtgtgtatgtggttgttttgttttgtttttgccaatcctaaatatatagagctgaaattttatgttttatttctctatttattctctattattctttattgctcttcaaaggacttgtaattccaagttcatttacagaactgaccagaaaccatccaacaagtactaagttagtaatgggaactatgtaaccagtggaggatatttaaaggacacaggaagtacaggcacttccttccccgactgtaaaatctggttggcgtactaagtcatagaaatataaatagttcagtacccatataaagaggtgtgactaagaaccaagaggatgcagttaacaagcaccataaccagcacacattcacataatgaatgagcgaatcatatacttccttccctcatttcatccaggcctctgttccaatgtgatctcctgaaggaaggcttccttgaccaccctatctaaattactgtttccattactctttatcccctcactctgctttggttttctttaggccacttcataaccctaactctaaacttgctgttaaacattatttaattagttgttgattgaccctactactaaaatattagctcattgatgatttgtagatagattgctatcaaatatttggggaaaactcaaatgtaatttttttttcccgagatgcagtctcactctgttgcccagatcttggctcactgcaacctctgcttcctgggttcaagcgatcctcctgcctcagcctcccaaatagctgggactacaggtgcgtgccaccacacctggctaacttttgtatttttagtagagatggccagcctggtctcgaactcctgacttcgtgatctgcccgcctcggcctgccaaagtgctgggattacaggcctgagccactgtgaacccttattttaattttacagtttgagagacaccaattcccattacctactcaggacattgcttaaaaacatgggatgtacgcaaacatgaccaaggaattttgaatattaaaagattggagcagaattggaatttaaaaaattattttattattctagttagttttttgtttactctctccttggtgatttttatgagactgaggcactacctactggctaaaaaggcaccttgatttttaaaagaaaatcaagaaaaagaaaaagaaaaaaattttttaagggaaacctcttctgctattctaatatatccgtgtgccaacattttatgcttttacaattatagggtgcaaagagtttttgtttgtttgtttagagacagggtattcctatactactaggctggagtgcagtggcacaatcctggcttactgcagcctctaactctggggctcaagcgatcctcccacctcagcctcctgaacgatggctaagactacaaacatgtgccaccatgcccagctcatttttttattttttgtagagaaaagatcttgttatgttgcccaggctagtctcgaactcctgggctcaagtgatcctctggctttggcctcctaaaactctgagattatatgtatgagtcacccccagcctgcacaaacaattttgaattctacatttttttccacatgacatcttattgcaaacattttggacattgcctatagatgggataacagtttttaaactttttttttttggaaaaattttaaacttacagaatacttgtaatagtaactcttcttctaagcccttctaaattcaccaattattaatttgttgcattgcctctcttaatctcattacttctgaaccatttgagaggaagttgcaggcatgatgatcctttacctctaaatacttcagcatgttcctcctatgaataaagacgttttcttacagcaccgtaatacaaataatgaaatcatgaaatataatagtagttttatctaaaataaaaaccataaaatcaatattcgtattttgccagtttcttcactcattttgacagaaatactacaaaaataatattgtattcttcctggtgcatcacatcatcggtaacattagtggcttcagaatattctgctgagtggatatatcacagttcccttaatcagttccaaatggttacatattcaggtaatttccagtcttatattattataatgttctaatgcatacatttatgagaaatgtgttttcctatttagatgatttcctcaggacaatttttcatcaatagaattagtttataggatacatagttttgactgtttatacataatggaattcatgttgctctccaaaagtgtggtatcggcatgagatgtcacagccaacttatcagtgttgggtgttaaaggaattaaaagaatgtatcgttaatgattcttgttgctagtttcaatatttacttattcacagcctttacctttgttccattacctgttattttggaaatgttgaaatctacaaaaaatttgaaacaatacaacaaacacttataaacccttcacctagattctctagttgttaatctttgaatcaataaggattgataagggctgggcgtggtggctcacacctgtaatcccaacactttgcgaggccgaggagggtgtatcacttgagctcaggagttttgagactagccggccaacatggagaaacctcatctctactaaaaatgcaaaaattagccaagcatggtggcgtgcacctgtagtcccagctattcaggagactgaggcaggagaatcacttaaacccaggaggcggagcttgcagtgagctgagatcgtgccactgcactccagcctgggcgacagagtgagtctgtctcaaaacaaacaaacaaataaggactgataagaatactgatgtaattttgaaaagtatgtagtagccaaggggcctgtcacatatggaagagttatggaaatggttaatggaacatggagtctctaggtgcaatatagatgggcagccaagaagggtattattcaatttacactacgaaaaaaaaataaataagtaaaaattagggccaggtgaagtgactcatgcctgtaatcccagcacttgtgggaggccaaggcaggaggattgcctgagcccaccaacctgggcaacaccgtaagccccagcctctaaaaaaaaataaacataaaaataaatgatggatgataaggaggccataggcagttgtaccaataaaacatcaaaatctcctgccaagttcctggacctgagccaatttttagacccaaaatccattgactgaagaagttaggtgcgagggagaaaggaaccgtggcaagcaatggggttaatgattccccagttcttcccccaaaatgatctatggctgtttacttgtgcaactgtatgctttgtaaaggggaacacccaagcagttctaatactgccggactcaggtttgacttgacattgatacccagagcctgaagtactatcctagccttcctgtttaagtgaggatatacggggttcaggtaatacatgaaaagcaaataaaaatggaaggtccaaaattccttaaatgtcttttaagcaacattaataggagactattatatacagttgacccttgaacaacacgtgtttgaactttgtgggtacatttacacatggactttttaaatataaatatactgcaaatatttttggagatttaggacaatttgaaaaatctcacaaactgcatagcctagaaatattgaaaaaattaagaaaaaggtatgtcacgaatgcataaaatatatgtgttaatagatagagtatgttattggtaaggcttctggtcaacagtaggttatgaatagttaagttttgggggagtcaaaagttatatgtgaattttcagctgggcatctcatacctataatcccagcactgtgggagaccaaggcgggtggatcacttgaggccaggagttcaagaccagcctggccagcatggcgaaaccctgtctttactaaaaatacattagctgggcatggtgtcgtggacccgtaatcccggctacttgggagcctgaggcacgagaatcgcttgaacccgggaggcggaggttgcagtgagctgagatcatgccagtgcactccagcctgagcaacagagcaagacactgtctcaaaaaaaaagtgttttaacatttaaaaaaattaaataaaaaagttatatgtgaattttcaactgcgtggggggctgaacacccctaattcacacattgtttaagggtcaactactgggaaaccaacagatgtgtcttctgtaatgaaaaccacacagaatctgtagaatgtagtggtcaacgattttgtagatttgaaatgaagagggaatagctgttttactctctgggagaagactatctgtaagagacttccaggctaatgaaattggtaaggtactggccaggcatggtggctcacgcctgtaatcccaacactttgggaggccgaggcgggcagatcacgaggtcaagagatcgagactgtaagatacaatgaatttctttgaacttctcttcaaaggtttagcctgctaacttccttgtcctttgttctcaaactcagttttcctgttcctccttgcccctagttactgtaaaacagcctacccccttcctgtcagctctaatcaataactcacatcttttcccttggttacctgcagccattgttcccccgaaactgcacgtctcaaacagtctcacatgctttaccactgtacctcacgtccccctgcccttccatatttagaaaaatatttgcaagtagccaatcgggtcagctcagattgtgcggtccgaccccagcccatcggggagggacaaagaggtagggattgcattaaggatataaaaaaaccctgatgtcctttattctctgtgctcttgcgatctcgattgacacaagtggcacccttcttccgaagtaaattgccctgctgagacaacttttgcctgagtgctggtttcactttgtggcaccgagcatttatttccagaacatttttttatccaacaagaccattctggccaacatggtgaaaccctgtttctactaaaaatacaaaaattagctgggcttggtggtgtgcacctatagtccgagctacttgggaggctgaggcaggagaatcgcttgaacccaggaggcggaggttgcagtaggctgagatagcgtcactgcactccagcctggcaacagagcgagactcgcctcaaaagagaaggaaggaaggaaggaaggaaggaaggaaaagaaattggtgaaattggtactgacatgaaattacaaagtgcattttagtctaaataaataagaaagaaaaataaggtatcagaggaatctgagacaagagaaagttggctggagatagttaaaatatttctaaggcccagtctcttgagatagacctgtagccaataatttacataataataacaaaaatgacaagggagtgagtaaacaagtagttcacagagctaaaagcaaggcatgatgcaaggtgtgaatggaattagtaagtaaaatgtgttgcctgggtatgtagaatttgatatttgttttaacaaatttaaaaactgtcagctgctactttaagtggagacagaatttccctttagcacatttttattctgagaagaatcacagtagtggctgcttttagttatgtaaatgtatgggcaaaagcataattgcaaactagggctgctggtagactgctccacttctctaattctctcttcagcagccaagtagcttggtattaggatagtcctcttggactagtaagtttctaggctttttaattaattcagagggaaatgcgacaacagaaactacttccccaataatgagtggaaagtaccaaaattaaataaatataactgaggtgtaattttagggaagaacaattggattgtgatttcaaccaaggaatgtaaaactatgtggttgcaatatattctgcctgaactaaaaaagtgctttagcagaggaaaggaaattggtagtagtctccctgtcatgttgaaaaggaaagtccagaaagatttggctgtgtgttgcctgcactactcggggccctagaatacaaatatggtagctgactcatggggtaagtatctccctatgtcagactaggaaagttagtgacacttatcattattgaataggttataaaactcaagaacaggacaggtgtggtggttcatgcctgtaatctcagcactctggcaggccaagggaggaagatgacttgagcccaggggtttgatactagcctgggcaacataattttaaaaaataaattaatttttaacaataaaataaataaaatacataacctcaaggacaaccttataaaattaatcctgataattgctcctagatgaatgctgatgaaggtaagtgaattctaaaaacagtactaatctcccttctacctcaccaaatatgtttcttttcctgaattctttatcctggttaattataaaatcatcttccagtcactcctttcctaaaatcttgtcatcatctctccaatgatggtcactctttcatcctccacatccagtaaatcagcaaggtttagcaattattattattattatttttcaagacggagtctccctctgttgcccaggctggagtgcagtggctcaatcttggctcactgcaacctccgcctcttgggttaaagtggttattgtgcctcagcctccctaatagctaggactacaggcgcgccccaccatgccggctaatttttgtatttttattagagacagggtttcaccatgttgcccaggatggtcttgaactcctgacctcgaatgatccacctgcttcagcctcccaaagtgctgggattacagatgtgagccaccatgcctggccatatttttatgttctcaagtattccctctcctcttcattctcactgtcttagtgtagtggacatctatatatctatagttcagctttctttttgtaatacttgcaattctgatcttttggggacctattccttctcactctaaccatgtggttctactgggacttgcctcatggttccccttacaccattattggaggcacatgacctgggtggaaaattagaaggagtcataactgaaagggtgaatgcagacacttcactttatacaagtcaaggttatcgtagtggtcatggtggatgacttctcaacaagagtctctcacaatgattagtctaagtcagaagtcaccatactgtggacatttagggtcagataattcttagttgtggaagttgttttatgtattgtgagatgtttagcagtatccctggcttctatcctttagatgccagtgcaccctttctctaaggtgtgacaactaaaaatactccagatattgccaagtgactcctagacagtgaaatcatctcaggttgagaactactggcctaaactatttgtggcaatcctattgcttatttcattggtctccaaaaacaggccaatgtaaggtgtaaaagttttgtccactagagggcttctgggaaggtttccacaatcctgagaaagtcgactggaattaagagcattttcttgagagaagttgtttttatgtgaatacttaaactggctgcagtcaacatggagggggaaatggagaaataaggaatgtaaagtaggagatagaataaattttactccttaactgttgagccgatgacttctctgcatgagcctaaaacaatcttatctctgtactaccacttatttttgagtatatatgtatgtactaaaaaaaaaaaaaaaacagctcaaatgggagtgtactgtacatgctttgtgttacttctttttacatatttgtaggtgatgctttcatataagtatatagaaagctgcctaattcttttcattgactgcaaattatttcatttcatagataaggaataattcatctaaccagtatcttggagtcttttatgtgtgtttttttttaaaaaaaaaacaaaaacaaaaacattttttctaatgcaaagaatggttccataactttccattatacacaagtcattggaatagacttgagaagaggaattattaagacggacgccatggctcatgcctgtaatcctgacactttaggagcccgaggaagtggatcacttgagctcaggagtttgagaccagcctggcctacgtggtgaaaccccgtctctactaaaaacacaagaaaattagctgggcgtgatggcacacacctgtaatcccagctactcaggaggctgaggcaggagaatcacttgaacccaggaggaggagattgcagtgagccaagatcatgccactgcactccagcctgggtgacagagtgagactctgtctcaaaaaaaaaaaaaaagacaaattattaggtgtgcatgtgtgattttcatagatattataaaatatcctgggaagagattgaattaacattctcattatcaacatatggtagcctcatactctgattaataaattatcaaactttgagacgtagtctcgctctgccacccaggctgcagtgcagtggcgcgatttcggctcactgcaaccttcacctcccgggttcaagcgattctcctgtctcagcctcccaagtagctgggattataggcatgggccgccatgcccggctaatttttgtatttttagtagagatggggtttcactatgttggccaggctggtttccaactgacctcaggcgatctgcctgcctcagcctcccaaagtgctgagattacaggcttgagccgctgcacccagccagttatcaaactttttgtgctttggtaatttcatgaaatactatatgcaatgtaatttcagtttatataataaaacttgtcagaatgaaaatggaatcatttgtgtaaaaccctggcaaatggaaggccttgaaaggagggttgtcacgcatgtatgcctaataacaagaactatcacaaaagatagcaaaaaacatgaccttacacagaggctacttcaacctcatacaaaaaatacttctgtgaaaaataaaaatacttctgtgagcacatgtgctgagcaactgcctgtccaaccttggactgacaccatcctcgttattggtctctgtaggcaaagataattgtttcaaaatagttatgtaatccccctcatttttcactgaaaaacccttttacctcccagaacatgctccctgtattcccattgcaaggctcaatccccaaaactatcattttcttttatagagtctctctctgcctgttatttaggttgacataatctggtgtcaagaagtgggaccaaagtgagctcaccttgatggatcggtgactcctggaatcacatgaagttcccacattgagcccctttgagctctccaatcctacagctcaccttttctgtcatggtgaatctcctctcaggttcttgaactccctcattttggtgagttcttttgactttctttgggatttgttttggataatggctgccttaataaaggaccttgtatctctcttgagactagaaaatacattttttctgacaaatcctttctggtacaaagatattttatctttctggagagtatacacttctgatttctataaaatttacctcatgtattttctggtgagttcttttttttttctttttgcatgccttcgcagccattatacaattcagtgagtcctagctgaaatgtaaaaacacctgagaaactaaccactaaatttgaggctttaaaaaaaaaaggtaagagagtttttttctttttaccaactgctatagggatgtaactcagatccaaccagtgaatttatgttactatattttacagtctcatgaatacatataaaagtgaaagctataagatctttgttaacatatgtgtttatgtatgttatatgttgtgtatacatggcaaaatctggcataattgaccagaaatcccttaaggaagcctatttagattggcttagagagaaatgggtactcatgtaaaattatatctaaaactgttgaaatatatagtaattaacccaaatgcctttttgtttatgtgacttaagtgaatctttgataaataagctggttttaaatttatcagtaaaatagaaatgtttttagaattgtcagcatacattcttgcctgcacttattgttcagacaatttttatatttgttctagctgttttaaagtgtcaggattcgacacacaggtcataaaactataattccagccttaaaagcaaaatgatctttgatggttaatactgagtgccaatttgattggattgaaggatacaaagtattgatcctgggtgtgtctgtgagggtgttgccaaaagaggttaacatttgagtcagtgggcttagggaaggcagatccacccttaatctgctgggcaccatctaatcagctgcagctaatataaagcaggcagaaaaacatgaaaaggagagactggcctagcttcccagcctacgtctttctctcatgctggatgcttcttgtccttgaacattggactccaggttcttcagttttgagacctggactgggtttccttgctcctcaagtttgcagacagcctattgttggaccttgtgatcatgtaagttaatacttaataaactcccctatatatctataaacatatatatatatgtatgtatgttacgtatgtatgtatgtatgtatgtatcctattactctgtccctctagggaaccctgactgatacagtttatgtcactttttttttttttgagatggagttttgctcttgtccaggctggagtgcaatggcacgatctctgctcactgcaacctttgtctcccaggttcaagtgattctcctgcctcagcttcctgagtaactgggattacaggcaagcgccaccatgcctggctaattttgtatttttagtagagacagggtttcaccatgttgatcggactggtctcgaactcccaacctcaggtaatcttcccacctcagcctcccaaagtgctgggattacaggcatgagccaccacacccggcctacttttttttttttttaaggcaggatcttgctctgtttcccagtctggagtgcagtgacacgatcatgactcactgcagcctcaacctctcagactcaagcaatcctctcacctcagcctcccaaatagatgggactttttttttctttttaatttttttatagagatagggtttcactatgttgcccaggctactctcaacctcctgggctcaagtgatcctcccaccttagcctcccaaagtgtcaggattacaggcatgaaccatcctgcccagcctatttttgtgcaactttttgatgaataagactagtttaatattgttactttagtgaaaacagctgtatcttctaagtaatcaataaaatatccatgtactttaaggttcttaatgtgaacatctaacattcacatgctgtaaaaatggctaacagaaaggtaacttgaaataatgattagctctgtgtaatatctgttttcataagtaatctaggtataatggttaaaaaataaattaggtaaatgaaaagggaataagtatgtataaatgaacttttcatatgatttgagatcttaaagttatgttaaataagtaatagttattcattaaatgtctgggtcatagccaaataagataaaatatgaaaacattaattactgaacatagattcaaattaatttacttttggctttttttttttcttttttgagacaaagtttcactcttgtcccccaggctggagtgcaatggcacaatctcggctcactgcaacctcccccttacaggttcaagcaattctgcctcagcctcccaagaagctgggattacaggcgcctgccaccacacccagctaatttttgtatttttagtagacagggtttcaccatgttggccaggctggtctcgaactcctgacctcaggtgatctgcccgccttggcctcccaaagtgctgagattacaggcatgagcaccatgcccggccttcttttttttttttttaggcagggtctcactctcacccaggctggaatgcatgatcacagctcactgcaacctctacctcccaggcttgagcagatcctcccagcttagcctccccagtagctaggtctacaggtgtgaaccaccatgcccagctaattttttgattttttttttttttttttttttttttgagccagagttgcgctcttgttacctgggctggagtgtaatggcgcaatctcagctaactgcattcttcgcctcccaggttcaagcgattctcctgcctcagcctcccgagattctcctgcctcagcctcccgagtagctggaattacaggcatgcgccaccatgcccagcctttgattttttttttttaagagatggggtctctgtatgttgcccaggcttgtcttgaactcctgggctcaagcggtcctctcacctcagcctccccaagtgctaggattacaggcaggagacaccacacctggcctacttttggcttcttaagttttaaagaaagagaaaagctatttgggcttattaataaatacgttctgtttcacattggaaaattgttctatgagaaagcacatgtttctagagattatgaaatacatattcataggaggttgatgtatgtcagatagttcagagtttgcttgcttcctgggctttcactagaaattagggttactgagagttaaaaattctaattaatgtatgtgattctgcatgcaagatatataagaaattgtgtttttgatgagaaaaactttgaagatgagaatttttttaaagaaaagaatagttttgtctaaattcagaggttatttaaggttattttaaaagtaaatttagaaagaagatagcagcaagacagaaaggaaccagtaggaagaagagaggcttgcatagaaagttataggtatgaagatgtatttttggaaagggaggttaaaaagagaagaggtttttttttttggtatgagagagaatctcaagtggtcaaaatcaaaagaaaaaaagtaaattgtgtcctaaagtaaaatgactggttgttaaagaaagagcaactataaataggacaaaaccaaaagtctgggcaggtcacagacagtctgagctagttgtaaaaggtttgtgaaagatgactcttacgaaagaaattttgtgtgtgataaagttggctaaaattacacttggttttagccaaaaggctgagaagcgatgaagttggctaaaattagaagagaattatttataaatatttctaaagatttagatttaattatatgtataattaaataaaaacagctacatatgtatacatatatataaatatgttatggatacaaaactaaaattttagttccctatgttagaagcactttttttggagtgttgatctgctcttcataaaatttgtaagaggttttgatttctaaaatcgattctgaaatctgtttaagtttttaaccatcttctgaactaagcttttttctgttttatagtctccatttaatttccataattccaggttaaaaatgctatcttcttcattgcgaatagtaatttattttctcaaaatagagttttcctttggaagcttttcggattcatatctcagaagttcaaattttgctgcatctcactgcatgtgatttgcaggtcaggcatgattaccttctgcttctcctctttttctccttgagaaggtactctttttgtttggctggggtgatgactcttgccttcagcctttttgtcagctcttgtaacttttttctccagtcctaactctgctgttgtgacctgacaccgaatatctttgtcttgaaggcctaggagagcaatgctttcctccaatataactagattctgtactcttggcttttcttgatgtgtctggattgttccatgtaaccaggcaatttcacatgcttctgctttttctaagagccatatattctccctgctcaagggactggttttcttgtttacttctatgacacagtgtacactcataaccttggacatacactcttccagtgtctgattgaattcaagtacctttatatcaaatctgacttccaggttatctgaatgtgcttcccataaagaaaagcaatcacaatgcaggaggtttttcttttcactttggtaattggcctaggaaacaaagatttggtgttttatcaagataattcctgcgtatcatattgtttttattaggttttttattatgtaggaaaactgagctttaaaagagttaaagcttctttatttgttttgttttcttttgtttttgtttctattttgcatctatataatattctgtatttgcttttgaaatattttaattaccattctagttaagtgaatgactattatttcacaatgacatgtgatcccattttgatcagatgttttaaaccttttgacatctttggcaggcttcctcgtatcaaagctctaaattaagttttcttgacctacaattaactttgagattttccacttggacctgtggagagcctccaataatgtacttctcatctggtagaaatgttaataattaggcttattagatgtattaaattgtttgggaagcattgtcaaataaatgatgttaaatctttgttaaagttatatttatacgaatataatattgatattctatatattaacactgtgactgttctgaagattatgtaaaatttctgaaagtctgatgatcctgatgtgttgctgtcagtcatgattctggttgttatattaaaatgatatatgaaattttcatatctgaatataactgaatttccttgtcaattgctaaactttcatcagatttctccccatggttattcagagtctctgtcatccacaattttgatttttcactaaaagcatctgcattcagcttgggtatggtggctcatgcctgtaatgccagcactttgggaggctgagacaggaggatcacttgcgactataggttcaagatcggcctgagcaacacggcaagaccctgtctctatttaaaataaaataaaataaataaaaaataagagcatctgcaatcagattcatggaaagactctagcaaatgctcttgaatacaggtttctgataactttaaaatcaatggctctagtaaaaatttacagaattgtaatgaagaaactgatgagttcatgaaactgttaatcaagaccaagtaaaacaaaaattaattacatgagattgtataactgaaaaggataatgtttttataacttttatttgaaacattgttggctctttacttaaatgttttgttttccagatttaaggaaaccttttctcataactagctatagtttatggaaatttgataatgcatacttttgtaataaaattggaagaatctactttttcttcctacttgattcctccaaaattccgaaactatttgtattttagtttaaatttttttaaatcaatagttttggccaggcgtggtggttcactcctataatcccagcactttgggaggccaaagcgagtgcatcacctgaggtcaggagttccagaccagcctggccaacatggtgaaaccccatctctactaaaaaaaatacaaaaattagctaggcgtggtggtgggcctctgtaatccccgctactcgggaggctgaggcaggagaatcgcttgaaccgggaggcagaggttgcagggagctgagattgcgccattgcactccagcctgggcgacaagagtgaaactctgtctcaaaaaataaataaataaacaaataaatgatagataaataaaatagtttgcataagttcaataagatctgctctctttataacaggatacaattgaaaatgttggctttactagcaagattttgactgggatgttatatttaaataatttaggccgggcacggtggctcatgcttgtaatcccagcactttgagaagccaaagcaggtggatcacgaggtcaggagtttgaaaccagcctcgccaacatggtgaaaccccatctctactaaaaatacaaaaattatccgagtgtggtggcccgcgcctgtaatcccagctacttgggaggctgaggcaggagaatcgcttgaacccaggaggcagaggttgtagtgagccgagatggcaccactgcactccagcctgggtgacagagtgagaatgtgtctcaaaaaaaaaaaaatcatttataggtactgcaggcaaaatctgaagtctcttttggtttggcttcccagcctcaagtggtttttaaatatgagatttccaccaggcgcagtggctcgtgtctataatcctagcactttgggaggctgaggtgggcggatcactggagaccaggagtctggggccagcctggacaacatggtgaaacctatctctacaaaaatgcaaaaattagccgggcatggtggcacatgcctgtaggtccagctacttgagacactgagctggtaggattgcttaagcctgggaggtcgaggctgcagtgagctgagatcatgccactgcactccagcctgggtaatagagcaagaccttgactcaaaacaaacaaacaaacaaaaaggaaaaagaaaaaagatgaaatttctatgtgaaaaataactattcttgctgcacttctgtaaatgatcataccaacattgatgacactaaattattttacaaataattttgtctttttctgattgtttttagtagaaattgggatgactggaaatttatgtgtttttgttgttgttgttttttgttgttttttaaaaaagctataatacacctgtgactagattgtagccctgtatcatggttgacctctgcttaatttgaaaaacaaaattgtagccctgtgcagtgttttgggttttcgatatctgcttatagactagattagatcctgaattcacctcattcctaccaatatctggctacaactattcaactaagtataagaatgctctgttttagccgggtgcggtgactcccagcactttgggaggccaaggcgggcggatcacgaggtcaagagatcgagaccttcctggccaacatggtgaaaccctgtctctactaaaaatacaaaaattagctgggcatggtggcgcgtgcctgtagtcctagctacttgggaggctgaggcaggagaattgtttgaacccaggaggcagagattgtagtgagccgaggtcgagccactgcactccagcctggtgacagagtaagactccatctcaaaaaaaaaaaaaaaaaaaaggaactgctctgtttttcaggccttataagatgaaactgagtaacttttaagggacaaatctcatgcctaatgtaagggcttccccaaaagttcactggaccacccagtgccaggaccagaaacattcacaccaaaaccaggatgtgaatttgacagtttcatactgtagatgggttttcccaagacaatggaataagattctccatcataatgagactcttatccctattttttctttgcttatgcctaccttttgtctttgacaggtgtaatggaaatttcacaattagtagctattgcatgtaacttgacagaacctgatctaagaaatcctttagttagtgggtaactgtggcaacatccctaatacaactttttgttcatattatactaagggtccttttttcttttcttttcttttctttttttttttgagctagctctctctgctttaattcaaccaagtcatggaatgctaaataacaggattgctacctactagctaaacagagatatctgtatcaacacaaacactacatgctgtaccaggataaattattctggggaagttgagacccaaatacacaaaataagaaaagaagccatggtcacagcaggtctcatatggccgggtgcggtggctcacgcctgtaatctcagcacttagggaggccgaggcgggcagatcacttgagctcaggagttcgagaccagcctagccaacatggtaaaaccccatgtctactaaaaatataaaaattacccaggcgtggtggcatgcacctgtaatcccagctactcaggaggctgagtcaggaaagtcacttgatcccaggaggcggaggttgcagtgagccgagattgtgccacagcactccagcctgggcaacagaatgagactccatctcaaaaaacaaacaacaacaacaacaaaaacaccaggtctcatccaatttcccatggccatttgatttattcaattggttgcctttaagcataagctcatggcttaaaaccataatgcaaactgggattatcatattactattaattttacttagtgttttcctttttaaactttgtacctgttgcctgtcacatttctgcagatatacaactctttgcagaataatgctggtccagcactttgagatgatagacaacgcctatggaacacacaaaaacttaacaatggactcctggcagatttagcctgagagtcacttcctccaaacctcccttgctaaaaaggttttgccactgactcttagtcatgagtcactccctccaatgtaggactagacaacaacctgggacacataagtcttggcattgagggacaatcaaaacctaactccatagctgggtgtgatggcatttgcctccagacccagttactcaggaggctgaagcaagagggtcacttcagcccaggagttcagtgctatagtgcacagtgactgagcctatgaacagactctgcactccagcctgggcaacatatcaagacactgtttagacttttttttttttttttttttaagacagagtctcactctgttgctcaggccggagtgcaatggtgcaatcttggctcacagcaacctctgcctcccgggttcaagtgattcttttgcctcagccacctgagtagctgggactacaggcatgcaccaccatgcctggctaatttttgtatttttagtagagacaggatttcaccatgttggccaggctagtctcgaactcctgagctcaagtgatctgcctgccttggcctttcaaagtgctgggattacaggggtgagccaccacgcctggcctactttttttaaaagtagggaaaaaaaaccccaaaaaaaccaagccctaactatgggtaactgatcagcaatgcttgtagaaaaatcttttgatcaagagggggacgtatgaaagttgtcaggatcaaaaaggagtcacttgtgtcaaaccctgaaatatggagccagagaaggccacaaagggagggttgtcatgcttgtatacctgataagaactatcacaaaagactgactgcgaaaaaccacaaccttgcgcaaaggccatcacaaccatacacaaaaaatatttctgtgagtacatctgcctagcaactgcctgtccagccttgcactgatgccacccttgttattgattcttgtaatgaagaataattgtttacagacacttatgtaatattttcattttttctttaacaactcttttctttcattacctccctgaatatgctcaccatgttcccattgctatgctcaatcccaaataaatattatcaatcctgaataattatcaataaatatttttaaaatattttatatgtaatatatgtatataagaatatatatttatagtatatataaatatttataatataaaagtattcatgttttactttttttggagacaaagtctcattctgtcacccatgctggagtgcagtggcatgaacatggctcactgcagtcttggcctcctgggctcaagtgatccgtccacctcacccctctgggttgctaggactacagatgtgcaccactatgcttggctaatttttaaaaaatttttgtagagacagaatctccttgtcttgcccaggctggtctggaactcctggctcaagtgatcctcctgccttgtgaacctcccaaagttctaggattacaggcacttacacatgagctactgcacctggccctatttatatatttttttttaatccacccatctgcacactgagagtgtgtgtgtgtatttaattattttttatgcagtttcatgtttttagatcttaagtttaaatctttggattatttagcaatttttttggtttaatgtgttatataaaaacccttatataatgtgttatataaaaacttttatgtaaaaacctgtattttttctgaactattatccaatagtaccatgatgttttctttcttttagtttgtgtacttgtttattatagtagactttttccatggttcatttatgagcagttctgtccaaatctgcttttcacccaaaaagtgttggtgaattctgcttgactgtccactctctttttacctgggaactgtaaactgtaccataatattagaaatgggtatattctctttgtaataacatctacactatactctgtgatatgtagtatgtacaaactcaccttctggaaccagaatgtctgattgtgtctgttgcttaccatctgtgtgcccttggacttcttttttctctctctctctttttcttttcttttttttttttttttttttttttgagacagagtcttgctctgtcaccaggctggagtgcagtggcgtgatctcagctcactgcaacctcaacctccgccttttgggttcaagtgattcatatgcctcagctttccaagtagttgggattacaggcacgcaccaccacacccagctaatttttgtatttttagtagagatggggtttcatcatgttggccaggatggtctcgatctcctgacctcatgatccacttgcctcagcctcccaaagtgctgggattacaggtgtgagccactgcgcccagctgcccttggacttctgaacttttctgtggctcagtttccttatctgtaacaggagactagttaggattgaatgagttaatgcttgtaagatgtatgaaatggttcctggtacatagtcaaggctttgtaagttttagaattaggattatccccttctatggcttaagagagagaggaagagggctgaagctatgggaagcttgagtattttgtgggtcttggtttctgatttagaaatgaactcagtcttgctcagagactgtgttcctaacctctaatgtttttgtctctctattttttcttcaatttagtccaaattcttcggtatttgagagatgtttctcaaagtttaaaaaaatttttttaattttttaatataaaaaactccaaacattaaacaaaagctggaggaataacaataaatctcatttacccatcatccagtttcatttttttatgttatttttattccatttttttagaatagagacggagtctcactatgttgcccaagctggtcttgaacttctgggctcaagtgatccttctgcttcagcctcccaaagtgctgggttttgaaggcatgagtcaccatgcccggtctatcatccagttttaattgttattgtcttatggccttcatagttcttggtatgttggaaggattacttgagcccagcggtttgagaccagcctggatgatatagagagaccctatctcaaaaaaaaaagttattagtataaggttgagaactcttccctagtttccacgtagatggtgctattgttcctagcacctaggagaaggaagctttgtgggtctgtacctatcctttcagatttcctgtaggtcataaacccaatacttgagctatcatgatttaaacactttttcttgcaactgtagcagctcatcaggctgttatatctatctcatcctctttatttctactctaattgccctacttggaccttcactgcttttcatctgaattattgcaacagcagcctaattggccttcctgtattcagacctctatattcagtccactcttcgtactgtcgaaagtttatttttttttaatatcacaagcctaattatggcactctgttctagaagccaaggaattgctctcggttgcctatggagtaaaattcaaatggtctttttttccacaagaacatgagatggcccttttcagcccttcactagagtatctttcactatataccatagttcctcaattctaacatgccattgattatagactatatattatgattatatgtcattgatttagcaaaagcttttgggtcagggaccaagaggcacaatggaacctacgcatcagtgataagatacattgtgatttcacaattatgaaaatgtagaggcatattaaattattcctgtaatcacagcaacagtattaaggtaacagcaataaatggatggcatattaacctgcgtaattataggagatttttagtaaggtaattatttgcagacatgggcaaagtttagggagccaataggacatggtatagtattcccaggctggctttagggtgggtgggggactgttgcaaccgaatatctaggtatgaaggctgaggggaaggaactctgccagaaaccagagagagaagtgtacagagcaggactctagacaaaagttgcggacttcagtagagagagtgagtgagccatggaaacatggtagggaaggggccaaaggaataaagatctcgaatacttcactctctccccaccctcttatctccaagctagctaaagccatctcgaatccagaggataaacaagtccaccaatgcagttaagcttcccagggcacaaagcattatggagaagaatggagcacagtggggagggaagccaaaggctaaatggacagtgtcaggcacatcctccattcgatttactctccatcttattttatttatttatttatttatttacttatttatttatttatttattcattcgagacagaatctcactctgtctcccaggctggagtacagtggcaaaatctcggctcactgcaatgtctgcctcctgggttcaagggattctcctctctcagcctcctgagcacctgggactacaggcgcatgccaccacacccggctaatttttttttctttttttttttagtggagatggggtttcactgtgttacccaggatggtcttgatctcctgaccttgtgatccgcccacctcagcctcccaaaatctgggattacaggcgtgagccaccacactcagcctactcttcatctcaaatcacagattaaatctctacatacctgaatatttgcccgcttgctgtttatttggcctttgagctcagcttaattttcgcgttctccatgaagccatctctgacttgtttagtcaatttgtcctctgatgtgttcccataaaacgccacttaaaagatttaaactttagatggtccaaaaggaaccgttgatgtcaggacaaccataaaccaaattttatctcatggggaaatatgagattggatgagtgacaaaagaggctttgaaaatgtagaactgggagtgatacaaggaaagaagaaagtcccaaggagagccatcctctttgttagtgatgacacaatgaaggaatacagcacagatgaagatgaagttgatggcctagagaggaaagatgttttgcctactcttgacccagaagaagaaggaggtggaggaggtggagtgaaggaagaggaggagaaaaataggatgtctacagaagcagaaagacattaccaacagaggaggaggaggaagaggaggagaatgtctgtatgagcagaaagacaatatcaacagaataaggccaggtgtggtggctcacgcctgtaatcccagcactttgggaggctgaggctggcggatcacgaggtcaagagatcgagaccatcctggtcaacgtggtgaaaccccatctctactaaaaatacaaaaattagctgggtgtggtggtgcgcccctgtagtcccagctacttgggaggctgaggcggaagaatcgcttgaaccctggaggcagaggttgcagtgagctgagattgtgccactgcactccagcctgatgacagagtgagactctgtctcaaaaaaaaaaaaaaaaaaaaccccaacagaataaattgcagactgattccattgttcagacagatcaaccagggacagtggtattcagttcatttgggaatctcaattttgaaatggagggagacagtgaagtaattatggaaagcaaacaaaatctcgtctcttttctactacaaaatgaaatgactatcaaacttcaaaccctaagggttttatttttttataccaggaactttcacattctctgctcagtgagacttaatgcaattatttatattttaaattacttaaataatctggaaaagagaaatgtttcttcattcttaggctctattcagcaaaagccaaatctgaaatttgtaccatttctgctgtgtgttgaattagtgctttggtttaaaatgatcttttaaaaaagttaaggataccctagagcttcaattgccaatttaaaagttaaattatcaaggttgtcttatttgtgcatttaaaaaaaaaaaatagaggccaagcgcagtggctcatgtctgtaatcccagcactttgggaggccgaggcaggtggatcaccagaggtcgcgagttcgagaccaggagttcgagcctggccaatgtagcgaaaccccgtctctactaaaaatacaaacattagccaggcatggtagcaggtgcctgtaatcccagctattggggagtctgaggcaggagaatagcctgaacctgggaggcggaggttgtagtgagctgagatcatgcctctgcactatagcctgggtgacagagtgaaactctgttacaaaaaataaataaataaaaataggtaagttgctgattaaggctaattggagctgataatcccacaatctcagatttaaatgaggattttttttttctcctagattttctcatgttatccctcatatttatatatctaaccattaatttcacactaagggtgttttgctgtataataaaaggagtaagatgggaaaaaaagatttaagctttacactttctttttttttttttttttttttttttgagacggagtctcgctctgtcgcccaggtgggactgcggactgcagtggcgcaatctcggctcactgcaagctccgcttcccgggttcacgccattctcctgcctcagcctcccgagtagctgggactacaggcgcccgccaccgcgcccggctaattttttttgtatttttagtagagacggggtttcaccttgttagccaggatggtctcgatctcctgacctcatgatccacccgcctcggcctcccaaagtgctgggattacaggcgtgagccaccgcgcccggcctaagctttacactttctaatgagttgtctatatacttgtctttgctgatatatcataaactctttaatagtaagggacattttacaatcattgtgtctttcccctttccctgaaaacacacaaacccacctgccacaatatcttctacttagaatcaaacacttcagagctggagaaagtcctagaaacatctaatccaataatcttattttataggtgaagaaactgggctcaaatcagtgttggtaaagggctcaataaatgctaattgaagtgaaagtgaaaattcagccccagagggtcaacaagtaccttcaagaaggctttgaaaacaagtagagaaaaaaatcactctcatgtggtaaacttatggtgcccagtcacctggaatatggtctgtgatttcacttttcactgaggttttgcttttattttgtaagaagaatgaaataagctaatgcatgtgaagtatcttagccaagggcctgggacatgataaacttggaaattggggccaggcgtggtggctcacgcctgtaatcccagcactttgggaggctgaggtgggcagatcatgaagtcaggagttcgagaccagcctgaccaacgttgtaaaacccatctctactaaaaaatacaaaaattagccgggggcctggtggtgcacgcctgtaatcccagctactcaggaggctgaggcaatagaagtgcttgaacccgggaggcagaggttacagtgagcccagtgggcgatggagcgagacttcatctcaaaaaacaaaaaaaagaaaagaaagaaattggttagttctagaaagattacggtgagataactttcaagaatttagaaataataaaagaaataaggttttcctctgatacttgaaacttaagcacaaataaattatgaaacatttatacaatctagtaatatgtacttgttaaaatgataacatacatttgcagttgacatgggcaaatgtctgtgatatatttttgagtacataaagtaagtaacaaaaaggcatatacttacagtattttttttttttttttttgagagggagttttgctcttgttgcccaggctggaatgcaatggcgcaatctcggttcactgcaacctctgcctcccgagttctccttcctcagcccgagtaggtgggactacaggcatgtgccaccacgcccagctaattttgtatttttagtagagacagggtttctctatgttggtcaggctggtctcaaattctcgacctcaggtgatccgcctgcctcggcctcccaaagtgctgggattataggcgtgagccaccgcacccggccatttttttttttaattaagggagatctaaaaggatgttttccaaaacattaacagtgactttaactgagtagtatatctctggtaaattttacattctttatgctgtagtgtaatatttaaatgttttactaccagtttgtgttgtttttaaaatcagaaaattaatgttgttttcatgtcaaaagcaaaaaccagtaatgggtgaagtcacctcaaatagcaagactctaaaccaatttgattggactgtaaaagatggattagactgtaacagcattaacatatacaaagtatgaatgtgttggcgagtaggggacgtgtcagctattgaagcactgaatgcaaagaatcagagaaacaaacttaggcagtgatgatccatgcactgtgaaagaaagggggaatcatagccaatggggaggccttattgacaaggggtatgtatctcaggcactcccagccaaatggcattgaattataacaaaagagagagagtgagaggagaaaaaaatacaacaaatataccaggttacaaatgagaaaagagatgcactcaaaaatccgaaaaaaaaattatattgcatgaacatgtaatatgcaactttatggcaaaattttgaacaaattagccaagaagagtcatgaccaaatagactagtaacaacagaagttgttgagaagatggtcaaataattaactctccccaaaacaaactacacaaatggtttaactgataaactattttacatcatatttcagggaacagataccatatattctatttagatattttggagcaaatagaaacagtagaaaacttctcaatttaggaggctaagatgactctgtcatcaaaactgattaagaacagaaattaaaatggaaaataattccaaataaaatattagaaaaatataccagtcatgtctcaaagtgagatttatttcaataataaaaaataatctggccaggtgcggtggctcatgcctgtaatcccagcactttgggaggccgaggtgggcgtattgcctgaggtcaggagtttgagaccagtctggccaacatggtgaaacctcgtctctactaaaaatacaaaaaaattagctaggcatggtggtgtgcacctgtaatcccagctacccaggaggctgaggcaggggaattgcttgaaccagggaggtagaagttgtagagagccgagatctcaccactgcactccagcctgcgtggcagagcaagactctgtctcaaaaaaaaaaaagaaaaaaagaaaaataatccactctttgaaagcctgtcatatgtatgtatatgttatgtacaaagtcaatcacattaaacagttaaaggaaacagttcatgaatgcatctagataaatgctgaaaatatatttaatacaaattaagtgccaacctcagattcaaactagaattgcaggcagctcccttaccataataataattacttatatgaaaccaatagccaatgtcatacttaacaatgaaatactacaggcattcatctgaagccagccctgacatttccattcttttcttttcttttctttttcttttttttttttttttgagacatcatcccgctctgtcgcccaggctggagtgcagtggtgcgatctcggcttaccgcaagttccacctcccgggttcacaccattctcctgcctcagccttctgagaagctgggactacaggcgcccgccatcatgtccggctaatttttttgtatttttagtagagacggagtttcacagtgttagccaggatagccttgatttcctgaccttgtgattcgcccgcctcggcctcccaaagtgctgggattacaagcgtgagccactgcgtctggcctccactcttttgaaaatctttaccaaggtaatatttgtataatttactatgtggtttaacttaagtttctgaagatggcccagaaacttaaatacctacagggaaaggcagggtgcataaatggatgaagtagccaggatattataaaatgttctttgccagtgctatggtttgaatgtgtcccctccaaaatccgtgttgaaacctaatccacactgtggtggtattaagaggaggggtcttttgggaagtgattaagtcataagggctgtcccctcatgaatggatcagtgctttataaaaaggctggagggaaacagcctgggtcctttggctcttccctcccttcctccatgtgaagacacagtgatcaaggcaccctattggaagcagagacgagggccctcaccaaacactgaacctactggcaccttggtcttggacttttcagcctccagaactgtacgaaatacatttctattatttgtaaattacacagtctcaggtattttgttacagcagcacaaatggactaaaccacaaaaaaagaaaaaaatacaatcttctatttctaagaaacatataacatgtttgtataagaccttattttcctctgaactttaccacaataaatacagcaacataactgtagtaataagtagcaatgacaacagcacaaatgtgggaagctctgcaggttgatagccactctgtgcttgctgccagagtgagcgcttgcatctacaggtaggatgctgaggcagaagcagaaacatacacacaaggtgagctggaggtggactctatgagttcgagtcttaacttgctggtatctgtgtaccatatctgttgtagaaataaggggtgggccccagggatgtgatatgaggcatcataagtgtctgtttacactgtccatttatgaaatggaataaatcattccaaaaaaaaaaaaaaaaaagtcctggctcacacctgtaatcccagcactttaggagcctgaggtgggcagatcacaaggtcaggagctcaagaccagcctggccaatatggtgaaaccccgtctctactaaaaatacaaacatttgctgggtgtggtggtgggcacctgtaattccagctactcgggaggctgaggtgggagaatcacttgaacccgggaggcaaacgttgcagtgagctgacatggtgccattgcactccagcctgggtgacgagagcgaaattccatgtcaaaaaaaaaaaaatacaaaatacaaaaattagctgggcgtggtggtgtccacctgtaattccagctgctcaggaagcaggagaatcacttgaacccgggtggcagaggttgcagtgagccgacatggtgccactgtactccagcctggatggctgagggagactctgtctcgaaaaaaagaaaagtttagtttttagcttattaaaacatattagttcaaaatcttttaaggtttttttttaacttaaaatgaaaagtactcatacataaattaaaggtgtaataataatgatcacatatactttgctatgtgtcagctggttagttgttccagaaagattatggtgagataactttcaagaatttagaaataataaaagaaataagattttcctctgatacttgaaacttaaacacaaataaattatgaaacatttatacaatgtaataatatatacttgttaaaatgataacatgcctttttagatatatgtaggcaacatttttaggatatatgtgtgaaatctcacccaatcctcaccacaatcctgtgagacaggcactattattattattattattattttttctgagacatactctcgctcagccccctaggctggagtgcagtgatgcaatcttggctcactgtaaccaccatctcctgggttcaagagattctcccgtctcagcctcccgagtagctgggattacaggcacatgccatcatgcatggctaatttttgtatttttgtagagatagggtttcaccatgttggccaggctggtcttgaactcctgaactcaggtgagtctgcctgcctcggcctcccaaagtgttgggattacaggcgtgagccatcacgcccagccttttgttattgagttctatgagctactgacagctttctaaatttttctaagattctggatttcaataatttattatttttgaaaaaatttctgtaaagttgctgaaaactgcaagtctataattatacatattagactaagcagttggctctcacacaaatgaagtggattttgtttttctcatctcaacagtatttttaatcattatgttgtcacttgctaatgtctatagggatgtcttggttctctttcaatggcggagacagcatatgtgtttgtgcattacttgaagatcttccactctaccagatgaaactgggaaaggacaatgtaccaaagagtatccaagcacagaagggaatctcagtttgaagttaggtgagttcccgacatgaacaggcatgtctggcccaacaggaaccacttttataaggaaaaatttccctcttgggagaaatcacgatgaagaaaagctgagtcagaaacaataaacttgagtttgtaagagagccttcgtaggaggataatagtgctctgtaggcaggctggtggctatcattcagtttcttatcatatacaagcccctgagtgggtgtctgggacctagagaaagagtggtctgtaagtaaaaattgaaagtactgtttcacttaaagttgtaaaacactgatgccactgatttgaattcctcctgcagaattgaatccaagaggaagagaagcatccttccttcagtgcctttgtggtggtgcttggtgagagatagtggtgaaggcattgcctaaagagagaggcactaacaggcagaggagtggttgagaccagtaagaactgccctgcctggtggagcagaggcagaagctgatgcccaggctctgcagcatctatagggaacttggtgcctgcagtgctcatcaaatgatccagaggcctccttgaacactgcaaaacccagaagaaattaccatgccaacggagcagaaccagatcctttggggaaacacagcgctggtggaagaactatagctccagtaagcaaatgtggtgcctggtgggtggttgctgaatcagtgtgtgtttgtgagcatatgtgagacacccactgaagatgcctaaaaacacctctagaaactgacattttaaaaggagactgaagtcctgcattatgcaggtgctgtgagcctgtgactattgggttattccacttaatgtgacttacttgtatctacaagctagtggaagctgggtgccatagttcagatatttttcccccaaaacctcatgttgaaatttgatccccagtgttggagatggggcctaatggaaaatatctgagtcatggaggtggatgctttatgaatggattaacctcctcactgtgggggtggtgagttcttactctcttagttcccatgaaagctggttgttaaaaagagccttgcagggcgcggtggctcatgcctgtaatcccagcactttgggaggctgaggtgggtggatcacctgaggtcaggagttcaagaccagcctggccaatgtggtgaaaccccgtctctactaaaaatacaaaaattagccaagtgtggtggtacatgcctgtaatcccagctacttgggaggctgaggcaggagaatcacttgaacctgggaggtggaggttgcagtgagctgagattgcgccactgcactccagcctgggtgacagagagagattccatctcaaaaaaaaaaaaaaaaaaaaagcctggcacttcctctctctgtctctttcattcctctctcactgtgtctctgcccttaccagcttccctttgccttctgccatgagtgaaagcagcctgaggccctcaccagatgcccaattttgaacgttccagccagcaaagctgtgtgctaaataaacctcttttctttataaaatactcagcctcaagtattcctttatagcaacactaaacaggccaggtgcagtggctcatgcctgtaatcccagcactttgggaggcaggggtgagcccatgtgttcaagaccagtctggacaacatagtgagaccctgtctctacaaaaacaacttaaaaattagctgggtatggtgatgtgtgcctgtagtcctacctactcagaaggctgaggccagaggatcacttgagcccaggaattcaaggttgcagtgagctatgatcataccactgcactccagcctgggcaacagagtgagatcctatctcaataaaagataaaataaaataaaatataacgacactaaacagactaaggcactgagcaaatggatctacaaaataatctagagattagaagttgtcatcagagatgatgggaatatttagggggccactgggcaacttatgttataataacttaggtacaaatagaaagtgtaatttcattttatagtcacaggttacaatgttgtataagttcttatgtaagactaaataacctagactgtgagaatgtaccaatttacactgtggtcattatctcatagaagtcataggaccaaacaatgtcttcatgagttggggtgggattttattcccaaagagaaaggatatatttatactatcttgagagtaatatttgccttatgtatcttacttttaacagcaatactgaacaagctaagccttaagatagctgtctgcttacagtcccttagaaaggattttccctatagtcttcttctagaatattacttctgtgtgtagtttttttcttgtgtaagatgaccctgtcaccttaaccacaattgatatgaatgagagcagttatctaatccaaggaaaagcaacccatcattcagtcaaaaacctgtgatttgtccgatcatgaagactgttcaatggagataattgtagctaactggactgaagaatatcacctttctttgaaaggagttcaactgttagcaaaggcaaaaactgaaagaaaaagagaaatgtaactagtagaagcctacaagcaggagaagccaaaaagaaggaaaagctaatacaacagatgctattatgttgagcaaaagaagagagtacacatactggtgacttattggaaggacaatcagactcagaataattgtctccattatagtgaagcacaaaatggagccattagaagctacccagttaaccagaacaactggacatcaagaaggaattttcagttctcaaatcatgttctgtctccttgagtcctgcaggatagcttcagcatgtctttattcctgtaacctactaaactctagctactcccacatggctgcaatgaattttaccagtttttaaaaaatcaatactgatttaaataagtaggaaaacgtattagtaggcattagtaacaaagtgaaacaagactgacagaaatcaaaatttaagaaaaactaataaatattattttttccttttctttctttattcattgtaaagatgaggttttgctttattgcccagactgatctcaaactcctgggctcaagctatccttctgccttggcctcccgaagtgctgggattacgggtgtgagccaccatgctcagccttctttttttacttctttttacctcagtgaaaactggaaaagctgctagacaaattctaaaagagatataacgctggaaaatattcttactctgtgggtactgagcatgaaattcgaatcttggcttccaagtatttaaggcaaaaagaaaaaaaaatgagaacaaaaatattttaaaatatttaacttttatcttcatttatttttccctttccctcctctcatattagccaggtctgtactttcctcttcaaggtgaagtctgttgtaaggatggacattgaacttgcctagaaaactgtctggttttatttcaaaacgctaagcctcagtaaaggagagaaatagcaggtaaagataaaatgacttgcagaaagctgaagtaaaagaactttgctcagttgataaaacaatatcccacatgctcgataataccagaggaacttgcgttttggacatgaggaccctgatccagatttgtgatagtattgctagggagagagcaagagaccccaaagtatgaaattctcagccttggcaaaaaatacccatgctgcaaacctggtgtggaagcagctaagccctactggatgtgaagggatgatgcagaaagagcgtggacaggtctatgaagagatgaccaatgactagtgggcctttctgttacctccttgatgccctggcactgcataagattccagaaccacgaacagccctggggagattggcatcaagcttaaagaatgaacaaagttaaatttctatattctgggtagaatctgggtggggagtgttgctcaaaatcagaaagtatcttgatgtacaaaattttttgcacatctgtagagaactgatattcccacccactatacctgagttatcagaaaagacaagaatcaagctcacttctgagtttcaatggatcacagtggctgcaaggacagttaggctctttctaattacaagccaaaatgacatgttagggaatcttaggggtgttaaagtaaagaagacaaatttctgtcttacagccagtcctcccacccgcgttggaatgaatctggaaaatcatttgggatattaccagttcttgccattgtgttctcatgctgctgtagattcctattgccgtcctataccattctggtgattcagctactctctgtagctgctattcctgctactgagcaatgaactgacttctctccattgtctttctcagcttttgccattcatggtttctgactactcttggcttttattgtctcatggcttctgatcattgccttttctctgggtgagaaaaggttggctttgttcttttctttttttgaattctacccccatgataaactgctgacttactctgtgtgttgtgcactcagctttgtaagagagaatactgatccattcattcaatcatggccacctctgttgggcaaggctatcattcctgaatcatttgcttatccctggtccaagctgcagccagggataggagttctcaagctttttttttttgagctggcttgctctgctgcccaggctagagtgcagtggtgcgatctcagctctctgcaacctctgcctcctgggttcaagtgattctcctgcctcagcctcccaagtagatgggattatgggcttgtgccaccaagcctggctaatttttatatttttagtagagacggggtttcatcctgtttgccaggctggtcttgaacttctgacctcaagtgatccacctgcctctgcctcccaaagtgctgggattgcaggtgtgagccaccacgcccggccggttctcaagcttttctgagcttacctcacaaggagttgtaattgtggcagaccctgtgagatgaagaataaaagcgaacacttatggagtgctaaccgtgggccagacattgttctaagtgctgtgtagtctgttcaaccttccaaataatatacccattttacagataaggaagctaaggtggttaaagttgacaatatttccaggatcacatagccagtaagcagcagagctaggattctagccaggcagtctagcttttttataagcagtgctctctgcttgtattctgtgagatctctttatattaggatctgttcctttattttctgaattgagactgataattaagccaagaatattcttactaaactgttgattgcggatcaacctttgagtatcactaacagtattagtaaggaagattctttcaacaatcccagaaattcatcaaatgctttcttcctaagtgaaaaagaaaaaagagatgttattagggtagatattttctttcaatgttattcagcattccagaccatcaggagcataacataattctgttcagggacctgtactgttgtttatattcaaagaggatagaagccttaaaagagcagcttcattaatatcagatttttcagagtcctccaaaaatgttttatggcatgtcctattcagtttttctaaattatagactcaagtatttatagacaacaatagcattgctttaagtaagatgaaatgatgttaggaattgaaagcctatcctgatcatctttgtaaaaaatatcagaatagtgggagcttaaaaaattaagacaattgaactcatggagatagacagtagaatgatggctaccagaggctgggaaagatagttgaagagtgagtggttaacgggaacaaaaatgtagttagaatgaattagcacaagaggatgactacagtacaacaataatcgcacattttaacataactaaaataatacaattgtattgtttgtagcacaaagaaaggataaattcttgacgtggtggatactccatttaccctgatgtgattattatgcaatatatgtctgtagcaaaatatctcatgtgccccataaatatatacacctagtatgtacccacacatttttaaaaaaatttttaaatatcagaatacatgtaataaacagtaatgaagataaaattacttgagaatccctaaagacacgttacttgtattcttgtagtaaagactattattggaaaaaaaatttgcctaaatgcagcaagtgttttgagaagaaatatgatttaactgtaagatatggaaggagactgaaatgcattattcaattgcattattcattttcatgctgataagactgagataaagcaaaatggatggcttatgcaatcccagttgcatattgccactttttgaattaccaagagacatttgattaaatagcatcacacagtcacagtggtcattcttacaacagcagctgtactcacatctgggtgtagtggcattctcaaaaggcattctgaccttggtatcatgtctgacctctcctttgagacttctctgctagcccctgtggatctcccctcttgtgctgctttcaggcatgcccagaatagagctgaaatggagtcctgccataaatcaaaatctgtgaatggatactataaaattcctaatttatatgctatgtggtgtgtgttcctttgagatacttaaagatatgcaaatagagtaaccagaaaggactgatgtaaaagtactattttgctaagaaaagaagcaacagaaatctgtaaactcccttcatatgagtgtaccactaagcaatgtggaatggcagctggagaggggcttgtaagaagctgataaatgtatatcaaacagaggcgtttctttcatttccaaactggtttggtgtgatgtagttgtctttcctgctcctacttggaagacatgacaaagtattctgtgtaatttgagcccaaactggaaggtatgaaagaactgtacttccccttccttttttcctctttctggtcctctttctgctaaaagggttgttctgaactcaagcagaatataaaaggttatttcctaacataaaaatgtcatgttcctggataatcaagtctttagatcctactagcctgtatgatgtattactttcacagttcaaatgagaaataaagttttgcaatgaggctttggtgttaatgtacatatccaatattccacaattcatggatatttgtcttaactctactcaaagtttccacttattttaaatttatcacaagcactcaagacagaaatcagaatggtgcttattttataccacatctccagacccactttgtaaaaaattacttttagttcatcttgcctctataatcaatcttagaacagttttgtaatacattgtataataagtcagcagaaatcaattcaagcaacccttcagcagctcatactaacctcaaaggaatagcagatgacaccacttgccattttaatttgttaaatggtatggagggaaaccagatatggaacacatatttccaattaaactttataatgcttggttgatatttatctgagacattgcattttagatggtagaattgtagtagcacaaaattttagtcaactaattttgaggctgaattgtagaatgaaacatgtttttttaatatgaaaagtagaaaggatagtacctgaagtgtgttaggcttgtgagtccagaactctttctcatgctacattttagaaatgctgatgtagaattctccattgttataatctgaactgaaatctagaccttgtaataaattaaaaagaaatagaaaattttggacaaataatgtgggcattacattattgtaaatagcatattatataagtttaaaaataatgttccttcttttaaaaatagcttttccccttcttttaaaattatttttaattaacacataataattatatgtacttatgatgttcagtgtgatatttcaattcatgtatacaatgtgtaacgatcaaatcaaccccttaatttataaaaaaattttttttgagaaagggtcacactgacacccaggatggagtgcaggagtgtgatcacggctcactgtagcctcaacctcctaggctcaaccaatcctcctgactcagcctcatgtagctgggaccacaggtgtgtgccaccacacccagctaatttttgtattttttgtagagatgggagtctccccatgttgcctaggctggtcacgactcctagcctcaagcgaccctcccaccaaggcctcccaaagtgctaagattacagatgtgagccactgcacctggcttcaaccccttaattttaaggggtcgaatcatattcattatgattcaacaatcaatattcattaattgatactagaaaatatggaaaagtataaagaaaaaaactgtcattgtccactaaagataggtattagctatatttaggtatgtttcctctataccttttttttttttttttgagatggagtcttgctctgttgcccaggtgggagtgcagtggcacaatcttggctcagtgcaacctccacctcccgggttcaagcgattctcctgtctcagcctcccgagtaactgggattgtaggcgtgggccaccatgcctggctaattttgtatttttgtagagatggggttttgccatgttggccaggctggtctcaaactcctgacctcaactgatgcccctgcctcagcctcccaaagtgctgggattacaggagtgagccaccacacctggccgtttccactatacttattcttttgttttgtgttgtgtgtttcatttattttattatattattattattgttttagaactgggatttcactgtgttgcccaggctgcactccagctcctgagatcaagtgatattcccgcttcagcttcccgagtacctggaattacatgtgcatgttccactgtgcctggctctggtgtgtttatttttagaaaattttttaattcttgccttttcagttaacaatatataatagcatttatctatgaatgctaatacatacctttacaaagaaatttacagtatagtacaattttccattacatgcagtttccataatttatttatttagtctcagatctttttaggtggacctaagttttccctttcataaagtatgctattatatctttatgtatggaaaatactcttaattttgaattttagattttatgtttaggcttttttctcagaaagggaataaaatttaaagactcattcaaaaaatgtattatcatcagaaatctatgacaatgctttgcttggtggcagtcttgccagcattgaatagcatcatgtatgtgtgtgtatatatatatatatgacttcctattaaacataatagaatgatcatatacatttattttctcctctactcaaaattttattaaagagggagcaaaagagtaaaatatatgtacagacccataagatcaaagaaaatgagagtgaaaacaggagatttggagcacagaaagctgtgacttcaggagctgactaggagaataaaatgaaaatacataaactcttctgagtttcctagcctcaaacacagacagtcagatgtatgactttttggcatgaaataggagaggtttttttttcgtttttgaattacaagattaggagaaaggacaacaaaataacaatattctgggctcccagtacaatttccagcttgttgtccaaaatattcaaacaaaaactaagagaaaacaaaggatagaaatagaaaagagcttagaaacctatggaacatgaagaggtaatagaatatatgtgtaattgaaatttatttttaaaatttcagtataaattgataattgataattatatatatttgtggggtacaaaatgatgttatgatttatgaatatgatgtggaaaacttaaatcaagttaatatagttatcacttcaaaaacttactattttttgtggtgagaacatttgaaatttgctctcttagcaattttgaaatgtacaatacactgttactaactatgctcaccacactgtgcaatatattttttttaaaaccaccttattcctcttgtctaactgagatttgtagccctttgaccatcatctacccatgtcccccaccatccagcctctcactaccattctactctctacttctatgagtttgattgttttagatttcacatctaagtgggaacatacagtatttgtctttctgtgccagacttacttcacttagcataatgctctctaattccatctaagttgttgaaaataactgaaagctgaatggtattccactgtgtgtatgtgccacattttcttcattcattcatttgttggtggacacttaggttgattccataatattgctgctgtgaataacactgcaatggccatgggagtacagatatttctttgacacattaatttcaaaatttttgagtaaacactcagaagtaggtttactggatcatatggaattctatttttaatttttgagaaacctctatacagttttccatactggctgcattaatttacactcccaacaacagttgtacagggttgccttttttccacatccttgccaagatttatcttttgtctttttgagaatagccattctgaccgatgtgaggtgatttgtagttttaatgtgcatttctctaatgattagtgaagtagaacattttttcacatatctactggccatttgtatatcttctttttttgagaaatatctattcaaggtccttgtccccaccaacttttttttgagacaggatcttgcttctaggctggagtgcagtggcaccatcatagttcactgtagcatcaaactcctggattgaagcaattctccctcatcctccagagtagctaggactacagatatgaaccactgtgcctgacctttttgtgttttttttttttcctttgagatggagtctcgctctgttgcccaggctggagtgcagtggcgagatctaggctcactgcaagctccacctcccgggttcatgccattctcctgcctcagcctcccgagtagctgggactacaggtgcccgccaccatgcccggctaattttttgtatttttagtagagacagggtttcaccgtgttagccaggatggtctcgatctcctgacctcgtgatccacccgccttggcctcccaaagtgctgggattacaggtgtgagccaccgcgcccggccctttttgtctatttttaaattgaattttttttgttttcttgctattgagtggtttgagttccttatatattttgaatattaactcctttaggatgtagggctttggcttacaaatgttttctcccaatctgtaggttgagtcttcacactgttaattgtttcttttgctgtgcagaagctttttagtttgatgacatcacatttgtctacttttgtttttgcttcatgtgctttggggaccaagtgaaaaaaaaaaatcatggccagaaaaatgttatacagtttctcttctatgttttctttcagtagttttacagtttctggcctttaacccatttgggttgattttgtatacagtgtgagataagggtccattttcattcttctgcatgtagagatccagttttctcagcacaatttcttgaagagactatccttttcccattgtgcatttttggcagttttgttgaaaatcaattgactgtacatgtatgagttcatttctgggatctctgttctggtccattgatgaatgtatctattttttttttattcccagtactatagtgtttgggttacaatttatatatagtatattttgaagtcagattactgtggtgcctccagctttgttctttttactcatcattggtttggctattttttttttgtttttttttttttaatagtttcatatgaattttaggattatattttctaaaatgacattggaattttgataaagattgcattaaatctgtagattgatttgagtaatatggacattttaacaatattaattcttctaatccatgaacatagagtatttttctatttatttgtgccttcttaaatttctttcctcaactttttttttttcatgaaaatcaaactatcttgtgcacccaaagacattatcaagaaagtaaaaggcaactcacagcgtgggagaaaatatttacaaatcatatagctgataagagattaatatccagaaaatacagtaaattcctaaaactcaacgctaacaacaacaacaaaaacaacatatttaataccacttaactatttaaaaatggttgaagtagtgaattttataattttaccatgataaaaaaattggaaaaaaatttataggctatccaaggtttcaactacattctcaacacttataccactgtatccactgtatccctttcccagccgaagcgtgtgtttaaaaaaaaaaaaaaaaaaagaaaacccaggatgaaaacactaaagaatactgcaacttctttaatgagttaacatatttaaagtctctcatacatagtaagcgttcataaaatgttagttattattctatagatgctaattttttaggaacaggtagaggcattttttcaaattattttatttatttatttttttgagatggagtctcgctttatcacccaggctggagtgcagtgatgtcatcctggctcagtacaacctccgcctcctgggttcatgcaattcttctgcctcagcctcccaagtagctgggattacaggcatgagccaccacgctctgctaattgttgtatttttagtagagacagggtttcgccatgttgcccaggcaggtctctaactcctgacctcaagtgatccaccctccttggcctccccaagtgctgggattacaggtgtgagccaccgcacccggccattttttcaaatttaaaaataggttgcaatctcattatagaaaagtatattataatccaagagaaaatataacaaataggatggagcaatcctttattttttacacactttgacaaaaaggttttcagtaaacaatgtttcctgtggagaacagagaacatgaaaatcagcctccagccatcagcagctgctctgctcagggcctagtatccccttgccgaattggtgacgtggagaggtatattacccttcctttactagcttgttctgctgcttctggatggtactcacacgtctgattgtttcctgccaaaacaaacactatgaaatcatcaaattttatcttgcactctttctctgcccggatactatggattccttatgtacattctttccattctttttcaaacccatggcattgagcaggaatcttgtagggctgttcagcactttggattgtcatccatcaatctatgttaaagccagaccttttttgcacatccaagaaaggcatgggctgggcgtggtggctcatacctgtaatcccagcactttgggaagtggaggaaggaggatcacttgagtccaggagttcaagaacagcctgggcaacatagtgagtcctcgtctctatgaaaaataaacaaaattggccaggtgtggtgacatgcacctgctgtcccagttacttgggaggttgaggtgggaggatagcttgagcacaggagattgaggctgcagtgaactgagattgtagcactgcactccagcctgggtgacagggtgagaccctgttggaggaggaggaggagaaggagaaagtttgtggaatttagaggaatttatttttatttatttatattattattattttttgagacagagtctcactccgtcacccaggctggagtgcaatggcatgatcttggctcactgcaacctccacctcccgggttcaagcaattctcctgcctcaacctcccaagtagctaggattacaggcacccgcaaacatgcccagctacttttttttgtatttttcgtagagacggggtttcgccatgtttgccaggcttgtctcaaactcctgacctcaggtgatccacccactttggccttccaaactactgggattacaggcgtgagccaccacgcctggccaggaagttatttttaatatgtgttgtaatgagaaatattggctaagaattttcaaaatctggcaagagacattcatccaaagcattcataagctctagactccaagcaggataaatacaaagaaaatgagatctatgtacaaatatagcaaaactaccgaaagctaaaaacaaagagagaaatcttaaaaccatttggaaggaaaaaaattacttttgaataggcaataagactaacatccagcttttaaacaaaagtatgaaaaaaaaaagaaagagtatgaaaaccaggagacattggaacaataacgttaaagtccttttcaggagcacttccaggagtcagcctttatatctttatttttcttttcactttgcttcaaagttatttttaaaatcatgaaaccacaggacacagagcaaagtaaatttttaaaattgaaatgtaattaatctaccataaaatacagcattttgcagtgtacaattcaatgacttttagcatatttacaaagctgtataactatcatcactatctaactctagaacatttttatcactcaaaaagaaaccctcagtcactccccattttctcctcccctcaacccctagaaatcactgatttactttctatggatttgcctattctggatatttcatagaaatggaatcataaagtatgtggttttttatgtttggcttctttcacttattataatgtttttcagatttatctgagttatagcatgtattcatttctttatacggctgaatgatataaattatagggatatagcactttttttaaaaaagtccactcatgggtgggaggagggtgaggattgaaaaactacttatcaggtagtatgctgattacctgggtgacaaaattaactctacaccaaacccccatgacacacaatttacccatgtaacaaacctgcacgtgcaccccctgaaagttggaaaggcaaataaaataaaatgtttttcatctctaggaaaaagcaaagtccattcatcagtggatggatattggtttgtgtcttagtctttttaggctgctataacaaaagactttaaactagataatttataaacaacagaagtttactgctcacagttctggaagtgagaaagcccaagatcaaggtgccaacagattcagtgtctggtaagggcctgctagtcattgatggtgccttctatgtatcctcacgtggtggaaggggtaaacgagctcctttgggtctcattttttttttttttttgagacagagtctcactctgtcacccaggctggagttcagtggcaagatcttggctcactgcaacctccgcctcttggttcaagcagttctcctgcctcagcctcccaagtagctgggattacaggtgtgcaccaccacatctggctaatttttgtatctttagtagaaacagggtttcactatgttggccaggctggtctcaagctcccggctttgggcctcttttgtaagagtactaattccttttatgtgggtgaagccctcatgacctaatcacctcccaaaggcaccacttcttaataccatcacactggggattaagtttcaacagatgaattttgtggagacacaaacatttagaccatagcagattattttcatgttttgaaaaataaatgtatgagtttatttctgaactctcaattatatcccactgatttatgtctatttataagcctgtatgttcttcttcttgatagtagttatctactcctgatatttatttgattattgtctgaaccttcaaaaacataaattctatgttgtctactgcttactgatgtatctcgagaacctagaacagtgtgcttggaatgttgtaggtgctcactaaatacatgataaagttgaattttggacatattcttccatttttaataatttttaaatagaattttagaaaatgctgattttatttattttagttattctttggccaatcttgttatctttaatttttttacttttgctctttcatcaagattttttccaaattgttaaccaatttttctaaaattatttgatcattcttccctttcacatgaatttgtagtattttcattagacatcacatatgaagaaattgtcgtatattggagaggatagggagaaactaactgcaaagcagatgaattagaacttgaactctggccaagcatggtggctcacacctgtaatcttagcactttgggagactgagacaagaagatagcttgagcccaggagtttgagaccagcttgggcaacaaagcaggatctcctctctaccaaaaaaaaaaaaaaaaagaaaaagaaaaaggagagagagaagaacttgaactcagatattcttatttttcccactctgctttctagactgttttgtcccttgggactatattattattatggtagcatctctatatggtagaattaggcttttcatttaatttatgtctcttccataattttgtggctatccttgccttattcaaaaaattattttaattatttcaatacaattaacaaaataatatctctcactggttttgtagttgtaactaacctatatattaacttgggacaaaccgacaatatttttttcttttcttttttttcttttcttttcttttcttttcttttcttttcttttgaggcagagtctcgctctgtcacccaggctggagtgcagtggcatgagctcggctcactgcaacctccgcctcctgggttcaagtgattctcctgcctcagcctccagagtagctgggactacaggcccacgccaccacacctggccaatttttgtatttttagtagagatggggtttcgccttgttggccaggttgatctcgaactcctgacctcaggtgatccacctgcctcagtgtcccaaagtgctgggattacaggcattagccactgtgcccagcctcaaaccgacattttttgaaaaatttgtcttcctgtatataaatatgtgtccttccatttatttaagtctctcaataaagttttctaaatgttttcatcttgatattaacccatttctcaacaagctactcgttggtattttaaaaattgctattataaaagacatattggctgggtgtggtggctcacgcttgtaatcctagtactttgggaggctgagtagggtgaattgtttgagcttgggagtctaagaccagcctgggcaacatggtgaaacccccatctctacaaaaaattcaaaaaattagctgggtgtgaggatgcatggctgtagtcccagctacttgagaggcttagatgagaggatcacctgagcctggggaggtcgaggcctcagtgagccatgattgtgctactgtgttccagcctgggcacaacagagtgagaccccatctcaaaagaaaaaaaaaaagacaagaaaagaaatattctttgttatttttcttagtttgctgtatctactagatgttctttacaaagtgagaaaatcatcctcttaaaagcactaataaggcagggggtggtggctcacacctgtctgacctcaagagctcaagacaaccctgagcaacatggtgaaatctcatctccattaaaatacaaaaaaattagctggggtggtgggtgctcctgtccagctatgcaggacaggaggctgagtcatgagaattgctagaaaccaggcggcagaggttgcagtgagctgagatcatgccattgcactccagcctgggcaacagagaaagactctgtctccaaaaaaaaaaaaaaaaaaaaaaacaacaaaaaatcactaacagatgtttatcagctaatatttattgaaaatccatttttgatatggttttaaatgcaaatttcatattttaaatattttaagaatcatgtatttatgtgtaagacaggtatgggagtttcttttccccgatgatgattccacatacacattggtaatttaagactaatagaaattttgttattcatataatttaatcaaaacaactattaaaatgcatttagttctttataatttaataagaacaagatgcctttgttcagaattataaacagcctgtcataatctgttttttaaagaaaatttaaaaagcatattctggaaaggcactcaatggcaatacagtaaaggaaatactgacttttagagagtctgcagcaaagcgtgctaattctattgcaattccttggtaagaaccattattggagatgcaatttaccatatctactgttcaatgaccccatgaatattgagtataggcacacagagatatgttttatgtagctcacagctgaaatgtgcatttgtgcaaccctgttcttctgttattttgttactctgtgcacatagacatccaaaaatgaatgtacaagtatataacatttgtttcttaattgtaaaaactattttttagtagaattaaaatatgcatgtgctaaaattgaaacatttcaatcaaggtcaaactatctcctcagaataggtcagacaatttttgcaacatctgtgggtcaggcaatggctctgcccatcattaaaaaaatagtttattgtactatacattagaaaaatgcattaagttagcatacataaggcattattttataaatatcttgcattgggtaggcaacatttcttgaaacaatctgaaacttacagaaaagttgtaaatatagtacaaaaattactttttcttaaacggtttgagagtaaattgccagcctgatgccccatcagttcctcatacttcagagtatattttctacaactgggacattctcctatatagctaaacactactaaaaaaatcaggaaaaacactatgaaaaaaatcaattaccattggtacattactaccatctaatcctcagacctcattcaagtttcaccaaatgttggaataatatcctttagagcaaaaggatcaatttcagaaccgtgtcttaattttaatcatcacgtctcattagtgtccttcagccctgtcttagttcagatggaatggcttaaacaatcaacatttatttctcacaattcaggaggctgagaaatccaaaatcaaggcacccgcagatctgatgtctgatgaggacatccttcctggtttactggctgctttcttgctgtatcttcatatggggtggcggagggagagagacagagagaagaagcaagccttcctgtctcttttttatgaaggcacgaatctcattcattcaggagttcaccttcatgacttaattacctcccaaaggtctcacctcctaatagcatctcattgggagttagaatttcaacatatgaatttggggagggcgacacaaaacattcagtccataacaaatccaaaaacatttccttaatctttccattattttcatgaccttaactcttttgaaaattataaggcatgtttgtataatgttcctcaattttagtttgtctgatgtttcctcataattagattcaggttatgcatttttgggaggggcatcacagaagtcatgctacattcattttattgcagcctatcatgtggagagcacaatttcaatttgtcccattgctgatattgtttactttgattacttgattaaggtggtgtctgcctggcttatcaactcaaattacttttcccattataattaataaggattttgtggggaagtactttgggattatgtaaatattctgtttctcattaaaccgtcagtttattcatttatcattttatatcagtatgcttcatcatttactattagtatgaaatcacagcctatttcaacaggccgtaatctattgctatcattatttattttggagctaatattctctgtgattttgactgtgggaacttcatcaagcatacttttctggttcttttgtatacttgtttgttttacgtgtccccacaattctttgattattgggaaaattcactccccatatttcacgtaggttcttttctattttccctaagtgtcggccggtctgagaaataaagggacagagtacaaaagagagaaattttaaagctgggtgtctgggggaacatcacatgttggcaggttccgtgatgcccccccaagtcgcaaaaccagcaagtttttattagcgattttcaaaaggggagggagtgtgtgaatagcgtgtgggtcacagagatcacatgcttcacaaagtaatataatatcacaaggcaaatggaggcagggcgagatcacagaaccacaggaccggggcaaaattaaaattgctaatgaagtttcgggcacacattgtcattgataacatcttatccggagacagggtttgagagcagacaaccagtctgaccaaaatttattaggcgggaatttccttgtcctaataagcctgggagggctacgacagaccggggcttatttcatcccacattagtcttccctttcctttcttttctctttttttttttttgagactgggtctcactttgttactcaggctggagtgcagtggcgtgatcttggctcactgtaacctacacctcccaggctcaagcaatcctcccgctccagcctccaaagtagctgggaccaattcacctacctcggcctcacaaaatgctgggattacaggtgtaagccaccatgcctggtctacggtctctcctttctaattgatgacttcctcatatggctttggctctgacaccctatgcctgcccctttcccaatggactcctccttactgcactagggttctgactcccatgctggttcacccctggaggacaccctcctgaccccaccaggcactgacttttcatcctgagcctcctcctttgtgggcacccttctcatcacacttggcggatgactccccttgccaggctgtccctcagtggtaatgctcttctcaccatacccaggttataacatcccagcctggacccttacactgcagagacatctgcacatcattgttctgaggctctgacatcctactccaggccatccccttcagggagacaccctcttgatactgagtattacagcctgaccaagatgaaaagggaattcccaaagagaggcagtctagggtgggagttggaacctgagcaaggtgaggtgtgtgttaggctctggcagtcagcctcagtgctgagctatttccttgcatggaccctctccacatcttgtgtaggttctgacagtctattctgagctgcatggatcccacccctgtacggactctttcctcttgagctcttacactctcagcctcccttggtgttaaggactgcaactatcttggaaaaagaactaaatgtgaggctttgctctttcagatagcaaaacttattataaagctacagtaaataaggctgtattgtatagaggcaagggatagccaaatagaataatatagaatgttaagacatgactccactcacatatggttacttgatataagacaaagatggtctgcagagcagcggggaaagggtgggcttcaataaatgaagttttcctgtcctctttaaggaatcattaccttccataaggttgtgagatactgtccagtgttatcatctagaagctatattgtttacttttcttatttatgtctctaattcccccaaaatcaaatttttaggcagctatccatacaagacaaagaaaagaaatgtgacctctatgcaaaagtcttatatggttgttgggtacctactgagaaagaatgttctaagaggggttaaggttgaagctccagatctctgaaggcctgacttcagaagttttaacattcacttgatccagggctgcccacctgtgaagaagattgaggtggaataagagcaaaacctcaagtggggccatttttgcttcagaatgaaatagaaaaagttagtttcttggccaacagaaacatattatgaacaatccaagtgagattttggaagcaaaatttcaagaaaaagaacttttggctctgcctcttaaggaaggtagatgctgtcacaacattatcacagaatgggtctagtccgtgaggcccatactagagaatgggcctagtaatggggaaacagcagcatttggttacaaatttctccaaatccatcctgggaaatggaacttttttttttttttttttttgagctgggggtctcactctgtcagccaggctggagtgcaatggcccgatcatagttcactgcagcctcaacctccagggttcaagtaatcctcctgattcagcctcccctgtatctgggactacaggcatatgccactatgcctggctaatttttaaaattatttgtaaaaatgggggtctccctatgttgactgggctggtcttgaactcttggacttaagccattttcctgccttggcctcccaaagtgctgggattacagggatgagccaccatgcccagccggaaatgggacttttgggaaactactattctctcagtggggccttaacagcaaatagtgaaaatgctttaggcattttagctgatgcaaattcaagtttaaggcgttattgagaagctaaaaaaccaaaccaaaaggaatataggctacatttagatatgtatattttattcatttattgatgtatttattctataaatatttatcaattgttgtagcaaagactggctagatgttgatcaaaccaattttgttttattcctaaggccacagctgaactacattttctagcaatcctcagaataagatgtggtcattgactgaattctggacaatggaatggagtagagtgaaatacatcactcctaggtttggcctgtcaaatctcatgcacaattctgtacattcatgtgccagcctctcctcgggtggggactccaagcactttggagttggtggagccacaagatggatctgagatctttgctaaggtagggtttccctggctggcctatagctgactgtgacataagagagaaataaattttgattttcttaagctcccaaaagttttgagattgtttgttacagccatgagtcttccctgattaatacaaatgcaatgtctattctgtgccagccttattctgggtactagggatgcaacaggaaacaaataagagacatgattcctcctctcacaggagataccttataaaaggggtggcacacaataaacagtgacaacttacatttgcatggtgctttactgtttacacagtgctttcatgggcaccaactcatttaattttttttttttttttgagttggagacttgctctgctgcccaggctggagtgcagtggtgcaatctcggcttattgcaacctctgccttccaggttgaagcgattctcctgcctcagcctcccgagtagctgggattacaggtgcatgccaccgcacctggctatttttttttttttattttcggtagagacgggggtttctccatgttgccgagggtggtctcgaactcttgacctcaggtgatccacctgccttggcctcccaaagtgctgggattacaggcatgagccaccgtgcctggcccaatttttataacaatattttacagataaggaaacaaaagctcaaagattttaagtgtcttgtatgagacaaggaattacgaactagacaaatcaatcagttttctggctcccaacccattactcacaatgattctcaagtatgaggatatgacagagcaaggaaagtgctaatccttgttagaaaattccattattcaattttatgtcttaaaataatgtattccacacaagtgtaagtctattcatggaagcattgattgtaagggcaaaatacagaaaacaaagatttaaatatccattcgtaagagaatgcacatattgtgatatattcagagaacagaaaattatatggtagggaaaataaagaaattagggattcaagtatccctaatttcaaggatgaatctcacaatcatgatgaagaataatgaaggcaagaatgaagagtacagagtataatgccatgacaaaggtttaaggtcttcatgggaatgataaacaccaaatttaggatagtgactctgcagaagagaagaaggccgatgcaatcagagagagttatgctgaggagatcaactgtattggccatatttcattcttaagctgggtggtgaatattacattattctggattatcttccttttgtccgtctgaatctgttttctaccttctcatttctgccctctgtcctgagaggctgacttgtgtggtcttctataggatcaatgggctccttgtcccagctttcagaagatcataaggtggaagagaatgaagtctcagcttcctgactttttaggatgactttgggctggccaggtctcttaagcagaggtcacatctcctgtttggaggccctctctacccagcccactgtgagttttggtaattgcccagtccccttgtgcctgcagggccagaaatggaaatgtcctattgttaacactcagttactacaccattccttacagttttccgaaaccctgccacccaagctggagtgcagtggctggatcatagctcactgcagccttgaactcttgggctcaagcaatgccagggagctgaagctaaaggcatatgctaccacctgtggctaattttaactatttgtttttaatttcttttaattttaatttttattattatgatttttagatggagtctcgctctgtcgcccaggctggagtgcaatggcgcgatcttggctcactgcaacctccgcctccagggttcaaacgattctcccacctcagcctccccagtagctgggattacaggcacccaccatcatgcctggataatttttgtagagatggggtttcaccatgttgtctgggctggtctcgaacatccgcccacctcggcctcccaaagtgctgggattacaggcgtgagccactgcacccggccttttattttttaaagagatgagggtcttgctatattgcccagactggtctggaactcctggcctcaagctgtcttcctgcctcagcctcccaaagtgctgggattacaggtaatttgaaaagaatgaagagtttaatcgagactatagccatcctgaattaaggaacagagaaggggacaaagaaaaagaagagactgtagttggacatggtggcttgcacctgtaatcccatcactttgggaggctgagatgggaggatggcttgaggccaggaactggagaccagtctgggcaacatttcaagaccccatctctataaaaaataaaaacaaaatagttgggagtggcggtaagtacttgtagtgtgagacaatcttatttgagcccagaagctcgaggttactgtgagccatgactgagccacagcactccagcctaggggacagaatgagaccctgactctaaaataaatacacaaaaataccattttatttatttggtgttacccagcttgagagtgccatctgtttttttgctgggttgctgagttctgactgatagaatagatattctctctctttttctctctccagacacatgaatcttttttttgcatatttgacataatgtgctaacaagttgagaagaaaaaacttttatttttaatttttgatacagggacttgttctgtcgcccaggctgcagtgcagtggtgtgagcatagctcaccgcaacctcaatttcccagactcaggcgatccttctgcctcagcctcctaagtagctgggatgacaggtgaccactacgaggtccagctaatttttaaaattttacttttaggctgggcacagtggctcacgcctgtaatcccagcactttgggaggccaaggtgggtggatcacttgaggtcaggagtttgagaccagcctgaccagcacggagaaaccccgtctcttctaaaaatacaaaattagcagggtgtggtggcacatgcctgtaatcccagctactcgggaggctgaggcaggagaatcgcttgaacccaggaggcggaggttacggtgagccaagattgcgccattgcactccagcctgggcaacaagagcgaaactgtctcaaaaaaaaaaaaattacttttggcagagatgagatctcgctatgttgcccaggctggtcccaaatgcctgagctcaagtgatcctcctgccttggcctcccaaagtgctgagattgtaggtgagagccaccatgcccagccaaacatttattgagcacctattatatatcaagcattgtgctagggttaaggtttggagatagagagaaaaataaattaaatctgttgttacaaggaagtcacagtctagtaggagacacaggtgaaaaactggcaatgaagtatagtggctaaaaacatgggatttgcagtctgagaaacctgagctcaattctaggttctgttacctactggctatgtgaccttgggctacagaaataaaaatgggattactactggtaccttccttatagggtagttgtgaggattaaaagtaaaagcactagtatctatacttttacatctcactagttatgtgttgcttaaccatggggatatgctctgagaaacgcattgtcaggtgattttgtggttgtgtgaatatcataaagtgtccttacacaaacctaggtggtgtagcctactacacgcctggctgtgtggtgcacaggcagtctactgctttgaggttacaaacttgtacagcatgttactgcactgaacactgtaggcaattgtaacacagtggtatgtgtgtatctaaatgtatctcaacatacaaagttccagtaaaaatatggcataataaatcttatgagaccactgttgtatatgtgctctgtcattgacccaagtgttggaatgtcatacacatgactatatgcctaggatatattaagtccttaataaatgttacctaaaattattgtcaattgtaacaatagcactttgtacttggtttagaggtagcacagaggaggcactgattaagtagagctaaggaggtcagcagaagtttaatgggtgaagcgatgtcagagccggatcttaaggaaatggtactttcaccaagagatcaagtggggaaaggcaatccagacagaggaaacaacatgtataagaacatggaagaatgaaatagcactatgtgttcaggaaaacatgagcatcttgctattgctaaatggtcaaggcctaggcatgaaaaataatgagacgaggctgagttacgtggaggtatacacaaaaagcctggattggacttgatcctgcagttgagcatctaggaagaatttttaattctaatttttaatttttagcaccatttacttgcttttgagaggaagaatttctaaaacttttattttaaaataatttcaaagctgtagaaaagtagcaaattgaaaaaataaaaaactctgctatacccaggttctccaatttttaacgttctctcacatttgtcttatcattcatttctctttctgacttccactatgtgtaattgtcaaaatcagggaattcataaggatacaacgcaacctaatttcctttatagcaaaaacctttctttcttttgatccaaaaatccaacccatgatcatgtgttgcatttagctgtcaggtctcttcagtctccttgaatctggaagagttcttcaaatctgtcttttgggacattggcattttgaagagcataggtcaattatattgtagaatgtcttcagcttgtgtttgtctgatatttcctcatgattagaggcatttatgcattttttttcaggaacactagaaaagataatactgtattctcctcaatggttcatatagagaggtgtacaatgtctatttgtcacattattggtgatttttcactttgatcacaataaagagtatctcccaggtctctccactttaaagttactatttttcctttttaaatgataaacgttttgtagggagttacactgagatatgtaaaaatatggcaaactatataaagaacaaaagacagtgaaaactcttaacgcagcaattccacttttaagactgtatctgaagacctcctcgcctcatgcctgcatgcaggctgcatgcctgctcatcccagtactttgggaggccaaggtgggaggatggcttgagatcaggagttcgagaccagcctgggcaacatagggagaccctgttgctattaaaaaaaaaaaaaaaaaaaaaaaatatatatatatatatatatatatatctcctaagtaaataaggatgtatgtaaagttttagctaaacggatattcactgaaaccttgtttataatagataacaatttaaaataacctaaatgtccattattagtggatttggttcagtaaattacccatacgatagaatattatgcagacattaaaattatgtggtaaaagtataattgatgacaataaagaatgttgtgtgcagtggcttgtgccagtaatcccagcactttgggaggcgggggtgacaggaccacttcagcccagaagttcaagaccagcctggacaacatagtgagacccctgtctccacaaaaaagctaaaaaattagctgggcaaggtggcgtgtacctgtagtcctaactagtccagaggctgaggcaggaacatcacttgagctcaggatgttgaggctgcagtgagctgttgtgtccggaattggtgggttcttggtctcactgacttcaagaatgaagccatggaccctcaccgtgagtgttacagttcttaaaggcatcgtgcctggagtttgttccttctgatgttcagatgtgttcagagtttcttccttctggtgggttcctggtctcgctggctcaggagtgaagctgcagaccttcacggtgagtgttacagctcttaaggcggcacttctggagttgcttgttctcccgggtgggttggtggtctcgatggcttcaggaatgaagctgcagaccttcatggtgagtcttacacctcataaatgcagtgtggacccaaagagtgagcagtagcaagacttatagcaaagagtgaaagaacaaagcttccacggtgcagaaagtaacccccatgggttcccactgctagcttgggcagcctgcttttattcccttaactggccccacccacatcctgctgattggtccattttacagagagctgattggtccattttgacaggttgctgattggtgcgtgtacaaaccttgaactagacacaaaagttctccaagttcccactagattagctagacacagagcactgattggtgcatttacaaaccttgagctagacacatgatgcttattggtgcatttacaaaccttgcactagatacagagtgctgattggtgtattcacaatcccttagctagacataaagattctccaagtccccaccagattagctagatacagagtgtggattggtgcatccacaaaccctgagctagacacagggtgctgattggtgtgtttacaaaccttgagctagatacgagtgctgattggtgtatttacaatcccttagctagacataaaggttctccaagtccccactagactcaggagcccagctggctacacccagtggttcccgcactggggccgcaggtggagctgtctgccagtcccgagctgtaagcccacactcctgagcccttgggtggtccatgggaccgggtgccctggagcagggggtggccctcgtggggaggcttgggccacgtgggcaggagcccacggtggggccgggggaggctcaggcatggcgggctgcaggtcctgagccctgccccgtggggaggcaggtaagccccggcaagaaatccagcacagcactggtgggccggcactgctgggggacccggcgcaccctccgcagctgctggcccaggtgctaagcccctcactgcccgaggccggcggggccggccggccgctctgagtgcgggccgccaagcccacgcccacctggaactctagctggcccgcaagcgacgcacgcagccgcagttgccacccgtgcctctgccaccacacctaccacaagctgagggaaccgtctctggcctcggccagcccagagaagggctcccacggtgcagcggcggctgaagggctcctcaagcacggccagaatgggagctgaggccaggaggcaccgagagcaagcaagggctgcgagggctgccagcatgctgtcacctcgctgtcacctctcactgtgagcaccactgcactccagcctggttgacaggatgagatgctgtctcaaagaaaaaccaaacgacaaacaaaaagttgacatcatagtaactgaagaaatcaggtaagtaaattactttatatggtatggtgcagtttttatttaaaaaatattttatacatacatacatacttattgatttttttcttgtatacaaaagtatatgtatgtatgcatgtaaacatttctattacttgattttattacatcatttttactgcttatattgcaaaactaagtttttttttttttgagacatggtcttgctctgccgtttgggctggagtgcagtggcaggatcatagcttaccatatccttgacttctcaggttcaacagatcctcccagctcagcctcctcagtagctgggactacaggcgcctgccaccatgcccggctaattttttagtttttagttttagtttttgtagagacggggttttgccatatttccaccctggtctcgaactcctggcctcaaagaatccgctggccttggtgccctggatgccctggcctctcaaagtgctgggattgattacaggcgtcagccaccgctcctagccaaaacaaagttcttaaaaataaaagtagtatgagcttttctggtgtattaagtacggagaagttaaaaaaatacaataacaaagttcacagccttttgtgatcagtaaatgttagtttttcgctcttccctagtgacaaggaggcactcaagcatgagttacaacacaaccgacctggaatacagctgaaaagattgaagcaacaggttcgcaggggaaggcctttacagcttctttcgactctgacatttcaggatcagcacaattctcccctatttactgctgaagcaatcaactgggattatacaaaaaaattatttgtattgaatacctgacagttgtgttactattactagcactatcggttttgaaggggaggtggtggtgtgtggaaaaaaaaagtctggcaggagggagggcagatgtgaatcccagcccaccgtcccgttgacagctctatggctctcctttctgtgaatgagcggtggtccttaggcctcagacccgacaatgtcagtgagaaacagaacttaacccaagggactgttctccaaggagcggcgggggaatccaacgcagaggagcgcagcgccctctctagcctcctgcgggtgtcggggatgatcagggctcctgggtgttcgtcagtgaagacgactgtcttatctgactgtaggcacagagagtgcgccgcgagagggcggctcctcaccgtcaggcgccggcaggtcgcgttctctgctggccgacgcccgaaggcgccgaatgggggggccctgccgagctcccttacagccccaatgtgcgcgccgccgggaggcttgggcacgcaggcaccgccggcggggggcggggcgaagccggcggggcggggcaccagctgcgcgcgcggggcgggggcggggccggggcggggcgcgctgcgtggtcccggccggccctggctcctccccctcccgcgcccaggccagcggcgggcccagctcctcccccgactcggtctctctcccctcccctccgcccggcagttcctccctcccgccgccgcctcttcctcggtgaggcgctcttccagcgggcaggcagcatggcggccgtggagacgcgggtgtgcgagacagacggctgcagcagtgaggccaagctccagtgtcccacttgcatcaagctgggcatccagggctcgtacttctgctcgcaggtaggcgcccgctgccccgcggatatgccgccgctgcgggacccctcctcgcttctcccctgctggctcctcccgcccttgcggcgagtcgggacgcgctcctcctcttccccccggccgcgtttcctcctccccccacccgcgtcgccaccgccccctcctgcctcctggggtccctgggtcctcgggaaccgcgctgggctcacgcgggggcgggggcgccacccgccgcggccatgtgggctggggcggaagcgggctgtgcggggtcgcgtggccgcgctagacctccgcgttctggggccggttccccgcgctggggcgggggccgccaggtgtgcgggctgccggaggcaggtagcggcgccgggaaggagggcagcccgagcgtcgcgagcctccacatccgcagcaccggcggggctcgggtctgggcgctggaggcgccgggccgtccgtcgggtccctgcggggtggggggctgaagctacctgccgggctctgagagatgggtggcccgaggaccgtcggagtcgcagagaggaggaacgctagctagctccagccccacttctttgtgctttactaccgtgctttgacacttaagcaactttgggggtggggaagggagaggtctgtgtaattcattcttttctttcggtatataaaattattaatttacaaaactgtaagctaacgggatgagtcacctgtgactgaatttcccagagtgaaaaggacagttccattgagggttaggcgtgaatgctgtagtgtattttaagttttgtgcagtagagcaaacccagcgttgaatggggtccagactgaagcgtgtgctcgtgtttctgtttactgaagagtactagtgttgctgctgcatttcgagacccaggatgagggctgggcggcaatagtatggctcttagttacagtccaggtttagtgaagagaggcacatgaatattcaaatattaaattggtagcgtcctgtggggaggagagccggaataaagagaaggcctgattggggccctgcccttgccagttattgtgcgatcttgaattagtaaagttacttaatctttctgagttccagtgttacactgtacagaggggatgattatagctttctttgtaagtttcacaagcttcttctgagacccagattatccaaggaacgtgaaatgctgttataatgtaaagtcctttattttttaaaggattctagtacgatttaactctgccataaataaaaatatgaataagaatgaaggcagatatatgaacacaatacaaataataaaagtgttttccaacataaaacataaaaacgtaaagatataaataaatacaatctttacgtcacaatatttgtagataagcgattgcaaaaggtcttagctgtgttatacagtcttgtttttagataggatatgatccttgaccttgttagtataatttggaaaaacttgcacgtggaggagtgttgcttgatctaaaaatagcattaccgaacaatctaaaggacctgtactaggtttaacatgttgagcattactcatgttagacctagtacacgtcctttagattctttaaaattcccaaattctatcttgttgtggcctgtgtgggacctgaaattaagaaacagtgtttgcttttgacagttgtaccatctgagtagaataactttaaaagtaggtggcattttgaattaatatgtattacaatcttctgttaagattttaaaaaggtagtgtgaaaccacattcatgaaacaggtagaaagaaggtgaatcactggggtttgtggaaaaatgctagacaaatttgtgaaaacaaaacatctagggtttattccgtgtgttaggattggaggtatttacatgttggattctgcaggtatatttctggtatcactgttagacatgcactcaaatattcccagagtggctgtcccaactgtctctttttcttcatttctgttaccacctcctatggtcagcttttaaaatttcccaccaaatcagttgtcatactctcttaatttatttctctactgtaattcctccccttgcaaacaaacgcccacaaaaaaccctatcaaacaaaaccttttgtacagaagttatttttcccgcagtctgattatgcgtatccctcattgctttcaggattccagccccacattcagggcccctcttctgagcctcttgctctagccaaaggctatgtttacattctttcctttccgaagtgtcacctgtcttctgaaatcacagctgttcccccaatcccagcttgagaccttgatcaagtcactgtaacttattctaagcgctttatacatctgtgatgaaatatgggcttggctgggcatggtggctcacacctgtaatctcagcactttgggaggcctaggcgggtggatcacctgaggtcaggagtttgagaccagactgggcaacatgtcaaaaccctgtctctactaaaaatacaaaaattagctgggcgtggtggcacacgcctgtagtcccagctactcaggaggctgagacacaagaatcacttgaacctgggtggtggaggttgcagtgagccgaggttgcaccactgcactctatcctgggcaacagagcaagactccgtctcaagaaaaaaacaaaaacaaaacaaaacaaaaaaccaaaaagaagaaattagggattttccttaacacttctgtgatcactaggaggtctttctttctactgctctggtccctggcctggctgtctggccagcttgtctttgggaacaaacagaacaaaactgcaagaggcctttctatcacaccattaacagaagtaaggcattcccagttactctgtcacaccaccttgtttattcctttatgaccttttgtgcaatctatgattacctcacctgttagaaaaatgaggattttttttttttttgagacggagtttcgcttttgttgcccaggctggagtgcaatggtgcgatctcgactcaccgcaacctccgcctcccaggttcaagcagttctcctgcctcagcctcgcaagtagatggaattacaggcatgcaccaccacgctcagctaattttgtatttttagcagagatggggtttctccatgttgaggctggtctcgaactgctgacctcaggtgatccaccctccttggcctcccaaagtgctgggattacaggcgtgagccaccatgcccggccgagaatgtctgttttttagtcggaaggtgaacttcatgaatgatcctatcttgttcactgccctgttctcatttcccagtatgatgctctgtatgcagtaggtggccattaaatgtttgaattaatggataaatgcatcaaaatagagaggtatactgctgtgtttgaatcacagctccatcatttactagttatgtgacttgggcaaataacctctctttttcagctgtatctttttaaaatggggctattaataatacctatctcagggttttgatgaagactaaatccaaagtatgtaaagctcttagcatattagtaaacttaatgaatgttagctctttttattgttatactgttttatgtttaggaaagtagaaatattttatctaggatgcttaattttttttttttttttttttgagaccgagtcttgctctgtcacccaggctggagtgcagtggtgtgatctcggctcactgcaacctctgcctcccgggttcaagcgattctgctgcttcagcctccccagtagctgagattacaggtgcgcaccaccacgcctggctaatttttttgtatttttagtagagacgggctttcaccgtgttagctaggatggtctgtaactcctgacctcgtgatccgcctacctcagcctcccaaagtgctaggattacaggcatgagccactgtgccagcctaggatgtttgattttaaggaaagcttttgttctttagaggagtacaaccagttttacttgaaaattgagttttccaagagttcttgatgttcgattgtgtttattaatagaagttttccttcctatttaatagtttatgtatgtctttttcatttgtgtgtaagaattttttgaggacagagggtgtgttttactcatttttgtattttccaaagtgccttgcccacagtaggccctcatttccttacatgaaagaaaagacatcagtgggcttgcaatggaaaacaaagaaattctgtatttacattatcctttgtaaacactgaatagtatagtatattgttgatacactcatttatttgcttatggttgaatttagttacttttcagttttttagctgatgtttaactttgtgaatagcatagggcagttgctgtctcctctggttagaggatcagctgggagggacctgagtgatctgtaactatttatatttataaggcataaaaggtagtaagcatagtgtaagtggaaggagacctggattttgctcccatgaccttgggtaagtcccctcctttgcttaatgaagcatcctcttcaatggagttgagcagaaggtgactaagagagcatccagggtgcctagtagagcatatagtaaatttgggccttattgtgcatataacctcatatgtaatgttattaaaatcagtaccaaggaaggcttaaaaatctttgaggggaaatgttacttgtttatgaacatttttgacaaatccaataataggttctttaaaagaagtggtaggtaacatgattaactgaatccaggaagaaagtcttttttttttttttttttaaataacaagacagtttttcttctctctctctctttttttttttttgagttgggatcttactctgtcaacccaaggttgaagtgcagtggcgtgatcttggttcactgcaaccttcacctcccaggctcaagtgatcctcctacctcagcctcccaggtagctgggaacaccagtttgagccaccacacctggctaattttttgtgtttttggtagagacggggtttcaccgtgttgcccaggctggtcttgaatttctgagttccactttgcctcagcctcccaaagtgttgtctatacaggtgtgagccactgcacctggctggaagaaagtcttgttgagcatcttgtaggttggagttagaaggtagagaaggaattgccgttataacatgcagtatctttgaaatgcaaccctgccctctgaaactttctctgtcagtaacaacattcctgccagtgcagggtgtttctggaattcatcttcattaaaggagatattatcatgttgtgcgtttttatttatagggattttctttaaattcctcatgtcacttcagaccacccttaaacactcctgtaagttagctgagtttaggtacaaatgccatagcttcttataagcaaaaagataggatgaggtaaagagaaattatgagtctttttaaaacaaaacaaaaataatttcataaattgtttattgtagaaaaatagaaaatatgtgtgaagataatcaattacccagagatgatttctatgaaattttggtgtgtattcttaagaacatatttgcgtatttattcatgtgcacacagttgtgtatgtttttacaaaaatggcaaccataatacatataatcttagagaattttctcatccttaatgtcttaaccagtgttttggtagtgtcatgtcatggctacatttacatgatcctttataaagactgttatgggtgtactgtcatttgtttattcacttatagttgaatttaatttcttttcaattttttaccttctgtttactcttcaataaatattcctcgaaaatttaaatcattttgacttactcaggaacgtataataatggtacaggatttggtacatgaacccagaattgaactatcctaagctaattctatatccttttccagaacagtggttctcacagtgtagttagtggattattgttggtttgagggccttctggtcatctatgaagttttggcatgaaatatacctacattacagtagaatttgtaaaacaacaacaacaaaaaaacgagcatcatttggttggtaggcaatcaaaagttataccagtctttgagttacctttttggaaattgaagtgctataggaaatgtgatcttatactgttcacttagtttgtggattgaaatcaagttttagtcatggttttttaaggtgaatctttttcatgtttagcatatttgcaaaattttagttaagttttagtaaatttcataggagtgacagacataagtgcatagctaagctcattccagctctagatattcggaagaaaagcagtggcacggtaactccttctgtaattgtctttggtattactgcaatagcaaacacttttagatagatattaaataggcagaaatactttataaagcaaccgttgagcttcattctgtatcaaatgtttaatgtaatggaatataaatgtaattacaaccctttgtgcttgatcctgaacttcgcctgacctcacagttttaacatgaagcattcttttattcatgcttgggcaggtagtgctcccagctcaacaattataagtcttttcctttgatttccttgattggtatcagtcttgtctctgggtttgaataaagagcaattcaaaacactctgtaaacgaggcctgcctttctcattgtgtgtgcatgtgtgtgtggggcaccttatggatgaaactaggatagggaccccatggaacttctcatgctttgtaagttgtaaataagttctctcctgtttttatctccagtaacctgacttattgcaaggctcagtaaagatttcttcctgatacaccagagctgtgccatgtctgttggaaagcatttctaaaaaccctgttaaggccaggcgccgtggcttatgcctgtaatcccagcactttgggaggctgaggcgggcagatatcttgctacgagatcagcctggtcaacatggggaaaccccgtttctactgaaaatacaaaaattagctgggtggtgatggtgcatgcctgtaatcccagctactactcaggaggctgaggcacaagaatctcttgaacctgagaggtggagtttcagtgagctgagattgcgccactgcactccagcctgggcaacagaataagactgtctcaaaaacaaacaaacaaacaaaaaacaacaaaccaagaaaagcccctgttaattggggtctgctatctgctaatgtggcatttatctgggtcacaggctcaagcctttaaagagtggttaggatataaatgataagtgaaattgtaactttagcaacttcccttatcattataaagtgggaggcaacagagacttctctgtgttttgaatgtgtgtttaatgattcttctgtgatttaagtacaaaacgcaaaccaatctttgcatcacattctgaaggttaaccctgtcttatccagcaagttacaggcttagtcgttcaataaaataggtaaatgtaagttccgttaggttttaaaaatgtcataacttttttttgtcttctgagtggggatttatgttattactgattatttcactaactggtaatagggatgggattgactattagaatactgttaacttctcactccactaaacaaatgatagagaaaaatgtgaatgttgttacatgaataatttaatattgcttttgaattaaagttttaaggaccataaagtcaggatctgtcgatgtatgttttctaaattgtttttgatattgagtagaataaaaatattagtaaatgtttgggaaaaaaactcaaacttttttccctctgttctcataccacaacagtcatcaacacagatgatttctgtaaccaaacctatgggggtttctcctcaccaccaagcgagcaatcatttctgcagtggacaccaactgggtgtcctttagttcatttcctacactgtttgactggatatagtgtcagatcccagagatagagggcttagtcctcgaagctgcccctttcccaccctgttcagacaccagtcacgagtttgggcctccggaacttaaaacttgactggcttcaagttggggttctcatggctccccctctttgggtttggttaatttgctagagcagctcacagaactcaggaaaatacttattttactagtttattataaaggatattgcagaggatacagatgaagagatgcatagggcaaggtattggggaagggatgccaagcttccatgagttcagtgttcagctagctatttggaaactctctgaacccaatcctcttgggtttttatggaatcttcattccttcagggtatatggggtgggaccctctctggaatgagagtcttatgacccacatcacaaaggtgggggttagacacttgccttcaggtagggtgaaaggaagagagcaggagaaggttggagagagtctgtttcctgaggcctaaagcacccaacactataacgagactgcaacaaggctaggggagttattagccaaggaactgtggacagatacacacacacacacacacacacacacacacacacacatacacacacacacacacacacacacacacaaaataacacagcaaatcatccacgggatctaaagaagcatgatacagtaaatgcctatatacctaccatctaacttattaaaaagaacattaccaggaaaacaagtgaaaacagaaggctcctttttctttgtccctcatccaagaggtattccatatcctgaattttgtgtttatcattcatttgcatttccatgtttgatttcttaaaaaatgtatttttaatgtttttgaaattttttttaccaacaaaatgattacatgtattcttttacaacatgcgtttttttgtttgtcattatgttcctgagatttatccatgtttcattgtagctctggttcattttcattgttttcactgctatgtgatattccaataaattaatatatcataacttttacattcttctgtcaatggaaatttgggttgttacggtttttctattataaatagtcctcctctagacattcttgtgcctgattcttggtgcctgtttgtaaaaatttctcttgggtatacccctaaggagtaaattttttgggtcataggatatgtgtttagctttactttgatgataccagattgttttccaaagtggttgtacttcaaaataaataattgggacataattaaagtaaaaagcttctgcacagcaaaaataataataataatcacagtaaacagacaacctgtagggagaaaatatttgcaaactatgcatctgacaaaggactaatacccagaatctacaaggaactcaaacaaatcagcaagaaaaaaaaatcaaataatctcatcaaaaagtgggcaaatgacctaaatagaattttctcaaaagaagatatggccaacaaacatatgaaaaaatgctcaatgtcactaatcatcagggaaatgcaaattaaaaccacaatgagataccaccttactccagccagaatggccattactaaaaagtcaaagaacaatagatgttggcatggatgtgatgaaaagggaatacttaaacactgctggtgggaatgtaatttagtacaaccactgtagaaaccactgggtatctatccaaaggaagagaagtcattatataaaaagacacctgtatatgtatgtttatcgcagcacatttcacaattgcaaagatagggaaccaacctaagtgtcagctgatgagtggataaagcaaatttgatatatatacatcatgaaatactccccagccattaaaaaaagaatgaaataatatcttttgcagcaacgtggaaggaaccagaggctgttattctaagtgaagtaactctggaatggaaaaccaagtaccaggtcgtctcgcttacaagtaggagctaagctgtgggtactcaaagacattcggagtggtataatggactttggagactcagaaagggggagggctggctgagggtgagggataagaaactacatatttagtacaatgtacatactaggatgactgcactaaaatctcagactttagcattaaacaaaaaacaaaaatggtggtacttatagagagtttatgttgtttcatatgctagctaggacttgttgttaacagactttttatttttgccagtctggagttgtgtattactcatgaacagcagtgttcactgggctatttgcatcagtacacttgcaaaaatttaaaagggtttaactgtcttcaaggggcttatgctattcttgtatagacaagaagtactggaaaaaagataaataacagggaagtgctagtgaatgttatagacaaggaactatgttttccttgaattttttataattttactgagtttctctagctttttactgtgacaaatttcaaacaaatagaaaagtttaaagaagaatatagtataattgcagtatactcttcacctaagttaacattttgctgtatttgttttatttatgtgtgcttgtatgtgtattgggtgtgtgtgtatatgtgtatttgttgaaatattttgggaataagacacagaaaacacgacactgaatctattaaatattcagcaaacattttctaatgacaagggcattcttaactataatactattattacacctaagaagattaacaagaattctctgatttcatctaataggccaatcttacttaaatttctcaattatctcccaaatgtcatccataaaagcttttttgtttgttttgctttttgattatagactcaggaacctatcaaagctcacatatagcatttggctgtcatgtctcttaatttagaatagtcctcatcttattttcatgatactagcttcttgaagaggctagtcagttgtcttgtagaatgttacacatttttgattaactgtttcctcaaagtgtctttaagttgttcttttgtcccctgtagtttctgtaagccagaaatcaagcccaactgctgttagatttgtgaaacactttttttttttttttgagacggtctcattctgttgcccaggctacagtgcagtggtgtgatcatggctcactacagcctcaacctcctgagctcaagtgatgctcccgccttggcctcctgagtagctgggaccataggcatgccaccatgcctggctaatttttgtactttttgtagagatggagatctccctatgttgcccgggctgctgtctcactcctgggctcaagtgatctgcttgcctcggcctcccaaagtactgggattacaggtgtgagccactgcacctgaccgtgaaacgctgttgacaagactcataggtgatgttatccacttcacatttcatcacatcaggaggcacagagtggctggtggttctgttcctagcagatcaccattgattgcacaggtacttttttttaacctcacaattggcatttaatctgtgggatgatattctggcacttggagagtatgcattttctcaacaatctttctctgagtggttttagcattgcgatgatccttacctgataattatttcagtggaggttgcaaatggtgattttctccctaagtctgtcattcaatagctgatctttttttttttttctgtaaggtagagttttccctcatcaactggtaaatgaactacgttccaccattcctaccaagaagatagaaatggttgtgtactgggcactaaccagtagttgcaaatgtttgttgttttcaattaggagctttggattgttttctttttcatgttcaaattgtctcaaatttgattagtgttatcacctttaaagtggcttctatatccttttgagtctcctccattactctctgattgcttcctagctctctggcatatgataaaacacattccctaatactttcccagccccagatctgcaatcagtcttgtttctaagcagccctggtttctggcaggaatgtttttagaaatctacatctgagtgctaggtatgcttcctcctgtaatgtccttgcctttagaagaaggggtagtgacatcttcaaggaatattgctcatgtggaggacacagataaaacagctaaagaacagtttttaaaagcagcacactaagtagctgaacaatgtactaggtaaagacaggctttgaaacgcctcatgaaggagttaagaactgaattttgataaataggtgtgaaaatcaaatagaggagtaggtaaataaaatggtatatattaaggtgaaggagaggacattctctgcagggaaaggatgtgtttatggaagtaggagcaagctgaggcatgtaggtaatagcaagtagattagcagctttactttaaggaagagtccaagtacagaaatataaggaaatgaaatgatcgttagtagggatagagaccttgctgttcagttgaatatttttttccaaaatgtaaatatttcctgttaaatatattgttataaaaaggagtacatgatctttgcagaaatttaaaacagaagtgtgttaggtgaaaactatcataattctagcatcctaaaaccaaagcattgtttggtttcttatctttccagatttttacatatgtactatatacaggttaagaacatggatgctgtcttaagagggcctgcattcaaaacttggacttgtcattaattacccctgtgttttttggacatgttaatctgtgcctcagctttctcatctgtaaaatgagatatctgtgataatagtacctatgtcttggtagtggtgtgaggattaattctctgcctaatcagtgcttggtatgtagtaaaatctcaaatgttagctgctgttttttatctttcaaaataaaatagaattgttgctctgcattatatacacctatacagttttgtaatttaccattttttacatatctttaaaaaatttgttataaaaaacatttaattttactgtcttaattatttttatgtgtatagttcagtagtgttaagcatatttatgttgtgaaacagatctctagaacgttttcattttgcagaactgaactccatagccctataacagcaactctcctttgtcctgtttcccaaacccctggtaactactattctactttctgtaggaatttgactactttagacatttcatataagtcagattacacaatatttgttcttttgtgactggctgatttcacttaatgccctgaaagttccttcatgttgtacccgtcacaggatttcctttgtaaggctgcatagtatttcattttatgtgtaccgcatgttgtgtttatccattcttctcttgatggacatttgggttgtctctacctcttggttattgtaaatagtgcttatgaacacgagcgtgcaaatatttccttgagaccctgctttcagttcttttggatctatactcagaagtgggattgctggatcacacgattatttgtttttagttttttgaggagcagtcattctgttttctatagtagttggattgttctacaattccaacacaatgtacaagggttctgatttctccatatccccaccaacatttgttcttttctgttttgtttttttcatagtagtcatcctaatgggtatgagctgatacttcatagagattttgatttgcacttttctgatgattagtgatgttgagcacgtttcatatgcctgttggctagtatatatcatctttggagaaatgtctgcttaagtcttttgcccattttaaaaattgggttaattcattttttgatattatgttgtaagagtcttaaaatataatctagatgtcaacccattaccaggtatgttatttgcaaatcttttctcctattccataggttaccttttactctgttgattgtgtcctttgatgaacaaaagttttttaagtttgagtagtctcatctgtctgtttttgctttaattgcctgtgcttttggtgttatctccaaacaatcattgcctagtccattgtcacaaagtatttccccatttcccttatgttttcatctaggagttttatagttttgggtctcatgttcaggtctttaatctcttttgagttaatttttatatatggttaagataagggcacaactttattctttggcatttggatccagttttcccaacagtgtttattgaagagactattctttgcctgttggcacccttgtcaaaaatcatctgaggccaggtgtggtgcctcacacctgtaatccctgcactttgggaggctgaaactggaggattgcttgagcccaggaattcgaaaccagtttgggcaagatggtgaaaccctttctctacaaagaatacaaaaattagccaggcgtgttggcatgcgcctgtagtgccaactacttgggaggctgaggcaggaggaccccttgagccctaaagagtttgaggtggcagtgagctatgattgtgccactgcactccagcttaggtgacgaggtgagaccccatctttaaaaaacaaaaacctcccaaaaaacacacatgaccaaatacacaaggatttatttctggattctgttccatttgtctgtgtatctgtttttatgccagtattacaccattttcattactgtagctctggtatgttttgatatcaggaagtgtgagtcttccaaatttgctctttttcagaattgttttggctatttgggtcccttgagatttcatatgaattttagaatttttttcaatttctgcaaaatatgccattgggatttggtgaggattgcattgaatctgtaaactgctttgggtaatattgatatcttaaccttatcgttttcagatacatgaacatgggatgtctctctatttgtgttgcctttacttgcttttggcaacgtgttgtagtttgcattatacaagtcttttaacctccttagtttaggtttatttctaggtattttatttttaatggaaatttatttttaaatggaattgttccttaatttatcttaaaattattcattgttagtgtatagaaatgcaactgatttttatgttgattatcctgcaactttagtttattagctctaacagttttttttttaatgaaatctttaaggttttctacatgtataagatcatgtcatctgtgaacagagataattttacttcttcctttttaatttggatgccttttatttctttttcttgcctaattgctctggctaggacttccaatacaatgttgaatagaagtgatgagagctggcatctttatcttgttcctggactcagatgaaaagctttctgtctttcaccattgagtttgatgttagttatgggcgtcttatatatgagctttgttatgttgaggtaattttcatgtattcctagtttgttgagtgtctttattttgaaggagtatcagatcttgtcagatggtttttctgaatcaattgagatgattatgtgatttttatccttcattctgttaatgtgatgtattaaattgatttttgtttttgaatattcttgcattcctggaataaattccacttggtcatggtgtatagtcctttcagtgtgctattgaatttatttgttagtgttttgttcaagattttgcatcaatatttataagggatactggtctttagtctttatctggctttggtataagggtaatggtggtttcaaagtatgagcttgggctgggcgtggtggctgatgcctgtaatcccagcactttgggaggctgaggcaggcggatcacctgaggttgggagttcgagaccaccctgaccaacatggagaaatgccatctctactaaaaatacaaaattagccaggcgtggtggcatatgcctgtaatcccagctactcgagaggctgaggcaggagaattgcttgaacctaggaggcggaggttgcggtgagcagagatcgctccatttcactccagcctgggcaacaagagtgaaactccatctcaaaaaacaaaacaaaacaaaacaaaacaaaatgagcttggaagttttctctcctcctttttagttattgagtcttatctcttttcttcggtagtctagctaagggttggccactttcttttcattgtttttatttttttgggtaaagatggggtcttgctgtgttgtccaggccggtcttgcattcctggcctcaggcagtccttcccacctcagtcttccttattgcctattaatttctaatatttattatttccttctgttagccttaggttttatcttttcttctttttctagttcttgaggtaaaagtcgggttgttaatgtgagttttttttttttttttttcaagacagtgtctcgctctgtcacccaggctggagtgaggtggcacaatcttggcttactgcaacctttgcctcctggattcaagtgattctcttgcctcagcctctcgagtagctgcactgacttacaggtgcctgccaccacgcccggctaatttttgtatttttagtagagacagggtttcaccatgttggccaggctagtctcgaactgctgacgtcaggtgatctgccccgcttggcctcccaaagtgctgggattacaggcatgagccaccacacccggccgaggtgtttcttttttagtgtatatgtttacagctgtagactttccttttaaaacatctttggctgtatcccataaagttttttttttttttttttttttttttaaagatttaaagaggtttattctgagccaaataagagcgaccaaggtctgtgacacagcctcaggagttcttgaaaacatgtacccaaggtggttgggttacagcttgattttatacattttagggggacagaagttacaggcagacattaatctgtacatgtaaggtgtgcactagtttggtccgcaaaggtgggacaacttgaagtggggtcttccaggtcataggtgggttcaaagattttctgattagcagttggttgaaagaggcaacttattatctaggggactggaattaatagaaaggagtgtctggattaaaataagggattgtgaagaccaaggttcttactatgcatcccgtaagttttgcatactaaatgtttttgtttttatttgtgttgaagttcccttgtgactttttctttgacacattggattgagagtatgtttcatttccacatatttgtggatttttcacatttctaacttacctatttttttaaaacctaagacattgtagacttctttgcacatgtaagattaatttcattacttctttcttttatgaaaatatttttattttctataaatacatttggaagaaattatttcttcccaacccagtccaccccattaactgtcagttttttctactaaaaaagatgctaataccaccctcacctgtgactgctaaacagaaaaatattgcctggactaggcattattcccctagttggaaataaaggctgttgggcatgggagtttgatcttgtaaagaaatcaacactgagacaaaggatctcttagcaaggctggtttactttctgccaaaagggtgcactcaccagcagtccagccacgagagcacaccaaacaaaggagacggggacatttataacctttacatcctgatgcaatcccctatggctgtgtcccgttcccattggctgggatgggacctcacactctaaacttaactggattggttaataatttaaaactttcctaaataggacgaagggaaaaaggacaaagaaaagaggaagttagtgatgagaggtcagaggggttcccaaataaggaatggcatgtatcctgatctgggactcatttagccttatctcaacctactggaacaagctggagcagccttggaatacacacatcctaacatttaaccggggaatgataaatctgtatggatttaagaaactttgaggaacttctccattcctttcaattccctcctctttttgttttataattcttcaaacttgtctagcaagtctctgctttgttgtttggcttgatcccctaataaaagcaacctttccgaatagggtgggggagaggcagaggatagattattaagggttgtactgatgagcctttgtacaagccgtcgaatacagggtatgacacaacatccaataagtagaagtatacctaacacagttatagaggaagtgaggattgaggttaagatatctttccaatttccaaatcagttttctagccagctagagatgggttatttatgccagagttcttagctagcttgtttgataaagcagtaagtccctctagggctcttgttatacttctatctggggctgtgttatttggaatgaacgtgcagtattgggtcttaatcattacgcaaacaccacctttctcagctagcatcatatcaagagtgattctgttatcctgtgtcatttggctagtagatcttaattcatctgcaattcccctgaccactttggtgtagttaactaatcattgttgattatagtaaatatagtttatccagtctacatttttgtttatcgtgacccaccaaaataacgttgactcgagtctagcagctatctgatctctggccttaaattcatcaggaaccccccttgcaacacctgtcgcatctaggtggatatgaggatcaaaggatctgtaaggagctcttgtagtgtgttggtggtggggtgtttcctatttttgttgatgaaatgccagggtaaaagggatagccaattggactagagtgcaagtaccattccagttatatggcagagtatccagtaagtgccccccgacattaccaccatatgtcccactcaaggatggctgatggaggcctcatgggttagctcttagaagtgccttacctccctgcatcctgtgaaatttccaaggaatattgagttctcctcctgctgtgagaggcatgaggcaaactctgccctggaagatggaggctgaatggccctcgggggctgaccctcagggtgttgtacttcaggatatagcagagagagagcttggcaagattcatcattccaggctgtagaatcttgaaagagagctaccacacactccaaatccgtcgcatgtgaagaacacttaagtggaaaggggacaatctgggcctctggcttaccgtgtgcacaagtgtaacagtcgcttttgtttagagtgtggacagaatatttaatccgttttaaccaggcatttgcatcttgataccctgtctcaatagcttaagtctgctttaagtcatttacttgtactactgatgcttttgtcttatcatttagtaaaggactaattgggataatagaagtttgatttaaagccgagactactggggttggagaagggaaaggaggaagagggagaaggcgtatttcaaacctccctatcggatccttcccctttgacatttgcccaataccgtagagatggccgatagctggctgattatctatattagaattaagaatagggttacactgataaagcttacaatcaggggaaatgcttccttatgtgaaataaagattaggcctaagctcagtacaaacccctcctgtagaggtccagcctctgtattgagtggtccatagaacattattccaactgctgcaaggctgccattcggtgggaatgaagaagcggcgtcttggctttaattgatcgcatctatgggagtgagagactgttagattaaatgggggaccaggacatagatatttttctgaagaggctagttgcctttggttatgtaggtccccgcatggcatcactagacaagcatcaaaggatatcacttgagatgattccaatctagttatgttaataataaaatgagagatagtgagaggaaagaaagaaaaatagaaataaaggtatgttaggttcttcttaattttaacttggtgggacttggctcggggaccacaatccaggattctgagggtgtcgacgctttcttgactcgagtgtgatgggtccaccccttctcggcagtgcgaactgcggtttcgatggtcaataacatgaggtaggatccttcccaggctggctcgagccttccttccttccatccctttatgaagacgtggtctccaggctgatgcgattgtactgggaattccaagggtggtgcttgtgctaaaagacctttggttttaagggaagaaaaagtagaggagagtccaaatatgttatttctaaggaactgatctttggtttcaaaggtaggcacatcagctgaggaatgtaagtaaggcaatccatataacatttcatagggggatgaacctgtatctcttcggggagctgtcctgattctgaataaagcaatagggaggcatttggtccatcgtagatgagtctctaaaatttagttagatgacttgtctgattcattctttctactctcctggaggaggaggggtgccaccgaatgtggtattcccattctatgtccagcacctgggccagttttatcataatgtgtgccgtaaagtgggtcccattatctgagtcaacattttctattaatccaaacctgggtataatatgttcaattaaggccgtcactatattactggcagtggcctttgagaaaggagtggcctctacccaatgagtgatgtggtctactatcactaataggtattttagcctactggcagcatttcaatataatcaacttgaacactttggaatggtcttagcctaggtgttcttcatcctagaggtagtttctttagggtctgcttattagttttcttacagataatgcagctgtcagtgacctgtctggccagggtgtagatcccagtacatccatagactgaggacagcgtcacatagggcctgagggccccagcatgttccttggtgtaagtgggacagaacttctttcataaggggtttggagagcatctctctctgatctgggagaatccatctcccttctgtattttctttagcccacatttcgcttagtttttccttttaggctgaagagaaaataggagctaatttgggggagaggagggagggagttagatgaaatatttgtttcacagccattgctgctcttttggctacctgatctgcaagattattacctcgactttcaaatgaaaagtcatgctggtgtccagggacatgtacaatagctatttctcctggtagctggagattatttaaaacacaagtcactaatgactcatgagcaagcttttggccttggctgttcatcaggcctctgtctgccccaatttttccaaatgtatgcgctaccccaaaagcatacttacagcctgtataagtgttcctatctcattttctggatatttaagggcctgactgagagcaaatagttcacagccttcggcggaatagttatcaggtaattgccccgattcagtttcctcaagagtttctccatccaccacagcatatccactgtgcctgtctccatcaaacatccgagaggacccatctaggaacaaatgttgtcttgttttataaggggtttcagataggtctggtcataccttggtatcataattaaatctagatacaaatgttctgtttgcagcaatggattccctcttaagaatccggcagggtcaagtgaactatcagtggttatagttagataatctctttctaataggatagcctcatactttaaaatcctagaatcagtcagccatctttccgctttttgatttaggatgacattgaccttatggggtgtacttactgttaagtatcccccaaaggtaatctttctgctttcttccactaatatggcattggctgccacagactggatgcactggggacagccactggcaactggatctaagactttggacagaaaggcaactggttgccggtggtctccatgttgttgagtgagtactccaagggccactccattgtctgtgctaacaaaaagatgaaagggtttttctaaagaaggcagggctaaaacaggggcagatattaatcatgcttttaattcatttatttggtctacttcatcagaagtccttataagtgggtctggcctatttttagttaatttctcataaagcaatttacttcttaatgcataagaatcaatccataatctacagtatccagtcaatcccagaaataagttcctgttttgtttgaggcaggggcaaggagacatttccctcgacctgttcaggtcctattctccttttggccgtgctaattagatgacctaaatgtctaacttctgtttctacatattggagctcttctttggagacccgcagtcccttagagtataaatgattcaggaagtacacagagtattcacttactttttctatatcttctccagatataagtatgtcatccatatataggattaattgtaaatgtggtggagtgtctgtctttctaataatcctatctagagcatgagtaaaaatattcagtgaatcctcaaatcctggggcaatactatccaccggtactgctgcttctgtcctgtatgggggtcctcccatttgaatgtgaatagatcttggctgtcctcagccaaaggacgtgcccagaaagcatcctttaagtctattacagtaaaccattgatgactttacagaattttactaaggttaatatatggatttgtcatagtagcgtgagtggtttgaactatttcatttatagctctgagatcttgtactaataggtaggatccatcaggcttcctgacaggtaggataagggtattatacggagacatgcaaggctctaaaagtccatctttaataaggccttcaatcacaggttttagtcctacccggccttccagggagatcgggtattactttctccgggctactcccccttggaacctttaaatgtatttgtatcaggggaatccgtaactcccttgctttccttctcttgaccataaatccggatgaattttcctctcatcaacagtagttagcaggtggagagagggaaggaacccctttggccctacttgcagtccaagacctaactttagcattaagtctcttcctaacaaattagtgcctgcttcaggaattaatggaaattgaatattagctgcctcatttttgtatctgacttctatatcttctaggattttggccttaaacctctcttctttcaccccagataatagtagctcttctggagaacagctgaggccacttggagaaaagcgtaaggaagaacaagtagctccagaatcaatgaggaatgttattagttaatggtttggtcccacctccaaatttatcaagggctcttgatgggactcaaggtggaaaagaaagagcccctgactcacgtattcttcctctctgaaggttggcatgagaggaggaatttcctctgtggcctttaggtcagggcattctctcttaaaatggcctgtttttccacatttataatacctatcttgtcccccttcttgttctattctggagatcctttgttttagtttctcttcatctgctctacatctccaccctttatgacatatgctgtggtcttctcatgttccatttcaacctcgacccctgcctctctgtgagatggcacccctggacactggtcaaaatctcatcccaggtatatttggtcctagtgaaatctgccaaaaaatttttgccttttgtttttgtctgtcttcatccttctcatgtatgctttctctgctgctgctaaaagttcttcaattgactgatttttccacctctctatcttttgtagcttcctcgcgatacctggccaactattggtaacaaaatgtaattttaacataccttgtcctagtggactgtcaggatctaaatcagcataccttcttatctgctcccttagtctaaaaagtgcataggtccctcatctttctcttgttgttcatcaaaggccttagtgaggttttggggtctgggtgcagactccttgataccttttataattaattcttgtagatccctcatattcttctggtgagcagcattattattattccattgtgggtcccgagcaggaaatgtaacatccgctgccggaatattttgaccggcagggtaatcacgttcccaggcccccatagcagctctgcagatcatgttccgctcttcctttgaaaagaggatacccaggattgacattaattcagtccaagtatatagtttggaacctaaaaactggtcaatttgctctgctactctctctgggtcatctagcaaaggcttaagctctttctttagacctcggacttcagaggtggttaaaggggcgttcatgaatccagttgtacccctaccctgtggcacctccattagagggaagagctgagaagccagctcttcggaagcgcagggaaagggaaaattttgaatatcccttctacattgttctatctctctctgaagccctctttttaaggagatatcagagacttctgcctccggagcctgaggaggaggaggcgggactaccacctgaggaggaggtgggactaactgctgcctgaggaggaggaggcgggactagaaaaggaggaagatggtttaggggatcccactggatattctctttttaccctcctccatcccttgcttcagatcccttaggggataaagagaaactggccccagctgccagcacatggcatagtgtatctcttctgaagacatacaacttttgctattaacatacagtattagaagctggcagacccagtcttcattcgagccatattttggccagaaaacagcaggttttaaaattggctcttgggtccacagaaagcaacaatacttgatcattagttgctttttcttatatttagtcctttcattttctttccagtgtgtaagcataagtcctaaaggactatcaggagggattcagtctttcttgcctccttcatctctggccttgtttccagttgcaggcctactagaagtattccccatgttgggtgagactttttcccagtagactcaatcccccagatcctccagctcagggatatcttgtctgctcaaatgtatttactccttttccctggggattagccttcccctttttagtgttagtttcttattgcctgtattctcagttccctggagataactttctcccctctgttccctgttctgaagataatccacattcctcttacagtcactttctctcaaccacagtcattcactcacatacatcacacaacccttcaaggaaggaccaccaaagaagtactttgccaccctctagcagtttttcctaccttggctcatgcacgaggtctcctggtcccgcggttttaaaagtctccttgtcccctgcattgctgagaatccagatgtattcctcttactgggtgagccctggctatctccctggggctgctgcagcagggcagctgggtgcctccccacaagagagggccaaggactggaggggaaacagtgtccccatacgagccacaaaattgatgggcacgggaatttgatgttgtaaagaaatcaacaccgagacaaaggatctctcagcaaggctagtttactttctgcagaaagggtacactcaccagcagtccagccacgagagcacaccaaacaaaggagacagggacatttataacctttacatcctgacacaatcccctatggctgtgtcccgttcccattggctgggatgggacctcacactctaaacttaactgggttgggtaataatttaaaactttcctaaataggaagaagggaaaaaggacaaagaaaagaggaagttagtgatgagaggtcagaggggttcccaaataaggaatggcatgtatcctaatctgggactcatttagccttatctcaacctactggaacaagttggagcagcctgggaatatacacatcctaacatttaaccggggaatgataaatcctttatggatttaagaaactttgtagaagaacttcttcatgccttacaaggcccttcctgggggcaggaagtgagattccaagaggaccctatagcagtaggcaaccaagagtcaaaacaagcatatgcagtagtcataatcatgctagtatgacagtatgaattagccaggcatatataggagtttagatgggggaatagtggaagcccacaaaacttccacgtttgggccctcaccagagacactggtctagaaacacaataaaatgtctgcctgggtagtcatgatcattctattatgaggtagacaggaaacagagcagggccaggagatggaaggggcctcccttgccctcaggagtccctgaccagggaagatccctccatgctctctgagggtggcggggctccaaagatcctggccaggagtgctttgttggagtgggccttgtcctaggcagttgccaggtgagcccattcacaccctactggctgtgctgctttccgggccctcagttcctgctcagtaggacgttgggcaaatgtccaggagccatctgggtgagcaagatccccatcaacagcaagaaagcattgtccccattccacactttgaagatagaagatggtctcacacttggcctgagtgacctccactctcaggtgctgcctgtgtgcacacctggcgctcaaaggcaaggtgctcgctgtggtgggaccaggtgaaatggtgcaagtacttgagattccataggtcataatgggaggggctgcacctgtgggtacccataggcgtgttgtgtagactggccgccacactcttggctatgcgcttgtcacggaactccacccatccctctgtgtagtccttgctgtggtactgcttttttccctcccacggctgctgctgccttctttttgcatctcacaaaccagtcctcagcctgaaagaacgcatctgacctcaccataggcactgagaaggttgcggacatgtaggggctggaagtgtggtgggatatggcccaggtacacaatacctggcactacccgcttcttgctgccacaggctgctgctttggattcctcctgctcctcctccacatctagtgtctggtctgtcccttccagcgcctttgctctgttgcggccttctccgattcctctgcctccgtgttgactgacacgagcagcacgacctaatttcattacttctaatgactgcatagattcatttgcatggttaaatcacaatttaacctattttatattgatgtatatctaaattctctttttcacaatagtaagtaatgctatagtgagcattaagttgcatatgttttgctcgtttgtcagattatttcctttggttaactatttggaattgagctactgggtcaaagtatttttttttgtctttgcatatgtgtttatatattaagtatttgtaagtatttatatatatgttatatcttgatacatacaaatccttttagttaccaggtgactactcagcattctttctaacattgtatggtgtgcttatttgctcacactctcatcaacatgaattgatgttagatttgagatggtggaaaagagagagaggtaatacaggatcttaaggtaataggacacattatgggtggtcacattatgaaaaccatttaatgttaattctagccactactttaggatggtttggaataggaaagaatttgagagaggttcaagatggggagatatgttgtgaagccgttgtagtttggcaagtcagtggggcctaaaataaggtgggagttagttgcactggttaatttgatagatactaaagtagtgtaaccatacaatgggttcatcttgcttgctgcctagacagagctgattatcaagacaagggaattgcagtagagaaagagttacttattcatgcagagccagctgtgtgggagatgggagttttattactcaaatcagtctcctcgagcgtttgggtaagggaggagactactcctcatattgtcttatgcccaatttctgcctccaaagaaagaagtaaaaactaaaaggcagaaatgaaatctacaagcccacagcccggcgccacgccctgggcctggtagttaaagatcaacccctgacctaactggttatgttatctacagattccagacattgtatggaaaagcatcgtaaaaatccctgtcctgttctgttgtgttctgattatcggtacatgcagcccccagtcacgtaccccctgcttgctcaattgatcatgaccctctcacgcggacccccttagagttgtgagcctttaaaagagacaggaattgctcacttggagagctcggctcttgagacaggagtcttgccgatgttcctggccaaataaaccccttccttctttaacttggtgtctgaggggttttgtctgtggctcttcctgctacaaggggatcagagtttttacggataatttggttggggggtgggcagtgagttgggagtactgattggttgggtcggagatgaaatcatagagagtcaaagctgtcctcttgtgccgagtcagttcctgggtgggggccacaagaccacatgagccagtttactgatctgggtgatggcagctgatccatcaagtgcagagtctgcaaaatatttcaagcactgatcttaggttttacaatagtgttgttatccccaggggcgatttggggagggtcagaatcttgtagcctccagctgcatgactcctgaaacataatttctaatcttttggctaatttgttagtcccacaaaggcagtctggtctccaggaagaagggtttggtttgtgaaagagctgttattgtctttgttttaagtggttcctaacctgtttggcaccagggaaaagttttgtgaaagacaatttttccatggacttgggggtggtggggatatggtttcaggatgaaactgttctacctcagatcttcgagaattagttagattctcacaaggagtgtgcaacctggctccttgcatgtgcagttcaaaatagagtttgtgcgctcctatgagaatctaatgccactgctgatctgacaggaggtggagctcaggctccacccggtaatgcggtaataatgccagcccatctgctgctcacctcctgctgtgtgggctggttcctaacaggccactgaccagtagcagtccatggcctggggtttggggacccctgttttaaactataaactaagtttttcccaaagttagtttggcctgtgcccaggaatgaacaagtttggcctatgcctaggaatgaacaaggacagcttggaggttagaagcaagacagagttggttaggtcagatctctttcactgtttgagttataattttgcagtagcgatttcagtaggaaataacttgttctagaagtgaaatgagagcaccttctcttaactctgactcttttcagtgattcacagtactggaaataaataagaattacctacatagcaaattcccagagattctgattgaatttgaagtggggaataacatggctatttatttgtaaagaaaagcatttcacaggattttaatgaggagccagagctgagaaccacactatcccattttagcttgtaaaccaaaaaaataaaatttgaactgccaaccaccctggcccccagcaaccatctgaatggactctccctccttggccagggcactctaacctgaaagactggttcaggccatgactggaagtgggatttggacgtgcctcattatacccttccagcattagcatcaacacagagcttgagtctgataagaaatatttacagtctattttctctgaagcctgttatgttacctggaggcttcatctgcatggtaaaaaccttggtctccacaaccccttgtcttaacccagacattcctttctacagataataacactttcaaccaattgccagtcagaatatgtttaaatctacctgtcacctggaaggctccttccccacttttgagttgtcccacccttccagatggaaccagttaagtcttacatgtattgattgatgtattatgtctccctaaaatgcataaaagcaaactgtaccctggccaccttgggcacatgttgtcagtactccctgaggctgtcactggtgcatccttaactttggcaaaataaactttctaaagtgactgagacctgtctcagatattttgggttcataagctcctaaatttagtaaattcctgttggtgctaaagaaaaaagcatgttgtcttggattgaaaactaaagttttacctactagttataataatgctttggtgttattaaataagtggagaataaagtagtaaaacaaagtgctgttcagcgagtattgaataagtacatgtgacatgttaagcttgtgtgtggagtgaagtgtggacattttttagagaaagtagcatttgaaacgacctaatggaatgggtaaagcttctgaggacgtagttataacggtgagtgttaggattaggtaggtcaggttatacaaagggaagagattgggaagtgtggtgtttgcctggggacctctaaatctaggttagttaggtctttggttcatttgttagagatgaggagggaaagattgccctgttaaggagtcagaaattaactcttcagagaatggatagtctttcaggattttgagtattcctcttctactggggaataagaggaagaaaaagagtgaagttgtggtttagagaaggcacattatttaggcttagagagttcttaggagatgtgggaatattttgacaccattaatgatgttgaagaccatgacttggttgcctcatggccccagtaaggaagataaagatgggtgtccttaaagaggtgagaggtgtttattatgaatattttggttactttatgctcatatatcttgaaatacaagcccttagctaatgaatctgttttgtgagacaagtccttagtttatttaatgagaataattctatcagccctcttgttaaaaagctaagaatttgatgaatgtttcatgaaccaagtataaagcactctgaaatcctctgaggagaatacaaggctatttgagtagctacttttcaatgaatatactgaatttcaaaatattagttaatgatggctgtgtagacccaagggaaaatttcccctttgccctttgaaggttcactgaaaaatcaacttacaaaaaccagattaataggagaaatggtatacaaatttattagtgtgcatggggaagaatcacagaatgattgtctaataacccactggggtacagatgcttattaccctacttcttaggggaaaaggagatggggaaatgtggatgtttttatggggattgtaaatgatttttaggggaactcagtgggcttcaaggacaagtggcctgggacagtcttttaggcctgcagaacagacatggtttgtgaaaagtccttccaggtgtgttgacagactttagtctttcttcctgcggtatgagttcagttaatgaaaactcagggaagggacaagaggtcaccccccccccgcctttgtcatataacctaacatatttatatttacacattccttgggttctgaggaataggaagtggacatctttgaagtgccattattctgcttaccagactaacccaacctccccaaaagactgagctcagttttagcttcaaaactgaaaaatctctaatgctgtagatacctttttatacatttggaatttgtttaggttgtaggttgtagagatagggatgacctggattttctttgcttaactgttgcgggctgtggaggctacagaaagagtaaagagaaagtagtgaagattctagctgaggttggagaaactgatctttcagagtcccttgggcaaacctttacagaaggcagctttagtgtaatatgatttggttaactacgtagtcctagggatttttttttcccgtgctttttttttccttaactttcttcttgtccgtgtcttactagttttatgtctacaaagataacacatttgtaagactttgtgaattctcttagcatttttaataatttatttgagtaactttgaactctttgaaggagaggccatcaacctcaaaacataaataaagtctatgtctgtttgaattattcttttcctttattacttgagttccttacttgaattcaattaattacttgaattcattttcccagtttgccacttcttactagtgtctgaaatatgttacatgaacatattttcctaaatgaaaagtctttctagttactcattaattctgatcattcagtcaagcattcactgaaaccctagcacatgccaggcactctgcttggctctgagcaatagtggtaaactttgataccatcccttccctcacacagcttatggcctcagggctgtgtcacatagtaactacttacatgggtgattttagtgtgtgtatgactgattgggaatctaactactgtaaataaaagaatctgcaaaaattttcttgcagtttttttccagtgtatgattggttaattgtctaatgattcttttgaaatacttcgtaatagtttgttgacataaaattgaaatataactgtgactattatataacatttagcctaatattccttgcttatttgaaataaagtttaggttgctttttgaagtgaatattgaacaggtgtcatttcttaagcttttcccaaatatttaattcgcaaagttacaggtcttggtttttgcaaatagtttacaataactcttgcttatatacaatattccttaaaatgtttcttattaaggaaggcctgacactaattttccttttttgttcttttaggaatgttttaaaggaagttgggctactcacaagttactacataagaaagcaagtaagtacaatcacaaatttttacaccatttgtcttagaagtggcatttgtgccagaaaacaagaattcttctagttctgaaagtgtatatttgaatgttctgaaagtataatcctgaatactagaattatgacatattttaaatttttgtgatatgtaaataaaatatgtctggataatatcttaatcttgtattacatatttaacatgaaaacatgagatagttgttagtatagatggatcttgcttgagccatacctgatgatgctgtcatcttttgacacactgttatgttgctggaagtgtttgcatattgtagtcagggattatgtgagtgatttggcttcatttaaccagattccttttggtttcttttagtttcaatttgtattgctttttctactcaaaactatattactttgttttttggtgttttaatgttattacctgcagtcttatgtttaattttcttttttgaagttttttgtgtgacactacaaagtaaaactattagctgctccttagctattactgtcagccacactgatgtagctgagattcacattgccttttttgctccagctaatttatcctgtaaattcatgtcattagcgtggctggtttaagacaacctgtcacagttgcctgaaagttgacaagggctttctgttctatatagcattgccatcctgatggatcaaagcttgatttaatttgaagtgggaaataacatggttatttatttacattgttcttggtataaggtttctgtttctacatacctgatcttggtgtcttatattcatctacttgtgtattttttttttaggagttagctgatttaatgaagtttgaatgtagtgtgtttttaccaaaacaaatctaattgaggtcagccaaaccaccatttgaaggaacagggaaatacaaattttaaaaagacaaattttctgtagttgtataaagcgacatctacatttaatggacatgctaggctgttgtgggagaaatgtggttagagatgaggaaaaatgatgtgactcagtgtaagtttatcaacgcataaaagataggacttgttgatttgttacctctgtcaaaatttagagatggatttaaataatctcacttaactatattcattcatgcattacatacatcctgtgtttctaatgtgttaggtattttgcagagctctttgagccagttactagcattttatacccaggaagttaaaagcattggtaagtaataaagggttgaggttaaacaatatgttagtaaaaaagcttaaaatcggcctctccctcagatttgctaactcattgatgtgtgcctgtttcttcaatactggatatttaggggcagggctatttccttttgacttacactacaagggaataaacagcaagtgttccctatgtaaaaagaaggtgattattacaacactggatttaggctatttgcatttttacttacacctctagtgtttagtatggtgccatcttgtagctattgctctgttggatcttttgggataacttttttcagtggatgagcctgctgttcttaatccctttggctgtgatggatagagatcatccttaggtggccagctctgtatctttcataccctagtaagttgaccacagtaaattttgagtgacagtcctagagggagggaatggtgtggggaagggtgatctccagagacaagaagagtattaggaaaagcattggggaaacagaatgttgcactaggaaggaaccaatgcatctttaaagttagcacttcagtccaagaagtgatagtgagataacacatagcaagcatttcttgtcatggagacgatatagttaggtttttttttttttttaagtatagtgtctactgatctctgattaatattcatatggaatattgatctataatttgcttttaatatatttgactggttttggtattggagcaattctggactcttaaaataaaatgggatatatttcccacttctgttttctagaagagattatgtagaattgatattatttcttcttaaatgtttgatagaattcaccactgaaacatctggatctggagtttgcttaatcatagaagcttaattttcttatgcaggccttaggaaattttcaagtgagttaaataaatgactcaaaggtagtttttttttttttttttttttttacttgtcatatagtaaagaagaccattcagatggtaaagtccttaattaaaagcacttaatgctgattcttgggtgcatgttttttatactgtgtcttctgtcacagtgtaccttaagcagcatttacttttagtattatctgtagaagttgtagcatttcacatctcaagactgtattattgtacactttttaatgtatcgctgacatattcagtgtgtttgtttctcattttcctgaagtaaaggtggaataatttgacaagtatcttgaatagccaaaattaaggtataaaagccgcatttaataaaagaactctaagtaatacttttccttccactcccctacccattcacactagtgtgcctgatttttggattacagagagaaggtgttatgtaatgtcttaaactggctccaccaaactttgtgaccatgggttattctaagtctcacctccaagatgctggaatcataggtttgtgtgaggattaaataaagaaatccatgagaagtgcttagcatgtgtaccatgcatagtaagtactcaaaaactaataatcatctctggaagacttgagtcagaattttgatcagaaaatcctgtcccatgcaaagcttagacatctgtagttattttgtgtcagctgaccagaggaagcagcctgcatacaactttttaaagaataaagcctgactgtgatgaactttgggccagaccttgcatgtatcacgtacttatgacactacctgcattttacctgggactgttgcattgtgatgtttggaagacagcttacaaatgtatatttatactgccctgttgttgtacagtcttttcaaaaagactagttattatgcagttgtgctaccatcatcagctcaattcagatttgttaatggtctgttaatctggttagcacctaaggctcagatcaaattgatcctaaaatgtaaacgaattttcttttcaagtgtgaattttccgttaagtaaattgtacctagagatgagaggagaacttgccatattcaactttagttgtcttggtagttttgggttatattatttgtttgctttacattcgttttttttttgttttgttttgttttgtttttttttgagacagggtgttcctctgttgcccaggctggagtgcagtggtgcaatcatggctcactgcagccttaacctcctgggctcgagcaatccttctatttcacctcagccttccgagtagttgggattacaggtgtgcaccaccatgcccagctaagtttcgtattttttgtggagacgggtttttccatgttgtccaagctggtcttgaacttctgagctcaagcagtccacctgccttggcctcccaagtgctggtattacaggcgtgacctgctgtgcctgtacctaaattctcttttgaatataaactgtggaagggtaaaatccagagcaacaggaagctttaaaggatttttacaccctcaccttctcctgttctcctccccagaagtatgctagtgcaaaaagcctgcgtcttgattgcttttctctcctaggttttgggagaaagttattcttgaggttcatgtttcagacaaaatcacttgatgcacttcatagctgaagcaggctcagttggcccccattttgaactgttttctgtcatgtttgacccaactagcagtgaatgaagtttgtttttgtcctgtgaggagaaagttttcctattgatattaacattcacagtggctttcttgaattccagaggggagaaagatattttaaaattcaatagcatggtatctttctattcctttatatgtgatagtataaatatattcttttccaaagtaatatgaatggattttccatatttttgcattcttgtcagttgtaccttaagggcctttccagagttagccacatgctctttaagagtactggacgggggctggcattcttgtgtcacagctcttgtgaaccacacagtctctgtttcctcatatgtacaataaagaaacaacactatattgtctttaagatcctctctaagtttaacattttaagattccatctagtttccttcattttgtattttaaatagattgtttaagaggggagttttatttttttttttttcggacacttctaaaatcaagtttgaagtttgacttttaaaacctatggtagaatgacaataatcaggaaaaggtctgagtgcactgggagatgtttaggccaatacttggtctacgagggacttgtattccggctacttaaagtcttattttactatgtggataagagttttattttactatgtgaataagaggtgcagccagtatgttgacatcacaggcaccaaagagtgtcttctgtgtgagtagaattcttgcgtatatttcagtcagcacacatagattaataactgacacgattgtgtgtatggatatgattcttaatttttctgctgaactttaaacagaccgttccctcccttgtctttgcctttttcctgcctctttcctttacccctttctgaaaagaggcaaatgatgatcataaagttttcaaagcaatttgaaatattgacttgaaagcaattgatcagctttgtgagaaataattatttttgattttgaatttgctttgggattacttgggatctgttcttttagtaagaacataatttatttgtaacatctgacctcagttgggtaggttttactagggcttatgtttcatattttaaaatgggctttctataaattgatgtggtcagaatacatttagaaaagctgtctatgacctgttcttgttcgatattatgtaaaaacttagtatatgtttacatggagttttttcttccaagacctttagatcttcaaaaaggagttataagggttttgaatatagcagtaaagcagttgctttggtgatttaggttaaggtaaaagtttggtggatttttgtgcctggacttgttggcttggttttaaacaagagatattcaaagtatgctgctgctcattagcttgaccactgaaacattcctttccctccttctcctccttcctctcatatctattcctccgtctcccagaagatgaaaaggcgaagcgagaagtgtcttcctggactgtggaaggtgatattaatactgacccatgggcaggttatcgatatactggtaaactcagaccacattatccactggtgagtaaataaggtaataaaaacaacattccaattttgaattttccaaaaatgatactcgtaatttgttttccagtagtgaatcatataatcaggattgtgtttacaaaggaactcgaattttagctcttgagctcttacggtgcatcatttgggagctggtagtttggcaatcatggaagaagtgggaaaaattttagatgaaagaactaaaacttttaaaaagaagtgtagggtaaggtagaatagatattttgttgctggcatgatggtagtgtgtacagtcgtccctcgatatccatggatgattggttccaggacatcctcactccccatatagttacgaaaatccactgacgctcaagtcccttaaagtcaaccttccgtatcacagattgtgcgtcaacagatgcagaaccaggagatatggaggactgactgtattatacttttctaaaattattttattatgatatatttctcccttaatttagatatggcttttctgccactcttttgccttcctctattcttggcagataggacttggagtcttaatgtaagaattcattcaagttgaaatctgtttgtcacccttaaatatttaaattctctttactgatgattttctttttataaaaggaatacatctttaatctttaaaatttggaaaaataggaaaagcataacaaaatctccttaattctgcctcccagagataatgactaggaacatgttggtatatatttactttgagacatcattttattgttgttagcttgccaatttgtttggaataacatgggtgtcttgttattagtctctgtctaatcttaaatccttaatggccttggccactttccccctttctaaataccctgcaaaaggggtggcattaccactaggaaaagtaaagcataatcttaatgaaatatatatctgttataatatttaagatgccatttaaaacttctaaaaacttttgaatggacttctttctcccctcgttttatttatttttcgttggtaaatcagttttaactaactttgtttttagatgccaacaaggccagtgccaagttatattcaaagaccagattatgctgatcatcccttaggtaagctctgctatgttgattcttcatttttcaatttgtgggcttgatgactactgcaaagggaaggaatgcttttcttgtagaaatttttcagtgctggacttctaataaatgtgttttcaagcaccattagaacattgaagagaattaaagattcttgcccccattagaaatctacctacctctgaaaacactatgtagctgttaaagactatatttaaaataatactgtattttatgttgttataacaacttctagacttactaaaaaacagtttttaattttaatattccctcctatctaaattaaacaatatctatttaggtaaaggcagatggtagaggcctgagtgaatgcataactaaagactttggactgtaacattaacagaagtagtaatggtggtgatagtgatagtaatgatgagaatgatatgatgatgatggttctctaataataactggtatttatttttgcttaactatgtgtcaggcactgtgctaagttctttgcacgtgttactccatttaacactttcaacactgctgaggtaggttctgttgtcttctccatttttatagataatgatactgagacacccagcgaagataggtaatttgcaacacaggtcagtggaacaatctctgaccttaaggcctgtacacataattaatttagactttgtgaaattactgattttgcatgtcaaagaaggtcgactctcagcaattttgtgtggttttatctagcaagctaagctatccttgctttgttctctaagaagtggggaactgtattacataacattcttatgaatatcatttttaaattttagttaaaccctactatttcagaaaaatttaagggaaagatagtctaaatgatagcctactgttgaggatgtataatttcattatttttctatttaatcttaaatgtagtattagcttgtattttagaaaaacaatcatagacaaggtaaattctaacaaatgttatgcagtgaaagtaagttctagtccttagaggtaactgctattcacctttatgtacagaacttttcagaactattctatatatgtaaacacattaggaccccgtctctgccatctatacacaaatggaaaaaactatatttaccttttcaccttgctgtattcacttaatatgtcttacaaatgtgtcttataaagccacctcctttttagtgaatgaaggttatgtggatgtatcatatttcttaagccaggcttttactactgagtgtttagatcatttcgaggtttttgcttattgtaatttgactgcaaatttgttgcaatttgactgcagtaactactcttatatttatatctttgtccatgtgtcaaagtatttctgtaggttgatagtctaaaataggtggatcaaaggatatatacatttttgattttgagagatattacaaatttcagagatttttccagttccattaaaaatacatggatgtctcttttctgctatatttttcgcagcatagtgtgttacaaagctttatgatctttgctaatctgaaagacgaaaaatgttattttgctattattttaatctgcattttaaaattatgagtaaggttgagcatcttttcatatattaaagtcatttatattttcttcccttttgaaatgtttattcatatccttagcctttttttccctgttagagtactagttttttccatattgatttataaatgttcttagtatattaacgaaaataaccttttgatgtatgtttttaaaactgttttttaccaattgaccgtttgttttgtcattacatttattacagattttgagtatcctaacatagtaaaatttatcagtgttttattttacagtgtgtatggctctatgacctagaaagacctttttggtgcagaagttataaaaaaatattcctatgttttcttctagcatttttatggtttcagtcttttttatgtatgataaaaatcatttgtatatctgaaacttacttggcataaggagttaaatagggatgcaacttaattttttttctcagaaggatacctggttattatatcaccagttatttaaaaaatcagcctttccttattgatttgaagtgcaacctatattgttgtattatgttctcacatgtctttaggtctatttctggattctattctgttttattaacccatttgtctaatcatgtaccactgccaaacttttaattatcatagctatataatgtttaatatttggtaggccttgttgcccctacctttcctctttttcagaattttcctggctattcttgcatgtttgtttttccatgtgaaatttagaatcagcttgtctggttctcaaaattatcctgttgacatttttttattgggatagtattaaatttatagattaattttggaagaattgacatctttacaatattgagtcttcctgtccaggaacagggtatgtttttaaagttttatttgactccttttatgtctttcagtggtgttttcagattttcttcatgtagggattttattgttaaatttattcctgggtacttcatctttttagttgtttttgtacataatagcttctgtattttttagctgattatttgtatgtgggaaagttattgattttgataaatttatcttaaacaatatgccaacttgctgaatttgtatttatggtcatttaccaggtgattcttctgttctagagatacataatcacatctgaaattgataagaattttgtcctttcttttctagttttatatgttttatttctttctcttgtttaattgcatctgctagtattgccaggacagtgttaaataatagtgccgatagtgggcattctgtaatgttggttctcagtttgagatttatatttatcatgtcaaggtggtagctggccatgttatcagaattaactttccttctagatgattatttacttttactttatttatgaatgatgaattggatgaatagatttgtcagtattgaactatccttgccttctggtatgaatctcacttgcatcctgatgtattaagtttttttggattctgtttgttaatatttttatttggaatttttccattagtacttgtaaataagattagttgacattatttttgttagattttgagttaattgctatcctggctttattacttttcatgtatgtaaaacttgaagctaacaaattttattagtgaagatttttagggcaatatttttaaaacttttttgagtatgactcagaaatggcttttataacgtgatctttgtatgtgtatataaataaagatttcatggcagcacttattcctactccgtataatacgagtataatactttgttatgccattttaatattttctgtcccatttatttacttttaaaaaatgttaagtgtagcctaataaaaggtcacaaactggagattgaaaaacacttaactttggttcctgtttcagaaaatagtgtaattaattcatcagttgttgatgtataattgcttcatgagatgattatgaaagtaatttgtaaattctgtggtacttttcaaatgtatatcatttactgagtctgattatcacacggcctggcatataataagtactctataagtattggctgatttctaataggtctgaaaatttatcttttagaattttttcttcagttggtttagcgagtttccctttgatgttgaaaatgtttttttttaaaaatctaacctagaccatcccaaatcatgaattactgttgtgtgaaacagtgagactactgtttttatgccacaggtttataattatgcaaataaatactacatctttgcattcattttggttttacttaccgaattttcattccaggaatgtctgaatctgaacaggctcttaaaggtacttctcagattaaattactctcatctgaagatatagaagggatgcgacttgtatgtagggtaagagtgattttttctccatggggtaggaaatgtttaagcagtacttagacatgaagtcagtggtttgctgatttataaagatagcaaatgttatattgttagactgaccagccatgctttttttttttttttaacttttttttgagacagagtttcactctgtcgcccaggctggagtgcagtggcgtgatctctgctcactgcaacctccaccttctgttttcaagcgattcttctgcctcagcctcctgagtagctgggattacaggtgcccaccaccacacctggctaatttttgtatttttagtagagatggggtttcaccatgttgcccaggctggtctcgaactcctgacctcgtgatctgcccaccttggcctcccaaaatgctgggattacaggcgtgagccaccacacctggcctttttttgtatttttagtagatacagggtttcaccatgttggccaggctggtctctaactcctgacgtaaggtgatctgcccgcctcggcctcccacagtgctgggattacaggcgtgagccattgtgcccggtttagccatgcttttcattaaactattgttagtatataattttagtcaacagttttcttcttaaaagcctatttcagaattaatctggtggatagtctatatttagatgacaatccttttcatttatttaatgatatttaaaaacattttgtcattttattttcacaagtcatcataacataggacagagtttaaggctcagagggttatgctgtaggcctttttgtgaaatacctatgatgagtggtagtagtggttggtactcattaggtgaaatcacatatttattctgaaggaaaatataatacattgatattattcatttaagtaagattcttaaggtttctattcagtgctttaaaagtgatttgattctaattttgtttgatatcctggagaactttctcttcctatgacttgctgtgattctttgaggaattcattcatctatttttttttttttgagacagggtcttgctatcactcaggctagagtacagtggcacaatcatagatcatatagatcatagctcatagcttactgtaactccaaactcctgggctcaagctatccttccacctcagcctcctgagtagctgggatcacaggcatgtgccactacacctgactactttttttttttttttttttaagagacaggatctcactatgttgcccaggctcatctgttcttttttcttttcctctacttttccccattatagaaatgagagaagactacctctatcagttgatgatagtttagatttcttaggatgtatattttcacatagaaatcagccaaccttactgctgcttgcttgttaacccaatttttatataaaattaatgtttgtttttatgtatttacatataatatatttatatattttctataaaattataatattcaaggggagattcatttttaccaatcttccacagtcaaacagtagaaagggtatagatttctgtttctgtgtcttttttaatgtattgagtgttccttttttacagcttgctagagaagttttggatgttgctgccggcatgattaaaccaggtgtaactactgaagaaatagatcacgctgtacacttagtaagaacttcacttttttactttgagtaattttgttacattactagatgctttgaacttaaacattaagtagatttaagttctgagtgtctaaggtaacttgggtaaactcatttgaaagcaaatttttgctttgtttcaaatatggaaaacattcaacagtcattattctcatctttaagaatctataatattaaggtctgaggtaagcttgaaatatcttgtttctgaaacaacatatttgtaataagcatttcagttgagcttttataaaatgattgattttatctgctttaagtaaatcctgccactacagacatcaaatattctgaaataaaaaaaagaatatgacttctgatggtagattagttaaatgtttcctcaaggcaatgaacagtccacataaatatttgtagtaagtatagggattaaaaataaataaataaagattgtctgcccatcaaagagagaccttaagaccttattagatgagtgtacacattatatgaattttaaaaaaaagagtgataagtagttaatataacatatggaaagcagatcacacgtgttctagtaaacaaatacaaattataaagacctagtaaatttgtattttaaagatgtttatatgcattgcttgtgtggaaatgatgaaactggtcctctcttctgcttggtgatggtattgtaaattggaagaacccttttggaaggatttgacaatctatcttgagctatgaaaatgtttataaattttttattcagaatcttattaatcctgacttttgggtattgtttcatatgttagtataagacgtatcgtatgcaataatagcattttgagtatgctctgtgggccaggtactcaagtgcttcttttacattaactcattaatcttaccaacaacctcttgagggtaggtactattgtaatctccgttttataggtaaggaaactgaggaagagagaggttaattaattaaattggtaaaagttacacaacttgtaagtgatggaattggcattttcaatctagaaagtctaattctgtatgctctgaactattatttgtaatgctatgagaagtagagaagtatattcctaaatgagggaaaagccacaaatgtagttattggttgtaagattttttttttttttgtaattgaggaaacttcatattaatttagattttcagtaagaatggaattgctagtaaaatcatggtatattctgcatattctgcaaatggtatattgtgcaaccattaaaaaatattagcctgaagactagagcaggttggaaacagaaattacgtatactgtgattaccactgtgtaaaagcatccagtaaagtaagacttgttatggagagcagaccatgtttttctgttaggagttcttttgttgttccactgaatgtggttattaaaatatctggaagtactttaccgtttcttaattatactagtagtcatttttggggcatagtgatataggcttgtttcaacataagaattataattacatcaaaaatgcttgttaatatttacttcaaatattttatttttactttaacatttttcataaggactagttaattctaaagtaaaatcttcatatgtggtaatatttatatatatatttgttatagaggttgagtatcccttatctgaaatgctttggaccagaagtgttctgaattttgaatttttttggattttggaatatttgtattatacgtaactggttaagtgtctgtaatttcaaatttgaaattctaaatgctccaatgggcatttctttgagtgtcctgtcggtgttcagaaagtttcagattttggaggatttcagatttttggattaggaatacttaacctgtatgtcattttacttttcctttgtgcagttaccagtaaactggtttgtgtatgtgtacctgactggcacaaaccctgttgtatattgtttaagataatatccagtactgttactaaaataaaatactgagttcttcatagtagcatgtgtccaactgttttcacatttttcaaattttaaaatctgtaatttcatacagattttttcttttatatattccaaattattttttctgtattataggcatgtattgcaagaaattgctacccttctcccctgaattattataatttcccaaagtcttgttgtacctcagtgaatgaagtcatttgccatggaataccagacagaaggcccttacaagaaggtgacattgttaatggtaagaaaaatatgttactttcatcaccatgggcaaagaaacaacaaagcttggggaatctgacagtgacttgtgttttcttgacttgcttcctgtacttaaactttttcctttttaaaattcagtatcactaactcttaaatctacaggaagctctcttaacggttttgtgcatgttgcttttaagatacttccggtgtgatgtgtttggtgcagtgtatttctttaatgcttatctcatatgtgattggtaaataggtcaaagatgtcagtgaaatgtggagtctagtttttttcccccagaagttcactaatggttttgaagagaccagggcaggctttgttatagatacaggaaaacccttcataatatatgaagacctaaaggaaagctgaaaatcttgcagaagtgccttacttgagtggaagtagctttaaagacccctatgttaagctaccttgggaagttacaagtatagagagtagaggaagtagtttaaaagacattaatgaaggctttcctagatggcatttgtttttgttttgtgtattattttattttttggagacagggtctcactgtcacccaggctcgagtgcaggggcgccaccatggctcactgcagtcttgacttccctggctcaggtgatcctcccacctcagaagtagatgagactgcaggctcattgctaccatgcccagctcagtttttgtattttttgtagagatggggttttgccatgttgcccaggctggtctcaaactcctggactcaagcatctgcccaccttggcctcccaaagtcttgggattacaggcatgagccaccgtgcctggcttagatggcattttaatattgatggaattagactctttgttaataagatatcttaaaggaactacctatcaaatgaggaagcatgagcccaagtgttagaggctgcagataattgactgattgtgatgctagctgtgaatgatagccgaaatttaactatgacactatttttattagaattgctactgctttagttagggtatctgttcataaagttccataggttttgaggccaaccctgtttttcaaatataaagcctgttatttttattatatgtagaatgtgtgaggtttttcaggaatgtatgtgttgtgctagaaccaaaatatctatattgtgatgttacaggttgattgaaatatgtggtttaaaaatactcaatgtgctctctagatacattataatggtataatagtatataatatatagtataatagtaatctatattcttaaacatggggacaaagagaagaatgaatattcacaaataagagaaaagcaaatgagttttaaaaaaacaggtgtagagcagtgtaaatttttctgttattccctagcaggagtaaggaacttgtaaaagataagtgaaaatggtattttgtagcaatgtagcaaagttttcaatttaatgttactaactctggtaatttattttgcatgattgtgtcccacatacatttttcttttgccacaagtgatacaattactataagagtataaaaacccactatctggcttatgttacatggccatattcctgctctccacagtgagttcagttacatctcagggagcttctgttgggcaataactatctatccattggtgtctaatttgagaatgcagaagttgtctttttcattaagttgctagatgctgtcatgttggaaaaacacttgaattttgaaatgaaaataagtatggtctttatatttgcacattctcttgcagtggatatcactctttatcgcaatggttatcatggggacctgaatgagacattttttgttggagaagtggatgatggagcacggaaacttgttcagaccacatatgagtgcctgatgcaagccattgatgcaggtcagcctcagtgttgagcacctattggcagtcctgtgtgttgatgggccaagaatgactgggcgctgcagttctgtgcattccttgtaccttccaggttgcccctgttctacctgagttagctttggttgttagcagtaatgggtaaaaggatgatctgggaatctcttggtggtgatagaccagatgattggttagcatcctttgtttcttctgtgatttatcttccttttctttgcctgataaatgaagaggactgtgcagatggttttttagtgcaacttttattctatttttaaaattctttccagtacataaatattatgttctcctcataaaaaattaaaagtgaagattatgagtgaaaaatgtgtgatcctcctttacacttgcctcccctcttatctctctcttctctctagagatatcccattaccgtttaggttttttctctctcctgtgcattaatgcacacacgtatgtgtatgtgttaaattaagttaaatggaatcataatatttttaatgtgtaactgggctgttttttcaactatcatagagatcttttcaagttagcatatatacctacagacatagatttacctcattcttttaatggctatgtattatattctatagtattacaatttgtgtaactattctgttggattttggtgctttccagatttcttactattgtagtaatgggtaggggtgtatttctggaggatttttctcaggctgtctgtctttgtacatatgaacaacttatcgaggcttttttgtttaatcagtatcttatggggataagagaaggaaaggggctgggcatggtggctcactcctgtaatcccagcaccttgggaggctgaggttggcagatcacttgaggtcaagagttcgagaccagcccggccaacatggtgaaaccctgtctctaataaaaatacaaaaattagccaggtgtggtggcgggcgcctgtaatcccagctactcgggaggctgaggcaggagagttgctggaacctgggaagtggattgtgccaccgcattccagcttgggcaacagagcgagactccatttcaaaaaaagaagaaaagaaaaaaaagaaaggaaagttcttaacagcatcttgttggagttgttaacaaactgttaataaatgggcaaacagccttctggttaaatccttaccatatcaactttattaccagtgtgctacctgcaatcctccccagtctctccaaatcttgatgtcatcaacagaatagtgaacaggacagagttcttagacaaacatacagttatctctaataatgttgatccagtatttttattgtttttagtgcgttctttaatgtgtatgggagatgaaatttttactcaagttggaggaatggaaatgaaggaatatgatatttttgtgtatcaggtgaaattttgaaaacttattactcattgttgattattttaaaacattaatacaggaggtggaattgaagaaatttaatgtttaatttgtcatttgtgaaagcttaagtttgaaataatttttagagtttctgccagataatatagtcaatatttctattctttttgcttctctgtgaatcaactgaagaaacaaaaaaaaaaaaaaaaaaaaaagaaaaagaaaaaaccagatagttagaatgctgttttatatgacgtatgactggaacttgccaatagttttcataacagtagccaggaaggaacgaaagtggcttgatcttttttggaaagtgctttgaattcctttgtatatatcatttttgcccctcattttgcacctcccttactcccccaggtagagggtttgaaaagctgttgaaattaggcttcttaagtagggtttcttagtctatgcacttagtggcttttgggcctgataattttttgttgtagagacctgttctatacacataagatgttccacaagcattcctggtctctacccagtaaatgccagttacaccaccaccctgtgtttgacaaccagaaatattaatatctctagatactacccttggggccgcagttggagcagtttgaaaattagggaagacttcctctgtcactctttctatgcaacatggattacaatattgttccccctcccaccccaggctgataggaaggcctggataggaatgaaagaaagtaattatgaaagtcagcatgatttttcaaaaccagaaacctccttccttctccccccaaaatcaagctgcaaaatacagttaagagcaagtaaaaatgttaattaaactgattccttgagctatttaccctgaaatggatgggaaagatacattgtatctgaacctcagtctgggaatcagataggctgagtaggagagtagagagagttaaggatccccagagccatcttgaggttctctaggagtctgacagtgcccagctcctgggtcttagtgtgagggagaaccttatagtgatgagaaccactttttttgttttgtgttttattgaaacactagtaaaagtcataaaaactaaacagagcagaaagtgtatatagtgagaagtatctttcctgtactgtacctctagggttgtcctgtagaggcagtcatggaaagtttgagaactatttttatggggataaagaagcccaggggaagtaagtcttttagaagttgtccaggctgaaactcaggacaattcgttactttttggacgttccttttactcctagtgcactttcttatctcttctgctcatattaatagaatggaacacttggccttagggaaggatgcgaaaagaagtgtattttcctctctatttttctctgttgttaaagaaagcaaaaggtacctacttccaaccctttagtgctgctatgagtctaacgtttttggcatgaaaggaggaactacagatgcccttggtttgaattagaactttaccaattactggctgtttggcctctctgtgcctcatctgtaagttgaggcatggatgcataaaagtgtttcaaaaacttcctagcacaaagatagtaattactttttttttttctttttctattttgagacaaggtctctctcttttgcccaggccagagtacagtggcaggaacactgcagccttgacctcccgggttctagtgatcctcctagcacagcctcccaaatgtagctgggactataggcatgcaccactatgcgggactaattttcatattttttgcagagacagggctttgccctgttgcccaggctggtcttgaactcctgagctcaggcgatcttcctgccttgacctctcaaagtgctgggattacaggcatgagccactgcatctggttgatagtaattgcttagtacgtattagttattagtttatcatgaattttcttttttcctttcagtgaagcctggtgttcggtacagagaattgggaaacattatccagaagcatgcccaagcaaatgggttttcagttgttcgaagctattgtgggcatggaatccacaagctttttcatacagctcccaatgtaccccactatgctagtaagtactatccagagatttggtataagctcaccatttattcaacaaatacttattcatacatttaacagtacctactattttgtattcactagagtaatctcttagctgtaatagatagattcccaaaatgtgtatttgctgaaacacagtgcaagttcgtatcttactcacataatagtccaaggcaggtgtgtttggtcactgtgggggcagggcagttactatgtgacacaggctgtgtcatctttgacctatggctttcaaagtcactttgggagttgccctcctggtcagtagatagtggagatgttgggggttgaagcttgaaggggtatacctgggagtttttaacagacagctggaattggcataaatcaaatttattttccattggcaggaattcagtcacatggctacatttaaatgcaagggagatgggaaaacgtaatctaattgtgttatggaagaaaagtaaccttattttggcaaacagtcaacagtttgccacaggcctagccattactcttctgattccttaggtgaagtcagttcgtcttgcttggtttgagtgtttaatgtatgtcagatcctgtaatatttgtttatataaatagaggggaataaacaaagtgcctttccttaggttgagtgccgtgtgatacaataacaaagaaagtgtaagatagataatatcttacagaaacattttctgtagagagagaagaacatgttcaggaatgaatctgttatttaatgtcagaaatgaaagctgtccacagtaagtgacctaggaaggaacttagcacatatattttgagccgctgctagatgaacactttcatctccttgtgcttaatttttttcatctgtacaatagtagggaatggtacttactgtagaattgttatgaggattaagtgagatgatacatggaaagcacttagaattctgcatgaaaacagtacatgaaagcatttaatgttaatgtttacaatgacagtaatatgcattatctcatttgatcatcacaactctatggataacttcttagcccaatttttttaaagcaactctgtgcttacagaggtaattggcttgctcaaggtcacacaaactagtaattaaatgccagactagcattgatacctgggttctgtcttgctttctggagtcagtcttttctcccatacttcatgctgacgagtaaggattgaagaaatttggtgcagggggcggtgggagaactaagttttggttgggtggagaggagaaaaagccagttggtgggtgaacatgggtgcttcaaatagagaaaaacagagaaaatataaggttggctgagttatatgttaaggactagcagcaggcagtccaggtgtgccaaatgccagactgaaggaatttgacttgtatgtcggaatcttcagaaatatttttgggcagaagaatggcataatgaagctgatattttgagaaggctaatttggcagtggtgactaagatggattgcaggtgggagttctgaagatagttggcctgatggacagttgttgctgtagtgcaggtgtgaggtggtaaaatcctagacgtggatagttgtgaagagaaagtgaaatgagtgagcaacctttctaagggagaagctggagcagtcattcagagcaggggtccccagcccctgggccgcagacaggtaccaatccatggcctgttaggagctgggctgcacagcatgaggggagcagcaagcaagcgagctttaccacctgagctccacctgctgtcagatcagcagtggcattagattctcataggagtttgaaccctgttgtgaactgtgcatgtgagggatctaggttgcgcactccgtatgagagaatctaatgcctgatgatctgaggtggaacagtttcatcctgaatcatccccccaaggcttgtaccctcaaaatcctcctggtctgtggaaaaattctgttctacaaaaccggtccctagtgcaaaataggttggggactgctggtttagagcacagcatctaatgtgtgtcaataaatggttattagcagaccacctaattctttttatttaaaatgtgaatcatgcttgaaataaaagctagcaacagaaaataggtaactgacttcattccttccttttataccctgtaatcatctgaatatgcattccctttcacagaatggaagtagctattctagttacagtggggtgtgtgtatgtaagagtatgtgcaggggagggaatgaaaacagtccccttacttgcagaagcaataaaatttgagtttagatatggatttgagtgtgagggaaagagagagactgaagacaataatatttatgggagaaggggattttggtcagtggttatagtgtcagcaaaatatgttgccactgttatacaaaaggtgtcatgtgagtttcctattaaagcatttgattagacataagaaacaattatgaaaagaggaacaaagacccaggtgtactttattttatatagtttttttgagacaggatctcgctgtgtcgcctaggctaaagtgtagtggtgcagtcacagctcactggaaccttgacctccgagagctcaagcagtcctcctacctcagcctcctgagtagctggtacttcaggtgtgggccaccatccctggctaatttttatatttttgtagagacagggtttctccatgttgcccagactgatatcaaactcctgggctcaagcagtctgctcacctcaggctcccaaggagctggggttacaggtgtgagctaccacacccagccttatatattatgtttatgaagagtcacatttatgtaaaacaaaatatgcaatgatcactgtagggaagtattaaactattgagggtttttttttttgtatagcagagatatcttttgaaatgtaaatctctgctttagtttgtaactctatattcctagcccaaatgagggaagaaccaggaaattgttgtataacattcctccactccttctatgtaggagaaatccttgttaggtgagagtttatttgcttctatgtttgaatcaatgggtgggaagtaatgatgataatactctgcatttaaactgtacaggcatacctcagaggtaactgtttggttctagacccttgcaatatagtgaatatcacaataaagcaagtcatacagattttttggtttcccagtgcagtgcataaaaagttatgtttatacagtagtctattgtgtgtgtagtctaacaatgcacaacccttgatttaaaaatactctattgctaaaaaatgctaacagtcatctgagtcttcagtgagttgtaatcctctggctggtgaaaggtcttctcttgatgttgatggctactaactgatcagggtggtggttgctgaaggctggggtttgtattacattctcacattgttagaaattcctggtagaattcttgttagaacctgggtaatttataaagaaaagaggcttaattggctcacggttctgcaggctatacaagcatggcagcatcagcttctggagaggcctcagggaacttacaatcatggcggaaggcaaagagggagtgagtgtctcacatggtgggagcaggagcaagagagagagtgcatgggaggagaaacaaccagatctcatgacaactcattcactgtgcagtaccaagggaggtggtgctaaaccattcatgagaactctgcgcccaggatccagtcactttccaccaggcctctcctccaacactgggaattacatttcaacataagatttgggtaggaacacagatccaaaccatatcagggttgttgtggcagtttcttgaaataagacaacaaagtgtgtcacattgattgactcttcctttcacgaaggatttttctgtagcttgtgatattgtttgatagcattttatccacagaacttctttgaaaattggagtcagttctctcaaaccctgctcctgttttatcaactaagtttatgtaatattccaaatcttttgttgtcatctcaacatcttctctatgggtagattccatttcaagaaactactttctttgtttatctgtaagaagcagctactcaactgttcaagtttcatcatgagattgcagcaatccactcacatcctcaggctccattactaattctagttctcttgctctttccaccacatctgcagttacttgctccactaagtttcaaactcctcatagtcatccaaaagggttgaaatcactttctgcccaactcatgttaatattgatatttggcttcctctcatgcatcacacaatttcctcccatgaatcacaattttttggttttggttttgtttttgtttgttttgagacagggtctcactctggttgcccaggctggagtgcagtggcacgatctcagctcactgcagcctccacctcctgggctcaggtgattcccccacctcagcctcctgagtaactgggattacaggcacgtaccaccctgcctggctatttttttttgtatttttagtagaaatgggattttactgtgttgcccaggctggtcttgaacttctggagtcatacattccacccgcctctgcctcccagagtgctgggattacaggcgtgtgccaccacacccagcctacaaagtttttaatggcatcgagaatggtgaattctttcaagaaggtttttcagtttacttttgtccagattcatcagaggaatcactatctacggcagccttagaaaatgtatttcttaaataataagacttgaaagtcaaaattccttcttgatccatgagctacagaatagatgccatgttagcaagcatgaaaccaacattcatctccttgtacatctctgttagagctcttgggcgaccaggtgcattgtcagtgagcagtaatattttgaaacgaatctttttctctgagcagtaggtttcagcattaatattattaattatattaactatattatatgttaattatatattaatattattaaaatattcagtaaaccatgctataaattgaggtgctgtcatccaggctttgttgttctgtttctagagcacaggcagagtagatttcgcttcattcttaaggaatctttaggaatggtagatgagcattggcttcaacttaaagtcacaagctgcaggatcccctaacaagaaagtcagcctgttctttgaagccagttgttgacttctcctctctagtgagaaagtcctaggtggcattttcttccattagaaggctgttttggtctgcattgaaaatctgtttgttagtatagccaccttcatcaattatcttagctatatcttctggcaaatttgctgcagtttctacatcagcacttgccgcttcaccgtgcacttttatgtaatggagacggattctttaaacctcacgaaccaacctctgctagctttcaacttttcttctgcagctttgtcacctctctcagccttcgtagaattgaagagagttagtgccttgctctggattgggctttggcttaagggaatgttgtcggttgtgtgatctatccagaccattcaaacttcctccataacagcagtaagactgttttactttcttgcatttgtgggttcagtgaagtagcgctttcaatttccttcaagaactttccctctgcattcacaatgtggctaactctttggaacaagagacctagcttttggcctatctaggctattgacatgcctttctcattaagtttaatcatttctagcttttgattcaaagtgagagacatgtgactcttcctttcagttaaacacttagaggccattctagggctattaagtggcctaatttcagtattgtgtttcagggaatagggaggcctgaggagagggagagagaagtggggcaggctgatggagccttcagaacacacacaaacatttgtttgccgtctttacatgggcacagtttgtggtgctccaaaacaattaaaattttaacatcaaagaccattgatcacagatcactataactggtgtgataataatgaacatgtttgaaagattgtgaaaattaccaaattgtgacacagagacatgaagtgaacatgcactgttggaaaaatgacattgttagacttgctcagagcagggttgccacaaatcttcaatttatttttaaaaaaaaaagcatctggtcagatgtggtggctcatacctgtaattccagcaccttgggaggctgaagcaggcggatcatttgaggtcaggagttctagaccagcctggccaaaatggtgaaaccacgcttctactaaaaatacaaaaattagccggccatggtgcatgcaactgtagtccccagctactcaggagcctgaggtgggaggatcacttgaacctggaaggtggaggttgcagtgagccgagatcgtgccactgcactccagcctggacaacagagcaagagtccatctcaaaaaaaaaaaaaaaagagaaaagaaagaaggaagcagtatctgtgaagcataatatagtgaaatgcaataaaacaaggcatgcctgcatattacagtcattctgtgagagactatagatcaggtacaaattttttaaaaagtacctaagagtgtctgcgatagtatagtcactcagataatgtgtatttgttgagtgaggtatgttgggaaactgaaactttaatcagtgtaaaaattattgagagatatgttacatgttgttttagtctttgaaatccaaagggcttttgcactgatagcctcagttctgattggtcacttttcaagtactttctagctatacatggccaatgctgctgttctggacggcagagttcaagagtctttcatcctttttactttctgtgacaccacactgacattcttgacgttttctttttggtttctccaaggaaatacagaccaattctgtatatgtattaagcatgtcattttgaaagtttatgaatttagaaattaaaagtcaaatgtttgtttttcttttcttccttttttcaaatgaccttaggattttataacagtttagaagctccagatttgaaatctgcagtaagtgtattttggcaatacctaagatagtggaaagcagcacgatagctattcatctggaaagttatgcaggaatataaacgtgtaggggaggttagaccattcctggaaagaggagagtttagttgagtcagcctcaaagggcgggcaaatttgccattcataacaaagttgcagatcagaacaacctcgcagaggaaccctgaaaagctgatgtattagccatctggtggtcaggttgggcattgcagtcattcacttagctgatacccttattaggttttgtttaacttggaatttaaattagttctccatttttgtctaaaaaagcctattcctagttttaacatttttggcatttttgaggggtatggcaggtctggtcactgtaatttattgttgtattgctcatgatgatcctgaaaaaaacttacattagtgaacttggacaaagaagctaaaaagtacttggagagagaaatggagtttgcttttttgctttgaattaaaaaataatggtctccttagttgtttgttttttgttttgttttttgttttttttgtttgcttgtttgtttgtttgtttttgagacggagtcttgctctgtcgcccaggctggagtgcatggcacaatctcggctcactgcaagctcagcctcccgggttcatgccattctcctgcctcagcctcccggtagctgggactacaggcccccgccaccacgcccagctaattttttgtatttttagtagagacagggtttcaccatgttggccaggatggtctcgatctcctgacctcgtgatccaccaacctcggcctctcaaagtgctgagattacaggtgtgagccactgcgcccggccttgtttttatttttgagagagtcttgctcaatcgcccaggctggagtgcagtggcgcaattgatctcagctcacttcaacttctgtcttctgggttccagtgattccctgcttcagcctcttgagtagctaggatttcaggtgcacgccaccacacctggctaatttttgtatttttagtagagacaggttccgccatgttggccaggctggtctcaaactcctgacctgcctcaggtgatccacctgcctcggcttcccaaagtgctgggattataggcatgagccaccgcacccagcttattttttaaaaagtaggttaatgtgcatagattttgttcttctttgaagatgagaaaaacacaacagcttatgaaacattatgaaaatcatgtagtttctatgggctgtgcacctgtgtgcaaacacatgcttaccccccaaagcggtgggaaatttctggcataatctgaaacatctgtcattctcctttgagcttctctacccggatgagtagtggaactcttggttctgtgattgcaattctaatcatgaggtaatagaaatcaaggcacttttcttttattctttatttgccacttttctttttatagaagtgatactcatctctgaaatacagcctacaaatacctctgttttcctagagaacacataagcgtaattgaaatgtgcctaggacaatacgtgcaccatattagatggctgccagtataatacctgtttgttgaactttaagaaagggaatcagggtaattaatttaacaatcactgatgggaatttgagttatgtactctttctagttagctgttcaacagtacactgttggttttgctaccttttgagatttttttctttgatttcagaaaataaagcagttggagtgatgaagtcgggccatgtatttacaattgagccaatgatttgtgaaggtgagaaaaaaggatgccatgatatttttcaattgaatttatatgtattttaggtaattcatcatgtcagtggtcttttctacctgcttgctttttgcttcctactcactccctgtcccacctcaaacttgattcagtatcgtgaagaactgaaaattgtgagggttggcaagaacggcatgggttctgcgtggtagtcttctgtcaggagatgctgaaatgcttgaattctggtcccttttcataaagatcatgtcaaagggtgcattgtaataatgaggtgcccaggtcaagtctgtgcggacgttcttgcttgatgtaggagagggaagaggagggaacagagcagagcattgacgagccacccagttcgaggcagacatgattatatgatttaattcttcacaatttataaggtaggtgttaccccattatagaaactaggaaactggtccttgaagagggtgggtagcttgcctgtaacttagcttgttacttggcagaatttgtcagactcagctcatgagctgttctgacccttcatggtctgtactcatgtcatcacgtggcatcatatagctattgtggggaaagcacaccaaggacacttggaaagcacacttggctctggcagcctccccactgttgtcatctcttccagacaggcttgtagcagtgataggagactgggagtcacaattagggctcctcaccgagattttcagagtgattctggtaatggagctttctggttaggggatgcaaagtgaggcagtagcagtagagcttgtgtgtcctgagccctgttttaaaggatactccctctcttgatccttccagtctttttataacccagtcttgggagtgacttctatattgtctttcttagaagtgattcactgaatccagcccgcactcaaggggagcaggagctcacacaagggcctgcatgccaggaggctggggatcactgaagtcactttagaggctgccttctaaagctggttccttattgcgttttctgtaaaatgaaaattagaatctctatcttgccaacacccagggctgctagactgagatgatttatgttatgttatatactttaaaagactgcacaaatgtgcagtaaagtttttgtcatcctcttataataaggataaagttctgatcacgtgcaaccagttgtaaagatggtaagtatttagcagtgaaaagaaagatagtgggaggaaattgtcattttggctacgtatttccattaactagcacctggttggtgagccatgatgtagtgttttcagtaagcaaataactttctatacagccagcacaggtaattaatcatcaaattatagcagatatacttgaagtgtaactcagctaggttaaatccctggactagaaagtctcaaatctgcaggagaatttcctcagaatagccaaataagtttgacttgacattactaaaaatcctgttttatcagatcacaataaaattacagtagtaatgttttaaatttgtgtaaaggccatttgtgtaaaggccattacattgaaaaacatcgatgtactcatctttagttgcttgatgaggcatgagttaacttttttaggccgcctcgtattttctttttagcctgggatttaatattgcaaaagtagtttacttcactacagagtttatgttctgggatttgtctgtctgaggcagtgagtcctagaggtaatatgtttcacctaaagattactcaaaatgaagaaagtattgatttttttttaacatctaattttgaaagaagaaagctcgcaaatacatcttttacagtagtatctagaattgcctttctcattccacctctgcttcacattctcttgggcctttgctttctgctttccctcattatgaccccttcaccccctttccctcctttctctgagttttctttcatggcctcccagattcactgtccctttgcttcccttctctggtttcaactcctgtccagaccattctgcttcatatttttcttatgctctcacaccagtctttcttttgcccctctttctgattccaggggtatagttcacaaaaatttcactgtataatctgttctcaccatctgtttgtgtgcctaccattttgaaattatatcaggaattgaatgctgtaataaaactgtaaacatttacatgatttccttcacaatatatgctgagtatagttttgtcagatgcccaagttatactaggaaagagctaaattcattcaagttttttttctgattttttaattgtaaaatacacatctcatttttaaatgtacagttcaatattattaaatacattcataacgttgtgcacccattaccaccatccatctccaaaagtcttttcatcttgtaaaactgaaactcaacccattaaacattcccttcctattgctcactactcccagaccttggcacccactgttctgctttctatctccatgattttgactactgtactctacctcatagaagtggaatcattaagcacatgctttttttttttttttttttttgagacggagtcttggtctgtcgcccaggctggaatgcagtggcgcgatctcagctcactgcaagctctgcctcccaggttcatgccattcttctgactcagcttcccgagtagctgggactacaggcgcccaacaccatgcccgggtgattttttgtatttttagtagagatggggtttcactgtgttagctaggatggtctcaatctcctgaccttgtgatctgcccgcctcggcctcccaaagtgctgggattacaggcgtgtgccaccgcgcctggccaagcatatgcttttttatgactggcttatttcacttagcattatgttctcaaggttcatctgtgttgtagcatattgcagaatgtcctttttaaaaaatttcctgttttaaaatggacaattattgtacatattcatagggtacatagtgatgctttgatacatataatgatacatataattaattaaggttgttactcaaagttgtggtgattggtatcaatatgttgttaaaatgaaatccagcgcctttattttggaaattccatcttgatttgatatttgggatatataaaaaatgtggttgtaatacatctgatgaaatttaaacatcaaacatactgaagaccaaaatgaagttggaaaggcattagctaaaacaattggcatgtaaataaggatcttagtagtgaattttttccttggctttcttcttgatagagttcatttagaaaactgagtgaactaagaaattgtttttgtttgttgaaggcggatggcaggatgaaacctggccagatggttggactgcggtgacaagagacggaaagcggtctgctcagtttgagcacaccctcctggtcacagacactggctgtgaaatcctaacccggcgacttgacagtgcacggcctcacttcatgtctcaattttaatttctcccaagatggcacatctcagtaccttcttactgtgctatgcattttattgagagtacagaaaggaagaggaacctttttttaatcacttgttttgttttgactatagataagaaaggactacagcatttgatgtgtgtcctcaagaacttgtcttgggtctgaaaaagctgagaagaataaaggaaacattgctcaactcttcagccccctccccctgcacacctgttttctcatttgccctttgagcacttttacttaaacttgcttgtagttgcttttatcactgccgcaaaacagccatcaagagccatctgctttccaggtgaacattggaaatgagaatctttgaaacttagcaatatgtgttgcaccagattttttaaattatatatatggaaatatatatgtatacattttaagttctgtatacataattaccaaacactatgtgacctggagtttgtgttgtttctgctctgacaggtttatatgttcttacaaatggatccatagtttgcagtgatttaattcctggttgggatttggcctcccctctcccccatgctaattatttacccttgtaattgtgcatagggaagcactcacccaatgagactttctccaatgtggactctgtgtgtcagtgaatgaatgtagtaaaattcactttggaaggttatcaggcttttaaaaatctagtttatggcaaaaatagccattttccaagtggtggctgactgttgcagggaatgagaatttcataatacactgctatttcagacctctgtttggtcagaaatggaaaagaaaaagccccctttcttcccttttctgttttacttcaagggcataccttggaggtgctcagagaagcgtgaagtttgcactatggtggaggatggggaaagagttctaaagtgtctccagctgtgaacccaggaggtcaagtgggctattaaaatctaacgttgagtaaatgtgatagtgatgagaaaggaattttgtgtactgtaaccttgcagtagagatgcagctgtccttcgtgtgtggaaacacacctctcctttacatagttgggaacctcattagaaatgacctcagctgccccatatctacgttcctttcagcagttgtccaagtaggagtgtatccagtgaagacatatcaaatcacaaagtcattgtcattagagtgtacttgattactgggcatccttgtaatataatttcataccactgacacattatacttgtaagagaacatctttcccagagtgcctcagaccttattgctttaaaatataataatgttttcattacttttattatttgaatgatttagtaaagttgactgaatctggtatagactttgggagtatgtgtgtgaagtttttatcaaactgtaatatttgtgaatggaatgccttgcaatatgaatgttaatataatgtgtaaagggagattaaaaagtttgaatgattatcctaccatgtagtcattaactttgctgcatttctttgggatttcagagggaaatggtgggaatggggaggctgtttgataatctaaaataaattcatgaccatttgagtagaaatgttttttcaggtgtaatggctgtacataaactcagtagagtgccagcagcatttgagatgcaaccatatttttgagagcttttaagacagaatgctgaatattaggggagcattttatgtactgattgtggaattaacaatgtgggcttattcagtgtctgtcattagaatataagctgaaggaagaaagatcttggtgtgatagttttttggttaaaagataaaacaccacactggtgataatgcttttcttagtttgggagattttaaaacaatatggactctagtctaattgcatatatctaattacaaatgttcattggatttaggtgacaaaacacctagtttcatcattctgccacctttttacaaaacaagtcagagcatggtgtgcgagcctgtagcattagctactcttgagactgagatggggggatcgcttgagcccaggagttcaaggttacagtgagctatgattgtgccactacactccagcctgggtgagagagagagacctcatctcaaaaaaaaaaaaaaaaaaaaaaaaaaaatcaaagtattaacttctttttttacattaacttttagaataattttttccccctgccagtcttccaactcctttggaattataacttggaagaagggaaacatgaacttcattttatgtcttttgttgataaaaaggattaaccaacacctttataccacttgcacccacatatctaaattaataggcaagagttgatgaggtttaggaatttgtttgcttgattcctcagtttgttctctaacgacttctgggttttcattggatttggttaaaactgagagcaggatgctcccctttgcttaacctctaccctcatggtatctgtaagcgatttccttcctgtttttcccttcttttaaaatttttattttttatctccaactttttatattgaaaattttcaaattacagaaaagttgaaagtatagtacagtgaaataatcatatatcccttacctttatctaacaaatgtcattttgtcacctttgctttatctctgtataagcacttttcttttgaaagaagcaacatcgtacttcaccctactacatcagcatgtatctcttaacctaatgacattcttttacatgatcataacacaattagaaatttagtattaatacagaattatataatgtataggatataaactttaattttcccccaaaatgttatttaaagcttccaaattcatggcatttagttgtcatgtatctgtagtctcctttttttttagatggagtttcactcttgttcaggctggagtgcagtggtacaatcttggctcactgcaacctccacctcctgggttcaagcgattctcctgcctcagcctccctagtagctgggattacaggcccccgccatgacccaggctaatttttgtatttttagtagagacggtttcaccatgttgatgccaggctggtctcgaactcctgacccgtggtgatccacctgactcggcctcccaaaatgctgtgattacaggagtgagccaccatacctggtcttagtcttcttaactctagcagccgtgtctaatcctttgagtgcgaggatcttttatctgtggtggtggatatcatgaaaattatgcacaggcctttgtttgagctcatcagctatcgttggtgtattttacatgtggcccaagataattcttcttccactgtggcccagggaagctaaaaggttggacacccatgctagaataaccctcacaccttttttgatgtcttacgaaatggacacttgaaaaatcaggttagtttacaaaagtccgtttgtctgattgttcctcatgaggatagatgcaggataaacatcttggtggaagactacagaaatggcagttgtatgccccattcattgtacaacgtgaggcacataatgttgttgtcaccttattgctgatgcaaagtttgatcacttggtgtttgtcagaccttttcactgtaaaaataccttttttcctaaacaagtaatctgggagattaatatttgcttgatactaccagacagatgtaaaattgtttcaaaattactacactaaaatcactgccaacaataaagtacactttctttatgattctttttttcttagaacatatcattgaagtaatttagatcttattctgaatttcataaaccatgggctactttaagaatgaatgcagtgaatctcgggggcaaaaaatacagtagaggtggggagggatatattagtggtctggcagttagaaatgctggaactgtttgagacagtgtagtaagattctgtctacatttgatagtgtttaacttttaccaagctttccagctgcaagaggagcaaatcataccacttgtaaattacaccacacttgtggcagtgtcgctcattttccaactcctttatttatttatttatttttatttttttctttttttattatactttaagttctagggtacatgtgcacaacgtgcaggtttgttacgtatacatgtgccacgttggtgtgctgcacccattaactcgtcatttacattaggtatatctcctaatgctatccctcccccctcctcccaccccacgacaggccccagtgtatgatgttccccttcctgtgtccaagtgttctcattgttcaattcccacctgtaagtgagaacatgtggtgtttggttttttgcccttgcgatagtttcctgagaatgatggtttccagcttcatccatgtccctacaaaggacatgaactcatccttttttatggctgcatagtattccatggtgtatatgtgccacattttcttaatccagtctatcactgatggacatttgggttggttccaagtctttgctattgtgaatagtgccacaataaacatatgtgtgcatgtgtctttatagcagcatgatttataatcctttgggtatatacccattaatgggatggctgggtccaatggtatttctagttctagatccttgaggaattgccacaccgttttccacaatggttgaactagtttacagtcccaccaacagtgtaaaagtgttcctatttcttgacatcctctccagcatctgttgtttcctgactttttagtgattgctattctaactggtgtgagatggtatctcattgtggtattgatttgcatttctctgatggccagtgatgatgagcattttttcatgtgtctgttggctgcataaatgtcttgagaagtgtctgttcatatccttcgcccactttttgatggggccaactcctttatgttagaacataacatttagacattcatgttttaggaacaaactgtttcataacataggctgcattaggctaaaacctataaaagttgtgttttgttctattttaaaaatggacacctaaggaaaggttagcttagcacacagtctgtgtatggaaactctggcccttatggcaaccttctctcatcttccttttggtgctaagtaggaaaaagaaaaatagtctgcatttatttgggtgttttgcaagatgaagcaggaataaggtggccctggctacgtgtttgctgcttttcattttggggactgtgggtgagcaacaatagaactgtgtatatggtgattctggttatttttgaaaaaaggtcaacactggtattttactagaatactccaaaaagttaaaatatggagcactcaagaaggacttcctataaaaattttcacttatcacaattgtgctgttagtcgttcacagtattttaatagttttttgttgttgttgttgttgttgttcctcaggctggaggcagtggcatgatcatggctaactgcagccttgacctcctgggctcaagcagttctcccacctcagcttgccacgtaactaggactacaagcatgttccaacacacctgattattattatttttctatagagacagggtctatgttgcccaggctggtcttgaactcctggcctcaagtgatcctcccacttcagcctcccacagtgcttggattacaggtgtaagccaccacacccagccaatttctacaatttttaaattgattctgtggctaggagaacaaatcaccacacttctctgtggcaatctcctatttgtgcagtgatatgacaactaccaactgttttattctatacagaatgtgactggctatgaagcagatttgctttgtttcagtagttgggtcagagatcaccagacaattccagatagaattttttaaacttaaatctgaatttgagccctggatgattctgaggaaacaatgccaaggataagaacatttaatattaacatgtagattacagaaagagatcaacatattttaaagcgtgttctgctgctttatcttgcttaacatatctcgatatttttggcagtcaagagtacatgtttaaactggaggtaattccatggtgggttatcactcttttcttgaaaggagcatgtgcatatttctcttatacataaggaattctgatatgtccagtttgataaaaatcaatctgcttaagagcccattacgctgctttgtcaccataatgttccaccgaaggaaatcttgtataatagaggactttgctcatcttgttcacttggtagttgttccttaaagacacaattaccttggtatagttctatgcaattattatctaaatagctgtttatacagtacttaataaaatgttttccaagtgtgtttgtagtgtactttttctaaaaggtatttgctgacaaagaaattgatcttgtgtgtgaactgaaaaaaattggctgaagccagttagtcaacaaggtgtccctgtaggcccaaagaactaaactgtactttaggactttgattatcaacctacatggcagattggtagccgagcagaaaagttctgaagcattctgtgcatgtaaaatatgtttccccttccctgagtcaacaaaacattttgagaattaccagctaagtaaaattttccattcagatgggatgaacagaaatagtgctatgtatactttttggagccatttttgttaggtgttaagttgtacacatgttgactggctccactgtagtaaagttttggacataatgcagttttttccatacctctatcccaaacgacgtcatcatcccataaattctactctatatgttagttttgtgtgaataaagaacttgtgcctatcagacatgcctgtagacggactgtctccagcgagtatcactaggtaggttacatagcagaatagccaaacatgctaaaaatggcaatgcaggaaatacttgaagagaaatttttatattgggaatataaaaattttgcaattaaacataaagatgcttaagttccttacatggcaaaattttagatcctttaaaaaaattttaccagctttaatgaaatatacagtggaagttaatatccatctgtattgcaattatatacctcttgtccaaaaaagcagcttaaagataactttcaaaagtttcccaacaattaataatttattgtatatttcaaaacagctaaaagagcagctttggaatgttcttttagaaatgatcattgtttgaggtgatggatattccagttattctgatgtgatcattatatattgtatgcacatatcaatatcacatgctcggtaagtacatacaactattatgtatccactgaaaaaatgtctaacaagacttctaaagtggttgaatcccaatttgggacaaccagggtagatttgcttacatgcacttagtgaatggttggttggttttttttttttttgagactgagtcttgctttgtcggtcaggctgtagtgcagtggcgcgatctcggctcacggcaacctctgcctcctggctttaagcctcccgagtagctgggattacaggtgttgtgcgccaccacactcagctgatttttgttagtagagacagggtttcaccatgttggccaggctggtttcaaactcctgacctcaagtgatccacctgcctcggcctcccaaagtgctgggattacaggtgtgagccaccacgcctggcagtttttagcatatataacatacatatgttaagcaattcctcaattcaagacgatgtattaaaatgatcttaaaaagaaagacttggctaggcgcagtggctcacgcctgtaatcccagcactttgggaggctgaggtgagtggatcacctgaggtcaggagttcaagaccagcctggtgaacatggtgaaaccccgtctctacaaaaaatacaaaaattagccgggcatggtggcatgcgcctgtaatcccagctactcgggaggctgaggcaggagaatcgctctaacccgggaggtagaggttgcagtgagctgagatcgtgccacttcactccagcctgggcaacacagactctgtctcaaaaaaaaaaaaagacttgacaactatagccgagtctcatgacccaggaattctaatagtaaagattttgtaaaattgattatttttattatttttgtgacagggtttcactctgccacccaggctggagtgcggtagtgcaatcacagctcaaagcagcctcgacctcccgggctcaagcacagattttgtaaaactgattctttatactggatctctgaaagagatagttgtgctttcagccaggaaatgctaatactaaacttaatcagctggctcaagagtatgtacttaactgtgccagaaatgaaaagcaaattcaataataggctagctacaaaaattagagtagtattttatttatttatttgacagggtctcactctgttgcccaggctgtgcagtgctgcgattatgacttactgcagtctcgacctcctgggatcaagccatctttctaactcagcctccttagtagctaggaccacaggcacatgccaccatgcccggccaattaaaaaaaaaaaattttttttttttctagagatgacatctgtgttgcccaggttggtcttgaacttcggaggccaagtgatcctcccactttgggctctcaaagtgctggaattacagttgtgagccaccgcacttggcctattttaatattaatcatcttaaaactgctttacattttcatattggcgaacctaaaaaacgtttgccattgcaattcatgaatatctcatgtttgtttgagaagaaaagtcaaaggaacaagacctttaggagttactggctctcctccatactctccataactgttttgttactgcagttgccaacataggatacttttgttcctagaaggctgggctacaccaaagattaaaagcacatttcctacaagtggagtagaagctagttttaatttcgtcttcctttcagtccacttaagataacagttgtggcccctttgggccctcatatctccagccctctaggtaaaacaggagggaagctggactacattgtcaggcacttcaaatgcaccaaagttctgaaaaggggaaatcctgaccattactaccagtttgtttcccacttttcaatcaatgacatattgctctctcacacaattctgtgggagcatttaaaccatatcaataaattgaaaaagcacatagcatcaatccaaccaaaagatatttgcatggtaaacgtgatgcactgatataaactctatgttatcatgtggagaaaaaagttcacagagtagtgttgatagtattcctttcgtgtaattttagaggatatatatgctattgtgtgcatagaaactcctaaaaagatacgtaagaaacttaacagtaatcacccatttttttgcaggtgtatagcttttctttctcattatataatttcctaacaatttatattttctaacccttaggtatattgcattcattaatttatttttatgtcaaggattatcaggatggtaagatcctggaccatttttgtttgcttctttatacttctcaggataaaataacctaaatgttacttaccaccaccaggaagatttatgtgactacattaaaactttattcaacaaaataccataaagtaaaaagaaaagtcacaagatagactagaagatatttgcaacatataaaactgacaaatgattgatgtctagaataaaagaactcctaaaaattattcagagaaaaataattcaatacaaagttgagcacaggatatgaacaggttcttcacaataaaatgtccattagaatgaaggatttaacgagaattgaggaaaatgcaaactaaagtcataataaaacaccattccatactcatgtaattcacaaaaactcacatttactttgaagagcaatttggcaatgtctataaggctaaatgtgtttattctgtgatacgtcttaggtaacacgcagtgagcccaatgcagaagaatgttccactacagtgttataatacagaaactggcaacaacttcatgccttcaactggagaacagataaattatggtagttcccgtaattgaattctgctacacaggactaaaattaatgaacgagagcttcagatataattatacaataatgagtgaaaaaagctgtagaatgagcaagtatgaggcttaaaaatatataaaacagtactaaagagtagatggtttaggttatacacagtgaaagtacaacaacacaggaatgataaacatcaaattgtggataattgttacctctggaggggaggaatggcaatgtgatctcgaagtggcaaaatgttaagatttgacaaaagtaggtgctgagaacttggatattcagtatgtagttcactatactagaaatagtacagtcacaaccaacacatacatacacctatttaagcccagaatgctgtttcaataatacattttagtgccccctgaagggcagatgccatcctaggaatttggggtacaggtatgaacaaggcacagtacctcccttcaagataatatcacagaagcagacttgggtcctgattaactttgtcactgatggctaggatctgttctttaatcaacggggactgagacccttaaaagttcaacgttatgtttctgaggtttcagacacccaccactgccctgcttcctttccctttcccttgcagaatgaagataatgggcagacaaaccgtgacaatgatgacagcataaaacaagacaatttccacacaaatgtagaaattacttttattatgttaaaatattccttaataaactagcaattatttatgtggaggagcatccagaaaacaggttcatgactgaattatccttgtccttgattatagagattcatgaatgacacacataaccctattttctggagtagctgtgaagctctacgaggctgtgaggttggaggcgcttctccctgcctgttaagctgctcctatcacatcacgacaggatggacattatttttctcttttgaattaaatctttacaacagttcgaatgctgtaaaaggaagcaacatactaagttttaaatgatacctttaagacaactaaaattgtgtttttcgactctccatcccctcaaactcaacatcattattacattctatgatatataaagagaaagcctacctctttccagaatgcatcagttcaaaggctttgttgatttcatcaaaagacagattgtgagtcacaaattcatcaacttttatctttttggacatatattcagacaccaactttgggacactttctacactcttccatcctaaaagaaatcacacattaatttattcaacaaatttctgcagtatgcttgttacttagctgaggacaaaaggcatttaaaagaatgaattttttgatgagttaaagagtaatgagaaactccaaaatagcatggagatgaagaatttgaccaacacctttcagtgaagaagtaaatacttttgaaatttcccttcctctgtattaagatttactaaaacctcattaaagttttggccaattgagacttttaaactacccaggacagaactctggaagtctcaacaacaagcttatttaggtccacatcagcaaagatttctataatcatgatattcaaggaagaaaaaaactaatacaggactttatttccttggttttaaatttaacaatgaaatagggatagcatatcagaacagaaaactatgaaactgaaaaatgaagtagaactctttagctaaatgctaagtttgttcgtttgtttttgagacggagtctcgctctatcgcctaggctggagtacagttgcgtgatctcagctcattgcaagctctgcctcccaggttcacgccattctcctgcctcagcctcccgggtagctgggactacaggcgcctgccaccacgcccagctaattttttgtatttttagtaaagatggggtttcaccatgttacccaggatggtctcgatctcctgacctcgtgatccacccgcctcagcctcccaaagtactgggattacaggcgtgagccaccaggcccgactaaatggtaagattttaaataaaattaggtacttcaatttctcactgtatctaaagaaggaatacaatcaacaagaagccttctcaccttctaaggatgctttcaacgatatttcaaacctcttttgagccttttccaaatctcctctcttatattctccactaattattctttccccacaaatggtagggattttttctttctcctttaaatgtcctggtaactgagatgaccacagtcactcctgttctctagacaaaagcttctattatctttagatcagcaatgcaaggggcctcaatgatacaatgaatttcccaaccagcatgtgctagaatgaggcttcagttagaggttactagcaagatcccctggatcagccaggcttagaatgccctttaaaatacagctatggactccaaaatgatacccccgaatagcatacatggcttaaaaagtttcttctatgatactctgctgtgacatgtatctagagctttgaagaggaggtcaagtcagattgacatcttctaaggcaaattctgtagttataaagaacgaagattttggccaaacccctcattttagcatattttccaaatcttttcttctggccttcaaaaaagctggcataatatgaggtagaggaccttaaaagacaacccgttaaacacagatcattcaaaacacacactatgtgattttttttctttaggaggaggatgaaatataaatatatatttttaaagccctttaaaaactttagactcattcattcacaactgttgggaaatacaaacatgttgtgacatcttttctctcctctggctgagcaaccatggaaaagatagaaactgtttccccgcaaccccaaaccaccaaggactttttaggatcacaaagggaaaaatgatcagtctagcagctttttgattttatgataaggctttgtccaattaaatattttcagtttgagactcaatattggttactgctaaaatcagacagatatatgatcacatccagtgatcactgcactcctggaaaaatgaataaaaatgtaacaagctacttgggtccacaagaaacacaccatggctgatactgctgtttgcttactttgcaatcaacttcctgtccctgctatacccataactacttcctcactatcagaatattgatatttttcttttatagaatatgcaccaagtggtcctatgtttcaggtgagcaccaccctcccccccaagtcccaggggtaaatagtgattgagtctgaatcccttctaataaaacagccttgcatgcaacaacttataatgagaaggaactcatgaagattcttgttaatataaaaaaaattaggtggctgggattaaacatctgccaatgcaactaacaaaagagaaaatgcagtcatctcatccatcgaattacctccaaaggcagtgcctttccatgtgcgacctgttaccagctggaatggacgagtggcaatttcttcacctgaagcagctactccaaccacgacgctgacgccccagcccttgtgacatgcctcaagtgctgctctctgcaggcacagagatatgaccaaatcacagaagtcagtgcattttcctgagaacaactgctggcgaaacttctagagatggcatagtttttaaagataatggcaacaaaaggccaaacttaacatttagtgagctcaatgttattgaacaatttatattttaattttttttgttgttttttttttttttgagataagagtctccctctggcacccaggctggagtgtagtgcatgatcctggctcatggcaatgtccacctcctgggttcaagtgattctcgtgcctcagcctccctagtagctgggattacaggcgtgcgccacgacacccagctaattttcgtatttctagttgagacggggtttcgtcatgttgccctggctggcctcaagtatccacctgccttggcctcccaaaatgctgggattacaggtgtgagccaccatgcccggcctgaacaatttattttaacaaattaacctggttaaatattaacataaattaaaataatttgaagtgtttatttgctttctattttaaaaagtaaactgtagttcaaaactctaaaagatttaattttaaaaagcaggcagcagaattaatagtaatacttttactgagtgtctatgtaggtttaagtaggtgttgttactacaggttgattatcttttatctgagatgcttgggaccagagtgttttgaattttgggttttttcggatttggaatatttgcatcgtatttattagctgagcattcctaatctgaaatgccccaatgagcattttctttgagcatcatgttggtgctcaaagtttcagattttggagcattttggatttttggattagggatagatgttcaacctgtacctgcattttacagatgaggaaactgaggttgagagaagctgtttgttcagggtcactgagttagtaagtggatgtgtatttgattccaaagatcatgctctgcacaactgctttattctgtcttttcatttcatgagacatgcacttagcaggcattgaaaggcaaagaaacatcttttctcatccttccctgagctgttcttgtatcatttcccattgtagttcaaatagatattttccccttctttcactagaaaaattcttattaagagacttttcctttgccaaaacaaaacaatttttaatctaaaactgcacttcaaaaaaagcagttccataaactaaaaaggaatgaagcccatactcaccatgaccttcacattaccaatacattcaaaggaatagtccactcctccatcggtcatctcaatgagcacttcctggatgggtttactaaaatcctgagggttaatacattcagtggctccaaactctttggcccttgcaaatttatctttattgatgtccacaccaatgatccgggaagcaccagccactttacagcccatgataactgccaatccgactcctcccagaccaaagacggcacaaacagagccaggctccaactaggagtaaagaaagtttataaagtactcattctaccagagtcaagagaatcactgggtttcatacagattggccaatttcactattccaggaaagtttcactgaattaaattagaaggcagaagcaaaaaacccaagtcagtctcttaccttggcagtgttcacagcagcaccataaccggttgaaatgccacaacctagaaggcagactttatccaaaggtgctaaaggatctattttagcaacagagatatcagccacaactgtgtattcagaaaatgtgctggttcccatgtaatgcaaaattgtctttcctttgcaagtaaatctgctggtaccatctggcattaatcctttcccttgagtgactctaaagaaaaaaaaaggaaaaaggcaagttggaattaggtttcttaaaacccacaggaaaaagaaatgttttaaaaataatgaccagtaaatattaagaaagtgttgtaaactacaatttcaaatatattcattagtaatttagcaccttgcagcaatgccttataaaggaaatttataagatatttataatcttatccatcttttccaatattcactatccttctagatcatactgtcagaatactgaactcattttaaaaggtacaacttatggatcagatggaattattttaaaatcccatcattaaaacggtgggccaggtgcagtggctcactcctataatcccagtactttggaaagttgagacaggaggacaacttggagccaggatttcaagagtagcctgggcaacatagcaacaccctatctctacaaaaaataaaattagccaggtgtagcggagcacgtgcctgcaggaggttcacttcagcccaggagtttgaggctgcagtgagccgtgactgtgccactacattccagcctgggtgacagaatgagatcctgtctcaaaaataaaaaaaaataaaacaacctctgtgagcaaatataacatcataaaggataaagtcaaaaccagtatctatgcaagtagagattacaaaccattaaccagatcaactaatgaaaacagatagccaaactggctaatttatatctttcaggaggcatttttctgaagtgtaactaacagtcctcaataatgcaagttaaattacttcttcactttgttttgcctgtgacttggttacaccaataggaaagaaaacccaaaaagcttacaaaggccactgatataataaatggtaacaaaaattacttttgctattctaaacagaggtgatgtaacatcttgcttaggaggacccaccctaaagtcagagcacttgggttcaaatcctgtgtgatctgagcaagttaattaatctttatgccttcattttctcactagaaaatgctgagaaacataggtaacttcctttacaaattgctataaaagtctaatgagatgttatatgaggctttagcattgtgtctggcacagaactgatgtttagtaattatgttattttaaataaaataaacactataattgctttttttgagacagcccaggctggagtgcatagctcaccacagccttgaacactgaggcaggaggattgcctgagctcaagtgatcctcctgcatctcagtaccaagtagctggtactacaggggcatagagacggggtctcactatgttgcccaggctgaacactataatttgatgtatactcttaaactctttcgaacatacatatgaataaatatacagatgaagagaaaatggactgtctctagattcaagagcaaatacatttcctttgagagaaaaataaatatgaccagaaacaaagaagaggtgacaaagctccatcagaaagaatttttttttgacacagggttttactcggtcgcccaggttggaatgcagtggcacatcatggctcactgcaacctcaacctccagggctcgtgatcctcccaccacagccactgggcagctgggaccacaagcacgtgccaccaagcccagctaattttttaaattttttatagagagggggtttcaccaagatgtgcaggctgttctctaactgttggactcaagtgaaccacctgcctcagcctctcaaagggctgggattacaggtgtgatccactgcacccgactaaaaataactgctatatcttaatgagaacaatttaagtttgtttagccttccttaatgtgagaaatcactgtattccagaggagtttcttgaacaaaaggtgatgtggaatacattttatgctttgaaagaatttaaatggttacaatcacaaagaacccatcaccactattatatttgatgtgttgcaaaatctttcagactgcgtttaaaattccctttcaaagtgattagatttttttgtttttggttctggttttaccaaagtaactggatttgctttataaaataaatggaattttgttttccaaaaatataaactaattttgtcaatggcattataaacaaatggatctcccatacaatgctggtgcaagtgtaaactggtacaagtacacgagagagctgtagatgcatatcttacgactcagcaattataatctcaagaaaatgctcaagagaaagcaatgcctatatccatcaaaagacatgtataaataagaatgttcctagcagcattaactgtaaccacccaaaactgggagtaatctaaatgtccatcaacaggagaatggatcaatactggtattttgaatggattaagacagagcaacaagaaggaactactgacgcatatgcagcttggatatatctcacagacattatgaaaaaaaagaaacctgacaaaagagcatgcactgcatgactctatttatacaaggtcacagtgaaaggaagaatcaggacagtggttacctaagagggaggtaggttctgacttggaagggacatgagggagcttatcgggtgctggcagggttctctatcttgatctgggtgacgttcaaatcaacaggtgtttatatacataatcattcattgagctgtacacttaagatctatacaccttaagtgctttataatatgcatgctctacttcaattaaaaaaaaaaacggaacacacacaaggggatcttaaatttcctcaaagaggtagttctttcagtgttgttacctagtacaataaaaacaactaccttttctgtgtcaaggagttaggttatctcctgcagtcttcctaatagccttagtgggtaagttttattactctcacttactgggcagtggttcataaaaatgatttcgtttaatctcagaagcacgtctttccttactacatggtttggcaaatttagcctgctgttatgtgaagagaatgggtacagaaaattctgttttatatcttaacggctggtgatactgggcacacccctttagtttctcttttatctgtaagaaaagtcagtatatttatggtttgctttataaaaagttactattaatacaatggtacacagtactgaattcacaaaaatatgaacaaatatttacagtaagagacactcacaacagaaacactgcttcaaagcaagttacatccggatgacaatgtctatacacacaaaaatccctaaaacttattggttcttttctttgcagcaggagggagggagagaaaagaaaaaaagatagcagataacctcaactcttcaaaagcagagatttgttcaatgaaaaataaaggagttgaaagaaaaatgagccaacaaatttccagattatgacaaaccattctggggtaggggttaggggatcctgggacagggagggcccagggtccagtcgcctttgtgaagaccagccaaggttaacatagggtaccacagctgggcaagatgagaccagggtgaggcataaggtggagtcactcccctggtctcttcacatccccccgcttctttcttttatggggtagaaaggagacagaaggcagacaccccttgagagctgcacaagttacttaaatcagccacctctacaagctacacatttcctcatgtgaaaaataaatgtttcttcagttgcacaattaggcagaaaaccgcaaatggtagagaaggctgttgctgtgcccaggtaccctctctgtgtcaaaacctcttaatttctgagtcttctctcatctgtgaaaatggggatagtagtgaggttgttataaagatggaatgaaaccactgatgtacaatgcactacataaactgccacacaattatttattcttatcattgttaatatgaccttgtggaacaggaattaaaagaaattaaagaatgtgtaagcaaaaactcagttgtatgtaagaaaacccaactccccctgaggaagagaaagagctggagtcctttaaaattaactgcctgtttttctgtggctagtgagccttctctctccctttcccacgcattgtgaagactctgtttctctagctgtgcagctgcaaggtcactagacagatcatctcaaatcataaaacacgttgttccttgaaaaataagaaatgatgtaatgcatgtctcagttgaataactgtctttgtttcttgcttctgtaatatgctccccctacaaaggtctccccccaccccacgaaatgcttaaaaggtagcttgactctttgttcgggactcagtcctttgaacgttaatccgactgggttaatgaacctaaattattaaataattcctcctcaacccctcggtctctgtgattccttaattatcccgcagcacttgtgttttaagaagaacataaaaagatactaaccttatcttctggcaaaggttagttttaggatttagacaaaatttgcattctccacactgtgggatgtaaagtgggatgacagtgtcacctggaaacaaatgcaaagacatcctgaataggtagtatctatttctaaatgaaaacatcagcccttgcaaattcctgtcaacggatgtggctttgcaaagttaaaaacttcaagtcttagaactttacctaggtaacatcattcagatactgtctgaccatgcaaaaagtatgtttcaatatttttatctaaatgaaactctttaaacaataactgaagaacaatgaagttatatgcttcaaaatcctgcttcattgatgcatctctaaaaattcttgcttaatatgccaaaattggttttggaaatgtacttagaaaagtttcacaaaaacagtagtctgcaaaatcagagagaaaaaaatatccaaatatttgtgcttcccagatgaggaatcaacttaatcttgacaatctacttagatgatacctattcataaatagtgggtagttttatcagaaaaacaatttccccataggaataagccaaaattattaaacaagtggttcaagtattctccttacccgccttcagcttagtaactccctcaccaacactttccacaattccagcaccttcatgtcccaagatcactggaaaacaaccctcaggatcagctccactcagggtataggcatcggtgtggcaaaccgcagtggcaatgatctatcaggacattaaaacaacgaatgtgtaagtatgtgtgcatgcaattcagaggtacagatacaagaaaagtcattttattataatactatatttcattgactctaagacacatttctttcatattttaacctctctaaaatcagcatgtgcttataatccatggcatcttaacaattagaattggcagcaattttttagtggtacataaaagcaatggtgcatttatatgcaacgaaatagggaacatctagtccccctttcagcgcgcgttagcaagagaaggtaaacaaggtcattttatgggcactatgccttcaagcatggagagaaccatcgcctgtgtgcaaaacaggtggaatccaactcacttctagtttcctcatgacagctgggaaatatgatttttaaagaggtaatgactatttctgaaataggccagtctgcttgagtctggaccaaatttcagaactttcagaggaaccaactccctttttacaaaccacatacaagttctatttaaataagcctgttatctctatctctctggctttcaagtaacttattatttttttttgggacaagagtctcgctctatcacccaggctggagtgcagtggcatgatctcggctcactgcaaactccgcctcctgggttcaagtgattctcctgcttcagccttctgagtagctgggactgcaggcgcgtaccaccaggcctggctaattttttatatttttagtagagatggggtttcaccatgctggccaggctggtcttgaactcctcacctcattatctgcctgccttggcctcccaaagtgctgggattataggcgtgagccaccatgcccagccgtaacttatattttaaagccaccaaaagcacagaaaggcaaaatcttggagtatttctatttatgcgtctctgctcctggcttatatatccacttacaacgtaacaatctttgctacctgtctgcagttttgcagggaagatggctgtactcattgtgtccatacagctcaatgagcacaatgaatacccattgagctgtatgggcacttaatacatccaggacaaacatcttcagtggcaaaatcacagtcagcttaatttctgaatttgaagaaaaaaacactattatatgatttcaaattcctgtgtatgggttgcaaaggaccttaagatgttatttgggccaggtgtggtggctcacacctgtaatcccagcactttgggaggctgaggcgtgtggatcacttgaggtcagtagttggagatcagcctggccaacagggtgaaactccgtctctactaacaatacaaaaactagccaggcgtggtggcgcatatctgtaatcccagctactagggaggccgaagcaggagaattgcttgaacctgggaggcaggggttgcagcgagccgagatcgcaccactgcactccagcctgggcgacagagtgaaactctgtctccaaaaaaaaaaaaaaaaaaaaaaaaaagataaaaagacgttatttggtcctggtctgctccacctggtatttgtgatctttgggagcatgagccagtatgtgtggtgtgttttgaaagtgagatggtaggggaagtatactccaagtcacagctcttttttgctgtgactctcttcctagaatgttaatgatcactactctaaagcactaattttatatcaaaacaagtagagagtagtagaatgctaaacacatgaagttttctacatgccaaggtttcaaagatctctccagctggctaccttgtacaatatgcctctctccaagggtaacatcatttctctgccaccagaggttgagaagcactagaataatgaattccctgaaccctacccttgtccgccagggtgggtgcattttaaagctctctaagcaagctgacttcatttgcttattactctattcaatcaggagcctcttctcaaatcttgtttaagtcgctgtagcaaaactgaagaccatttctgtcagaggcattttaaccagagcgactccaccttgaataggcgctgggtaaaataaggctgagacctacctactgggctgcattcccaggatgctaggcattcttagtcacagaatgaaataggaggttggcacaagacacatgtcacaaagaccctgctgataagacaggctggggtaaagaagccagcaaaaacccatcaaaaccaagatggcaatgaaagtgacctctggtcatcttcaaggctcattataggctaatcatagtgcatttgtacaccaaaaggcagtctcaccagtgccacgagtttacaaatgccatggcaatgtcatgaagttaccctatatggtctaaaagggggaggaatccttagttctgggaattgcccacccctttcttggaaaactcacgaataacccatcctttgtttagcatataatcaagaaataactatatgtatactcggttgagcagcccatactgctgctctgtctatggaaaagccattcttttatttctttgcttctctaataaacttgcttccactttatcctatgaactcactccaaattctttcttgcgtgaggtacaagaaccctctctggggtcagaataaggacccctttctggtaacatttcttcttttgtttctaacgtgtcagcatatatttaaagttatctaatcagcagaaaaatgagtatcctacagagttaccttaaacctaaactgcagaagataaattgcaataatccagtgacccatggggatagctgctcagcccaagatcaaaactaaaagagatggagaagcatgctgcaaaggtgaaagataagagaaggatgttgtgattgtaaggctggatgactttcaacaccttttctttgacactgtcctttgggatttatcctctgcagatctcagatctactcatctatccagagacctcattgtgtctctttttttcccagtgccttaaatgtatcattaccttgattcgaacttcatgagcctttgggggtgccacctctatctcctctatggagagaggctttccagcctcccaagcaactgcagccttgcacttgataacctgaagtggggaaaaaagggaataagctgtttatcctcctaaacaagtaactacttaatagccaatttagatacagattaatgctaatcttaaaaagtatatcacagattcacaaagaaacatatgcttccaagtgatatgtttttagatttcacacaaatagtatacatcaaaaatgatttaattgagatgattacctggtcagatagaaaagtatcttttggttaaaaagttgtactcatcaaatatttaatggccttctacagtgcatatgcaaaagcaggttaagaacacaagttccgagagaatctgattcagcaggtctggcatggggtccaagaaatctgcatgcttaacatatgcctgaagaaattcttttgctcaggctgttctgaataccaccggcttggtgcaaaactgcagggtgggaaggaggattaggagtgtaacagtgaggagctatatcccttgtaactgcaccggccaatacagcagccacttgccaaatatgactactgagctcttagaaaatgaccactggccgggcttggctgctcacgcctgtaatcccagcactttgggaggacaaggtgggcagatcatgaagtcaggagttcaagaccaacctggccagcatggtgaaacctcatctctacaaaaatacaaaaattagctgggcatggtggtgcgcatctgtgtggtcccagctactcaggaggctgaggcaggagaatggcttgaacccgggaggtggaggttgcagtgagccgagattgtgccactgcactccagcctgggcaacagagcgagacatcgtctcaaaacaaacaaacaaacaaacaaaactgagatatgctataaatatagctggactttgaagacttagttcaaagaaaagtaaaaatatctcatcaacagtatttttaaaaatactgcttacatgttgaaatggtagtttatttataacaacattataaataatgtaatttaacataattaaaatattaaaacttcactttttcctttttaatgaggctactgaaaatttaaaattacacgtgactaattatagcacacagacctgctttagagattatagtcatgtataccctccattacaagagaatcacacgtaatgagaaaggttctaattagtttacattacacttgagaaatgtgtggacagactaaaggttgtaagccactgggtttacaggagacagactttaaagttaataattacaaagagtgtgatttaaagagacaggcacaaagtaatacagaaagcaaaaaaagtaggttaagagtgtaactttgcttggtttgggagagcttcacttctaaccaggatactgaaggatgaggaaaaggtaattataaatggtggtaaaacacctacatatagggtgattgtgagaactgaataagaaagaatatgaagtccctggccgggcgcggtggctcaagcctgtaatcccagcactttgggaggccgaggcgggcggatcacgaggtcaggagatcgagaccatcctggctaggtgaaaccccgtctctactaaaaatacaaaaaattagccaggggaggtggcagtcgcctgtagtcacagctaccggggaggctgaggcaggagaacggcgtgaacccaggaggcggagcttgtagtgagccgagatcgcgccactgcactccagcctgggtgacagagcaagactgcgtctcaaaaaaaaaaaaaaaaaaaaaaaaagaatatgaagtccctaacacaatccttggcacagcatagctttgcaaaataagttagtagttattggtagcaacagaacaaacggttgagggaaaggagaggtgaactacatagagatataaaaaatggcctctgtaggccgggtgcaggggctcacgcctgtaatcccagcactttgggaggccgagatgggcggatcacctgaggtcaggagttggagaccagcctggccactatggcgaaaccccgtctctactaaaaatacaaaaataccgagcatggtgacgggcgccggtaatcccagctactcgggaggctgagacaggagaatcgcttgaacccgggaggcaaaggttgcagtgacccaagatcgcgctatcgcactccagcctgggaaacaaagagcgaaactccgtctgaactggcgggggaggggggggggagggaaatggcctctgtaaattggtgaggttggaaatgtggaaatgatcgtttttaaaattaaattgcagatattaaatctcatagtacaaagaatcagacactgcattagaacctttttcatttcaatgtgccataaatttcaactccacaagtcagattcagaatactaacaattaagttatgcaacataggaatccaaagaaacaagaatactaaatttgatggcctgctcccctttaaaaaatgtcttaatggagcctaaccttttccttttactgacaattctaagcaaaacaaagccccactctaaatccgcgggaaatggccctacttcaacatttgaactatagtaacaattataatctttcaccttctctgaataaagacactcagtaataaggaaaagcaactaccagtttaagtctgaaagactgtttagagtttatttctttcaaactccaatatgtttaaggccatttgtcttactagaaaatgtccaaaattgcaaaacattaaaataatcagcaactttagactgagtatgttattcgtaatttctgcctttctttactgtctaatttgtattttatgaatttgtcatagaggagcagacctgggtcggaatcccagctcgccatcgttggtgtgaccaagcacaaccaacctcaaacctcagtttttggtaagatggggataacacctcgcagaggtgtttgttacgtgaggactagagggaatataaatctcttggtatttaagtgctcgaaaatgtttctgaaagggacgtaggggtctttccaaaatacactccttggaggcacaataattaaggcgtaggctcaattatgcaacacaagcaacctaggagttagaagcacgggatctggctgcagctctgccaagtatgcaagctgcaagaatgacccagagcgagttacttaatttcgtgtaagaagcaatgcgtggccgctcctaagccatttccactgggataccgacctgaccagcccctgccccccactctccggctctcccacccccccaccccgttccgactgtcccagaagcagcaaagaaagctgcttcccaactgaagagccgagacaaagcttccttctctttctgcccctctgagccgctcgctgggggcccagtttcagaaccaagagccagatcccgtcttgggcgccgagcctcgcgcgcccccgaggatagcagcctagtcccatgccatgcactccctcccttggactcagggccctccgctcaacgggccctacctcgttcgccatgttcacggattctggtcggcgcggggggctgacatccggggtgggccgcgcagcgacggaggcatgggcgtggcgagcgcctagcgaggggggcggggcgtggggggggcttgcaatggctccaaccggaagggcggtgctcgagctgtggtgcgtgccgctaagttgtgcgttccagggtgcactcgccggcgaggctgcacggcgccggtttcattgctaaaatccgacggacttgttgcagaactcgttttttttgtcgggaaagggcttccccgtgtaactttacagcagttatcgtagataagacttgcaaattacagatgtggacggtgagggaacgggaatttcactgaaagcgcctgagaaccagtaagagacctgcaacagctttgtgctccactggcgaatgcttcctcccctaatacacattatgtgtgcttggagacacaaggagtaagatacagcccctcaagggactcgtcatagggagaggacacagctttgggaataaaggggccacaaaggaggagagaggagtttgctgaaacttcccaagctcccattccagcagttcctgaagggtaggtaggattttggggagacagtagaacgtgggcagagaactttggaaggaggagatgaggagaacaaaaagtctcctgatcctggacagttttttgtgttaagagtgggccagagtgtagagagagagaatgtagtatttgtcggtttactctttctttgtttgtttgagacggagtctcgcactgtcgcccaggctggagtgcagtggcgcgatctcgggtcactgcaacctccgcctcctaggttcaagtgattctcgtgcctcagcctcctgagtagttgggatcacaggcacacgccaccacgctggctcaattttgtatttttagtagagattgggagtgggggcagggggttggtctcaccatgtatgccagtctggtcttgaactcctaacctcaagtgattcacccacctcagcctcccaaagtgctgggattacgggcatgagccaccgcacctggcctgccagtttactcttaaactctgttgtaaacgctgaattttgttaaaatagctctgtcagacacactgctcttttctgtctttcagtctttttcttggctcttttccgggtacatatggtaagattgtccaaagtctttccgtcctttcactccactctctcactcacactttggcttttaacgtctatttatggaaagatgactaccagattattatctccaatcaggatggctcccctaaactccagacttggacatgtaactgcctactggatttctgtctccattaggatatctcacaatcgaatgcaactcctaaaactcctattaatattttctccttatagggactctttcctctgtgtgttgacactctccacatacttaccctagccagaaacatgagagtcacaacttctccctctccctcggtccctgcattcagtttgtcaccaagccctaaatatctctctggtcttgtgcctctctctccccactgctgctgtattagttcaggctttcataatttcttacaggattactgaaagagcctcccatctgatttctttgatgccaggcccttgaatctaatacttaaaaaggaatgccctgttagtgatctttccaaaacgtaacatcaatcaatgccatttcctattttccttcaataatttttgaatgagttaggctataaataaataaataaataaataaataaataccattcttctatttaaaaatattcaagggagaacaaatggataaaatccaaactctttaggccactcaggctctgaattacttccttctgtatatacctctatccttatttcctgctctcctgccaaatttcacaccaacatttaaggaacattcgtagttccttaaagggactatgctttttcttgattccaggcctttgtgtatgtcaatacttctgcttggaatgcagcaagcaatttctagtgggaaaaaaaaaagacttggcagagagttttcttttccctattgcagatatattgtctattttctggaaagagacacttgcatttttgtagtgccttgtttaacaataataggcaagactttaggtttctggtctgacatgtaaggaatttagaagtcatcactccatcctaacaacaactaaaaagctaaaaaaaatgagaaattaataactcttcttagagctgtaagtgaagtggggtcacagagaaaacagcttctccaaaattagagacacagatgggtggattcaaagaatcacaacttaccatagaaacacacttttgcaggaactgttactggagtaggaaagtctgagctgtaattgatgaattgccagaggctcattgtggattagtttgagagttaaagattcttgggggacccaatcttaggggggctttcacacttttgtgagttttacctccgtgaattctcagagaagatcagagaaaaatccccaattgcttcctgcatgaggagtgtaaaaggaattattttgaaaaattctagtgcattttgttcttaacaagacttgccaacaaaagaaactattttactcgagcctagtgtactgggatttttacaagtggttaactgacctgggggaaaggaaatacccaactccagctccctctagacattctgtaccacctaagggggtgaaaaaacaaactgagaactgtgaagtttacagcctagggacacaggctcactaaaagactgagataaaatggtagaactataggacacttccccttcccgtgtatcttaccactacattactaaagggctatttactgcaatttctttgactcagtatattatatccgcctttcaatacaaaattacaaggcatattaaaaggcaacatagtttgaatggacagagcaagcagtggaaccaaacccagaggatgacagggatgttgctattatcagaccatgaatttaaaacaactatgattaatattgtttgaaatgcttgttccccggtgctgtaaagaaatagtacttgaacataaatttaatttagtaaggccatttttacttttgcagaaagggtacactggccagcagttttgccatgagagtacaccaaacaaaggagacagggtcatttataacctaatgtatccaccctactgctgtgtccggtttccattgtctggaacgggacctcacattctgtatttgtcctgacttgctagcaacttagaactttttaaaagaggcagaggtagaggagaacaaaggaaggaggaggtaacttgtggaatgctgagaaaggtaaaaacacttttaaataaggaagaggaacaggctatgacctagtgcttgcttggactagtataagcatgccagggcaaatatttaggagcacaggtctttgaataaattttgcttataagagaagttaccatttattcctaattagatgggcaggaaagtctttgaagaagaacctctactttattttttacagtatgctaagggctttaatgggaaaagtagacaacatgcaagaaccgatggataatgtaagcagagagatggaaattctaagaaagaattgagaataaatgacagaaaaaatactgtaacaaatgaaaaatgcctttgatgggctcattagtagactggatgtgactaaggaaagaatctttgagcttgagtatatgttaatagaaacagtcaaaacaagaaagcaaagaggagaaacgaataaatggaacagggtatcatatacatgtatgggagtaccagaaagagaagaaagcaaaaggagcagaagcagtattcgaagcaactatgactgagaatttccccaaattaaagtcaggaaataaaccacagatccaggaaacttagagaacaccaaacaagtgttccttccaaagcagaaagcacaaagcccacatgggttcactgatgaatttttccaaacatttaaggaaggaaatataccaattttctacaatctttttcagaagatagaagcagagagaatatttcctaactcgttttatgaggccagcattactgtaataccaaagccacagacattgcaagaaaactacataccaatatcccttatgaacctagatacaaatatccccaacaaagtattagcaaattgaatccaacaatgtataagaataattacatgccacaaccacgtggtatttatcccaggtatataaggctggttcaacattagaaaatcagttaatgtaatccatcacatcaatgggctaaagaagaagaaaataacataattatagcaataggtggagtaaaaaacatttcacagaattcaacacctaatcatgatgaaaactttcagcaaacgagtattagaaggaaactgtctcaatgtgataaagaacatctacaaaaagcctgcagctaacatcatacttaatggtgagaagctagaagacttcctgctaagactaggaacaagaaaaaggtgtcccatctcaccattccttttcaacatcttgctgaaaatcctacctaatggaataacacaaggagaagcaataaaatgtatactgattagaaaggaagaagtaaaactctctttgcttacagatgacatttatctatttacaaaatctgaaaaaattgacagaagtctcctgaaactaataagtgattatagcagggttgcatgatacaggtttaatacacacatttcagtcattttcctatatgccagcaatgaacaagtggagtctgaaattaaaaacccaataccatttacattagcatccccagaaatgaaatgcttaggtagaaatctgacacaatatgtacaagatctgtgaggtaaattacaaaactctgatgaaaaaaaataaatggagaaatgtctcatgtacatggatattctgaaacaacattgtcaaaatatcatttattcccatttgctctatagatttaactaaatcccagtaaaaaaataccagcaaattattttgtggatattgacgaactgatttcaaagtttttatttttatttttttttaaagtacagcataatttgttgaaaaaaattggaagttaagtgcagaatacagtacaacctgagagtgatattccaggccgggctgctcataagagtgagacagcgtggattgtcgccagagaaactgccttatgggagttttgcattattattattattttttattatacttctagggtacatgtgcacaacgtgcaggtttgttacatgtgcgtacatgtgccatgttggtatgctgcacacattaactcgtcatttacattaggtatatctcctaatgctatccttctccccgcctcccaccccacaacaggccctggtgtgtgatgtcccccttcctgtgtccaagtgttctcattgttcaattcccacctatgagtgagaacatgtgatgtttggttttttgtccttgcgatagtttgctgagaatgatggtttccagcttcatccatgtccctacaaaggacatgaactcatcttttttatggctgcatagtattccatggtgtatatgtgccacattttcttaatccagtctgtcgttgggcatttgggttggttccaggtctttgctattgtgaatagtgccgcaataaacatacatgtgcatgtgtctttatagtagcatgatttataatcctttgggtatatacccagtaatgggatggctgggtcaaatggtatttctagttctagatccctgaggactcgccacactgtcttcaacgatggttaaaccagtttacagccccactaacagtgtaaaagtgttcctatttctccacatcctctccagcaccttttgtttcctgactttttaatgatcaccattctaactggtatgagatggtatctcattgtggttttgatttgcatttctctgatggccagtgatgatgagcattttttcatgtgtctgttggctgcataaatgtcttcttttgagaagtgtctgttgatatcctttgcccacgttttgatggggttgtttgtttttttcttgtgaatttgtttgagttctttgtagattctagatattagccctttgtcagatgagtagattgcaaaaattttctcccatcctgtacattgcctgttcactctgatggtagtttcttttgctgtgcagaagctctttagtttaattagatcccatttgtcaaatttggcttttgttgccattgcttttggtgttttagacgtgaagtccttgcccatgcctatgtcctgaatggtattgcctaggttttcttctatggtttttatggttttaggtctaacattgaagtctttattccatcttgaattaatttttgtataaggtgtaaggaaggcatccagtttcagctttctacatgtggctagccagttttcccagcaggatttggtaaacagggaatcctttccccatttcttgtttttgtcaggtttgtcaaagatcagatagttgtagatgtgtggtattatttgtgagggctctgttctgttccattggtctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatgtgaactttaaagtagttttttccaaatctgtgaagaaagtcattggtagcttgatggggatggcattgaatctataaattaccttggccagtatggccattttcatgatattgattcttcctatccatgagcatgaaatattcttccacttgtttgtatcctcttttattacattgagcagtggtttgtagttctccttgaagaggtccttcacatcccttgtaagttggattcctaggtattttattctctttgaagcaattgtgaatgggagttcactcatgatttggctctctgtttgtctgttattgatgtataagaatgcttgtgatttttgcacattgattttgtatcctgagactttgctgaagttgcttatcagcataaggagattttgggctgagacaatggggttttctagatatacaaacatgtcatctgcaaacagggactatttgacttcctcttttcctaattgaataccctttatttctttctcctgcctgattgccctggccagaacttccaacactatgttgctaggagtggtgagagagggcatccctgccttgtgccggttttcaaagggaatgcttccagtttttgcccattcagtatgatattggctatgggtttgtcataaataactgtgattattttgagatacgtcccatcgatacctaatttattgagagtttttatcatgaagggctgttgaattttgtcaaaggctttttctgcatctattgagataatcatgtggtttttgtcattggttgtgattatatgctggattatgtttattgatttgcatatgttgaaccagccttgcatcccaaggaagaagcccacttgatcatggtggataagctttttgatgtgctgctggattcggtttgccagtattttattgaggatttttgcatcgatgttcatcaaggatattggtctaaaattctcttttttggttgtgtctctgccaggctttggtatcaggatgatgctggcctcataaaatgaattagggaggattccctctttttctattgattggaatagtttcagaaggaatggtaccagctcctccttgtacctgtggtagaatttggctgtgaatccatctggtcctgggctttttttggttggtaagctattaattattgcctcaatttcagagccttttattggtctattcagagatccaatttcttcctggtttagtcttgggagactgtatgtgacgaggaatttatccatttcttctagattttcaagtttatttgcgtagaggtgtttatagtattctgtgatggtagtttgtatttctgtgggatcggtgatgataacccctttatgattttttattgtgtctatttgattcttctgtcttttcttctttattagtcttgctagcggtctatcaattttgttgatcttttcaaaaaaccagcccctggattcattgatttttttgaagggtttttttgtttctctatctccttgagttctggtctgatcttagttatttcttgctttctgctagcttgaatgtatttgctcttgcttttctagttcttttaattgtgatgttagggtgtcaattttagatctttcctgctttctgttctgggcatttactggtataaatttccctctacacactgctttgaatgtgtcccagagattctggtatgttgtgtctttgttctcattggtttcaaagaacatctttatttctgccttcatttcattatgtacccagtagtcattcaggagcaggttgttcagtttccatgtagttgagcagttttgagtgagtttcttaatcctcagttctagtttgattgccctgtggtctgagagacagtttgttataatttctgttctttcacatttgctgaggagtgctttacttccaactatgtggtcgattttggaataagtgggatgtggtgctgagaagaatgtatattctgttgatttggggtggagagttgtgtagatgtctattaggtctgcttggtgcagagctgagttcaattcctggatatctttgctaactttctgtctcattgatctgtctaatgttgacagtggggtgttaaagtctcccattattattacgtgggagtgtaagtctctttgtaggtctctaaggacttgctttgtgaatctgggtgctcctgtattgggtgcatatatatttaggatagttagctgttcttgttgaattgatccctttaccattatgtaatggccatctttgtctcttttgatctttgttggtttaaagtctgttttatcagagactaggattgcaacccctgcctttttttgttttccatttgcttggtagatcttccttttatttgagcctatgtgtgtctctgcacgtgagatgggtttcctgaatacagcacggtgatgggtcttgactctttatccaatttgccagtctgtgtcttttaattggagcatttagcccatttacatttaaggttaatattgttatgtgtgaatttgatcctgtcattatgatgttagctggttattttgctcgttaattgatgcagtttcttcctagcatcgatgatctttacactttggcctgtttttgcagtggctggtactggttgttcctttccatgtttagtgcttccttcaggagctcttttagggcaggcctggtggtgacaaaatctctcagcatttgcttgtctgtaaaggattttatttctccctcacttatgaagctcagtttggctggatatgaaattctgggttgaaaattcttttaagaatgttgaatattggcccccgctctcttctggcttgtagagtttctgccgagagatcagctgttagtctgatgggcttccctttgtgggtaacctgacctttctctctggctgcccttaacattttttccatcatttcaactttggtgaatctgacaattatgtgtcttggagttgctcttctcgaggagtatctttgtagcattctctgtatttcctgcatttgaatgttggcctgtcttgctaggttggggaagttctcctggataatatcctgcagcgtgttttccaacttggttccattctccctgtcactttcaggtacaccaatcagatgtagatttggtcttttcacatagtcccatatttcttggaggctttgttcatttctttttattgttttttctctaaacttctcttctcgcctcatttcattcatttgatcttccatcactgatacccttccttccacttgatcgaatcggctaaggacttctctgcattggttattctagttagccatttgtctaatcttttttctatgtttttaacttctttgccataggttcaaacttctcctttagcttggagaagtttgatcatctgaagccttcttctctcaggtcgtcaaagtcattctccgtccagctttgttccattgctgatgaggagctgcattcctttggaggaggagaggtgctctgatttttagaatttcagtttttcagccctgttttttccccatctttgtggttttatctacctttggtctctgatgatggtgaggtacagatggggttttggtgtggatgtcctttctgtttgttagttttccttctaacagtcaggaccctcagctgcaggtctgttggagtttgctagaggtccactccgaccctgtttgcctgggtatcagcagcagaggctgcagaacagcagatattggtgagcagcaaatgttgctgtttgattgttcctctggaagttttatctcagaggggtacccggccgtgtgaggtgtcagtctgcccctactggggggtacctcacaggctactcagaggtcagggacccactttaggaggcagtccgtccattctcagatctcaagctgcatgctgggggagccactactctcttccaagctgtcagacagggacatttaagtctgtagaggtttctgctgcctttcgtttgtctatgccctgcccccagagatggagtctacagaggcaggcagacctccttgagctgcggtaggctccacccagttcgagcttcccggaggctttgtttacctattcaagcctcggcaatggcggtcaaccctccccccacttcgctgctgccttgcagtttgattgcagactgctgtgctagcaatgagcgagtctccgtgggcataggaccctccgagccaggcacaggatacaatctcctgttgtgccgtttgctaagaccattggaaaagggcagtattagggtaggagtgacctgattttccagatgccatctgtcacccctttccttgggtaggaaagggaattccctgaccccttgtgcttcccgggtgaagcaatgcctcgccctgcttcagctcacgctcagtgtgctgcacccactgtcctgcacccactgtccgacagtccccagtgagatgaacctggtacctcatttggaaatgcagaaatcattcgtcttctgtgtcactcacgctgggagctgtagactggagctgttcctattcagccatcttggctccaccccctaatttttactcttaagtaaggattattttggactgagggactcactaagtgaaagtgattcatcatttcagactttgttacagggaggtgattatgcagtaaacatagtcaaacatttcaaaaatttgaagcatattttataaaacttacaagaaagaaagatacatactggatgaattgaaggaagaattcataaaaccatatgtgtctgcttcatattgagggaaactttttttttctttttttaacctctcagcactagttgacattgcttggctacgtactccgttagagtagagacagctattgccatagctcctgtgaattgaaacagaaattgtccatagtggaggcagtcacagatgggttaaacatgaaggagtcagaagtggtagaactaattctaaatactgagattccatactgagaggtaccaaagctacccaacaaactcttttcctcttgggaaacacatatacacctgacataaaaataaggtagacatttagtttgtagctgtagatctcaatagcattgtgtaatttttcctgttacttttcaagaccaacacatatcacagtatagggaggtcagagactcctgagggcagctctacaattctgaagcagtacatttcttttatatttttgtaggtaatgatttgttgtaagttatccatagttgtaagtaaccggatcatatgttttccttgatattatggagaatttgacaggttggagaaatacaaggtatgatttcatgattaaacataacaggaaatttaaatgggactttacatatgatctcaatttagctaagaactcaagaccaagctatacagacaccaaattacctccacattctaaagcaaggggctagaccaccttatgtaggacatgctaagagatagagaaatcgcttctgccagcattagcctatctcctgtctctcatctatataaggtgaggcaaagaattcatggggaagggtggaagtatttggaagtgaagatttctttggagatagttgtcagtatgctgtgtttgcccttcccatctccacagtgagggtggtgaaagtacttccccttcatctgaagccaagagaagaaaactgctcagaaagcttgaaatgttttctctggaatctagaaaattcaagttctggtatgtgaaagaaaaaaaaaattaaggcaagaagctgctgtcttactctactttctgctggtataacagaatacctgagataacagcattaattcattcatgagagcagagccctcatcctctaatcaccttttatttttatttttttgagacagcatctcgctctgtcacacagtctggagtgctgtggtgattgtagctcactgcagcctagaactcctgggctcaagtgatcctcctgccttagacttctgagtagctgggactacaggcgtgtgccaccctgccctgcttctaataacctcttaaagattcctcctcttaacactatcacaatggcaattaaatttccccatagttttggagggaacattcaaatagtaacatctagctagaacagcctgtctgttggcagaatgaagtagaacagtttagtgggaacaaggatacaagtgtatttttcatggaccaaatacagactctggaaaggatacggttgtggatcatcgggaaaagaacttcacgaaagagatagatgcacagatggatagtgaaggtcaccctggtgaaagccaaggactgaatgcaggtcttaaatggccagttgtggaaagaatcatccttataaaagaattgagataggagatctctaatagaggaggagttctctaatagaggaggagttctttgtgaaacccacagaaatcccccaactcaaaaaaaaaaaaccggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagatcgtgccactgcagtccgcagtccggcctgggcgacagagcgagactccgtctcaaaaaaaaaaaaaaaaaaaaaaaaaaaaaaaaaaaaaagaaaaaaccaaaaaacgtagtatctaaaaggtagggcaccaatatcaaattgcaactgtactggccatatgcaatgtagagcaccaatatcagatcgcaactgtactggccatatgcaatgtagtctttttctccaggtttcccctctcttctaggctggacaatggaggaggcttgaaacagtagctggcaagtggtagaagagatggagcagagaagcaagaagaagcagactcctcactccttcaccagggtggatttgctggtttgaagcagacctgagttgggagaggagagaggcgagaagttttaattggatgaaatatttctttagactggtctatacttttttctttatatctaaaattcactggaagagctatgaaatctgtccaagatttcgttcagttcaggaaaaaccaaaaccaaaaccataaccagtgagtttataaaggaagtttatggtggattttttaaaattattttgataactgacattggggtattctccatcttatgagtctgaaaatatttcttcgcagccaggtaatacacatgtgactcagatgccaccaaagaagtatgtgtccaagacctcaagttgaaagctgtggactgcggagggactctctggtgaagttgttgcaagcatgattaattcattggggcagcaatggcagccaagccagtggtggtatcctgtgtccaggagtggtattggtgattcagtttgcagcctctgaggtacaaggataaggaaaatggtgaccagatcagttttgctgcctcagattagacataatttcaagctgtatatctctaatcctcctaataattctatgacctacatgatatcctttaaataaatgacttatcatttaaaataattccgaattgatttctgtgacttgcaatgaaatcaataaaaaaaaaaaaatacctggactattactagaaaacagaccaccagggaaatgggtcaatctgggattaattttctgacctggtttaggctgaaggcagtgataattcagatgactctaagggtggagcagctctagacatgcaggagtggaacagttaataataaaaaaaaaacctctgacttcctgaaaggaaataagaattaaaggcaaggccttagagacaatagggttattgccatggaagaatattaaagtgcatgagctatttaaagtctgtaaggtaggtggttacttcattaaagtgttgggcagtttagttaaggagaatggtaagcttaaaatttcaggttcttggctcatggtataaactgaaacctaaggatgttttatgacataatttcttgaagccataaggttaaactagccagaagccaaattaaaaatttgatcctgtaggtttccagctgtaacactgattaaattcataggaacacaaaagatctcttaggtgaaaaccagggcattgactgggaaataataggatctcaaatactataatgggtatatattgaaagattcaaatgtccctcagattatcctgaactcccagtctccactgatctttctttgcctactgaaacattttcttttgcctgtctgatgaggatgtcactgcttgatttgaggacatataaggaccttggctgagcagcgtccctgtaaggggaagccaatttcctcatgtcctattcacttccatctctcattgtcttcaggcctataattatagtcagactaagcagtaagggggcaagttggaaggagaagtgttaaataccaaaataatatgtattatattttgctgatgaatgctgaccaaactctgaccaactcttgcgaaaatgaattctgtgggtgctagggcaagtggggaagggcataattttagatcaggctaaatgggtcatgatgggtgcctttattagaaattctgtattgatcacactagctcaaaaaacattagaagttaaaattgtttgttctatttatagatagaaatccaagctcaaaaatgatccatgttcaatgaagttgagatgccagatatttctttagataatataaaggaaggaatacaaggacacagagagaggaatgtagggaggaatttttcatgtgctacgtgcttacctaacccccatactatgttccttgagagaagcccagaaaataaactttccaacaagggattgagaaataaattgtcaagggggagggctatggttcatttttccctgtaggttggcaggggatgctttggttgagatgggcttcctgatttcaaccaggataccagatactggggtggtagaggctaagtagtgaggcaggagaagccaggtaggcatgatcactatgacaggtagctggagtagtttggaaaatagtattgtctgatctactgcaatttttggaggtggcagtggaggtaccatatgtatcaattagattgttttgcctgaaaataatagaaatttgagtaaaagaggcttaaaaaatgaagatttattattattattattattttgcagttgcaagatttaatagagtgaaaacagagctcccatacaatgggaggggacccaaagggggttgcccctgaaaggaggttgcccactcccggctcgaatgcctggagtttatatcccaatcattgtccctccccctgtgccctcaggcgatatatgatttgactgtgtctttaccttctgctctagcctaatttgtattttagcgagccctctttactacctgattggttgggtgtgagctgagttacaagccctgtgtttaaaggtaggtgcggtcacctttcccagctaggcttaggaattcttaatcggcctaggaaatccagctagtcctgtctctcagtccccccgtcaacaggaaagcccaagtgctgttggcaaggttggccgacaaccactcttaactgcttcctgctgaattggggcatagtaggggttgtgcagttgagatttccttggaaagggtggcttcgatgtcattaacatcagagcatgggctagcaagccggtccaggggtccgtggtaggtcttagtcatggactgcatctgggggtccatttgaagaactgtttgcagttttacagcttcgattctggaagagacaaacttaacaaggaggttaaagatacagggattgaaatgtatggcctgaagtgcaggggattatttctttggcacacttcacaggccctgactatctgctttatagttttgaaaaggcctggttcagtaaataatgatgtggcaatctgatgggtgctatcaatgcctaagtaaaaggtttggtgaagggttttaagtaatttccattggttagctgcaggcagaagtatttttcctttttcggtggctagccatcctgaggggaggaaacgatgtcgatgtccttgtgagtttccccattcgatttcttctgctgagtactggggcttggtttcctggaggggattaccccatactaggggtccttctataagcttttctaatggagggtcctgtcttgcggctctttttgcttcagtatctgcttggcagttcccttctatttccctttcctttcctttctgatgaccccggcagtgtaagactgccacctctttaggtttctgtactgccaataataatctcctaatggcttcctgatgtttgataggtgttcccttggaagttaggaattccctttctctccttattgctgcgtgggcatggaggactaggtaagcatacttagagtctgtatatatatttaccctttttccttctcctaattctagggtataatgacccctgcttttgctaggatgtctctccctaacaaagaagtggagctttcaggcataattagaaaggcatgtgaaaagagtaaagttccccagtcacaacttagtggctgggagaagtatctagtgactggctgtcctaggacccctcagatagtgacagatctggaggacagttgtccaggacaggagagtaagactgagaagttcacgccagtgtccaggagacagttaacgccctggccctcaatggtcaagcatacccgggcctctgtgagggtgatggcatgggctggcacttgccctggaaaccctcagtcctgctgctggatcatctggttagtggcttctgactcagaggaccttcatcccctggggcagtgggccttccagtgattcccttgacataaggggcatggacgagggggtggcttatttctattcggacaatctttttgaaagtgtccttgtagaccgcactggaagcaagccctattaggcattcagtttgcccaggctttccctttttcagagcctccaaagtctacttgcctgagggccacgactaaagcagtgggtggccttttttgttttatcccagttttcccatttcacctgcttttcctgatctctattataaaaaaatcgaggttgccaatagggtttctaagttttgctccaggcctaaggcagacttttgaaattttttctaatgtgtgcaactgactgagtgataacttatcctttaagattagttggccttcagtagagtcaggtgacggagagatatgcttcctcaatgcctcccttagtctctccagaaaagcagtaagattttcttcctttccctgtgttatagtggacatcattgaatgatttataggctccttcctagttttccttagtccttctagcatgcaagttagcaaatgtctgtggcaccaatttccatgttctaattcagcgtcccagtgagagtctacactgggaactgcctcctggcctgtggggaatcattccctttcctctgttgtcatcctatcattgacctgactgagataccagagattgccaaactcttgggctgcagttatggtggcacttctctcatttggggttagtgtctgatctagcagtaacattatatctctccatgacagatcaaaggattgtcctaacccttgtaaaacatcaatgtagccatcagggttatctgagaatttacctaggtctattttaatttgtttcaagtctgagagggaaagagttacgtgcactctgactgggccaaattctccagaatatatcttaggagcttttttgccttggggggaacatttcccatctgaaaaaagaacatagggatgccagcacccctagtcattttctgatgagccttagtcctacagcgtcctctatggtcctaatgcttattcctttccagggtgcataaccacccatggacatctgcttatcggattagttaacattcactgatgtagcagtcctgcaccccttttcccgcctttcttgaccacaaagaaaggggtccaggctgctggattctagtggtcctttaccagtgtgcccaacattgcctttgtgctcaggggtgagtcctagagctaggctgggttcctgagtatttcataacaacccagttgccccatcaagatgcattcccataaacaacagttcttatgcaaattcatttcagagagggtgtaggtaacctttgagtcaggattgagatggagttttttgattctgtaagtactttaaggcttggctgagtgcaaagggctcatacgtttgagcagaccaattattaggcaatttttctaactctgcttctacaagagtttccctatcaattactgaatacccattgtggttttttttctccatcacctgggaggaaccatctattgtcctgttctgaagggagttcctcctaggtctggtgggaccttcgtatggtaattaagatttaaatccctttttaggaaatctgctgggttaagggaaatttcagtggttaatgttaaatcatctttttctaacagaatagtcctacactttaagatttttgagttagtaagctaccttttggctttgtttttttttttttttttttgacttaggatagttctgaactggtgaggtgtgttcacaatgaggttttctctaaaagttatttttctactttcttctgttagcaaaacagttgccactacagattgaatgcatttgggccatccgcaggttactgggttaaagatttttgataggaaggctacgagttgttagtggtctcagtgttttcaggctacgcccttgtttacactgacaacaaggtagtatcgagtgttatagggtcacagagaagaccttcaattatcaattataggttttaaatttactctggcttttaaaggaatagggcacactgttttttctttactacttctgtctttctctttctttctctctctgcctctcttacccaccacccccacctctctgtctctctctgtctctctcctctctgtctctgtaggtggattttggaaacacagtggagggtcgttcacttgttgcccccatttgccgctataggaatatgtgcctccctttaatttactcaattcattttcatcttgatatattatgttgtagacccagttccagttgttaaagtactgggttatcagttctaaggccctggcaagggtggtggggaacgggtcccacataactgcccatgtcgagagctgcatgcctaaattgggaggaacaccagggataaaactccctggattcatagcctaggtgcccaaggacacagcgtagagcttccttagatccctttagagatacaacttgctctaatacttgggagaggaagtgaaagtctgaagcattagtatctaggaggcagggatcagaggaagtagattcagaagtaagaagaattttggggctacactttcaagaaagttgtggttgggacccaggaggtatgggtcagaaggagaggtaggggcacacgcatgggcgactgttgagtagagacttctggctgcaccataatctcgaccatccaatgctgggggtttgggacaacagctttctgcctctagtcaaccctcagcttccccaggaaaattgtgaaagcaaaagctggttctaggtagaccaatgctcccaacccagaagggttggggcttgttagaaagccttttcccaggaagcctcacacctgagtcttaagtccagtggccatgctaattgtttttaactggctgacaggtgcctggtattttcctccaattctaaggaaggataggacagaatggcgagcaaattattactcaccgctttgaagaatccccgtacgggccaccgaatattacgggtggatctttgttcatagaactcccaagatggtggtgggccactcccaagatggtggtgagccactcccaagatggcagcaaaccttttgttctctgacctggggttcttggcctcatggattccaaggaatggaaccttgggccatgcggtgagtgttataactctattagaagccgtgggtcacggaagagaaccgtggaacccagcgactagtgttcagctctattaggacgaacctgggcacttagctgcgcaggaacaatggcgagactttagcctgattgggagtggcaatggatgcctcactggatcaggggcacagcggacaccctgctggatctggagtggtggaagtcaacagcgggtctgtgatggcagcaaacagtggtggacggcaagtgaaagctcagctcgagccataacaaatacgaaccagaagagtgtgcagttgcaagatttaatagagtgaaaacagagctcccatacaatgggaggggacccaaagggggttgtccccccaaaaatgaagatttattatctcacacaaccaaaagtctagaggatgttgataaattctccttttcagtgatgccagggccctagattgcttctctgccattttcttgtctttcccatcatggttgcaagacagctgctgcaactctggcctgtcatgtttttacatgacagcatccaagggcaggaagggaagagtcttcttttcacccttccctactccttcccctgcttttttttaataaagagggaaatggctcccaaaagtcctccagcagacttccttttatgtctcattcaccagaactgagtcacatgttcattccaaatcagtcactaccaatgggaatagaattagactaatcatggatcatctcctggagcactgggagagtcccatcttccctgagctcattattgcctgtttcttgaacagaattggggttctctttctaagggagaaatgaggaatggctgatgaataggcaatcagtgtagggagcctccttttgggggagttctcacctatttataatgtaacttaaaagacttccagctttgagcagagcttagagcagaagaagtctctttagctggcctaaattgtcacaagaacaactctgatgccttccttttatggaataaatggttttcttttcttttcttttttcttttttttttttttttgcaacgaagttttgctcttgttgcccaagctggagtgcaatggcactacctcagctcagctcaccacaacctctgcctcccgggttcaagcgattctcctgcctcagcctcccgagtagctgagattataggcatgcgccaccatgcctggctaattttgtatttttagtagagacgaggtttctccatgttggttaggctggtcttgaactcctgacctcaggtgatctgcctgcctcggtctcccaaattgctggggttacaggtgtgagccaccgtgcccggcgggaatgaatggtttttaagtgtctgtggcaggtgttgaatgtaacctgtgggaaggtccaataatagaagcatgatggagaacctcgagttttagagcaaagtaatgcttgtttcagtcctgttgtgattaaatgcctggctatgagacacactaggtgattgtgctacctgagtttctcactgtgaactgggtattacctgatccacagaattataaggctggacatgcccaggagaatactattatcaagtggaagtgatatatctgtgctatctgagtgggctctctctctctctctctctctgtgtatatttgtatatatacgtatatatatatacacatatatatgtatatatatacctatgtatatatacgtatatatacataggtatatatgtgtatatatacacatgtatatatgtatatatacgtatatatatacataggtatatatgtatatatatgtatatatatacactacacacacacacacacacacacacacacacacacacacacacacacatatatatataaactggatcccagcaggtcccaaaggtgctgggagaggaagtgaaggaagagttaactcacactcttccttcacttcctctccttgggggaatttcctataagcagttcaaagagcaggaagagaattatagcttggtttagaaatgctctgcacaatatcctggtagttgatagtggcagacttggaaaaatcttgctggggtatagaacttcaagcattatatttctgtgagccctcttggacaggaatgaaatcacctgaagtaaagatctacattgacttatgggtagtaatttatgatttggtcagatgatcagggactttgaaggaatatgattgtaagattggtaacaaggaaatctggagtagcggtgtgatggaccttttgtaatggtcactgagtgaggaaaattatgttccatgtgcttctcaccaaaaggtctgattttgaaggacattgtcaataattaggtgaacaagatgaccaccttggggatgttgttgagcagggcatccaactgcttgctcagtgggcttgtaaacgtagtggccgtggatataagcatggacccaacatcatagatactttcttgtcaaggctgttctagctcagccactgctgaataccagattgagaagtagcaccaccaaccctgggtccccagtatggtataataactcaaggggagtagacagtttctatgggacaggttggtcacatttgatctctttcatcatggaggaggcagaaatttgttctcactgggaccaacacttactctggatatagaattgttttctggctctgtcatgcttctacttctactatcatccatgaatttattaatataaattaaacatagactcagactctgagatttaaaaaattaaggcataagctttaaattactccattatgcatgtagggggaaaggaaaatgctaatgactttcttttaactaagcagaaaaactaaaatactgcttagaaatacagagatgtattcctacaacattcttcccaggtcaaaaccttgtcagtaagacaatcagaattacagattctttttggaggttattttcataggacaaagcaacactttctaacactttagagtcttataagacattttggttcaaataacatttacagagaatggatttctttttagtaaggaacagaaggtgttctagtaacagttatgaatattcacacagctccatattgctgagaacaaatggatattttttggaacattcttaatttattacctaatcaaatcagattttttgaaatagttaatgatgcagaattgtatttctcttttcatagatgcaaggagaagggacatcctttttctcagacttctttggttaattataaagatttatttttaaggccagcttctgaaattttattagctatattataagcaggtctatagaagataattttattgtcagaaatggagaaagtgataaaaagttatttaataccaaaacataggatgatattgtttttcttctatattattaagtaccttgtttacctataatttctttcaaaaagaacttgaaacttcagagaagataaatggtctatccttgggttttttattttattttattttattttgagatggagtctcactctgtcacccaggctggagtgcagtggcgggatctcagttcactgcaagctccgcctcccaagttcactccattctcctgcctcagcctcctgagcagctgggactacaggcgcccgccaccacacccggctaattttttgtatttttagtagagacaggttttcaccgtgttagccaggatggtctcgatctcctgactttgtgatctgcccacctccgcctcccaaagtgctgggattacaggtgtgagccaccgtgcctggcctatccttgggtttaaagttatagaataatagtgcctaagaggtatgaaagaaaaaaattaaaaaataaagttatataataagagcagtctggtttaatagcatttcagagtggatatatttaggaattttataaagctcaatatttgtcaacaataggagatggctggcaagagaatacatagagactgcatttactggcatatttttccaaataaggatgttattcagactgtatgtagaatattgagtttaagttatacttagagacatttaattaggaataaagaggacttggtggtagtgggaagagtaggggagaggcatgccaattgtcttcaactctccgagggactaggcttactctgtgatactccagagagcagaactaggaaggcagagcttagatttagccataaggaagaaattggcctgtgtatgtgttaagcccaaggttagctgacctgccagacatattttaaaaagtgatttctttattgcatttggagttggaaaccatccatgtttcttcacccaactttttactttgaaaaatttcaagatttcaaaatctgaaaaatagtacaataaacatctctatgtccttcacctaggtgtaccaatattttttgccacacttactttctctctctctctctctctctcacacacacacacacacacacatatttttttgcatcaatgttcatcaaggatattggtctaaaattctctttttttttgtttgtgtctctgccaggctttggtatcaggatgatgctggcctcataaaatgagttagggaggattccctctttttctattgattggaatagtttcagaaggaatggtaccagttccttcttgtacctctcgtagaattcggctgtgaatccatctggtcctggactctttttggttggtaagctattgattattgccacaatttcagatcctgttattggtctattcagagagtcaacttcttcctggtttagtcttgggagggtgtatgtgtcgaggaatttatccatttcttctagattttctagtttatttgcgtagaggtgtttgtagtattctctgatggtcgtttgtatttctgtgggattggtggtgatatcccctttatcattttttagtgcgtctatttgattcttctctcttttcttctttattagtcttgctagtggtctatcaattttgttgatcttttcaaaaaaccagctcctggattcattaattttttgaagggttttttgtgtctctatttccttcagttctgctctgatttttgttatttcttgccttctgctagcttttgaatgtgtttgctcttgcttttctagttcttttaaatgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgccttcattttgttatgtacccagtagtcattcaggagcaggttgttcagtttccatgtagttgagcagttttgagtgagtttcttaatcctcagttctagtttgattgccctgtggtctgagagacagtttgttataatttgtgttcttttacatttgctgaggagagctttacttccaactatgtggtcaattttggaataggtgtggtgtggtgctgagaagaatgtatattctgttgatttggggtggagagttctgtagatgtctattaggtctgcttggtgcagagctgagttcaattcctgagtatccttgttaactttctgtctcgttgatctgtctaatgttgacagtggggtgttaaagtatcccattattattgtgtgggagtgtaagtctctctgtaggtctctaaggacttgctttatgaatctgggtgctcctgtattgggtgcatatagatttaggatagttagctgttcttgttgaattgatccctttaccattatgtaatggccttctttgtctcttttgatctttgttgatttaaagtctgttttatcagagactaggattgcaacccctgcctttttttgttttccatttgcttggtagatcttcctccatccttttattttgagcctatgtgtgtctctgcacgtgagatgggtttcctgaatacagcacggtgatgggtcttgactctttatccaatttgccagtctgtgtcttttaattggagcatttagtccatttacatttaaagttaatattgttatgtgtgaatttgatcctgtcattatgatgttagctggtttttttgctcgttagttgatgcaatttcttcctagcatcgatggtctttacaatttggcatgattttgcagtggctggtactggctgttcctttccatgtttagtgcttccttcaggagctcttttagggcaggcctggtggtgacaaaatctctcagcatttgcttgtccgtaaagtattttatttctccttcacttatgaaacttagtttggctggatatgaaattctgggttgaaaattcttttctttaagaatgttgaatattggcccccactctcttctggcttgtagaatttctgccgagagatccgctgttagtctgatgggcttccctttgtgggtaacctgacctttctctctggctgcccttaatattttttccttcattttaactttggtgaatctgacaattatgtgtcttggagttgctcttctcgaggagtatctttgtggcattctctgtatttcctgaatctgaatgttggcctgccttgctagattggggaaattctcctggataatatcctgcagagtgttttccaacttggttccattctccccatcactttcaggtacaccaatgagacgtagatttggtcttttcacatagtcccatatttcttggaggctttgttcatttctttttattcttttttctctaaacttcccttctcacttcatttcattcatttgatcttccatcactgataccctttcttccagttgatcgcatcggctcctgaggcttctgcattcttcatgtagtactcgagccttggctttcagctccgttagctcctttaagcacttctctgtattggttattctagttatacattcatctaaatttttttcaatgttttcaacttctttgcctttggtttgaatttcctcctgtagctcagagtggtttgatcgtctgaagccttcttctctcaattcaccgaagtcattctccatctagctttgttctgttgctggtaaggagctgtgttcctttggaggaggagaggtgctctgctttttagagtttccagtttttctgctctgttttttccccatgtttgtggttttatctacttttggtctttgatgatggtgatgtacagatgagtttttggtgtggatgtcctttctgtttgttagttttccttctaacagacaggaccctcagctgcaggtctgttggaatttgctagaggtccactccagaccctgtttgcctgggtgccagcagcgatggctgcagaacagcggattttcatgaaccgtgaatgctgctgtctgatcgttcctctggaagttttgtctcagaggagtacccggccatgtgaggttttagtctgcccctactggggggtgcctcccagttaggctgctcgggggtcagaggtcagggacccacttgaggaggcagtctgccctttctcagatctccagctgcatgctgggagaaccactgctctcttcaaagctgtcagacagggacattttaagtgtgcagagcttactgctgtctttttgtttgtctgttccctgcccccagaggtggagcctacagaggcaggcaggcctccctgagctgtggtgggctccacccagttcgagcttcccggctgctttgtttacgtaagcaatcctgggcaatggcgggcgcccctcccccagcctcactgcggccttgcagtttgatcttagactgctgtgctagcaatcagcgagactccgtgggcataggaccctccaagccaggtgcgggatataatctcctggtgcgacattttttaagcccgtcggaaaagcgcgttgttggggtgggagtgacccgattttctaggtgccgtctgtcacccctttctttgactaggaaagggaactccctgaccccttgtgcttccggagtgaggcaatgcctcgccctgcttcggctcgcgtgcggtgcgctgcacccactgtcctgcgcccactgtctggcactccctagtgagatgaacccggtacctcatatggaaatgcagaaatcactcatcttctgcgtcgctcatgctgggagctgtagactggagctgttcctattcggccatcttgactccccgatcacacattttttttgatgaaccatttgaaaggaagttgcaaaactcatgaaattcaccgctatcttcttcagcaagtatcccctaagaacaaagacattttcctactgttcccattcatccttaagataatgttcagcttgcaggtgctatgattctcataaaccagtaagaaaaatactgcctgttttccctgtaatacaggattcattcagtgaagttcttgcttgcttcacaaggtgcattgctggaggcctgctctctgcaagcctctcaaagaatatgaaaatagtcctgccctcaagaagctcttcagatgaaataatatgtatgaaaatacttaaatgtcaactacgatataagtgaaagatgctattttatctctttgcaaattctttttctcaaagaaaataagatttagcagatggaaaaacgtaaaaaaaaaaaaccgaaacaaaacaaaacaaaacaaaacaaaacaccagagggcactatagtagcatttgtagtagcatttgaaaagcaatgtttgaaggcattgtaaatatatcttaaaactgcataattttttcttctcggagtaatatactgtgattgtattgccttcgaaattcaactactgtgcaccgtattaactggtgttcttaagtgtttgtaataatttcagaccaaaaaataagttttttttttacatagacccatgtatcttattatactgaacaatataatttttttcctgaaagtttaataatctttaacatactgaaggtccatggcttatatgccttggacagattttcaatgtttggtccagagcattgtgggagggggagcggtaattctaatgaagtgtttagaacacgggaaggtagatcttccatcaaacctttaaattaccacttttgattttttcctttggaggggtcaagttccattccagttttatttcactggcttgactcctttgaaatattttaatttttgttgcccctactctttcaaaaagcaatattctttaagtgaagaatgaatgagaatactcaggaaaagtggacaactgtcagtagtttacaaacttttaaaaatgcctttgaagcatagttcttaactggaggttttctacatattgccaatggcatcattgatgtatgatttttgttttctctggagtatcatatagagattcagcattcattcctcattttgaaagagatatatttgagcaacttaggcatttgatgtgcattttgaaaaattatactattggccaggtgcagtggctcatgcctgtactcccagcattttgggaggccaaggcgggcagatcacctgaggccaggagttcgagaccagccttggcaacatggcagaaacccatctttactaaaaataccaaaattagctgggggtggtggcacacggcctgtaattccagctacttgggagcctgaggcaggagaatcacttgagcctgggaagtggagattgcagtgagcagagatcgtgccactgccctccaacttgggtgacagagactctgtcttaaacagtaacaacgacaacaaacaaaacaaaacaaaaattatactatacattactaggaatttcaactgggtgcatggaggagaaaaaaagcctctgttgctgaaggaatgatggaggtgaagccttaaactccatgcatctcactctggggtttctcagttttatttttgcttctgagacagggtcttgctctgtcgcccaggctggagtgcagtggtgcaatcacagctcactgcagcctcgatctcctgggctcaagtgatcctctttccacctcagcctcccaagtggctaagactacaagcacacactgacatgcccagctatttttcatttttacttttatttttagtagagacaaagtcttgctatgttccccaggctggtctcaaacatcagagcttatgccattgtcctgcctcagcctcccaaagtgctgggattacagatgtaagccactttgctcagtctcattgattttatatacaattctaacagctctgccaaggataatcagaatttttttttgaatcgcagaactaggtatgaaaattagaagactgatagagacagggacatttactgcagcagtgattgctcagagggtggggggcagtagagagagactgagactactgaatcacaatttagcataaaaattaatgatcataataatatggacaagagacagggaaatactggatagaagagggtggttccccagcaaaggccccaccctcaagtctggagaccctcagccctaagtgggaatgggcatttctgtttttgtgccctgaaagttgccttttgacctgctatgccccccatctggtacccatatgaactctgaacctcaggctctagaagcagatgaacagatgaggagatgaggaaacaagcagatgaatggcagaatgatgtggcagagaaagagagaagaggaggaacatctaaacaccaagaggagttaggctgggggcggtgggagaggagtttggcctctggatggccaaactctaggggaagaaaatcttcctactccatccccacttccagctccccatccatcctgctgagagccaccttcaccactcaataaaaccctgcattcatccttcaagtctgtgtgcaacctaattcttcctggatgctgggcaagagcttgggatacagaaagttgtcacactggccctctgcccttgcaaaaaagcagagggtccattgagctggttaacagttatgttgtctgtggacagcaaggctaaaagaaccttgtaacactggggctgcaggcacccacccctggacactactgtggggccggagcccgaagcactcgccctgactcctgcacctgccagtctgcatgctcgcattcttgtcaggggtttgagcaatggtgactgaacaggcgagtcacacccctgttgcacatcctgtgagggggatcagggaactctcccatttcaataatgactattctgagttgttaagattagatttgggattatctaattaggaaaaaaaggaaatatagaaaatgttttggaaaaattccattcaaaagggtgaatatgaactattcacacacgaggatagaattttgttatcaagcaacgtatatttatcgaccatctctgatagagggatggattcaaagatcgttctgccttcagggattttacaaacatgtacttgaaaaactagcaatggaaacggcgtgtgataggattttgattaaaaacaccgagcatcaaaggagatcagggagtgagaacagctttgtggctgcaaagatctgaaaaagaggtgggtctgaaatggaatctagaaaggattcactgaagcaaaggaaaggaggaaagggatgaggagagagaaaagaactgatatagggaattgcatgagaaaggccaacaacctgtggggtgcattttagtcccacaatgccaacaaagaaagcatttacagataaagtgtctggcttccatttctaatgagagagaatcttaaataagcaagaatataagtttctactttgagatattaattactatcctttcagccaaaactttcaaagatgtttatcttctctcagaattcaatacgtggtaaatcattttaaagaaaactgataggtttcagaaattgctccaagatgaaagctagtctttattactctgatctaaattattatgtatcttacctgttttttttccttcaacttttattttaagttctggtccaaggtgaaagctagtctttattactctgatctaaattattatctgatccttttttttttccttcaacttttaagttctggggtacgtgtgcaggatgtgcaggtttgttacataggtaaacgtgtgccatgatggtttgctgcacagatcaacacatcacttaggtattaagaccagcatccattagctattcttcctgatgctctccctcctgccccccagacaggccccagtgtgtgttgttccccatgatgtgtccatgtattctcatagttcagctcccacttataagtgagtacatgtgatgattgtttttctgttcctgcgttatttgctgaggttaatggcttccagctccatccatgtccctgcaaaggacatgatctcattcctttttatgactgcatagtatcccacggtgtatatgtaccacattttctttatccagtctatcactgatgggcatttaggttctatgttgtccttttaaactgttcattgtaacatctcgagtataataacttgaaaccttccattttgctatttttgtatacatctttttatctgttaaatcttataactataaaagtttacttactacattattttataagtacatcaatttttgtaacttttaattgactattgaaaatagcattaattagtgccagttacagatcaatagtattaattagtgccaattgcagatcattaagctcaacattatgtgttgtaaaaattatgaaagatcactgatcattagagaaatgcaaacccaaaccacaatgagataccatcttatgccagtcagaatggtgattattaaaaagtcaaggaacaacagatgctggtgaggttgcagagaaaaaggaatgcttttacactgttgatgggaatgtaaattattagttcaaccattgtggaagacagggtggtgattcctcaaagatctagaggcaaaaataccatttgacccagcaatcccattaccaagtatatctccaaaggaatataaattattctattataaagatacatgaacatgtatgttcattgcagcaccattcacaatagcaaagacatggaatcaaaccaaatgcccatcaatgatagataggataaagaaaatgtggcacatatatgctatggtatactatgcagccatgaaaaggaatgagatcatgtcctttgcagggacatggatggagctgtaagcccttatcctcagcaaactaatgcaggaacagaaaaacaaatactgtgtgttcccatttataatgggagctgaacaatgagaatccatggacacatggtgggaaacaacacactagggcctgttgaggggggtagggggagggagagcatcaggaagaatagctaatggatgctgggcttcatacctaaatgatgggttgatctctgcaggaaaccaccatggcacacatttacctatgtaacaaacctgcacatcctgcacacgtaccccagaacttaaaagttgaagaaaaaaaattatcaaagatgaaagggcagttattttacagagatagaaacttgagagagtagatatgcttttattctttttaaaatattcacttaaatagattctgatatctccttccatgtgattgcagttaatgatagagtggggctaagagaaaagaaattagcagatgttaaaaagaaaattatttagcaacttatttttaaaaagtagcttgtggcttattggaacacaaagtatataataatgttttatgtatatatgtgtgtatatattaatatatatatacacacataatcacaattactatatatttcatatatatagtgtatatatatatataatgtatatatgtacacatgtatgtgaaatatagtgatttttttccagtaaaaatctttttattgtgggaaatcttttctttatttttatttaaaacattttatattttaagttttgtgggtattaggtgtatatatttatggggtacatgagatgttttgatataggcatgcaatgtgtaataatcacatcatgtaatatggggtgtccatctcctcaagcatttatttgtgttacaaacaatccattatactcttttagtcatattaaaatatacaattaaattgctgttgactatagtctccctgttgtgctatcaaataccaggtcttattcattctttttaaaaatttccaacttttattaagttccagggtacatgtgcaggatgtgcaggtttgttacataggtaaacatgtaccatggtgctttgctgcacagatcatctcatcacccaggtatgaagcccagcatccattagctattcttcctgatgctctctctctgccgactccctgccctcaacaggccccagtgtgtgttgttccccatcatgtgtccatgtgttctcatcatttagctcccagaaaattttcaacatagacaaaagtggagagaaaagtataatgaaactccatgtattcattacccaatctaaaaaaattataaacatatggccaatctagttttatttattatctcttcattccccactttcaacttcccagaactaattttaaacaatttctaaagatgatatgattctattcataaacactagttattattattatttaacatagggaatattcatatatataacaggtacaaagtctataatatttaaagctcttttatgttcccatattaaatgtaaatatttgtttaaactcatggctttccttggttcatcaaatcaggtaataaattaaccaggcaggttcacattcaatcagatagtattctgaattgctcctggcatcttcaaaagatgaggattgttcggacgctgttaataacaataaaacattaataagtataattttcatgataaatttaaccaaagctcacaaataagttttgccttttcatttcaggatctggtcttcctttatagacattcactttattaagcctaatttcttttatcccgtcatcctcttccattcatggtgttaataatattttatgcatgtgctagtaaacttggggggaattgaggacccttactcaccttaggcagcgtccttgttactcagtggtgctgttgaggagaattagaatgtaccaaggagggagtcaggttttagtcttggaatagtcactgttctcggatctcctatagctgagggcaaagttgagcattgaaggagggagtgggcatcaaagttggtgtgttgggatgctactttttaagaacccagatgttcttatttctgggtaactccaacatgtagacacaaagagggggataagcctcaaggacagagcagtctttatctcaaacattactgctggaactgtggaacccctgctatgagcagggtgctatgcataaatgttttcttcacccaggactggaagacacccctacctgtagaaggagaatctctgtgtcctttcctcactctggggcaggatcactacacctcaacaggctagtcagtcattgtatcccatccccatccccccacttccttgcttctttgcagttgggtggtaggagggcctgccctctcttgtgcttcctgtgcccatatggtggacacacctgatgaggcccaacttctgccttcctcattgccacctttccatctgtgtgggcagtcaggtggtattctcagtgggccagagaaggagcaggaggcctcactctggtgtctacccctaggctgattaccagggaagcctcctgggagaatgtgggagacttgcccataaagcaatgcagcattttccacctggctgccacttagcattccttatggatgtattccataattgagaattc

SEQ ID NO: 50 - DNA, 150437 bp, Homo sapiens
ttcagtcagcacacatagattaataactgacacgattgtgtgtatggatatgattcttaatttttctgctgaactttaaacagaccgttccctcccttgtctttgcctttttcctgcctctttcctttacccctttctgaaaagaggcaaatgatgatcataaagttttcaaagcaatttgaaatattgacttgaaagcaattgatcagctttgtgagaaataattatttttgattttgaatttgctttgggattacttgggatctgttcttttagtaagaacataatttatttgtaacatctgacctcagttgggtaggttttactagggcttatgtttcatattttaaaatgggctttctataaattgatgtggtcagaatacatttagaaaagctgtctatgacctgttcttgttcgatattatgtaaaaacttagtatatgtttacatggagttttttcttccaagacctttagatcttcaaaaaggagttataagggttttgaatatagcagtaaagcagttgctttggtgatttaggttaaggtaaaagtttggtggatttttgtgcctggacttgttggcttggttttaaacaagagatattcaaagtatgctgctgctcattagcttgaccactgaaacattcctttccctccttctcctccttcctctcatatctattcctccgtctcccagaagatgaaaaggcgaagcgagaagtgtcttcctggactgtggaaggtgatattaatactgacccatgggcaggttatcgatatactggtaaactcagaccacattatccactggtgagtaaataaggtaataaaaacaacattccaattttgaattttccaaaaatgatactcgtaatttgttttccagtagtgaatcatataatcaggattgtgtttacaaaggaactcgaattttagctcttgagctcttacggtgcatcatttgggagctggtagtttggcaatcatggaagaagtgggaaaaattttagatgaaagaactaaaacttttaaaaagaagtgtagggtaaggtagaatagatattttgttgctggcatgatggtagtgtgtacagtcgtccctcgatatccatggatgattggttccaggacatcctcactccccatatagttacgaaaatccactgacgctcaagtcccttaaagtcaaccttccgtatcacagattgtgcgtcaacagatgcagaaccaggagatatggaggactgactgtattatacttttctaaaattattttattatgatatatttctcccttaatttagatatggcttttctgccactcttttgccttcctctattcttggcagataggacttggagtcttaatgtaagaattcattcaagttgaaatctgtttgtcacccttaaatatttaaattctctttactgatgattttctttttataaaaggaatacatctttaatctttaaaatttggaaaaataggaaaagcataacaaaatctccttaattctgcctcccagagataatgactaggaacatgttggtatatatttactttgagacatcattttattgttgttagcttgccaatttgtttggaataacatgggtgtcttgttattagtctctgtctaatcttaaatccttaatggccttggccactttccccctttctaaataccctgcaaaaggggtggcattaccactaggaaaagtaaagcataatcttaatgaaatatatatctgttataatatttaagatgccatttaaaacttctaaaaacttttgaatggacttctttctcccctcgttttatttatttttcgttggtaaatcagttttaactaactttgtttttagatgccaacaaggccagtgccaagttatattcaaagaccagattatgctgatcatcccttaggtaagctctgctatgttgattcttcatttttcaatttgtgggcttgatgactactgcaaagggaaggaatgcttttcttgtagaaatttttcagtgctggacttctaataaatgtgttttcaagcaccattagaacattgaagagaattaaagattcttgcccccattagaaatctacctacctctgaaaacactatgtagctgttaaagactatatttaaaataatactgtattttatgttgttataacaacttctagacttactaaaaaacagtttttaattttaatattccctcctatctaaattaaacaatatctatttaggtaaaggcagatggtagaggcctgagtgaatgcataactaaagactttggactgtaacattaacagaagtagtaatggtggtgatagtgatagtaatgatgagaatgatatgatgatgatggttctctaataataactggtatttatttttgcttaactatgtgtcaggcactgtgctaagttctttgcacgtgttactccatttaacactttcaacactgctgaggtaggttctgttgtcttctccatttttatagataatgatactgagacacccagcgaagataggtaatttgcaacacaggtcagtggaacaatctctgaccttaaggcctgtacacataattaatttagactttgtgaaattactgattttgcatgtcaaagaaggtcgactctcagcaattttgtgtggttttatctagcaagctaagctatccttgctttgttctctaagaagtggggaactgtattacataacattcttatgaatatcatttttaaattttagttaaaccctactatttcagaaaaatttaagggaaagatagtctaaatgatagcctactgttgaggatgtataatttcattatttttctatttaatcttaaatgtagtattagcttgtattttagaaaaacaatcatagacaaggtaaattctaacaaatgttatgcagtgaaagtaagttctagtccttagaggtaactgctattcacctttatgtacagaacttttcagaactattctatatatgtaaacacattaggaccccgtctctgccatctatacacaaatggaaaaaactatatttaccttttcaccttgctgtattcacttaatatgtcttacaaatgtgtcttataaagccacctcctttttagtgaatgaaggttatgtggatgtatcatatttcttaagccaggcttttactactgagtgtttagatcatttcgaggtttttgcttattgtaatttgactgcaaatttgttgcaatttgactgcagtaactactcttatatttatatctttgtccatgtgtcaaagtatttctgtaggttgatagtctaaaataggtggatcaaaggatatatacatttttgattttgagagatattacaaatttcagagatttttccagttccattaaaaatacatggatgtctcttttctgctatatttttcgcagcatagtgtgttacaaagctttatgatctttgctaatctgaaagacgaaaaatgttattttgctattattttaatctgcattttaaaattatgagtaaggttgagcatcttttcatatattaaagtcatttatattttcttcccttttgaaatgtttattcatatccttagcctttttttccctgttagagtactagttttttccatattgatttataaatgttcttagtatattaacgaaaataaccttttgatgtatgtttttaaaactgttttttaccaattgaccgtttgttttgtcattacatttattacagattttgagtatcctaacatagtaaaatttatcagtgttttattttacagtgtgtatggctctatgacctagaaagacctttttggtgcagaagttataaaaaaatattcctatgttttcttctagcatttttatggtttcagtcttttttatgtatgataaaaatcatttgtatatctgaaacttacttggcataaggagttaaatagggatgcaacttaattttttttctcagaaggatacctggttattatatcaccagttatttaaaaaatcagcctttccttattgatttgaagtgcaacctatattgttgtattatgttctcacatgtctttaggtctatttctggattctattctgttttattaacccatttgtctaatcatgtaccactgccaaacttttaattatcatagctatataatgtttaatatttggtaggccttgttgcccctacctttcctctttttcagaattttcctggctattcttgcatgtttgtttttccatgtgaaatttagaatcagcttgtctggttctcaaaattatcctgttgacatttttttattgggatagtattaaatttatagattaattttggaagaattgacatctttacaatattgagtcttcctgtccaggaacagggtatgtttttaaagttttatttgactccttttatgtctttcagtggtgttttcagattttcttcatgtagggattttattgttaaatttattcctgggtacttcatctttttagttgtttttgtacataatagcttctgtattttttagctgattatttgtatgtgggaaagttattgattttgataaatttatcttaaacaatatgccaacttgctgaatttgtatttatggtcatttaccaggtgattcttctgttctagagatacataatcacatctgaaattgataagaattttgtcctttcttttctagttttatatgttttatttctttctcttgtttaattgcatctgctagtattgccaggacagtgttaaataatagtgccgatagtgggcattctgtaatgttggttctcagtttgagatttatatttatcatgtcaaggtggtagctggccatgttatcagaattaactttccttctagatgattatttacttttactttatttatgaatgatgaattggatgaatagatttgtcagtattgaactatccttgccttctggtatgaatctcacttgcatcctgatgtattaagtttttttggattctgtttgttaatatttttatttggaatttttccattagtacttgtaaataagattagttgacattatttttgttagattttgagttaattgctatcctggctttattacttttcatgtatgtaaaacttgaagctaacaaattttattagtgaagatttttagggcaatatttttaaaacttttttgagtatgactcagaaatggcttttataacgtgatctttgtatgtgtatataaataaagatttcatggcagcacttattcctactccgtataatacgagtataatactttgttatgccattttaatattttctgtcccatttatttacttttaaaaaatgttaagtgtagcctaataaaaggtcacaaactggagattgaaaaacacttaactttggttcctgtttcagaaaatagtgtaattaattcatcagttgttgatgtataattgcttcatgagatgattatgaaagtaatttgtaaattctgtggtacttttcaaatgtatatcatttactgagtctgattatcacacggcctggcatataataagtactctataagtattggctgatttctaataggtctgaaaatttatcttttagaattttttcttcagttggtttagcgagtttccctttgatgttgaaaatgtttttttttaaaaatctaacctagaccatcccaaatcatgaattactgttgtgtgaaacagtgagactactgtttttatgccacaggtttataattatgcaaataaatactacatctttgcattcattttggttttacttaccgaattttcattccaggaatgtctgaatctgaacaggctcttaaaggtacttctcagattaaattactctcatctgaagatatagaagggatgcgacttgtatgtagggtaagagtgattttttctccatggggtaggaaatgtttaagcagtacttagacatgaagtcagtggtttgctgatttataaagatagcaaatgttatattgttagactgaccagccatgctttttttttttttttaacttttttttgagacagagtttcactctgtcgcccaggctggagtgcagtggcgtgatctctgctcactgcaacctccaccttctgttttcaagcgattcttctgcctcagcctcctgagtagctgggattacaggtgcccaccaccacacctggctaatttttgtatttttagtagagatggggtttcaccatgttgcccaggctggtctcgaactcctgacctcgtgatctgcccaccttggcctcccaaaatgctgggattacaggcgtgagccaccacacctggcctttttttgtatttttagtagatacagggtttcaccatgttggccaggctggtctctaactcctgacgtaaggtgatctgcccgcctcggcctcccacagtgctgggattacaggcgtgagccattgtgcccggtttagccatgcttttcattaaactattgttagtatataattttagtcaacagttttcttcttaaaagcctatttcagaattaatctggtggatagtctatatttagatgacaatccttttcatttatttaatgatatttaaaaacattttgtcattttattttcacaagtcatcataacataggacagagtttaaggctcagagggttatgctgtaggcctttttgtgaaatacctatgatgagtggtagtagtggttggtactcattaggtgaaatcacatatttattctgaaggaaaatataatacattgatattattcatttaagtaagattcttaaggtttctattcagtgctttaaaagtgatttgattctaattttgtttgatatcctggagaactttctcttcctatgacttgctgtgattctttgaggaattcattcatctatttttttttttttgagacagggtcttgctatcactcaggctagagtacagtggcacaatcatagatcatatagatcatagctcatagcttactgtaactccaaactcctgggctcaagctatccttccacctcagcctcctgagtagctgggatcacaggcatgtgccactacacctgactactttttttttttttttttttaagagacaggatctcactatgttgcccaggctcatctgttcttttttcttttcctctacttttccccattatagaaatgagagaagactacctctatcagttgatgatagtttagatttcttaggatgtatattttcacatagaaatcagccaaccttactgctgcttgcttgttaacccaatttttatataaaattaatgtttgtttttatgtatttacatataatatatttatatattttctataaaattataatattcaaggggagattcatttttaccaatcttccacagtcaaacagtagaaagggtatagatttctgtttctgtgtcttttttaatgtattgagtgttccttttttacagcttgctagagaagttttggatgttgctgccggcatgattaaaccaggtgtaactactgaagaaatagatcacgctgtacacttagtaagaacttcacttttttactttgagtaattttgttacattactagatgctttgaacttaaacattaagtagatttaagttctgagtgtctaaggtaacttgggtaaactcatttgaaagcaaatttttgctttgtttcaaatatggaaaacattcaacagtcattattctcatctttaagaatctataatattaaggtctgaggtaagcttgaaatatcttgtttctgaaacaacatatttgtaataagcatttcagttgagcttttataaaatgattgattttatctgctttaagtaaatcctgccactacagacatcaaatattctgaaataaaaaaaagaatatgacttctgatggtagattagttaaatgtttcctcaaggcaatgaacagtccacataaatatttgtagtaagtatagggattaaaaataaataaataaagattgtctgcccatcaaagagagaccttaagaccttattagatgagtgtacacattatatgaattttaaaaaaaagagtgataagtagttaatataacatatggaaagcagatcacacgtgttctagtaaacaaatacaaattataaagacctagtaaatttgtattttaaagatgtttatatgcattgcttgtgtggaaatgatgaaactggtcctctcttctgcttggtgatggtattgtaaattggaagaacccttttggaaggatttgacaatctatcttgagctatgaaaatgtttataaattttttattcagaatcttattaatcctgacttttgggtattgtttcatatgttagtataagacgtatcgtatgcaataatagcattttgagtatgctctgtgggccaggtactcaagtgcttcttttacattaactcattaatcttaccaacaacctcttgagggtaggtactattgtaatctccgttttataggtaaggaaactgaggaagagagaggttaattaattaaattggtaaaagttacacaacttgtaagtgatggaattggcattttcaatctagaaagtctaattctgtatgctctgaactattatttgtaatgctatgagaagtagagaagtatattcctaaatgagggaaaagccacaaatgtagttattggttgtaagattttttttttttttgtaattgaggaaacttcatattaatttagattttcagtaagaatggaattgctagtaaaatcatggtatattctgcatattctgcaaatggtatattgtgcaaccattaaaaaatattagcctgaagactagagcaggttggaaacagaaattacgtatactgtgattaccactgtgtaaaagcatccagtaaagtaagacttgttatggagagcagaccatgtttttctgttaggagttcttttgttgttccactgaatgtggttattaaaatatctggaagtactttaccgtttcttaattatactagtagtcatttttggggcatagtgatataggcttgtttcaacataagaattataattacatcaaaaatgcttgttaatatttacttcaaatattttatttttactttaacatttttcataaggactagttaattctaaagtaaaatcttcatatgtggtaatatttatatatatatttgttatagaggttgagtatcccttatctgaaatgctttggaccagaagtgttctgaattttgaatttttttggattttggaatatttgtattatacgtaactggttaagtgtctgtaatttcaaatttgaaattctaaatgctccaatgggcatttctttgagtgtcctgtcggtgttcagaaagtttcagattttggaggatttcagatttttggattaggaatacttaacctgtatgtcattttacttttcctttgtgcagttaccagtaaactggtttgtgtatgtgtacctgactggcacaaaccctgttgtatattgtttaagataatatccagtactgttactaaaataaaatactgagttcttcatagtagcatgtgtccaactgttttcacatttttcaaattttaaaatctgtaatttcatacagattttttcttttatatattccaaattattttttctgtattataggcatgtattgcaagaaattgctacccttctcccctgaattattataatttcccaaagtcttgttgtacctcagtgaatgaagtcatttgccatggaataccagacagaaggcccttacaagaaggtgacattgttaatggtaagaaaaatatgttactttcatcaccatgggcaaagaaacaacaaagcttggggaatctgacagtgacttgtgttttcttgacttgcttcctgtacttaaactttttcctttttaaaattcagtatcactaactcttaaatctacaggaagctctcttaacggttttgtgcatgttgcttttaagatacttccggtgtgatgtgtttggtgcagtgtatttctttaatgcttatctcatatgtgattggtaaataggtcaaagatgtcagtgaaatgtggagtctagtttttttcccccagaagttcactaatggttttgaagagaccagggcaggctttgttatagatacaggaaaacccttcataatatatgaagacctaaaggaaagctgaaaatcttgcagaagtgccttacttgagtggaagtagctttaaagacccctatgttaagctaccttgggaagttacaagtatagagagtagaggaagtagtttaaaagacattaatgaaggctttcctagatggcatttgtttttgttttgtgtattattttattttttggagacagggtctcactgtcacccaggctcgagtgcaggggcgccaccatggctcactgcagtcttgacttccctggctcaggtgatcctcccacctcagaagtagatgagactgcaggctcattgctaccatgcccagctcagtttttgtattttttgtagagatggggttttgccatgttgcccaggctggtctcaaactcctggactcaagcatctgcccaccttggcctcccaaagtcttgggattacaggcatgagccaccgtgcctggcttagatggcattttaatattgatggaattagactctttgttaataagatatcttaaaggaactacctatcaaatgaggaagcatgagcccaagtgttagaggctgcagataattgactgattgtgatgctagctgtgaatgatagccgaaatttaactatgacactatttttattagaattgctactgctttagttagggtatctgttcataaagttccataggttttgaggccaaccctgtttttcaaatataaagcctgttatttttattatatgtagaatgtgtgaggtttttcaggaatgtatgtgttgtgctagaaccaaaatatctatattgtgatgttacaggttgattgaaatatgtggtttaaaaatactcaatgtgctctctagatacattataatggtataatagtatataatatatagtataatagtaatctatattcttaaacatggggacaaagagaagaatgaatattcacaaataagagaaaagcaaatgagttttaaaaaaacaggtgtagagcagtgtaaatttttctgttattccctagcaggagtaaggaacttgtaaaagataagtgaaaatggtattttgtagcaatgtagcaaagttttcaatttaatgttactaactctggtaatttattttgcatgattgtgtcccacatacatttttcttttgccacaagtgatacaattactataagagtataaaaacccactatctggcttatgttacatggccatattcctgctctccacagtgagttcagttacatctcagggagcttctgttgggcaataactatctatccattggtgtctaatttgagaatgcagaagttgtctttttcattaagttgctagatgctgtcatgttggaaaaacacttgaattttgaaatgaaaataagtatggtctttatatttgcacattctcttgcagtggatatcactctttatcgcaatggttatcatggggacctgaatgagacattttttgttggagaagtggatgatggagcacggaaacttgttcagaccacatatgagtgcctgatgcaagccattgatgcaggtcagcctcagtgttgagcacctattggcagtcctgtgtgttgatgggccaagaatgactgggcgctgcagttctgtgcattccttgtaccttccaggttgcccctgttctacctgagttagctttggttgttagcagtaatgggtaaaaggatgatctgggaatctcttggtggtgatagaccagatgattggttagcatcctttgtttcttctgtgatttatcttccttttctttgcctgataaatgaagaggactgtgcagatggttttttagtgcaacttttattctatttttaaaattctttccagtacataaatattatgttctcctcataaaaaattaaaagtgaagattatgagtgaaaaatgtgtgatcctcctttacacttgcctcccctcttatctctctcttctctctagagatatcccattaccgtttaggttttttctctctcctgtgcattaatgcacacacgtatgtgtatgtgttaaattaagttaaatggaatcataatatttttaatgtgtaactgggctgttttttcaactatcatagagatcttttcaagttagcatatatacctacagacatagatttacctcattcttttaatggctatgtattatattctatagtattacaatttgtgtaactattctgttggattttggtgctttccagatttcttactattgtagtaatgggtaggggtgtatttctggaggatttttctcaggctgtctgtctttgtacatatgaacaacttatcgaggcttttttgtttaatcagtatcttatggggataagagaaggaaaggggctgggcatggtggctcactcctgtaatcccagcaccttgggaggctgaggttggcagatcacttgaggtcaagagttcgagaccagcccggccaacatggtgaaaccctgtctctaataaaaatacaaaaattagccaggtgtggtggcgggcgcctgtaatcccagctactcgggaggctgaggcaggagagttgctggaacctgggaagtggattgtgccaccgcattccagcttgggcaacagagcgagactccatttcaaaaaaagaagaaaagaaaaaaaagaaaggaaagttcttaacagcatcttgttggagttgttaacaaactgttaataaatgggcaaacagccttctggttaaatccttaccatatcaactttattaccagtgtgctacctgcaatcctccccagtctctccaaatcttgatgtcatcaacagaatagtgaacaggacagagttcttagacaaacatacagttatctctaataatgttgatccagtatttttattgtttttagtgcgttctttaatgtgtatgggagatgaaatttttactcaagttggaggaatggaaatgaaggaatatgatatttttgtgtatcaggtgaaattttgaaaacttattactcattgttgattattttaaaacattaatacaggaggtggaattgaagaaatttaatgtttaatttgtcatttgtgaaagcttaagtttgaaataatttttagagtttctgccagataatatagtcaatatttctattctttttgcttctctgtgaatcaactgaagaaacaaaaaaaaaaaaaaaaaaaaaagaaaaagaaaaaaccagatagttagaatgctgttttatatgacgtatgactggaacttgccaatagttttcataacagtagccaggaaggaacgaaagtggcttgatcttttttggaaagtgctttgaattcctttgtatatatcatttttgcccctcattttgcacctcccttactcccccaggtagagggtttgaaaagctgttgaaattaggcttcttaagtagggtttcttagtctatgcacttagtggcttttgggcctgataattttttgttgtagagacctgttctatacacataagatgttccacaagcattcctggtctctacccagtaaatgccagttacaccaccaccctgtgtttgacaaccagaaatattaatatctctagatactacccttggggccgcagttggagcagtttgaaaattagggaagacttcctctgtcactctttctatgcaacatggattacaatattgttccccctcccaccccaggctgataggaaggcctggataggaatgaaagaaagtaattatgaaagtcagcatgatttttcaaaaccagaaacctccttccttctccccccaaaatcaagctgcaaaatacagttaagagcaagtaaaaatgttaattaaactgattccttgagctatttaccctgaaatggatgggaaagatacattgtatctgaacctcagtctgggaatcagataggctgagtaggagagtagagagagttaaggatccccagagccatcttgaggttctctaggagtctgacagtgcccagctcctgggtcttagtgtgagggagaaccttatagtgatgagaaccactttttttgttttgtgttttattgaaacactagtaaaagtcataaaaactaaacagagcagaaagtgtatatagtgagaagtatctttcctgtactgtacctctagggttgtcctgtagaggcagtcatggaaagtttgagaactatttttatggggataaagaagcccaggggaagtaagtcttttagaagttgtccaggctgaaactcaggacaattcgttactttttggacgttccttttactcctagtgcactttcttatctcttctgctcatattaatagaatggaacacttggccttagggaaggatgcgaaaagaagtgtattttcctctctatttttctctgttgttaaagaaagcaaaaggtacctacttccaaccctttagtgctgctatgagtctaacgtttttggcatgaaaggaggaactacagatgcccttggtttgaattagaactttaccaattactggctgtttggcctctctgtgcctcatctgtaagttgaggcatggatgcataaaagtgtttcaaaaacttcctagcacaaagatagtaattactttttttttttctttttctattttgagacaaggtctctctcttttgcccaggccagagtacagtggcaggaacactgcagccttgacctcccgggttctagtgatcctcctagcacagcctcccaaatgtagctgggactataggcatgcaccactatgcgggactaattttcatattttttgcagagacagggctttgccctgttgcccaggctggtcttgaactcctgagctcaggcgatcttcctgccttgacctctcaaagtgctgggattacaggcatgagccactgcatctggttgatagtaattgcttagtacgtattagttattagtttatcatgaattttcttttttcctttcagtgaagcctggtgttcggtacagagaattgggaaacattatccagaagcatgcccaagcaaatgggttttcagttgttcgaagctattgtgggcatggaatccacaagctttttcatacagctcccaatgtaccccactatgctagtaagtactatccagagatttggtataagctcaccatttattcaacaaatacttattcatacatttaacagtacctactattttgtattcactagagtaatctcttagctgtaatagatagattcccaaaatgtgtatttgctgaaacacagtgcaagttcgtatcttactcacataatagtccaaggcaggtgtgtttggtcactgtgggggcagggcagttactatgtgacacaggctgtgtcatctttgacctatggctttcaaagtcactttgggagttgccctcctggtcagtagatagtggagatgttgggggttgaagcttgaaggggtatacctgggagtttttaacagacagctggaattggcataaatcaaatttattttccattggcaggaattcagtcacatggctacatttaaatgcaagggagatgggaaaacgtaatctaattgtgttatggaagaaaagtaaccttattttggcaaacagtcaacagtttgccacaggcctagccattactcttctgattccttaggtgaagtcagttcgtcttgcttggtttgagtgtttaatgtatgtcagatcctgtaatatttgtttatataaatagaggggaataaacaaagtgcctttccttaggttgagtgccgtgtgatacaataacaaagaaagtgtaagatagataatatcttacagaaacattttctgtagagagagaagaacatgttcaggaatgaatctgttatttaatgtcagaaatgaaagctgtccacagtaagtgacctaggaaggaacttagcacatatattttgagccgctgctagatgaacactttcatctccttgtgcttaatttttttcatctgtacaatagtagggaatggtacttactgtagaattgttatgaggattaagtgagatgatacatggaaagcacttagaattctgcatgaaaacagtacatgaaagcatttaatgttaatgtttacaatgacagtaatatgcattatctcatttgatcatcacaactctatggataacttcttagcccaatttttttaaagcaactctgtgcttacagaggtaattggcttgctcaaggtcacacaaactagtaattaaatgccagactagcattgatacctgggttctgtcttgctttctggagtcagtcttttctcccatacttcatgctgacgagtaaggattgaagaaatttggtgcagggggcggtgggagaactaagttttggttgggtggagaggagaaaaagccagttggtgggtgaacatgggtgcttcaaatagagaaaaacagagaaaatataaggttggctgagttatatgttaaggactagcagcaggcagtccaggtgtgccaaatgccagactgaaggaatttgacttgtatgtcggaatcttcagaaatatttttgggcagaagaatggcataatgaagctgatattttgagaaggctaatttggcagtggtgactaagatggattgcaggtgggagttctgaagatagttggcctgatggacagttgttgctgtagtgcaggtgtgaggtggtaaaatcctagacgtggatagttgtgaagagaaagtgaaatgagtgagcaacctttctaagggagaagctggagcagtcattcagagcaggggtccccagcccctgggccgcagacaggtaccaatccatggcctgttaggagctgggctgcacagcatgaggggagcagcaagcaagcgagctttaccacctgagctccacctgctgtcagatcagcagtggcattagattctcataggagtttgaaccctgttgtgaactgtgcatgtgagggatctaggttgcgcactccgtatgagagaatctaatgcctgatgatctgaggtggaacagtttcatcctgaatcatccccccaaggcttgtaccctcaaaatcctcctggtctgtggaaaaattctgttctacaaaaccggtccctagtgcaaaataggttggggactgctggtttagagcacagcatctaatgtgtgtcaataaatggttattagcagaccacctaattctttttatttaaaatgtgaatcatgcttgaaataaaagctagcaacagaaaataggtaactgacttcattccttccttttataccctgtaatcatctgaatatgcattccctttcacagaatggaagtagctattctagttacagtggggtgtgtgtatgtaagagtatgtgcaggggagggaatgaaaacagtccccttacttgcagaagcaataaaatttgagtttagatatggatttgagtgtgagggaaagagagagactgaagacaataatatttatgggagaaggggattttggtcagtggttatagtgtcagcaaaatatgttgccactgttatacaaaaggtgtcatgtgagtttcctattaaagcatttgattagacataagaaacaattatgaaaagaggaacaaagacccaggtgtactttattttatatagtttttttgagacaggatctcgctgtgtcgcctaggctaaagtgtagtggtgcagtcacagctcactggaaccttgacctccgagagctcaagcagtcctcctacctcagcctcctgagtagctggtacttcaggtgtgggccaccatccctggctaatttttatatttttgtagagacagggtttctccatgttgcccagactgatatcaaactcctgggctcaagcagtctgctcacctcaggctcccaaggagctggggttacaggtgtgagctaccacacccagccttatatattatgtttatgaagagtcacatttatgtaaaacaaaatatgcaatgatcactgtagggaagtattaaactattgagggtttttttttttgtatagcagagatatcttttgaaatgtaaatctctgctttagtttgtaactctatattcctagcccaaatgagggaagaaccaggaaattgttgtataacattcctccactccttctatgtaggagaaatccttgttaggtgagagtttatttgcttctatgtttgaatcaatgggtgggaagtaatgatgataatactctgcatttaaactgtacaggcatacctcagaggtaactgtttggttctagacccttgcaatatagtgaatatcacaataaagcaagtcatacagattttttggtttcccagtgcagtgcataaaaagttatgtttatacagtagtctattgtgtgtgtagtctaacaatgcacaacccttgatttaaaaatactctattgctaaaaaatgctaacagtcatctgagtcttcagtgagttgtaatcctctggctggtgaaaggtcttctcttgatgttgatggctactaactgatcagggtggtggttgctgaaggctggggtttgtattacattctcacattgttagaaattcctggtagaattcttgttagaacctgggtaatttataaagaaaagaggcttaattggctcacggttctgcaggctatacaagcatggcagcatcagcttctggagaggcctcagggaacttacaatcatggcggaaggcaaagagggagtgagtgtctcacatggtgggagcaggagcaagagagagagtgcatgggaggagaaacaaccagatctcatgacaactcattcactgtgcagtaccaagggaggtggtgctaaaccattcatgagaactctgcgcccaggatccagtcactttccaccaggcctctcctccaacactgggaattacatttcaacataagatttgggtaggaacacagatccaaaccatatcagggttgttgtggcagtttcttgaaataagacaacaaagtgtgtcacattgattgactcttcctttcacgaaggatttttctgtagcttgtgatattgtttgatagcattttatccacagaacttctttgaaaattggagtcagttctctcaaaccctgctcctgttttatcaactaagtttatgtaatattccaaatcttttgttgtcatctcaacatcttctctatgggtagattccatttcaagaaactactttctttgtttatctgtaagaagcagctactcaactgttcaagtttcatcatgagattgcagcaatccactcacatcctcaggctccattactaattctagttctcttgctctttccaccacatctgcagttacttgctccactaagtttcaaactcctcatagtcatccaaaagggttgaaatcactttctgcccaactcatgttaatattgatatttggcttcctctcatgcatcacacaatttcctcccatgaatcacaattttttggttttggttttgtttttgtttgttttgagacagggtctcactctggttgcccaggctggagtgcagtggcacgatctcagctcactgcagcctccacctcctgggctcaggtgattcccccacctcagcctcctgagtaactgggattacaggcacgtaccaccctgcctggctatttttttttgtatttttagtagaaatgggattttactgtgttgcccaggctggtcttgaacttctggagtcatacattccacccgcctctgcctcccagagtgctgggattacaggcgtgtgccaccacacccagcctacaaagtttttaatggcatcgagaatggtgaattctttcaagaaggtttttcagtttacttttgtccagattcatcagaggaatcactatctacggcagccttagaaaatgtatttcttaaataataagacttgaaagtcaaaattccttcttgatccatgagctacagaatagatgccatgttagcaagcatgaaaccaacattcatctccttgtacatctctgttagagctcttgggcgaccaggtgcattgtcagtgagcagtaatattttgaaacgaatctttttctctgagcagtaggtttcagcattaatattattaattatattaactatattatatgttaattatatattaatattattaaaatattcagtaaaccatgctataaattgaggtgctgtcatccaggctttgttgttctgtttctagagcacaggcagagtagatttcgcttcattcttaaggaatctttaggaatggtagatgagcattggcttcaacttaaagtcacaagctgcaggatcccctaacaagaaagtcagcctgttctttgaagccagttgttgacttctcctctctagtgagaaagtcctaggtggcattttcttccattagaaggctgttttggtctgcattgaaaatctgtttgttagtatagccaccttcatcaattatcttagctatatcttctggcaaatttgctgcagtttctacatcagcacttgccgcttcaccgtgcacttttatgtaatggagacggattctttaaacctcacgaaccaacctctgctagctttcaacttttcttctgcagctttgtcacctctctcagccttcgtagaattgaagagagttagtgccttgctctggattgggctttggcttaagggaatgttgtcggttgtgtgatctatccagaccattcaaacttcctccataacagcagtaagactgttttactttcttgcatttgtgggttcagtgaagtagcgctttcaatttccttcaagaactttccctctgcattcacaatgtggctaactctttggaacaagagacctagcttttggcctatctaggctattgacatgcctttctcattaagtttaatcatttctagcttttgattcaaagtgagagacatgtgactcttcctttcagttaaacacttagaggccattctagggctattaagtggcctaatttcagtattgtgtttcagggaatagggaggcctgaggagagggagagagaagtggggcaggctgatggagccttcagaacacacacaaacatttgtttgccgtctttacatgggcacagtttgtggtgctccaaaacaattaaaattttaacatcaaagaccattgatcacagatcactataactggtgtgataataatgaacatgtttgaaagattgtgaaaattaccaaattgtgacacagagacatgaagtgaacatgcactgttggaaaaatgacattgttagacttgctcagagcagggttgccacaaatcttcaatttatttttaaaaaaaaaagcatctggtcagatgtggtggctcatacctgtaattccagcaccttgggaggctgaagcaggcggatcatttgaggtcaggagttctagaccagcctggccaaaatggtgaaaccacgcttctactaaaaatacaaaaattagccggccatggtgcatgcaactgtagtccccagctactcaggagcctgaggtgggaggatcacttgaacctggaaggtggaggttgcagtgagccgagatcgtgccactgcactccagcctggacaacagagcaagagtccatctcaaaaaaaaaaaaaaaagagaaaagaaagaaggaagcagtatctgtgaagcataatatagtgaaatgcaataaaacaaggcatgcctgcatattacagtcattctgtgagagactatagatcaggtacaaattttttaaaaagtacctaagagtgtctgcgatagtatagtcactcagataatgtgtatttgttgagtgaggtatgttgggaaactgaaactttaatcagtgtaaaaattattgagagatatgttacatgttgttttagtctttgaaatccaaagggcttttgcactgatagcctcagttctgattggtcacttttcaagtactttctagctatacatggccaatgctgctgttctggacggcagagttcaagagtctttcatcctttttactttctgtgacaccacactgacattcttgacgttttctttttggtttctccaaggaaatacagaccaattctgtatatgtattaagcatgtcattttgaaagtttatgaatttagaaattaaaagtcaaatgtttgtttttcttttcttccttttttcaaatgaccttaggattttataacagtttagaagctccagatttgaaatctgcagtaagtgtattttggcaatacctaagatagtggaaagcagcacgatagctattcatctggaaagttatgcaggaatataaacgtgtaggggaggttagaccattcctggaaagaggagagtttagttgagtcagcctcaaagggcgggcaaatttgccattcataacaaagttgcagatcagaacaacctcgcagaggaaccctgaaaagctgatgtattagccatctggtggtcaggttgggcattgcagtcattcacttagctgatacccttattaggttttgtttaacttggaatttaaattagttctccatttttgtctaaaaaagcctattcctagttttaacatttttggcatttttgaggggtatggcaggtctggtcactgtaatttattgttgtattgctcatgatgatcctgaaaaaaacttacattagtgaacttggacaaagaagctaaaaagtacttggagagagaaatggagtttgcttttttgctttgaattaaaaaataatggtctccttagttgtttgttttttgttttgttttttgttttttttgtttgcttgtttgtttgtttgtttttgagacggagtcttgctctgtcgcccaggctggagtgcatggcacaatctcggctcactgcaagctcagcctcccgggttcatgccattctcctgcctcagcctcccggtagctgggactacaggcccccgccaccacgcccagctaattttttgtatttttagtagagacagggtttcaccatgttggccaggatggtctcgatctcctgacctcgtgatccaccaacctcggcctctcaaagtgctgagattacaggtgtgagccactgcgcccggccttgtttttatttttgagagagtcttgctcaatcgcccaggctggagtgcagtggcgcaattgatctcagctcacttcaacttctgtcttctgggttccagtgattccctgcttcagcctcttgagtagctaggatttcaggtgcacgccaccacacctggctaatttttgtatttttagtagagacaggttccgccatgttggccaggctggtctcaaactcctgacctgcctcaggtgatccacctgcctcggcttcccaaagtgctgggattataggcatgagccaccgcacccagcttattttttaaaaagtaggttaatgtgcatagattttgttcttctttgaagatgagaaaaacacaacagcttatgaaacattatgaaaatcatgtagtttctatgggctgtgcacctgtgtgcaaacacatgcttaccccccaaagcggtgggaaatttctggcataatctgaaacatctgtcattctcctttgagcttctctacccggatgagtagtggaactcttggttctgtgattgcaattctaatcatgaggtaatagaaatcaaggcacttttcttttattctttatttgccacttttctttttatagaagtgatactcatctctgaaatacagcctacaaatacctctgttttcctagagaacacataagcgtaattgaaatgtgcctaggacaatacgtgcaccatattagatggctgccagtataatacctgtttgttgaactttaagaaagggaatcagggtaattaatttaacaatcactgatgggaatttgagttatgtactctttctagttagctgttcaacagtacactgttggttttgctaccttttgagatttttttctttgatttcagaaaataaagcagttggagtgatgaagtcgggccatgtatttacaattgagccaatgatttgtgaaggtgagaaaaaaggatgccatgatatttttcaattgaatttatatgtattttaggtaattcatcatgtcagtggtcttttctacctgcttgctttttgcttcctactcactccctgtcccacctcaaacttgattcagtatcgtgaagaactgaaaattgtgagggttggcaagaacggcatgggttctgcgtggtagtcttctgtcaggagatgctgaaatgcttgaattctggtcccttttcataaagatcatgtcaaagggtgcattgtaataatgaggtgcccaggtcaagtctgtgcggacgttcttgcttgatgtaggagagggaagaggagggaacagagcagagcattgacgagccacccagttcgaggcagacatgattatatgatttaattcttcacaatttataaggtaggtgttaccccattatagaaactaggaaactggtccttgaagagggtgggtagcttgcctgtaacttagcttgttacttggcagaatttgtcagactcagctcatgagctgttctgacccttcatggtctgtactcatgtcatcacgtggcatcatatagctattgtggggaaagcacaccaaggacacttggaaagcacacttggctctggcagcctccccactgttgtcatctcttccagacaggcttgtagcagtgataggagactgggagtcacaattagggctcctcaccgagattttcagagtgattctggtaatggagctttctggttaggggatgcaaagtgaggcagtagcagtagagcttgtgtgtcctgagccctgttttaaaggatactccctctcttgatccttccagtctttttataacccagtcttgggagtgacttctatattgtctttcttagaagtgattcactgaatccagcccgcactcaaggggagcaggagctcacacaagggcctgcatgccaggaggctggggatcactgaagtcactttagaggctgccttctaaagctggttccttattgcgttttctgtaaaatgaaaattagaatctctatcttgccaacacccagggctgctagactgagatgatttatgttatgttatatactttaaaagactgcacaaatgtgcagtaaagtttttgtcatcctcttataataaggataaagttctgatcacgtgcaaccagttgtaaagatggtaagtatttagcagtgaaaagaaagatagtgggaggaaattgtcattttggctacgtatttccattaactagcacctggttggtgagccatgatgtagtgttttcagtaagcaaataactttctatacagccagcacaggtaattaatcatcaaattatagcagatatacttgaagtgtaactcagctaggttaaatccctggactagaaagtctcaaatctgcaggagaatttcctcagaatagccaaataagtttgacttgacattactaaaaatcctgttttatcagatcacaataaaattacagtagtaatgttttaaatttgtgtaaaggccatttgtgtaaaggccattacattgaaaaacatcgatgtactcatctttagttgcttgatgaggcatgagttaacttttttaggccgcctcgtattttctttttagcctgggatttaatattgcaaaagtagtttacttcactacagagtttatgttctgggatttgtctgtctgaggcagtgagtcctagaggtaatatgtttcacctaaagattactcaaaatgaagaaagtattgatttttttttaacatctaattttgaaagaagaaagctcgcaaatacatcttttacagtagtatctagaattgcctttctcattccacctctgcttcacattctcttgggcctttgctttctgctttccctcattatgaccccttcaccccctttccctcctttctctgagttttctttcatggcctcccagattcactgtccctttgcttcccttctctggtttcaactcctgtccagaccattctgcttcatatttttcttatgctctcacaccagtctttcttttgcccctctttctgattccaggggtatagttcacaaaaatttcactgtataatctgttctcaccatctgtttgtgtgcctaccattttgaaattatatcaggaattgaatgctgtaataaaactgtaaacatttacatgatttccttcacaatatatgctgagtatagttttgtcagatgcccaagttatactaggaaagagctaaattcattcaagttttttttctgattttttaattgtaaaatacacatctcatttttaaatgtacagttcaatattattaaatacattcataacgttgtgcacccattaccaccatccatctccaaaagtcttttcatcttgtaaaactgaaactcaacccattaaacattcccttcctattgctcactactcccagaccttggcacccactgttctgctttctatctccatgattttgactactgtactctacctcatagaagtggaatcattaagcacatgctttttttttttttttttttttgagacggagtcttggtctgtcgcccaggctggaatgcagtggcgcgatctcagctcactgcaagctctgcctcccaggttcatgccattcttctgactcagcttcccgagtagctgggactacaggcgcccaacaccatgcccgggtgattttttgtatttttagtagagatggggtttcactgtgttagctaggatggtctcaatctcctgaccttgtgatctgcccgcctcggcctcccaaagtgctgggattacaggcgtgtgccaccgcgcctggccaagcatatgcttttttatgactggcttatttcacttagcattatgttctcaaggttcatctgtgttgtagcatattgcagaatgtcctttttaaaaaatttcctgttttaaaatggacaattattgtacatattcatagggtacatagtgatgctttgatacatataatgatacatataattaattaaggttgttactcaaagttgtggtgattggtatcaatatgttgttaaaatgaaatccagcgcctttattttggaaattccatcttgatttgatatttgggatatataaaaaatgtggttgtaatacatctgatgaaatttaaacatcaaacatactgaagaccaaaatgaagttggaaaggcattagctaaaacaattggcatgtaaataaggatcttagtagtgaattttttccttggctttcttcttgatagagttcatttagaaaactgagtgaactaagaaattgtttttgtttgttgaaggcggatggcaggatgaaacctggccagatggttggactgcggtgacaagagacggaaagcggtctgctcagtttgagcacaccctcctggtcacagacactggctgtgaaatcctaacccggcgacttgacagtgcacggcctcacttcatgtctcaattttaatttctcccaagatggcacatctcagtaccttcttactgtgctatgcattttattgagagtacagaaaggaagaggaacctttttttaatcacttgttttgttttgactatagataagaaaggactacagcatttgatgtgtgtcctcaagaacttgtcttgggtctgaaaaagctgagaagaataaaggaaacattgctcaactcttcagccccctccccctgcacacctgttttctcatttgccctttgagcacttttacttaaacttgcttgtagttgcttttatcactgccgcaaaacagccatcaagagccatctgctttccaggtgaacattggaaatgagaatctttgaaacttagcaatatgtgttgcaccagattttttaaattatatatatggaaatatatatgtatacattttaagttctgtatacataattaccaaacactatgtgacctggagtttgtgttgtttctgctctgacaggtttatatgttcttacaaatggatccatagtttgcagtgatttaattcctggttgggatttggcctcccctctcccccatgctaattatttacccttgtaattgtgcatagggaagcactcacccaatgagactttctccaatgtggactctgtgtgtcagtgaatgaatgtagtaaaattcactttggaaggttatcaggcttttaaaaatctagtttatggcaaaaatagccattttccaagtggtggctgactgttgcagggaatgagaatttcataatacactgctatttcagacctctgtttggtcagaaatggaaaagaaaaagccccctttcttcccttttctgttttacttcaagggcataccttggaggtgctcagagaagcgtgaagtttgcactatggtggaggatggggaaagagttctaaagtgtctccagctgtgaacccaggaggtcaagtgggctattaaaatctaacgttgagtaaatgtgatagtgatgagaaaggaattttgtgtactgtaaccttgcagtagagatgcagctgtccttcgtgtgtggaaacacacctctcctttacatagttgggaacctcattagaaatgacctcagctgccccatatctacgttcctttcagcagttgtccaagtaggagtgtatccagtgaagacatatcaaatcacaaagtcattgtcattagagtgtacttgattactgggcatccttgtaatataatttcataccactgacacattatacttgtaagagaacatctttcccagagtgcctcagaccttattgctttaaaatataataatgttttcattacttttattatttgaatgatttagtaaagttgactgaatctggtatagactttgggagtatgtgtgtgaagtttttatcaaactgtaatatttgtgaatggaatgccttgcaatatgaatgttaatataatgtgtaaagggagattaaaaagtttgaatgattatcctaccatgtagtcattaactttgctgcatttctttgggatttcagagggaaatggtgggaatggggaggctgtttgataatctaaaataaattcatgaccatttgagtagaaatgttttttcaggtgtaatggctgtacataaactcagtagagtgccagcagcatttgagatgcaaccatatttttgagagcttttaagacagaatgctgaatattaggggagcattttatgtactgattgtggaattaacaatgtgggcttattcagtgtctgtcattagaatataagctgaaggaagaaagatcttggtgtgatagttttttggttaaaagataaaacaccacactggtgataatgcttttcttagtttgggagattttaaaacaatatggactctagtctaattgcatatatctaattacaaatgttcattggatttaggtgacaaaacacctagtttcatcattctgccacctttttacaaaacaagtcagagcatggtgtgcgagcctgtagcattagctactcttgagactgagatggggggatcgcttgagcccaggagttcaaggttacagtgagctatgattgtgccactacactccagcctgggtgagagagagagacctcatctcaaaaaaaaaaaaaaaaaaaaaaaaaaaatcaaagtattaacttctttttttacattaacttttagaataattttttccccctgccagtcttccaactcctttggaattataacttggaagaagggaaacatgaacttcattttatgtcttttgttgataaaaaggattaaccaacacctttataccacttgcacccacatatctaaattaataggcaagagttgatgaggtttaggaatttgtttgcttgattcctcagtttgttctctaacgacttctgggttttcattggatttggttaaaactgagagcaggatgctcccctttgcttaacctctaccctcatggtatctgtaagcgatttccttcctgtttttcccttcttttaaaatttttattttttatctccaactttttatattgaaaattttcaaattacagaaaagttgaaagtatagtacagtgaaataatcatatatcccttacctttatctaacaaatgtcattttgtcacctttgctttatctctgtataagcacttttcttttgaaagaagcaacatcgtacttcaccctactacatcagcatgtatctcttaacctaatgacattcttttacatgatcataacacaattagaaatttagtattaatacagaattatataatgtataggatataaactttaattttcccccaaaatgttatttaaagcttccaaattcatggcatttagttgtcatgtatctgtagtctcctttttttttagatggagtttcactcttgttcaggctggagtgcagtggtacaatcttggctcactgcaacctccacctcctgggttcaagcgattctcctgcctcagcctccctagtagctgggattacaggcccccgccatgacccaggctaatttttgtatttttagtagagacggtttcaccatgttgatgccaggctggtctcgaactcctgacccgtggtgatccacctgactcggcctcccaaaatgctgtgattacaggagtgagccaccatacctggtcttagtcttcttaactctagcagccgtgtctaatcctttgagtgcgaggatcttttatctgtggtggtggatatcatgaaaattatgcacaggcctttgtttgagctcatcagctatcgttggtgtattttacatgtggcccaagataattcttcttccactgtggcccagggaagctaaaaggttggacacccatgctagaataaccctcacaccttttttgatgtcttacgaaatggacacttgaaaaatcaggttagtttacaaaagtccgtttgtctgattgttcctcatgaggatagatgcaggataaacatcttggtggaagactacagaaatggcagttgtatgccccattcattgtacaacgtgaggcacataatgttgttgtcaccttattgctgatgcaaagtttgatcacttggtgtttgtcagaccttttcactgtaaaaataccttttttcctaaacaagtaatctgggagattaatatttgcttgatactaccagacagatgtaaaattgtttcaaaattactacactaaaatcactgccaacaataaagtacactttctttatgattctttttttcttagaacatatcattgaagtaatttagatcttattctgaatttcataaaccatgggctactttaagaatgaatgcagtgaatctcgggggcaaaaaatacagtagaggtggggagggatatattagtggtctggcagttagaaatgctggaactgtttgagacagtgtagtaagattctgtctacatttgatagtgtttaacttttaccaagctttccagctgcaagaggagcaaatcataccacttgtaaattacaccacacttgtggcagtgtcgctcattttccaactcctttatttatttatttatttttatttttttctttttttattatactttaagttctagggtacatgtgcacaacgtgcaggtttgttacgtatacatgtgccacgttggtgtgctgcacccattaactcgtcatttacattaggtatatctcctaatgctatccctcccccctcctcccaccccacgacaggccccagtgtatgatgttccccttcctgtgtccaagtgttctcattgttcaattcccacctgtaagtgagaacatgtggtgtttggttttttgcccttgcgatagtttcctgagaatgatggtttccagcttcatccatgtccctacaaaggacatgaactcatccttttttatggctgcatagtattccatggtgtatatgtgccacattttcttaatccagtctatcactgatggacatttgggttggttccaagtctttgctattgtgaatagtgccacaataaacatatgtgtgcatgtgtctttatagcagcatgatttataatcctttgggtatatacccattaatgggatggctgggtccaatggtatttctagttctagatccttgaggaattgccacaccgttttccacaatggttgaactagtttacagtcccaccaacagtgtaaaagtgttcctatttcttgacatcctctccagcatctgttgtttcctgactttttagtgattgctattctaactggtgtgagatggtatctcattgtggtattgatttgcatttctctgatggccagtgatgatgagcattttttcatgtgtctgttggctgcataaatgtcttgagaagtgtctgttcatatccttcgcccactttttgatggggccaactcctttatgttagaacataacatttagacattcatgttttaggaacaaactgtttcataacataggctgcattaggctaaaacctataaaagttgtgttttgttctattttaaaaatggacacctaaggaaaggttagcttagcacacagtctgtgtatggaaactctggcccttatggcaaccttctctcatcttccttttggtgctaagtaggaaaaagaaaaatagtctgcatttatttgggtgttttgcaagatgaagcaggaataaggtggccctggctacgtgtttgctgcttttcattttggggactgtgggtgagcaacaatagaactgtgtatatggtgattctggttatttttgaaaaaaggtcaacactggtattttactagaatactccaaaaagttaaaatatggagcactcaagaaggacttcctataaaaattttcacttatcacaattgtgctgttagtcgttcacagtattttaatagttttttgttgttgttgttgttgttgttcctcaggctggaggcagtggcatgatcatggctaactgcagccttgacctcctgggctcaagcagttctcccacctcagcttgccacgtaactaggactacaagcatgttccaacacacctgattattattatttttctatagagacagggtctatgttgcccaggctggtcttgaactcctggcctcaagtgatcctcccacttcagcctcccacagtgcttggattacaggtgtaagccaccacacccagccaatttctacaatttttaaattgattctgtggctaggagaacaaatcaccacacttctctgtggcaatctcctatttgtgcagtgatatgacaactaccaactgttttattctatacagaatgtgactggctatgaagcagatttgctttgtttcagtagttgggtcagagatcaccagacaattccagatagaattttttaaacttaaatctgaatttgagccctggatgattctgaggaaacaatgccaaggataagaacatttaatattaacatgtagattacagaaagagatcaacatattttaaagcgtgttctgctgctttatcttgcttaacatatctcgatatttttggcagtcaagagtacatgtttaaactggaggtaattccatggtgggttatcactcttttcttgaaaggagcatgtgcatatttctcttatacataaggaattctgatatgtccagtttgataaaaatcaatctgcttaagagcccattacgctgctttgtcaccataatgttccaccgaaggaaatcttgtataatagaggactttgctcatcttgttcacttggtagttgttccttaaagacacaattaccttggtatagttctatgcaattattatctaaatagctgtttatacagtacttaataaaatgttttccaagtgtgtttgtagtgtactttttctaaaaggtatttgctgacaaagaaattgatcttgtgtgtgaactgaaaaaaattggctgaagccagttagtcaacaaggtgtccctgtaggcccaaagaactaaactgtactttaggactttgattatcaacctacatggcagattggtagccgagcagaaaagttctgaagcattctgtgcatgtaaaatatgtttccccttccctgagtcaacaaaacattttgagaattaccagctaagtaaaattttccattcagatgggatgaacagaaatagtgctatgtatactttttggagccatttttgttaggtgttaagttgtacacatgttgactggctccactgtagtaaagttttggacataatgcagttttttccatacctctatcccaaacgacgtcatcatcccataaattctactctatatgttagttttgtgtgaataaagaacttgtgcctatcagacatgcctgtagacggactgtctccagcgagtatcactaggtaggttacatagcagaatagccaaacatgctaaaaatggcaatgcaggaaatacttgaagagaaatttttatattgggaatataaaaattttgcaattaaacataaagatgcttaagttccttacatggcaaaattttagatcctttaaaaaaattttaccagctttaatgaaatatacagtggaagttaatatccatctgtattgcaattatatacctcttgtccaaaaaagcagcttaaagataactttcaaaagtttcccaacaattaataatttattgtatatttcaaaacagctaaaagagcagctttggaatgttcttttagaaatgatcattgtttgaggtgatggatattccagttattctgatgtgatcattatatattgtatgcacatatcaatatcacatgctcggtaagtacatacaactattatgtatccactgaaaaaatgtctaacaagacttctaaagtggttgaatcccaatttgggacaaccagggtagatttgcttacatgcacttagtgaatggttggttggttttttttttttttgagactgagtcttgctttgtcggtcaggctgtagtgcagtggcgcgatctcggctcacggcaacctctgcctcctggctttaagcctcccgagtagctgggattacaggtgttgtgcgccaccacactcagctgatttttgttagtagagacagggtttcaccatgttggccaggctggtttcaaactcctgacctcaagtgatccacctgcctcggcctcccaaagtgctgggattacaggtgtgagccaccacgcctggcagtttttagcatatataacatacatatgttaagcaattcctcaattcaagacgatgtattaaaatgatcttaaaaagaaagacttggctaggcgcagtggctcacgcctgtaatcccagcactttgggaggctgaggtgagtggatcacctgaggtcaggagttcaagaccagcctggtgaacatggtgaaaccccgtctctacaaaaaatacaaaaattagccgggcatggtggcatgcgcctgtaatcccagctactcgggaggctgaggcaggagaatcgctctaacccgggaggtagaggttgcagtgagctgagatcgtgccacttcactccagcctgggcaacacagactctgtctcaaaaaaaaaaaaagacttgacaactatagccgagtctcatgacccaggaattctaatagtaaagattttgtaaaattgattatttttattatttttgtgacagggtttcactctgccacccaggctggagtgcggtagtgcaatcacagctcaaagcagcctcgacctcccgggctcaagcacagattttgtaaaactgattctttatactggatctctgaaagagatagttgtgctttcagccaggaaatgctaatactaaacttaatcagctggctcaagagtatgtacttaactgtgccagaaatgaaaagcaaattcaataataggctagctacaaaaattagagtagtattttatttatttatttgacagggtctcactctgttgcccaggctgtgcagtgctgcgattatgacttactgcagtctcgacctcctgggatcaagccatctttctaactcagcctccttagtagctaggaccacaggcacatgccaccatgcccggccaattaaaaaaaaaaaattttttttttttctagagatgacatctgtgttgcccaggttggtcttgaacttcggaggccaagtgatcctcccactttgggctctcaaagtgctggaattacagttgtgagccaccgcacttggcctattttaatattaatcatcttaaaactgctttacattttcatattggcgaacctaaaaaacgtttgccattgcaattcatgaatatctcatgtttgtttgagaagaaaagtcaaaggaacaagacctttaggagttactggctctcctccatactctccataactgttttgttactgcagttgccaacataggatacttttgttcctagaaggctgggctacaccaaagattaaaagcacatttcctacaagtggagtagaagctagttttaatttcgtcttcctttcagtccacttaagataacagttgtggcccctttgggccctcatatctccagccctctaggtaaaacaggagggaagctggactacattgtcaggcacttcaaatgcaccaaagttctgaaaaggggaaatcctgaccattactaccagtttgtttcccacttttcaatcaatgacatattgctctctcacacaattctgtgggagcatttaaaccatatcaataaattgaaaaagcacatagcatcaatccaaccaaaagatatttgcatggtaaacgtgatgcactgatataaactctatgttatcatgtggagaaaaaagttcacagagtagtgttgatagtattcctttcgtgtaattttagaggatatatatgctattgtgtgcatagaaactcctaaaaagatacgtaagaaacttaacagtaatcacccatttttttgcaggtgtatagcttttctttctcattatataatttcctaacaatttatattttctaacccttaggtatattgcattcattaatttatttttatgtcaaggattatcaggatggtaagatcctggaccatttttgtttgcttctttatacttctcaggataaaataacctaaatgttacttaccaccaccaggaagatttatgtgactacattaaaactttattcaacaaaataccataaagtaaaaagaaaagtcacaagatagactagaagatatttgcaacatataaaactgacaaatgattgatgtctagaataaaagaactcctaaaaattattcagagaaaaataattcaatacaaagttgagcacaggatatgaacaggttcttcacaataaaatgtccattagaatgaaggatttaacgagaattgaggaaaatgcaaactaaagtcataataaaacaccattccatactcatgtaattcacaaaaactcacatttactttgaagagcaatttggcaatgtctataaggctaaatgtgtttattctgtgatacgtcttaggtaacacgcagtgagcccaatgcagaagaatgttccactacagtgttataatacagaaactggcaacaacttcatgccttcaactggagaacagataaattatggtagttcccgtaattgaattctgctacacaggactaaaattaatgaacgagagcttcagatataattatacaataatgagtgaaaaaagctgtagaatgagcaagtatgaggcttaaaaatatataaaacagtactaaagagtagatggtttaggttatacacagtgaaagtacaacaacacaggaatgataaacatcaaattgtggataattgttacctctggaggggaggaatggcaatgtgatctcgaagtggcaaaatgttaagatttgacaaaagtaggtgctgagaacttggatattcagtatgtagttcactatactagaaatagtacagtcacaaccaacacatacatacacctatttaagcccagaatgctgtttcaataatacattttagtgccccctgaagggcagatgccatcctaggaatttggggtacaggtatgaacaaggcacagtacctcccttcaagataatatcacagaagcagacttgggtcctgattaactttgtcactgatggctaggatctgttctttaatcaacggggactgagacccttaaaagttcaacgttatgtttctgaggtttcagacacccaccactgccctgcttcctttccctttcccttgcagaatgaagataatgggcagacaaaccgtgacaatgatgacagcataaaacaagacaatttccacacaaatgtagaaattacttttattatgttaaaatattccttaataaactagcaattatttatgtggaggagcatccagaaaacaggttcatgactgaattatccttgtccttgattatagagattcatgaatgacacacataaccctattttctggagtagctgtgaagctctacgaggctgtgaggttggaggcgcttctccctgcctgttaagctgctcctatcacatcacgacaggatggacattatttttctcttttgaattaaatctttacaacagttcgaatgctgtaaaaggaagcaacatactaagttttaaatgatacctttaagacaactaaaattgtgtttttcgactctccatcccctcaaactcaacatcattattacattctatgatatataaagagaaagcctacctctttccagaatgcatcagttcaaaggctttgttgatttcatcaaaagacagattgtgagtcacaaattcatcaacttttatctttttggacatatattcagacaccaactttgggacactttctacactcttccatcctaaaagaaatcacacattaatttattcaacaaatttctgcagtatgcttgttacttagctgaggacaaaaggcatttaaaagaatgaattttttgatgagttaaagagtaatgagaaactccaaaatagcatggagatgaagaatttgaccaacacctttcagtgaagaagtaaatacttttgaaatttcccttcctctgtattaagatttactaaaacctcattaaagttttggccaattgagacttttaaactacccaggacagaactctggaagtctcaacaacaagcttatttaggtccacatcagcaaagatttctataatcatgatattcaaggaagaaaaaaactaatacaggactttatttccttggttttaaatttaacaatgaaatagggatagcatatcagaacagaaaactatgaaactgaaaaatgaagtagaactctttagctaaatgctaagtttgttcgtttgtttttgagacggagtctcgctctatcgcctaggctggagtacagttgcgtgatctcagctcattgcaagctctgcctcccaggttcacgccattctcctgcctcagcctcccgggtagctgggactacaggcgcctgccaccacgcccagctaattttttgtatttttagtaaagatggggtttcaccatgttacccaggatggtctcgatctcctgacctcgtgatccacccgcctcagcctcccaaagtactgggattacaggcgtgagccaccaggcccgactaaatggtaagattttaaataaaattaggtacttcaatttctcactgtatctaaagaaggaatacaatcaacaagaagccttctcaccttctaaggatgctttcaacgatatttcaaacctcttttgagccttttccaaatctcctctcttatattctccactaattattctttccccacaaatggtagggattttttctttctcctttaaatgtcctggtaactgagatgaccacagtcactcctgttctctagacaaaagcttctattatctttagatcagcaatgcaaggggcctcaatgatacaatgaatttcccaaccagcatgtgctagaatgaggcttcagttagaggttactagcaagatcccctggatcagccaggcttagaatgccctttaaaatacagctatggactccaaaatgatacccccgaatagcatacatggcttaaaaagtttcttctatgatactctgctgtgacatgtatctagagctttgaagaggaggtcaagtcagattgacatcttctaaggcaaattctgtagttataaagaacgaagattttggccaaacccctcattttagcatattttccaaatcttttcttctggccttcaaaaaagctggcataatatgaggtagaggaccttaaaagacaacccgttaaacacagatcattcaaaacacacactatgtgattttttttctttaggaggaggatgaaatataaatatatatttttaaagccctttaaaaactttagactcattcattcacaactgttgggaaatacaaacatgttgtgacatcttttctctcctctggctgagcaaccatggaaaagatagaaactgtttccccgcaaccccaaaccaccaaggactttttaggatcacaaagggaaaaatgatcagtctagcagctttttgattttatgataaggctttgtccaattaaatattttcagtttgagactcaatattggttactgctaaaatcagacagatatatgatcacatccagtgatcactgcactcctggaaaaatgaataaaaatgtaacaagctacttgggtccacaagaaacacaccatggctgatactgctgtttgcttactttgcaatcaacttcctgtccctgctatacccataactacttcctcactatcagaatattgatatttttcttttatagaatatgcaccaagtggtcctatgtttcaggtgagcaccaccctcccccccaagtcccaggggtaaatagtgattgagtctgaatcccttctaataaaacagccttgcatgcaacaacttataatgagaaggaactcatgaagattcttgttaatataaaaaaaattaggtggctgggattaaacatctgccaatgcaactaacaaaagagaaaatgcagtcatctcatccatcgaattacctccaaaggcagtgcctttccatgtgcgacctgttaccagctggaatggacgagtggcaatttcttcacctgaagcagctactccaaccacgacgctgacgccccagcccttgtgacatgcctcaagtgctgctctctgcaggcacagagatatgaccaaatcacagaagtcagtgcattttcctgagaacaactgctggcgaaacttctagagatggcatagtttttaaagataatggcaacaaaaggccaaacttaacatttagtgagctcaatgttattgaacaatttatattttaattttttttgttgttttttttttttttgagataagagtctccctctggcacccaggctggagtgtagtgcatgatcctggctcatggcaatgtccacctcctgggttcaagtgattctcgtgcctcagcctccctagtagctgggattacaggcgtgcgccacgacacccagctaattttcgtatttctagttgagacggggtttcgtcatgttgccctggctggcctcaagtatccacctgccttggcctcccaaaatgctgggattacaggtgtgagccaccatgcccggcctgaacaatttattttaacaaattaacctggttaaatattaacataaattaaaataatttgaagtgtttatttgctttctattttaaaaagtaaactgtagttcaaaactctaaaagatttaattttaaaaagcaggcagcagaattaatagtaatacttttactgagtgtctatgtaggtttaagtaggtgttgttactacaggttgattatcttttatctgagatgcttgggaccagagtgttttgaattttgggttttttcggatttggaatatttgcatcgtatttattagctgagcattcctaatctgaaatgccccaatgagcattttctttgagcatcatgttggtgctcaaagtttcagattttggagcattttggatttttggattagggatagatgttcaacctgtacctgcattttacagatgaggaaactgaggttgagagaagctgtttgttcagggtcactgagttagtaagtggatgtgtatttgattccaaagatcatgctctgcacaactgctttattctgtcttttcatttcatgagacatgcacttagcaggcattgaaaggcaaagaaacatcttttctcatccttccctgagctgttcttgtatcatttcccattgtagttcaaatagatattttccccttctttcactagaaaaattcttattaagagacttttcctttgccaaaacaaaacaatttttaatctaaaactgcacttcaaaaaaagcagttccataaactaaaaaggaatgaagcccatactcaccatgaccttcacattaccaatacattcaaaggaatagtccactcctccatcggtcatctcaatgagcacttcctggatgggtttactaaaatcctgagggttaatacattcagtggctccaaactctttggcccttgcaaatttatctttattgatgtccacaccaatgatccgggaagcaccagccactttacagcccatgataactgccaatccgactcctcccagaccaaagacggcacaaacagagccaggctccaactaggagtaaagaaagtttataaagtactcattctaccagagtcaagagaatcactgggtttcatacagattggccaatttcactattccaggaaagtttcactgaattaaattagaaggcagaagcaaaaaacccaagtcagtctcttaccttggcagtgttcacagcagcaccataaccggttgaaatgccacaacctagaaggcagactttatccaaaggtgctaaaggatctattttagcaacagagatatcagccacaactgtgtattcagaaaatgtgctggttcccatgtaatgcaaaattgtctttcctttgcaagtaaatctgctggtaccatctggcattaatcctttcccttgagtgactctaaagaaaaaaaaaggaaaaaggcaagttggaattaggtttcttaaaacccacaggaaaaagaaatgttttaaaaataatgaccagtaaatattaagaaagtgttgtaaactacaatttcaaatatattcattagtaatttagcaccttgcagcaatgccttataaaggaaatttataagatatttataatcttatccatcttttccaatattcactatccttctagatcatactgtcagaatactgaactcattttaaaaggtacaacttatggatcagatggaattattttaaaatcccatcattaaaacggtgggccaggtgcagtggctcactcctataatcccagtactttggaaagttgagacaggaggacaacttggagccaggatttcaagagtagcctgggcaacatagcaacaccctatctctacaaaaaataaaattagccaggtgtagcggagcacgtgcctgcaggaggttcacttcagcccaggagtttgaggctgcagtgagccgtgactgtgccactacattccagcctgggtgacagaatgagatcctgtctcaaaaataaaaaaaaataaaacaacctctgtgagcaaatataacatcataaaggataaagtcaaaaccagtatctatgcaagtagagattacaaaccattaaccagatcaactaatgaaaacagatagccaaactggctaatttatatctttcaggaggcatttttctgaagtgtaactaacagtcctcaataatgcaagttaaattacttcttcactttgttttgcctgtgacttggttacaccaataggaaagaaaacccaaaaagcttacaaaggccactgatataataaatggtaacaaaaattacttttgctattctaaacagaggtgatgtaacatcttgcttaggaggacccaccctaaagtcagagcacttgggttcaaatcctgtgtgatctgagcaagttaattaatctttatgccttcattttctcactagaaaatgctgagaaacataggtaacttcctttacaaattgctataaaagtctaatgagatgttatatgaggctttagcattgtgtctggcacagaactgatgtttagtaattatgttattttaaataaaataaacactataattgctttttttgagacagcccaggctggagtgcatagctcaccacagccttgaacactgaggcaggaggattgcctgagctcaagtgatcctcctgcatctcagtaccaagtagctggtactacaggggcatagagacggggtctcactatgttgcccaggctgaacactataatttgatgtatactcttaaactctttcgaacatacatatgaataaatatacagatgaagagaaaatggactgtctctagattcaagagcaaatacatttcctttgagagaaaaataaatatgaccagaaacaaagaagaggtgacaaagctccatcagaaagaatttttttttgacacagggttttactcggtcgcccaggttggaatgcagtggcacatcatggctcactgcaacctcaacctccagggctcgtgatcctcccaccacagccactgggcagctgggaccacaagcacgtgccaccaagcccagctaattttttaaattttttatagagagggggtttcaccaagatgtgcaggctgttctctaactgttggactcaagtgaaccacctgcctcagcctctcaaagggctgggattacaggtgtgatccactgcacccgactaaaaataactgctatatcttaatgagaacaatttaagtttgtttagccttccttaatgtgagaaatcactgtattccagaggagtttcttgaacaaaaggtgatgtggaatacattttatgctttgaaagaatttaaatggttacaatcacaaagaacccatcaccactattatatttgatgtgttgcaaaatctttcagactgcgtttaaaattccctttcaaagtgattagatttttttgtttttggttctggttttaccaaagtaactggatttgctttataaaataaatggaattttgttttccaaaaatataaactaattttgtcaatggcattataaacaaatggatctcccatacaatgctggtgcaagtgtaaactggtacaagtacacgagagagctgtagatgcatatcttacgactcagcaattataatctcaagaaaatgctcaagagaaagcaatgcctatatccatcaaaagacatgtataaataagaatgttcctagcagcattaactgtaaccacccaaaactgggagtaatctaaatgtccatcaacaggagaatggatcaatactggtattttgaatggattaagacagagcaacaagaaggaactactgacgcatatgcagcttggatatatctcacagacattatgaaaaaaaagaaacctgacaaaagagcatgcactgcatgactctatttatacaaggtcacagtgaaaggaagaatcaggacagtggttacctaagagggaggtaggttctgacttggaagggacatgagggagcttatcgggtgctggcagggttctctatcttgatctgggtgacgttcaaatcaacaggtgtttatatacataatcattcattgagctgtacacttaagatctatacaccttaagtgctttataatatgcatgctctacttcaattaaaaaaaaaaacggaacacacacaaggggatcttaaatttcctcaaagaggtagttctttcagtgttgttacctagtacaataaaaacaactaccttttctgtgtcaaggagttaggttatctcctgcagtcttcctaatagccttagtgggtaagttttattactctcacttactgggcagtggttcataaaaatgatttcgtttaatctcagaagcacgtctttccttactacatggtttggcaaatttagcctgctgttatgtgaagagaatgggtacagaaaattctgttttatatcttaacggctggtgatactgggcacacccctttagtttctcttttatctgtaagaaaagtcagtatatttatggtttgctttataaaaagttactattaatacaatggtacacagtactgaattcacaaaaatatgaacaaatatttacagtaagagacactcacaacagaaacactgcttcaaagcaagttacatccggatgacaatgtctatacacacaaaaatccctaaaacttattggttcttttctttgcagcaggagggagggagagaaaagaaaaaaagatagcagataacctcaactcttcaaaagcagagatttgttcaatgaaaaataaaggagttgaaagaaaaatgagccaacaaatttccagattatgacaaaccattctggggtaggggttaggggatcctgggacagggagggcccagggtccagtcgcctttgtgaagaccagccaaggttaacatagggtaccacagctgggcaagatgagaccagggtgaggcataaggtggagtcactcccctggtctcttcacatccccccgcttctttcttttatggggtagaaaggagacagaaggcagacaccccttgagagctgcacaagttacttaaatcagccacctctacaagctacacatttcctcatgtgaaaaataaatgtttcttcagttgcacaattaggcagaaaaccgcaaatggtagagaaggctgttgctgtgcccaggtaccctctctgtgtcaaaacctcttaatttctgagtcttctctcatctgtgaaaatggggatagtagtgaggttgttataaagatggaatgaaaccactgatgtacaatgcactacataaactgccacacaattatttattcttatcattgttaatatgaccttgtggaacaggaattaaaagaaattaaagaatgtgtaagcaaaaactcagttgtatgtaagaaaacccaactccccctgaggaagagaaagagctggagtcctttaaaattaactgcctgtttttctgtggctagtgagccttctctctccctttcccacgcattgtgaagactctgtttctctagctgtgcagctgcaaggtcactagacagatcatctcaaatcataaaacacgttgttccttgaaaaataagaaatgatgtaatgcatgtctcagttgaataactgtctttgtttcttgcttctgtaatatgctccccctacaaaggtctccccccaccccacgaaatgcttaaaaggtagcttgactctttgttcgggactcagtcctttgaacgttaatccgactgggttaatgaacctaaattattaaataattcctcctcaacccctcggtctctgtgattccttaattatcccgcagcacttgtgttttaagaagaacataaaaagatactaaccttatcttctggcaaaggttagttttaggatttagacaaaatttgcattctccacactgtgggatgtaaagtgggatgacagtgtcacctggaaacaaatgcaaagacatcctgaataggtagtatctatttctaaatgaaaacatcagcccttgcaaattcctgtcaacggatgtggctttgcaaagttaaaaacttcaagtcttagaactttacctaggtaacatcattcagatactgtctgaccatgcaaaaagtatgtttcaatatttttatctaaatgaaactctttaaacaataactgaagaacaatgaagttatatgcttcaaaatcctgcttcattgatgcatctctaaaaattcttgcttaatatgccaaaattggttttggaaatgtacttagaaaagtttcacaaaaacagtagtctgcaaaatcagagagaaaaaaatatccaaatatttgtgcttcccagatgaggaatcaacttaatcttgacaatctacttagatgatacctattcataaatagtgggtagttttatcagaaaaacaatttccccataggaataagccaaaattattaaacaagtggttcaagtattctccttacccgccttcagcttagtaactccctcaccaacactttccacaattccagcaccttcatgtcccaagatcactggaaaacaaccctcaggatcagctccactcagggtataggcatcggtgtggcaaaccgcagtggcaatgatctatcaggacattaaaacaacgaatgtgtaagtatgtgtgcatgcaattcagaggtacagatacaagaaaagtcattttattataatactatatttcattgactctaagacacatttctttcatattttaacctctctaaaatcagcatgtgcttataatccatggcatcttaacaattagaattggcagcaattttttagtggtacataaaagcaatggtgcatttatatgcaacgaaatagggaacatctagtccccctttcagcgcgcgttagcaagagaaggtaaacaaggtcattttatgggcactatgccttcaagcatggagagaaccatcgcctgtgtgcaaaacaggtggaatccaactcacttctagtttcctcatgacagctgggaaatatgatttttaaagaggtaatgactatttctgaaataggccagtctgcttgagtctggaccaaatttcagaactttcagaggaaccaactccctttttacaaaccacatacaagttctatttaaataagcctgttatctctatctctctggctttcaagtaacttattatttttttttgggacaagagtctcgctctatcacccaggctggagtgcagtggcatgatctcggctcactgcaaactccgcctcctgggttcaagtgattctcctgcttcagccttctgagtagctgggactgcaggcgcgtaccaccaggcctggctaattttttatatttttagtagagatggggtttcaccatgctggccaggctggtcttgaactcctcacctcattatctgcctgccttggcctcccaaagtgctgggattataggcgtgagccaccatgcccagccgtaacttatattttaaagccaccaaaagcacagaaaggcaaaatcttggagtatttctatttatgcgtctctgctcctggcttatatatccacttacaacgtaacaatctttgctacctgtctgcagttttgcagggaagatggctgtactcattgtgtccatacagctcaatgagcacaatgaatacccattgagctgtatgggcacttaatacatccaggacaaacatcttcagtggcaaaatcacagtcagcttaatttctgaatttgaagaaaaaaacactattatatgatttcaaattcctgtgtatgggttgcaaaggaccttaagatgttatttgggccaggtgtggtggctcacacctgtaatcccagcactttgggaggctgaggcgtgtggatcacttgaggtcagtagttggagatcagcctggccaacagggtgaaactccgtctctactaacaatacaaaaactagccaggcgtggtggcgcatatctgtaatcccagctactagggaggccgaagcaggagaattgcttgaacctgggaggcaggggttgcagcgagccgagatcgcaccactgcactccagcctgggcgacagagtgaaactctgtctccaaaaaaaaaaaaaaaaaaaaaaaaaagataaaaagacgttatttggtcctggtctgctccacctggtatttgtgatctttgggagcatgagccagtatgtgtggtgtgttttgaaagtgagatggtaggggaagtatactccaagtcacagctcttttttgctgtgactctcttcctagaatgttaatgatcactactctaaagcactaattttatatcaaaacaagtagagagtagtagaatgctaaacacatgaagttttctacatgccaaggtttcaaagatctctccagctggctaccttgtacaatatgcctctctccaagggtaacatcatttctctgccaccagaggttgagaagcactagaataatgaattccctgaaccctacccttgtccgccagggtgggtgcattttaaagctctctaagcaagctgacttcatttgcttattactctattcaatcaggagcctcttctcaaatcttgtttaagtcgctgtagcaaaactgaagaccatttctgtcagaggcattttaaccagagcgactccaccttgaataggcgctgggtaaaataaggctgagacctacctactgggctgcattcccaggatgctaggcattcttagtcacagaatgaaataggaggttggcacaagacacatgtcacaaagaccctgctgataagacaggctggggtaaagaagccagcaaaaacccatcaaaaccaagatggcaatgaaagtgacctctggtcatcttcaaggctcattataggctaatcatagtgcatttgtacaccaaaaggcagtctcaccagtgccacgagtttacaaatgccatggcaatgtcatgaagttaccctatatggtctaaaagggggaggaatccttagttctgggaattgcccacccctttcttggaaaactcacgaataacccatcctttgtttagcatataatcaagaaataactatatgtatactcggttgagcagcccatactgctgctctgtctatggaaaagccattcttttatttctttgcttctctaataaacttgcttccactttatcctatgaactcactccaaattctttcttgcgtgaggtacaagaaccctctctggggtcagaataaggacccctttctggtaacatttcttcttttgtttctaacgtgtcagcatatatttaaagttatctaatcagcagaaaaatgagtatcctacagagttaccttaaacctaaactgcagaagataaattgcaataatccagtgacccatggggatagctgctcagcccaagatcaaaactaaaagagatggagaagcatgctgcaaaggtgaaagataagagaaggatgttgtgattgtaaggctggatgactttcaacaccttttctttgacactgtcctttgggatttatcctctgcagatctcagatctactcatctatccagagacctcattgtgtctctttttttcccagtgccttaaatgtatcattaccttgattcgaacttcatgagcctttgggggtgccacctctatctcctctatggagagaggctttccagcctcccaagcaactgcagccttgcacttgataacctgaagtggggaaaaaagggaataagctgtttatcctcctaaacaagtaactacttaatagccaatttagatacagattaatgctaatcttaaaaagtatatcacagattcacaaagaaacatatgcttccaagtgatatgtttttagatttcacacaaatagtatacatcaaaaatgatttaattgagatgattacctggtcagatagaaaagtatcttttggttaaaaagttgtactcatcaaatatttaatggccttctacagtgcatatgcaaaagcaggttaagaacacaagttccgagagaatctgattcagcaggtctggcatggggtccaagaaatctgcatgcttaacatatgcctgaagaaattcttttgctcaggctgttctgaataccaccggcttggtgcaaaactgcagggtgggaaggaggattaggagtgtaacagtgaggagctatatcccttgtaactgcaccggccaatacagcagccacttgccaaatatgactactgagctcttagaaaatgaccactggccgggcttggctgctcacgcctgtaatcccagcactttgggaggacaaggtgggcagatcatgaagtcaggagttcaagaccaacctggccagcatggtgaaacctcatctctacaaaaatacaaaaattagctgggcatggtggtgcgcatctgtgtggtcccagctactcaggaggctgaggcaggagaatggcttgaacccgggaggtggaggttgcagtgagccgagattgtgccactgcactccagcctgggcaacagagcgagacatcgtctcaaaacaaacaaacaaacaaacaaaactgagatatgctataaatatagctggactttgaagacttagttcaaagaaaagtaaaaatatctcatcaacagtatttttaaaaatactgcttacatgttgaaatggtagtttatttataacaacattataaataatgtaatttaacataattaaaatattaaaacttcactttttcctttttaatgaggctactgaaaatttaaaattacacgtgactaattatagcacacagacctgctttagagattatagtcatgtataccctccattacaagagaatcacacgtaatgagaaaggttctaattagtttacattacacttgagaaatgtgtggacagactaaaggttgtaagccactgggtttacaggagacagactttaaagttaataattacaaagagtgtgatttaaagagacaggcacaaagtaatacagaaagcaaaaaaagtaggttaagagtgtaactttgcttggtttgggagagcttcacttctaaccaggatactgaaggatgaggaaaaggtaattataaatggtggtaaaacacctacatatagggtgattgtgagaactgaataagaaagaatatgaagtccctggccgggcgcggtggctcaagcctgtaatcccagcactttgggaggccgaggcgggcggatcacgaggtcaggagatcgagaccatcctggctaggtgaaaccccgtctctactaaaaatacaaaaaattagccaggggaggtggcagtcgcctgtagtcacagctaccggggaggctgaggcaggagaacggcgtgaacccaggaggcggagcttgtagtgagccgagatcgcgccactgcactccagcctgggtgacagagcaagactgcgtctcaaaaaaaaaaaaaaaaaaaaaaaaagaatatgaagtccctaacacaatccttggcacagcatagctttgcaaaataagttagtagttattggtagcaacagaacaaacggttgagggaaaggagaggtgaactacatagagatataaaaaatggcctctgtaggccgggtgcaggggctcacgcctgtaatcccagcactttgggaggccgagatgggcggatcacctgaggtcaggagttggagaccagcctggccactatggcgaaaccccgtctctactaaaaatacaaaaataccgagcatggtgacgggcgccggtaatcccagctactcgggaggctgagacaggagaatcgcttgaacccgggaggcaaaggttgcagtgacccaagatcgcgctatcgcactccagcctgggaaacaaagagcgaaactccgtctgaactggcgggggaggggggggggagggaaatggcctctgtaaattggtgaggttggaaatgtggaaatgatcgtttttaaaattaaattgcagatattaaatctcatagtacaaagaatcagacactgcattagaacctttttcatttcaatgtgccataaatttcaactccacaagtcagattcagaatactaacaattaagttatgcaacataggaatccaaagaaacaagaatactaaatttgatggcctgctcccctttaaaaaatgtcttaatggagcctaaccttttccttttactgacaattctaagcaaaacaaagccccactctaaatccgcgggaaatggccctacttcaacatttgaactatagtaacaattataatctttcaccttctctgaataaagacactcagtaataaggaaaagcaactaccagtttaagtctgaaagactgtttagagtttatttctttcaaactccaatatgtttaaggccatttgtcttactagaaaatgtccaaaattgcaaaacattaaaataatcagcaactttagactgagtatgttattcgtaatttctgcctttctttactgtctaatttgtattttatgaatttgtcatagaggagcagacctgggtcggaatcccagctcgccatcgttggtgtgaccaagcacaaccaacctcaaacctcagtttttggtaagatggggataacacctcgcagaggtgtttgttacgtgaggactagagggaatataaatctcttggtatttaagtgctcgaaaatgtttctgaaagggacgtaggggtctttccaaaatacactccttggaggcacaataattaaggcgtaggctcaattatgcaacacaagcaacctaggagttagaagcacgggatctggctgcagctctgccaagtatgcaagctgcaagaatgacccagagcgagttacttaatttcgtgtaagaagcaatgcgtggccgctcctaagccatttccactgggataccgacctgaccagcccctgccccccactctccggctctcccacccccccaccccgttccgactgtcccagaagcagcaaagaaagctgcttcccaactgaagagccgagacaaagcttccttctctttctgcccctctgagccgctcgctgggggcccagtttcagaaccaagagccagatcccgtcttgggcgccgagcctcgcgcgcccccgaggatagcagcctagtcccatgccatgcactccctcccttggactcagggccctccgctcaacgggccctacctcgttcgccatgttcacggattctggtcggcgcggggggctgacatccggggtgggccgcgcagcgacggaggcatgggcgtggcgagcgcctagcgaggggggcggggcgtggggggggcttgcaatggctccaaccggaagggcggtgctcgagctgtggtgcgtgccgctaagttgtgcgttccagggtgcactcgccggcgaggctgcacggcgccggtttcattgctaaaatccgacggacttgttgcagaactcgttttttttgtcgggaaagggcttccccgtgtaactttacagcagttatcgtagataagacttgcaaattacagatgtggacggtgagggaacgggaatttcactgaaagcgcctgagaaccagtaagagacctgcaacagctttgtgctccactggcgaatgcttcctcccctaatacacattatgtgtgcttggagacacaaggagtaagatacagcccctcaagggactcgtcatagggagaggacacagctttgggaataaaggggccacaaaggaggagagaggagtttgctgaaacttcccaagctcccattccagcagttcctgaagggtaggtaggattttggggagacagtagaacgtgggcagagaactttggaaggaggagatgaggagaacaaaaagtctcctgatcctggacagttttttgtgttaagagtgggccagagtgtagagagagagaatgtagtatttgtcggtttactctttctttgtttgtttgagacggagtctcgcactgtcgcccaggctggagtgcagtggcgcgatctcgggtcactgcaacctccgcctcctaggttcaagtgattctcgtgcctcagcctcctgagtagttgggatcacaggcacacgccaccacgctggctcaattttgtatttttagtagagattgggagtgggggcagggggttggtctcaccatgtatgccagtctggtcttgaactcctaacctcaagtgattcacccacctcagcctcccaaagtgctgggattacgggcatgagccaccgcacctggcctgccagtttactcttaaactctgttgtaaacgctgaattttgttaaaatagctctgtcagacacactgctcttttctgtctttcagtctttttcttggctcttttccgggtacatatggtaagattgtccaaagtctttccgtcctttcactccactctctcactcacactttggcttttaacgtctatttatggaaagatgactaccagattattatctccaatcaggatggctcccctaaactccagacttggacatgtaactgcctactggatttctgtctccattaggatatctcacaatcgaatgcaactcctaaaactcctattaatattttctccttatagggactctttcctctgtgtgttgacactctccacatacttaccctagccagaaacatgagagtcacaacttctccctctccctcggtccctgcattcagtttgtcaccaagccctaaatatctctctggtcttgtgcctctctctccccactgctgctgtattagttcaggctttcataatttcttacaggattactgaaagagcctcccatctgatttctttgatgccaggcccttgaatctaatacttaaaaaggaatgccctgttagtgatctttccaaaacgtaacatcaatcaatgccatttcctattttccttcaataatttttgaatgagttaggctataaataaataaataaataaataaataaataccattcttctatttaaaaatattcaagggagaacaaatggataaaatccaaactctttaggccactcaggctctgaattacttccttctgtatatacctctatccttatttcctgctctcctgccaaatttcacaccaacatttaaggaacattcgtagttccttaaagggactatgctttttcttgattccaggcctttgtgtatgtcaatacttctgcttggaatgcagcaagcaatttctagtgggaaaaaaaaaagacttggcagagagttttcttttccctattgcagatatattgtctattttctggaaagagacacttgcatttttgtagtgccttgtttaacaataataggcaagactttaggtttctggtctgacatgtaaggaatttagaagtcatcactccatcctaacaacaactaaaaagctaaaaaaaatgagaaattaataactcttcttagagctgtaagtgaagtggggtcacagagaaaacagcttctccaaaattagagacacagatgggtggattcaaagaatcacaacttaccatagaaacacacttttgcaggaactgttactggagtaggaaagtctgagctgtaattgatgaattgccagaggctcattgtggattagtttgagagttaaagattcttgggggacccaatcttaggggggctttcacacttttgtgagttttacctccgtgaattctcagagaagatcagagaaaaatccccaattgcttcctgcatgaggagtgtaaaaggaattattttgaaaaattctagtgcattttgttcttaacaagacttgccaacaaaagaaactattttactcgagcctagtgtactgggatttttacaagtggttaactgacctgggggaaaggaaatacccaactccagctccctctagacattctgtaccacctaagggggtgaaaaaacaaactgagaactgtgaagtttacagcctagggacacaggctcactaaaagactgagataaaatggtagaactataggacacttccccttcccgtgtatcttaccactacattactaaagggctatttactgcaatttctttgactcagtatattatatccgcctttcaatacaaaattacaaggcatattaaaaggcaacatagtttgaatggacagagcaagcagtggaaccaaacccagaggatgacagggatgttgctattatcagaccatgaatttaaaacaactatgattaatattgtttgaaatgcttgttccccggtgctgtaaagaaatagtacttgaacataaatttaatttagtaaggccatttttacttttgcagaaagggtacactggccagcagttttgccatgagagtacaccaaacaaaggagacagggtcatttataacctaatgtatccaccctactgctgtgtccggtttccattgtctggaacgggacctcacattctgtatttgtcctgacttgctagcaacttagaactttttaaaagaggcagaggtagaggagaacaaaggaaggaggaggtaacttgtggaatgctgagaaaggtaaaaacacttttaaataaggaagaggaacaggctatgacctagtgcttgcttggactagtataagcatgccagggcaaatatttaggagcacaggtctttgaataaattttgcttataagagaagttaccatttattcctaattagatgggcaggaaagtctttgaagaagaacctctactttattttttacagtatgctaagggctttaatgggaaaagtagacaacatgcaagaaccgatggataatgtaagcagagagatggaaattctaagaaagaattgagaataaatgacagaaaaaatactgtaacaaatgaaaaatgcctttgatgggctcattagtagactggatgtgactaaggaaagaatctttgagcttgagtatatgttaatagaaacagtcaaaacaagaaagcaaagaggagaaacgaataaatggaacagggtatcatatacatgtatgggagtaccagaaagagaagaaagcaaaaggagcagaagcagtattcgaagcaactatgactgagaatttccccaaattaaagtcaggaaataaaccacagatccaggaaacttagagaacaccaaacaagtgttccttccaaagcagaaagcacaaagcccacatgggttcactgatgaatttttccaaacatttaaggaaggaaatataccaattttctacaatctttttcagaagatagaagcagagagaatatttcctaactcgttttatgaggccagcattactgtaataccaaagccacagacattgcaagaaaactacataccaatatcccttatgaacctagatacaaatatccccaacaaagtattagcaaattgaatccaacaatgtataagaataattacatgccacaaccacgtggtatttatcccaggtatataaggctggttcaacattagaaaatcagttaatgtaatccatcacatcaatgggctaaagaagaagaaaataacataattatagcaataggtggagtaaaaaacatttcacagaattcaacacctaatcatgatgaaaactttcagcaaacgagtattagaaggaaactgtctcaatgtgataaagaacatctacaaaaagcctgcagctaacatcatacttaatggtgagaagctagaagacttcctgctaagactaggaacaagaaaaaggtgtcccatctcaccattccttttcaacatcttgctgaaaatcctacctaatggaataacacaaggagaagcaataaaatgtatactgattagaaaggaagaagtaaaactctctttgcttacagatgacatttatctatttacaaaatctgaaaaaattgacagaagtctcctgaaactaataagtgattatagcagggttgcatgatacaggtttaatacacacatttcagtcattttcctatatgccagcaatgaacaagtggagtctgaaattaaaaacccaataccatttacattagcatccccagaaatgaaatgcttaggtagaaatctgacacaatatgtacaagatctgtgaggtaaattacaaaactctgatgaaaaaaaataaatggagaaatgtctcatgtacatggatattctgaaacaacattgtcaaaatatcatttattcccatttgctctatagatttaactaaatcccagtaaaaaaataccagcaaattattttgtggatattgacgaactgatttcaaagtttttatttttatttttttttaaagtacagcataatttgttgaaaaaaattggaagttaagtgcagaatacagtacaacctgagagtgatattccaggccgggctgctcataagagtgagacagcgtggattgtcgccagagaaactgccttatgggagttttgcattattattattattttttattatacttctagggtacatgtgcacaacgtgcaggtttgttacatgtgcgtacatgtgccatgttggtatgctgcacacattaactcgtcatttacattaggtatatctcctaatgctatccttctccccgcctcccaccccacaacaggccctggtgtgtgatgtcccccttcctgtgtccaagtgttctcattgttcaattcccacctatgagtgagaacatgtgatgtttggttttttgtccttgcgatagtttgctgagaatgatggtttccagcttcatccatgtccctacaaaggacatgaactcatcttttttatggctgcatagtattccatggtgtatatgtgccacattttcttaatccagtctgtcgttgggcatttgggttggttccaggtctttgctattgtgaatagtgccgcaataaacatacatgtgcatgtgtctttatagtagcatgatttataatcctttgggtatatacccagtaatgggatggctgggtcaaatggtatttctagttctagatccctgaggactcgccacactgtcttcaacgatggttaaaccagtttacagccccactaacagtgtaaaagtgttcctatttctccacatcctctccagcaccttttgtttcctgactttttaatgatcaccattctaactggtatgagatggtatctcattgtggttttgatttgcatttctctgatggccagtgatgatgagcattttttcatgtgtctgttggctgcataaatgtcttcttttgagaagtgtctgttgatatcctttgcccacgttttgatggggttgtttgtttttttcttgtgaatttgtttgagttctttgtagattctagatattagccctttgtcagatgagtagattgcaaaaattttctcccatcctgtacattgcctgttcactctgatggtagtttcttttgctgtgcagaagctctttagtttaattagatcccatttgtcaaatttggcttttgttgccattgcttttggtgttttagacgtgaagtccttgcccatgcctatgtcctgaatggtattgcctaggttttcttctatggtttttatggttttaggtctaacattgaagtctttattccatcttgaattaatttttgtataaggtgtaaggaaggcatccagtttcagctttctacatgtggctagccagttttcccagcaggatttggtaaacagggaatcctttccccatttcttgtttttgtcaggtttgtcaaagatcagatagttgtagatgtgtggtattatttgtgagggctctgttctgttccattggtctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatgtgaactttaaagtagttttttccaaatctgtgaagaaagtcattggtagcttgatggggatggcattgaatctataaattaccttggccagtatggccattttcatgatattgattcttcctatccatgagcatgaaatattcttccacttgtttgtatcctcttttattacattgagcagtggtttgtagttctccttgaagaggtccttcacatcccttgtaagttggattcctaggtattttattctctttgaagcaattgtgaatgggagttcactcatgatttggctctctgtttgtctgttattgatgtataagaatgcttgtgatttttgcacattgattttgtatcctgagactttgctgaagttgcttatcagcataaggagattttgggctgagacaatggggttttctagatatacaaacatgtcatctgcaaacagggactatttgacttcctcttttcctaattgaataccctttatttctttctcctgcctgattgccctggccagaacttccaacactatgttgctaggagtggtgagagagggcatccctgccttgtgccggttttcaaagggaatgcttccagtttttgcccattcagtatgatattggctatgggtttgtcataaataactgtgattattttgagatacgtcccatcgatacctaatttattgagagtttttatcatgaagggctgttgaattttgtcaaaggctttttctgcatctattgagataatcatgtggtttttgtcattggttgtgattatatgctggattatgtttattgatttgcatatgttgaaccagccttgcatcccaaggaagaagcccacttgatcatggtggataagctttttgatgtgctgctggattcggtttgccagtattttattgaggatttttgcatcgatgttcatcaaggatattggtctaaaattctcttttttggttgtgtctctgccaggctttggtatcaggatgatgctggcctcataaaatgaattagggaggattccctctttttctattgattggaatagtttcagaaggaatggtaccagctcctccttgtacctgtggtagaatttggctgtgaatccatctggtcctgggctttttttggttggtaagctattaattattgcctcaatttcagagccttttattggtctattcagagatccaatttcttcctggtttagtcttgggagactgtatgtgacgaggaatttatccatttcttctagattttcaagtttatttgcgtagaggtgtttatagtattctgtgatggtagtttgtatttctgtgggatcggtgatgataacccctttatgattttttattgtgtctatttgattcttctgtcttttcttctttattagtcttgctagcggtctatcaattttgttgatcttttcaaaaaaccagcccctggattcattgatttttttgaagggtttttttgtttctctatctccttgagttctggtctgatcttagttatttcttgctttctgctagcttgaatgtatttgctcttgcttttctagttcttttaattgtgatgttagggtgtcaattttagatctttcctgctttctgttctgggcatttactggtataaatttccctctacacactgctttgaatgtgtcccagagattctggtatgttgtgtctttgttctcattggtttcaaagaacatctttatttctgccttcatttcattatgtacccagtagtcattcaggagcaggttgttcagtttccatgtagttgagcagttttgagtgagtttcttaatcctcagttctagtttgattgccctgtggtctgagagacagtttgttataatttctgttctttcacatttgctgaggagtgctttacttccaactatgtggtcgattttggaataagtgggatgtggtgctgagaagaatgtatattctgttgatttggggtggagagttgtgtagatgtctattaggtctgcttggtgcagagctgagttcaattcctggatatctttgctaactttctgtctcattgatctgtctaatgttgacagtggggtgttaaagtctcccattattattacgtgggagtgtaagtctctttgtaggtctctaaggacttgctttgtgaatctgggtgctcctgtattgggtgcatatatatttaggatagttagctgttcttgttgaattgatccctttaccattatgtaatggccatctttgtctcttttgatctttgttggtttaaagtctgttttatcagagactaggattgcaacccctgcctttttttgttttccatttgcttggtagatcttccttttatttgagcctatgtgtgtctctgcacgtgagatgggtttcctgaatacagcacggtgatgggtcttgactctttatccaatttgccagtctgtgtcttttaattggagcatttagcccatttacatttaaggttaatattgttatgtgtgaatttgatcctgtcattatgatgttagctggttattttgctcgttaattgatgcagtttcttcctagcatcgatgatctttacactttggcctgtttttgcagtggctggtactggttgttcctttccatgtttagtgcttccttcaggagctcttttagggcaggcctggtggtgacaaaatctctcagcatttgcttgtctgtaaaggattttatttctccctcacttatgaagctcagtttggctggatatgaaattctgggttgaaaattcttttaagaatgttgaatattggcccccgctctcttctggcttgtagagtttctgccgagagatcagctgttagtctgatgggcttccctttgtgggtaacctgacctttctctctggctgcccttaacattttttccatcatttcaactttggtgaatctgacaattatgtgtcttggagttgctcttctcgaggagtatctttgtagcattctctgtatttcctgcatttgaatgttggcctgtcttgctaggttggggaagttctcctggataatatcctgcagcgtgttttccaacttggttccattctccctgtcactttcaggtacaccaatcagatgtagatttggtcttttcacatagtcccatatttcttggaggctttgttcatttctttttattgttttttctctaaacttctcttctcgcctcatttcattcatttgatcttccatcactgatacccttccttccacttgatcgaatcggctaaggacttctctgcattggttattctagttagccatttgtctaatcttttttctatgtttttaacttctttgccataggttcaaacttctcctttagcttggagaagtttgatcatctgaagccttcttctctcaggtcgtcaaagtcattctccgtccagctttgttccattgctgatgaggagctgcattcctttggaggaggagaggtgctctgatttttagaatttcagtttttcagccctgttttttccccatctttgtggttttatctacctttggtctctgatgatggtgaggtacagatggggttttggtgtggatgtcctttctgtttgttagttttccttctaacagtcaggaccctcagctgcaggtctgttggagtttgctagaggtccactccgaccctgtttgcctgggtatcagcagcagaggctgcagaacagcagatattggtgagcagcaaatgttgctgtttgattgttcctctggaagttttatctcagaggggtacccggccgtgtgaggtgtcagtctgcccctactggggggtacctcacaggctactcagaggtcagggacccactttaggaggcagtccgtccattctcagatctcaagctgcatgctgggggagccactactctcttccaagctgtcagacagggacatttaagtctgtagaggtttctgctgcctttcgtttgtctatgccctgcccccagagatggagtctacagaggcaggcagacctccttgagctgcggtaggctccacccagttcgagcttcccggaggctttgtttacctattcaagcctcggcaatggcggtcaaccctccccccacttcgctgctgccttgcagtttgattgcagactgctgtgctagcaatgagcgagtctccgtgggcataggaccctccgagccaggcacaggatacaatctcctgttgtgccgtttgctaagaccattggaaaagggcagtattagggtaggagtgacctgattttccagatgccatctgtcacccctttccttgggtaggaaagggaattccctgaccccttgtgcttcccgggtgaagcaatgcctcgccctgcttcagctcacgctcagtgtgctgcacccactgtcctgcacccactgtccgacagtccccagtgagatgaacctggtacctcatttggaaatgcagaaatcattcgtcttctgtgtcactcacgctgggagctgtagactggagctgttcctattcagccatcttggctccaccccctaatttttactcttaagtaaggattattttggactgagggactcactaagtgaaagtgattcatcatttcagactttgttacagggaggtgattatgcagtaaacatagtcaaacatttcaaaaatttgaagcatattttataaaacttacaagaaagaaagatacatactggatgaattgaaggaagaattcataaaaccatatgtgtctgcttcatattgagggaaactttttttttctttttttaacctctcagcactagttgacattgcttggctacgtactccgttagagtagagacagctattgccatagctcctgtgaattgaaacagaaattgtccatagtggaggcagtcacagatgggttaaacatgaaggagtcagaagtggtagaactaattctaaatactgagattccatactgagaggtaccaaagctacccaacaaactcttttcctcttgggaaacacatatacacctgacataaaaataaggtagacatttagtttgtagctgtagatctcaatagcattgtgtaatttttcctgttacttttcaagaccaacacatatcacagtatagggaggtcagagactcctgagggcagctctacaattctgaagcagtacatttcttttatatttttgtaggtaatgatttgttgtaagttatccatagttgtaagtaaccggatcatatgttttccttgatattatggagaatttgacaggttggagaaatacaaggtatgatttcatgattaaacataacaggaaatttaaatgggactttacatatgatctcaatttagctaagaactcaagaccaagctatacagacaccaaattacctccacattctaaagcaaggggctagaccaccttatgtaggacatgctaagagatagagaaatcgcttctgccagcattagcctatctcctgtctctcatctatataaggtgaggcaaagaattcatggggaagggtggaagtatttggaagtgaagatttctttggagatagttgtcagtatgctgtgtttgcccttcccatctccacagtgagggtggtgaaagtacttccccttcatctgaagccaagagaagaaaactgctcagaaagcttgaaatgttttctctggaatctagaaaattcaagttctggtatgtgaaagaaaaaaaaaattaaggcaagaagctgctgtcttactctactttctgctggtataacagaatacctgagataacagcattaattcattcatgagagcagagccctcatcctctaatcaccttttatttttatttttttgagacagcatctcgctctgtcacacagtctggagtgctgtggtgattgtagctcactgcagcctagaactcctgggctcaagtgatcctcctgccttagacttctgagtagctgggactacaggcgtgtgccaccctgccctgcttctaataacctcttaaagattcctcctcttaacactatcacaatggcaattaaatttccccatagttttggagggaacattcaaatagtaacatctagctagaacagcctgtctgttggcagaatgaagtagaacagtttagtgggaacaaggatacaagtgtatttttcatggaccaaatacagactctggaaaggatacggttgtggatcatcgggaaaagaacttcacgaaagagatagatgcacagatggatagtgaaggtcaccctggtgaaagccaaggactgaatgcaggtcttaaatggccagttgtggaaagaatcatccttataaaagaattgagataggagatctctaatagaggaggagttctctaatagaggaggagttctttgtgaaacccacagaaatcccccaactcaaaaaaaaaaaaccggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagatcgtgccactgcagtccgcagtccggcctgggcgacagagcgagactccgtctcaaaaaaaaaaaaaaaaaaaaaaaaaaaaaaaaaaaaaagaaaaaaccaaaaaacgtagtatctaaaaggtagggcaccaatatcaaattgcaactgtactggccatatgcaatgtagagcaccaatatcagatcgcaactgtactggccatatgcaatgtagtctttttctccaggtttcccctctcttctaggctggacaatggaggaggcttgaaacagtagctggcaagtggtagaagagatggagcagagaagcaagaagaagcagactcctcactccttcaccagggtggatttgctggtttgaagcagacctgagttgggagaggagagaggcgagaagttttaattggatgaaatatttctttagactggtctatacttttttctttatatctaaaattcactggaagagctatgaaatctgtccaagatttcgttcagttcaggaaaaaccaaaaccaaaaccataaccagtgagtttataaaggaagtttatggtggattttttaaaattattttgataactgacattggggtattctccatcttatgagtctgaaaatatttcttcgcagccaggtaatacacatgtgactcagatgccaccaaagaagtatgtgtccaagacctcaagttgaaagctgtggactgcggagggactctctggtgaagttgttgcaagcatgattaattcattggggcagcaatggcagccaagccagtggtggtatcctgtgtccaggagtggtattggtgattcagtttgcagcctctgaggtacaaggataaggaaaatggtgaccagatcagttttgctgcctcagattagacataatttcaagctgtatatctctaatcctcctaataattctatgacctacatgatatcctttaaataaatgacttatcatttaaaataattccgaattgatttctgtgacttgcaatgaaatcaataaaaaaaaaaaaatacctggactattactagaaaacagaccaccagggaaatgggtcaatctgggattaattttctgacctggtttaggctgaaggcagtgataattcagatgactctaagggtggagcagctctagacatgcaggagtggaacagttaataataaaaaaaaaacctctgacttcctgaaaggaaataagaattaaaggcaaggccttagagacaatagggttattgccatggaagaatattaaagtgcatgagctatttaaagtctgtaaggtaggtggttacttcattaaagtgttgggcagtttagttaaggagaatggtaagcttaaaatttcaggttcttggctcatggtataaactgaaacctaaggatgttttatgacataatttcttgaagccataaggttaaactagccagaagccaaattaaaaatttgatcctgtaggtttccagctgtaacactgattaaattcataggaacacaaaagatctcttaggtgaaaaccagggcattgactgggaaataataggatctcaaatactataatgggtatatattgaaagattcaaatgtccctcagattatcctgaactcccagtctccactgatctttctttgcctactgaaacattttcttttgcctgtctgatgaggatgtcactgcttgatttgaggacatataaggaccttggctgagcagcgtccctgtaaggggaagccaatttcctcatgtcctattcacttccatctctcattgtcttcaggcctataattatagtcagactaagcagtaagggggcaagttggaaggagaagtgttaaataccaaaataatatgtattatattttgctgatgaatgctgaccaaactctgaccaactcttgcgaaaatgaattctgtgggtgctagggcaagtggggaagggcataattttagatcaggctaaatgggtcatgatgggtgcctttattagaaattctgtattgatcacactagctcaaaaaacattagaagttaaaattgtttgttctatttatagatagaaatccaagctcaaaaatgatccatgttcaatgaagttgagatgccagatatttctttagataatataaaggaaggaatacaaggacacagagagaggaatgtagggaggaatttttcatgtgctacgtgcttacctaacccccatactatgttccttgagagaagcccagaaaataaactttccaacaagggattgagaaataaattgtcaagggggagggctatggttcatttttccctgtaggttggcaggggatgctttggttgagatgggcttcctgatttcaaccaggataccagatactggggtggtagaggctaagtagtgaggcaggagaagccaggtaggcatgatcactatgacaggtagctggagtagtttggaaaatagtattgtctgatctactgcaatttttggaggtggcagtggaggtaccatatgtatcaattagattgttttgcctgaaaataatagaaatttgagtaaaagaggcttaaaaaatgaagatttattattattattattattttgcagttgcaagatttaatagagtgaaaacagagctcccatacaatgggaggggacccaaagggggttgcccctgaaaggaggttgcccactcccggctcgaatgcctggagtttatatcccaatcattgtccctccccctgtgccctcaggcgatatatgatttgactgtgtctttaccttctgctctagcctaatttgtattttagcgagccctctttactacctgattggttgggtgtgagctgagttacaagccctgtgtttaaaggtaggtgcggtcacctttcccagctaggcttaggaattcttaatcggcctaggaaatccagctagtcctgtctctcagtccccccgtcaacaggaaagcccaagtgctgttggcaaggttggccgacaaccactcttaactgcttcctgctgaattggggcatagtaggggttgtgcagttgagatttccttggaaagggtggcttcgatgtcattaacatcagagcatgggctagcaagccggtccaggggtccgtggtaggtcttagtcatggactgcatctgggggtccatttgaagaactgtttgcagttttacagcttcgattctggaagagacaaacttaacaaggaggttaaagatacagggattgaaatgtatggcctgaagtgcaggggattatttctttggcacacttcacaggccctgactatctgctttatagttttgaaaaggcctggttcagtaaataatgatgtggcaatctgatgggtgctatcaatgcctaagtaaaaggtttggtgaagggttttaagtaatttccattggttagctgcaggcagaagtatttttcctttttcggtggctagccatcctgaggggaggaaacgatgtcgatgtccttgtgagtttccccattcgatttcttctgctgagtactggggcttggtttcctggaggggattaccccatactaggggtccttctataagcttttctaatggagggtcctgtcttgcggctctttttgcttcagtatctgcttggcagttcccttctatttccctttcctttcctttctgatgaccccggcagtgtaagactgccacctctttaggtttctgtactgccaataataatctcctaatggcttcctgatgtttgataggtgttcccttggaagttaggaattccctttctctccttattgctgcgtgggcatggaggactaggtaagcatacttagagtctgtatatatatttaccctttttccttctcctaattctagggtataatgacccctgcttttgctaggatgtctctccctaacaaagaagtggagctttcaggcataattagaaaggcatgtgaaaagagtaaagttccccagtcacaacttagtggctgggagaagtatctagtgactggctgtcctaggacccctcagatagtgacagatctggaggacagttgtccaggacaggagagtaagactgagaagttcacgccagtgtccaggagacagttaacgccctggccctcaatggtcaagcatacccgggcctctgtgagggtgatggcatgggctggcacttgccctggaaaccctcagtcctgctgctggatcatctggttagtggcttctgactcagaggaccttcatcccctggggcagtgggccttccagtgattcccttgacataaggggcatggacgagggggtggcttatttctattcggacaatctttttgaaagtgtccttgtagaccgcactggaagcaagccctattaggcattcagtttgcccaggctttccctttttcagagcctccaaagtctacttgcctgagggccacgactaaagcagtgggtggccttttttgttttatcccagttttcccatttcacctgcttttcctgatctctattataaaaaaatcgaggttgccaatagggtttctaagttttgctccaggcctaaggcagacttttgaaattttttctaatgtgtgcaactgactgagtgataacttatcctttaagattagttggccttcagtagagtcaggtgacggagagatatgcttcctcaatgcctcccttagtctctccagaaaagcagtaagattttcttcctttccctgtgttatagtggacatcattgaatgatttataggctccttcctagttttccttagtccttctagcatgcaagttagcaaatgtctgtggcaccaatttccatgttctaattcagcgtcccagtgagagtctacactgggaactgcctcctggcctgtggggaatcattccctttcctctgttgtcatcctatcattgacctgactgagataccagagattgccaaactcttgggctgcagttatggtggcacttctctcatttggggttagtgtctgatctagcagtaacattatatctctccatgacagatcaaaggattgtcctaacccttgtaaaacatcaatgtagccatcagggttatctgagaatttacctaggtctattttaatttgtttcaagtctgagagggaaagagttacgtgcactctgactgggccaaattctccagaatatatcttaggagcttttttgccttggggggaacatttcccatctgaaaaaagaacatagggatgccagcacccctagtcattttctgatgagccttagtcctacagcgtcctctatggtcctaatgcttattcctttccagggtgcataaccacccatggacatctgcttatcggattagttaacattcactgatgtagcagtcctgcaccccttttcccgcctttcttgaccacaaagaaaggggtccaggctgctggattctagtggtcctttaccagtgtgcccaacattgcctttgtgctcaggggtgagtcctagagctaggctgggttcctgagtatttcataacaacccagttgccccatcaagatgcattcccataaacaacagttcttatgcaaattcatttcagagagggtgtaggtaacctttgagtcaggattgagatggagttttttgattctgtaagtactttaaggcttggctgagtgcaaagggctcatacgtttgagcagaccaattattaggcaatttttctaactctgcttctacaagagtttccctatcaattactgaatacccattgtggttttttttctccatcacctgggaggaaccatctattgtcctgttctgaagggagttcctcctaggtctggtgggaccttcgtatggtaattaagatttaaatccctttttaggaaatctgctgggttaagggaaatttcagtggttaatgttaaatcatctttttctaacagaatagtcctacactttaagatttttgagttagtaagctaccttttggctttgtttttttttttttttttttgacttaggatagttctgaactggtgaggtgtgttcacaatgaggttttctctaaaagttatttttctactttcttctgttagcaaaacagttgccactacagattgaatgcatttgggccatccgcaggttactgggttaaagatttttgataggaaggctacgagttgttagtggtctcagtgttttcaggctacgcccttgtttacactgacaacaaggtagtatcgagtgttatagggtcacagagaagaccttcaattatcaattataggttttaaatttactctggcttttaaaggaatagggcacactgttttttctttactacttctgtctttctctttctttctctctctgcctctcttacccaccacccccacctctctgtctctctctgtctctctcctctctgtctctgtaggtggattttggaaacacagtggagggtcgttcacttgttgcccccatttgccgctataggaatatgtgcctccctttaatttactcaattcattttcatcttgatatattatgttgtagacccagttccagttgttaaagtactgggttatcagttctaaggccctggcaagggtggtggggaacgggtcccacataactgcccatgtcgagagctgcatgcctaaattgggaggaacaccagggataaaactccctggattcatagcctaggtgcccaaggacacagcgtagagcttccttagatccctttagagatacaacttgctctaatacttgggagaggaagtgaaagtctgaagcattagtatctaggaggcagggatcagaggaagtagattcagaagtaagaagaattttggggctacactttcaagaaagttgtggttgggacccaggaggtatgggtcagaaggagaggtaggggcacacgcatgggcgactgttgagtagagacttctggctgcaccataatctcgaccatccaatgctgggggtttgggacaacagctttctgcctctagtcaaccctcagcttccccaggaaaattgtgaaagcaaaagctggttctaggtagaccaatgctcccaacccagaagggttggggcttgttagaaagccttttcccaggaagcctcacacctgagtcttaagtccagtggccatgctaattgtttttaactggctgacaggtgcctggtattttcctccaattctaaggaaggataggacagaatggcgagcaaattattactcaccgctttgaagaatccccgtacgggccaccgaatattacgggtggatctttgttcatagaactcccaagatggtggtgggccactcccaagatggtggtgagccactcccaagatggcagcaaaccttttgttctctgacctggggttcttggcctcatggattccaaggaatggaaccttgggccatgcggtgagtgttataactctattagaagccgtgggtcacggaagagaaccgtggaacccagcgactagtgttcagctctattaggacgaacctgggcacttagctgcgcaggaacaatggcgagactttagcctgattgggagtggcaatggatgcctcactggatcaggggcacagcggacaccctgctggatctggagtggtggaagtcaacagcgggtctgtgatggcagcaaacagtggtggacggcaagtgaaagctcagctcgagccataacaaatacgaaccagaagagtgtgcagttgcaagatttaatagagtgaaaacagagctcccatacaatgggaggggacccaaagggggttgtccccccaaaaatgaagatttattatctcacacaaccaaaagtctagaggatgttgataaattctccttttcagtgatgccagggccctagattgcttctctgccattttcttgtctttcccatcatggttgcaagacagctgctgcaactctggcctgtcatgtttttacatgacagcatccaagggcaggaagggaagagtcttcttttcacccttccctactccttcccctgcttttttttaataaagagggaaatggctcccaaaagtcctccagcagacttccttttatgtctcattcaccagaactgagtcacatgttcattccaaatcagtcactaccaatgggaatagaattagactaatcatggatcatctcctggagcactgggagagtcccatcttccctgagctcattattgcctgtttcttgaacagaattggggttctctttctaagggagaaatgaggaatggctgatgaataggcaatcagtgtagggagcctccttttgggggagttctcacctatttataatgtaacttaaaagacttccagctttgagcagagcttagagcagaagaagtctctttagctggcctaaattgtcacaagaacaactctgatgccttccttttatggaataaatggttttcttttcttttcttttttcttttttttttttttttgcaacgaagttttgctcttgttgcccaagctggagtgcaatggcactacctcagctcagctcaccacaacctctgcctcccgggttcaagcgattctcctgcctcagcctcccgagtagctgagattataggcatgcgccaccatgcctggctaattttgtatttttagtagagacgaggtttctccatgttggttaggctggtcttgaactcctgacctcaggtgatctgcctgcctcggtctcccaaattgctggggttacaggtgtgagccaccgtgcccggcgggaatgaatggtttttaagtgtctgtggcaggtgttgaatgtaacctgtgggaaggtccaataatagaagcatgatggagaacctcgagttttagagcaaagtaatgcttgtttcagtcctgttgtgattaaatgcctggctatgagacacactaggtgattgtgctacctgagtttctcactgtgaactgggtattacctgatccacagaattataaggctggacatgcccaggagaatactattatcaagtggaagtgatatatctgtgctatctgagtgggctctctctctctctctctctctgtgtatatttgtatatatacgtatatatatatacacatatatatgtatatatatacctatgtatatatacgtatatatacataggtatatatgtgtatatatacacatgtatatatgtatatatacgtatatatatacataggtatatatgtatatatatgtatatatatacactacacacacacacacacacacacacacacacacacacacacacacacatatatatataaactggatcccagcaggtcccaaaggtgctgggagaggaagtgaaggaagagttaactcacactcttccttcacttcctctccttgggggaatttcctataagcagttcaaagagcaggaagagaattatagcttggtttagaaatgctctgcacaatatcctggtagttgatagtggcagacttggaaaaatcttgctggggtatagaacttcaagcattatatttctgtgagccctcttggacaggaatgaaatcacctgaagtaaagatctacattgacttatgggtagtaatttatgatttggtcagatgatcagggactttgaaggaatatgattgtaagattggtaacaaggaaatctggagtagcggtgtgatggaccttttgtaatggtcactgagtgaggaaaattatgttccatgtgcttctcaccaaaaggtctgattttgaaggacattgtcaataattaggtgaacaagatgaccaccttggggatgttgttgagcagggcatccaactgcttgctcagtgggcttgtaaacgtagtggccgtggatataagcatggacccaacatcatagatactttcttgtcaaggctgttctagctcagccactgctgaataccagattgagaagtagcaccaccaaccctgggtccccagtatggtataataactcaaggggagtagacagtttctatgggacaggttggtcacatttgatctctttcatcatggaggaggcagaaatttgttctcactgggaccaacacttactctggatatagaattgttttctggctctgtcatgcttctacttctactatcatccatgaatttattaatataaattaaacatagactcagactctgagatttaaaaaattaaggcataagctttaaattactccattatgcatgtagggggaaaggaaaatgctaatgactttcttttaactaagcagaaaaactaaaatactgcttagaaatacagagatgtattcctacaacattcttcccaggtcaaaaccttgtcagtaagacaatcagaattacagattctttttggaggttattttcataggacaaagcaacactttctaacactttagagtcttataagacattttggttcaaataacatttacagagaatggatttctttttagtaaggaacagaaggtgttctagtaacagttatgaatattcacacagctccatattgctgagaacaaatggatattttttggaacattcttaatttattacctaatcaaatcagattttttgaaatagttaatgatgcagaattgtatttctcttttcatagatgcaaggagaagggacatcctttttctcagacttctttggttaattataaagatttatttttaaggccagcttctgaaattttattagctatattataagcaggtctatagaagataattttattgtcagaaatggagaaagtgataaaaagttatttaataccaaaacataggatgatattgtttttcttctatattattaagtaccttgtttacctataatttctttcaaaaagaacttgaaacttcagagaagataaatggtctatccttgggttttttattttattttattttattttgagatggagtctcactctgtcacccaggctggagtgcagtggcgggatctcagttcactgcaagctccgcctcccaagttcactccattctcctgcctcagcctcctgagcagctgggactacaggcgcccgccaccacacccggctaattttttgtatttttagtagagacaggttttcaccgtgttagccaggatggtctcgatctcctgactttgtgatctgcccacctccgcctcccaaagtgctgggattacaggtgtgagccaccgtgcctggcctatccttgggtttaaagttatagaataatagtgcctaagaggtatgaaagaaaaaaattaaaaaataaagttatataataagagcagtctggtttaatagcatttcagagtggatatatttaggaattttataaagctcaatatttgtcaacaataggagatggctggcaagagaatacatagagactgcatttactggcatatttttccaaataaggatgttattcagactgtatgtagaatattgagtttaagttatacttagagacatttaattaggaataaagaggacttggtggtagtgggaagagtaggggagaggcatgccaattgtcttcaactctccgagggactaggcttactctgtgatactccagagagcagaactaggaaggcagagcttagatttagccataaggaagaaattggcctgtgtatgtgttaagcccaaggttagctgacctgccagacatattttaaaaagtgatttctttattgcatttggagttggaaaccatccatgtttcttcacccaactttttactttgaaaaatttcaagatttcaaaatctgaaaaatagtacaataaacatctctatgtccttcacctaggtgtaccaatattttttgccacacttactttctctctctctctctctctctcacacacacacacacacacacatatttttttgcatcaatgttcatcaaggatattggtctaaaattctctttttttttgtttgtgtctctgccaggctttggtatcaggatgatgctggcctcataaaatgagttagggaggattccctctttttctattgattggaatagtttcagaaggaatggtaccagttccttcttgtacctctcgtagaattcggctgtgaatccatctggtcctggactctttttggttggtaagctattgattattgccacaatttcagatcctgttattggtctattcagagagtcaacttcttcctggtttagtcttgggagggtgtatgtgtcgaggaatttatccatttcttctagattttctagtttatttgcgtagaggtgtttgtagtattctctgatggtcgtttgtatttctgtgggattggtggtgatatcccctttatcattttttagtgcgtctatttgattcttctctcttttcttctttattagtcttgctagtggtctatcaattttgttgatcttttcaaaaaaccagctcctggattcattaattttttgaagggttttttgtgtctctatttccttcagttctgctctgatttttgttatttcttgccttctgctagcttttgaatgtgtttgctcttgcttttctagttcttttaaatgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgccttcattttgttatgtacccagtagtcattcaggagcaggttgttcagtttccatgtagttgagcagttttgagtgagtttcttaatcctcagttctagtttgattgccctgtggtctgagagacagtttgttataatttgtgttcttttacatttgctgaggagagctttacttccaactatgtggtcaattttggaataggtgtggtgtggtgctgagaagaatgtatattctgttgatttggggtggagagttctgtagatgtctattaggtctgcttggtgcagagctgagttcaattcctgagtatccttgttaactttctgtctcgttgatctgtctaatgttgacagtggggtgttaaagtatcccattattattgtgtgggagtgtaagtctctctgtaggtctctaaggacttgctttatgaatctgggtgctcctgtattgggtgcatatagatttaggatagttagctgttcttgttgaattgatccctttaccattatgtaatggccttctttgtctcttttgatctttgttgatttaaagtctgttttatcagagactaggattgcaacccctgcctttttttgttttccatttgcttggtagatcttcctccatccttttattttgagcctatgtgtgtctctgcacgtgagatgggtttcctgaatacagcacggtgatgggtcttgactctttatccaatttgccagtctgtgtcttttaattggagcatttagtccatttacatttaaagttaatattgttatgtgtgaatttgatcctgtcattatgatgttagctggtttttttgctcgttagttgatgcaatttcttcctagcatcgatggtctttacaatttggcatgattttgcagtggctggtactggctgttcctttccatgtttagtgcttccttcaggagctcttttagggcaggcctggtggtgacaaaatctctcagcatttgcttgtccgtaaagtattttatttctccttcacttatgaaacttagtttggctggatatgaaattctgggttgaaaattcttttctttaagaatgttgaatattggcccccactctcttctggcttgtagaatttctgccgagagatccgctgttagtctgatgggcttccctttgtgggtaacctgacctttctctctggctgcccttaatattttttccttcattttaactttggtgaatctgacaattatgtgtcttggagttgctcttctcgaggagtatctttgtggcattctctgtatttcctgaatctgaatgttggcctgccttgctagattggggaaattctcctggataatatcctgcagagtgttttccaacttggttccattctccccatcactttcaggtacaccaatgagacgtagatttggtcttttcacatagtcccatatttcttggaggctttgttcatttctttttattcttttttctctaaacttcccttctcacttcatttcattcatttgatcttccatcactgataccctttcttccagttgatcgcatcggctcctgaggcttctgcattcttcatgtagtactcgagccttggctttcagctccgttagctcctttaagcacttctctgtattggttattctagttatacattcatctaaatttttttcaatgttttcaacttctttgcctttggtttgaatttcctcctgtagctcagagtggtttgatcgtctgaagccttcttctctcaattcaccgaagtcattctccatctagctttgttctgttgctggtaaggagctgtgttcctttggaggaggagaggtgctctgctttttagagtttccagtttttctgctctgttttttccccatgtttgtggttttatctacttttggtctttgatgatggtgatgtacagatgagtttttggtgtggatgtcctttctgtttgttagttttccttctaacagacaggaccctcagctgcaggtctgttggaatttgctagaggtccactccagaccctgtttgcctgggtgccagcagcgatggctgcagaacagcggattttcatgaaccgtgaatgctgctgtctgatcgttcctctggaagttttgtctcagaggagtacccggccatgtgaggttttagtctgcccctactggggggtgcctcccagttaggctgctcgggggtcagaggtcagggacccacttgaggaggcagtctgccctttctcagatctccagctgcatgctgggagaaccactgctctcttcaaagctgtcagacagggacattttaagtgtgcagagcttactgctgtctttttgtttgtctgttccctgcccccagaggtggagcctacagaggcaggcaggcctccctgagctgtggtgggctccacccagttcgagcttcccggctgctttgtttacgtaagcaatcctgggcaatggcgggcgcccctcccccagcctcactgcggccttgcagtttgatcttagactgctgtgctagcaatcagcgagactccgtgggcataggaccctccaagccaggtgcgggatataatctcctggtgcgacattttttaagcccgtcggaaaagcgcgttgttggggtgggagtgacccgattttctaggtgccgtctgtcacccctttctttgactaggaaagggaactccctgaccccttgtgcttccggagtgaggcaatgcctcgccctgcttcggctcgcgtgcggtgcgctgcacccactgtcctgcgcccactgtctggcactccctagtgagatgaacccggtacctcatatggaaatgcagaaatcactcatcttctgcgtcgctcatgctgggagctgtagactggagctgttcctattcggccatcttgactccccgatcacacattttttttgatgaaccatttgaaaggaagttgcaaaactcatgaaattcaccgctatcttcttcagcaagtatcccctaagaacaaagacattttcctactgttcccattcatccttaagataatgttcagcttgcaggtgctatgattctcataaaccagtaagaaaaatactgcctgttttccctgtaatacaggattcattcagtgaagttcttgcttgcttcacaaggtgcattgctggaggcctgctctctgcaagcctctcaaagaatatgaaaatagtcctgccctcaagaagctcttcagatgaaataatatgtatgaaaatacttaaatgtcaactacgatataagtgaaagatgctattttatctctttgcaaattctttttctcaaagaaaataagatttagcagatggaaaaacgtaaaaaaaaaaaaccgaaacaaaacaaaacaaaacaaaacaaaacaccagagggcactatagtagcatttgtagtagcatttgaaaagcaatgtttgaaggcattgtaaatatatcttaaaactgcataattttttcttctcggagtaatatactgtgattgtattgccttcgaaattcaactactgtgcaccgtattaactggtgttcttaagtgtttgtaataatttcagaccaaaaaataagttttttttttacatagacccatgtatcttattatactgaacaatataatttttttcctgaaagtttaataatctttaacatactgaaggtccatggcttatatgccttggacagattttcaatgtttggtccagagcattgtgggagggggagcggtaattctaatgaagtgtttagaacacgggaaggtagatcttccatcaaacctttaaattaccacttttgattttttcctttggaggggtcaagttccattccagttttatttcactggcttgactcctttgaaatattttaatttttgttgcccctactctttcaaaaagcaatattctttaagtgaagaatgaatgagaatactcaggaaaagtggacaactgtcagtagtttacaaacttttaaaaatgcctttgaagcatagttcttaactggaggttttctacatattgccaatggcatcattgatgtatgatttttgttttctctggagtatcatatagagattcagcattcattcctcattttgaaagagatatatttgagcaacttaggcatttgatgtgcattttgaaaaattatactattggccaggtgcagtggctcatgcctgtactcccagcattttgggaggccaaggcgggcagatcacctgaggccaggagttcgagaccagccttggcaacatggcagaaacccatctttactaaaaataccaaaattagctgggggtggtggcacacggcctgtaattccagctacttgggagcctgaggcaggagaatcacttgagcctgggaagtggagattgcagtgagcagagatcgtgccactgccctccaacttgggtgacagagactctgtcttaaacagtaacaacgacaacaaacaaaacaaaacaaaaattatactatacattactaggaatttcaactgggtgcatggaggagaaaaaaagcctctgttgctgaaggaatgatggaggtgaagccttaaactccatgcatctcactctggggtttctcagttttatttttgcttctgagacagggtcttgctctgtcgcccaggctggagtgcagtggtgcaatcacagctcactgcagcctcgatctcctgggctcaagtgatcctctttccacctcagcctcccaagtggctaagactacaagcacacactgacatgcccagctatttttcatttttacttttatttttagtagagacaaagtcttgctatgttccccaggctggtctcaaacatcagagcttatgccattgtcctgcctcagcctcccaaagtgctgggattacagatgtaagccactttgctcagtctcattgattttatatacaattctaacagctctgccaaggataatcagaatttttttttgaatcgcagaactaggtatgaaaattagaagactgatagagacagggacatttactgcagcagtgattgctcagagggtggggggcagtagagagagactgagactactgaatcacaatttagcataaaaattaatgatcataataatatggacaagagacagggaaatactggatagaagagggtggttccccagcaaaggccccaccctcaagtctggagaccctcagccctaagtgggaatgggcatttctgtttttgtgccctgaaagttgccttttgacctgctatgccccccatctggtacccatatgaactctgaacctcaggctctagaagcagatgaacagatgaggagatgaggaaacaagcagatgaatggcagaatgatgtggcagagaaagagagaagaggaggaacatctaaacaccaagaggagttaggctgggggcggtgggagaggagtttggcctctggatggccaaactctaggggaagaaaatcttcctactccatccccacttccagctccccatccatcctgctgagagccaccttcaccactcaataaaaccctgcattcatccttcaagtctgtgtgcaacctaattcttcctggatgctgggcaagagcttgggatacagaaagttgtcacactggccctctgcccttgcaaaaaagcagagggtccattgagctggttaacagttatgttgtctgtggacagcaaggctaaaagaaccttgtaacactggggctgcaggcacccacccctggacactactgtggggccggagcccgaagcactcgccctgactcctgcacctgccagtctgcatgctcgcattcttgtcaggggtttgagcaatggtgactgaacaggcgagtcacacccctgttgcacatcctgtgagggggatcagggaactctcccatttcaataatgactattctgagttgttaagattagatttgggattatctaattaggaaaaaaaggaaatatagaaaatgttttggaaaaattccattcaaaagggtgaatatgaactattcacacacgaggatagaattttgttatcaagcaacgtatatttatcgaccatctctgatagagggatggattcaaagatcgttctgccttcagggattttacaaacatgtacttgaaaaactagcaatggaaacggcgtgtgataggattttgattaaaaacaccgagcatcaaaggagatcagggagtgagaacagctttgtggctgcaaagatctgaaaaagaggtgggtctgaaatggaatctagaaaggattcactgaagcaaaggaaaggaggaaagggatgaggagagagaaaagaactgatatagggaattgcatgagaaaggccaacaacctgtggggtgcattttagtcccacaatgccaacaaagaaagcatttacagataaagtgtctggcttccatttctaatgagagagaatcttaaataagcaagaatataagtttctactttgagatattaattactatcctttcagccaaaactttcaaagatgtttatcttctctcagaattcaatacgtggtaaatcattttaaagaaaactgataggtttcagaaattgctccaagatgaaagctagtctttattactctgatctaaattattatgtatcttacctgttttttttccttcaacttttattttaagttctggtccaaggtgaaagctagtctttattactctgatctaaattattatctgatccttttttttttccttcaacttttaagttctggggtacgtgtgcaggatgtgcaggtttgttacataggtaaacgtgtgccatgatggtttgctgcacagatcaacacatcacttaggtattaagaccagcatccattagctattcttcctgatgctctccctcctgccccccagacaggccccagtgtgtgttgttccccatgatgtgtccatgtattctcatagttcagctcccacttataagtgagtacatgtgatgattgtttttctgttcctgcgttatttgctgaggttaatggcttccagctccatccatgtccctgcaaaggacatgatctcattcctttttatgactgcatagtatcccacggtgtatatgtaccacattttctttatccagtctatcactgatgggcatttaggttctatgttgtccttttaaactgttcattgtaacatctcgagtataataacttgaaaccttccattttgctatttttgtatacatctttttatctgttaaatcttataactataaaagtttacttactacattattttataagtacatcaatttttgtaacttttaattgactattgaaaatagcattaattagtgccagttacagatcaatagtattaattagtgccaattgcagatcattaagctcaacattatgtgttgtaaaaattatgaaagatcactgatcattagagaaatgcaaacccaaaccacaatgagataccatcttatgccagtcagaatggtgattattaaaaagtcaaggaacaacagatgctggtgaggttgcagagaaaaaggaatgcttttacactgttgatgggaatgtaaattattagttcaaccattgtggaagacagggtggtgattcctcaaagatctagaggcaaaaataccatttgacccagcaatcccattaccaagtatatctccaaaggaatataaattattctattataaagatacatgaacatgtatgttcattgcagcaccattcacaatagcaaagacatggaatcaaaccaaatgcccatcaatgatagataggataaagaaaatgtggcacatatatgctatggtatactatgcagccatgaaaaggaatgagatcatgtcctttgcagggacatggatggagctgtaagcccttatcctcagcaaactaatgcaggaacagaaaaacaaatactgtgtgttcccatttataatgggagctgaacaatgagaatccatggacacatggtgggaaacaacacactagggcctgttgaggggggtagggggagggagagcatcaggaagaatagctaatggatgctgggcttcatacctaaatgatgggttgatctctgcaggaaaccaccatggcacacatttacctatgtaacaaacctgcacatcctgcacacgtaccccagaacttaaaagttgaagaaaaaaaattatcaaagatgaaagggcagttattttacagagatagaaacttgagagagtagatatgcttttattctttttaaaatattcacttaaatagattctgatatctccttccatgtgattgcagttaatgatagagtggggctaagagaaaagaaattagcagatgttaaaaagaaaattatttagcaacttatttttaaaaagtagcttgtggcttattggaacacaaagtatataataatgttttatgtatatatgtgtgtatatattaatatatatatacacacataatcacaattactatatatttcatatatatagtgtatatatatatataatgtatatatgtacacatgtatgtgaaatatagtgatttttttccagtaaaaatctttttattgtgggaaatcttttctttatttttatttaaaacattttatattttaagttttgtgggtattaggtgtatatatttatggggtacatgagatgttttgatataggcatgcaatgtgtaataatcacatcatgtaatatggggtgtccatctcctcaagcatttatttgtgttacaaacaatccattatactcttttagtcatattaaaatatacaattaaattgctgttgactatagtctccctgttgtgctatcaaataccaggtcttattcattctttttaaaaatttccaacttttattaagttccagggtacatgtgcaggatgtgcaggtttgttacataggtaaacatgtaccatggtgctttgctgcacagatcatctcatcacccaggtatgaagcccagcatccattagctattcttcctgatgctctctctctgccgactccctgccctcaacaggccccagtgtgtgttgttccccatcatgtgtccatgtgttctcatcatttagctcccagaaaattttcaacatagacaaaagtggagagaaaagtataatgaaactccatgtattcattacccaatctaaaaaaattataaacatatggccaatctagttttatttattatctcttcattccccactttcaacttcccagaactaattttaaacaatttctaaagatgatatgattctattcataaacactagttattattattatttaacatagggaatattcatatatataacaggtacaaagtctataatatttaaagctcttttatgttcccatattaaatgtaaatatttgtttaaactcatggctttccttggttcatcaaatcaggtaataaattaaccaggcaggttcacattcaatcagatagtattctgaattgctcctggcatcttcaaaagatgaggattgttcggacgctgttaataacaataaaacattaataagtataattttcatgataaatttaaccaaagctcacaaataagttttgccttttcatttcaggatctggtcttcctttatagacattcactttattaagcctaatttcttttatcccgtcatcctcttccattcatggtgttaataatattttatgcatgtgctagtaaacttggggggaattgaggacccttactcaccttaggcagcgtccttgttactcagtggtgctgttgaggagaattagaatgtaccaaggagggagtcaggttttagtcttggaatagtcactgttctcggatctcctatagctgagggcaaagttgagcattgaaggagggagtgggcatcaaagttggtgtgttgggatgctactttttaagaacccagatgttcttatttctgggtaactccaacatgtagacacaaagagggggataagcctcaaggacagagcagtctttatctcaaacattactgctggaactgtggaacccctgctatgagcagggtgctatgcataaatgttttcttcacccaggactggaagacacccctacctgtagaaggagaatctctgtgtcctttcctcactctggggcaggatcactacacctcaacaggctagtcagtcattgtatcccatccccatccccccacttccttgcttctttgcagttgggtggtaggagggcctgccctctcttgtgcttcctgtgcccatatggtggacacacctgatgaggcccaacttctgccttcctcattgccacctttccatctgtgtgggcagtcaggtggtattctcagtgggccagagaaggagcaggaggcctcactctggtgtctacccctaggctgattaccagggaagcctcctgggagaatgtgggagacttgcccataaagcaatgcagcattttccacctggctgccacttagcattccttatggatgtattccataattgagaattctaggagaaaaggtttgtgttcgaggatatgaatagaagggtgtgaggctcaaaccccacttcaacttctatctcctaacttgaggagtattccttatggggatattgaagttgtataatacattgcagggcttatatactaagtttacatggtgtagcttaaaaaataatgcttgtattttctttttattgaacttccttctgatatgttgtgactgacacgtttgcaaattggggagttcatgtcagtggggatatttcctcaggtttcttccccaagaagtagtctgggtcctcacaccatgaaactatcttcttcttctgcaacatttattccctgcttcaaatcccagttattttaattttactttagacttttcctcctctcttttgttgtatcttctcttttcatttcttcttggtcctgcgtctcctctatgtaacattgttcctaatgtttttgacctttgtttctattgatcaaggctgtgcttgaacattttacctagaatcattgatcctagtcttactaatcccccaacccctaagaatcttccaggtggaacatttctatgcatcagttcctgggatccctgacatgggagcactgtataactaaaatagtggatcagaaggtatcttagaggaactccatgacaaagcaagagaatgagacagttggggcatcctttacatgtctgatccctgccacagaggcatggttttcaccccattctgattgtgaagggtctggggtaggcactctgtgtcaaactgcagaacaccacggtgctaaactcaggggtacactctactagagggatctaacatactacacagaaacctctctttctagggagcaggcccaactgagttaatggtttgtgaaatggaaattgtatcaatttatgccaccattctatattgtaacagtgtacagatgtgcattattgaaatggaaggttttcccctctgaaatgaccactatttaatcttttaagcacatctagtacctgggatgtggaaaatgtcagaaaaaacaagctggttgcttcttaacatcaaaaagaagatagaatcattgtaaacgttttttaaatcattcagtcatctattagtaatgtacctttttccttggttcattaggtcaaatgcctcactgattttgtcaaaaggcagggtatgggtcaccagtgcatccagattgaatttcttattcttatagtcagtgaccagctttgggatagaatctacacttttccaacctgtaatgtggacaaaatgcaaaataaagacatggcacttgacacgaagtagtttaatcagcatttgctgaatgaatgaaattattaggtcagatttggtttgcttcaaatagattaaactccttccatctttaattttctgtacttatatctattttaaaatttttctttataagaaaaatttaagattattttccactctatataagaaattatctcaataaggtcaatgtttattttttgttcctccatgttggttcattcaaatgcaaattaaatttcaatttgcaaattataattacctttttatataaattatttataagtcattaatagtttttatgtagtatttggatatgctctagggattcaatggttgaataaattatttttatttcttttcaataaccttcactctaagaatttcagaactactaggaaaagaatttaaagctatgaagaaaaaaaaaactgaccaccaaagaatgttccatttatagtacggccgattattagctcctctggaaaaatagtcaatcctttgctaccagcagctactccaatgaaagtacatgatccccagcctgcggttgtacagtccagggctgctttctgtgatggagcataaaagaatacttgagtcagtggaaaagtagaatatgaactccagtgtggcaatgtacaatgctttagaaaaaaattaatccaactctgcatgtaagataatgggattcaagctaatgacatcatagtatcattgtagattgagccttgagggcccagtgttccattacaaatagaatgttcagcacagtccgggtgcaggtgactcattcctgtaatcctagaactttgggtggccaaggtgggtggatcacttgaggccaggagttcgagaccagcctggccaacatggcaaaaccccgtctctactaaaaatacaaaaattagctgggtgtggttgtgcctgcctgtagtcccagctactcgggaagctgagactggagaactgcctgaacccgggaggaggaggaggttgcagtgagccgagaccacaccactgcactgcagcctgggtcacagagtgagactctgtctcaaaaaaaaaaaaaattattagtaaaataaaaataaagatgtctaaaaaatcagcatacatttgtgtgtaagtaaataagttttatatttgcctctgctaaatgtttaaagtgtcagggtttgggacaaaggttgtgagactgtaaacccagccaaatctatcgttgtgtgacttttttttttttgacaaataagactaatttaaaattgttaggtcaataacagcaactgaatcacctaatttatcagcaaaatacctatgtgtttaaccttatggttcttacttaggttttcacctaatgtttagactttagttaacaagggccaggcatggtggctcacgcctgtaatcccagcactttgggaggccaaggcaggtggatcacttgagatcaggagttcaagaccagcctggccaacatggagaaaccccgtctctactaaaaatacaaaaaagtagccagacatggcagcatgtgcctgtagtcccagctactcaggagtctgaggaaggaaaattgcttgagcccaggaggtggaggttgcggtgagccaaaatcgtgccactgcactccaccgggcgacagagtgagactccatctcaaaaaaaaagttaacaaggaaataactttaaataatggctagttctgcataatatctcagttatcaaaagttatctagataactattaaaaatgaaaaagtatatgtaaatgaaataaatgcttataagtggactttttgtgtaatataaaatctgaaaattattttaaattaaataataaatgctggatatgtgagtcatttccaattaaaaaattatgatataggaaaacatgtttctaaaattgtgaaatgatttcatctataaaatgcttacatctaacagttcaggatttcttgctttctaagttttcatgaaaatttaaggttactaggaataagaattctaattcatatataaatatataattgtattatcttttttttgaggcagtctcactctgttgcccaggctacagtggagtggcgtgatcatagctcactgcagcctcaacttcctgggcttaagttattttctcaccttaccctcccaagtagctggtactataggcgtgtgccactacacctgactaattttcatatttttagtagaggtgggtttttgccatgttgcccaggctgctctcgaactcctgggctcaagcagtctgcccacctcagccttccaaagtgctggaattacaggcatgacccactgtgcctggcctgtattcttattaaagaataattttacataatttggaaattattttaaagttatttacttaaaaagataaaaaaaagtaagtaggggagagaaatgtaaagttataaatataaaaatgtatttttaataaaagggttattaaaaaagaataatttcatataaaaaagaatcttatggtaaaatcttgtcctaaaataaaatgacttattatttaaaaggaaaaaattaggataagtcagaagtccaagcatgtcatagatcatctgtgtaagtcataataagtttcatgaagaggaatttataaaaaaattttgtatgtgattaaatttgctgtgattaaaaaaggattatttagaatagtctttctaagattattcccctatgttaaaacaaagtctctttacagtattgatttgctcttaatacaattaaaagaaacttaacttttagttttataacctgtttcttttgaaaacttctcaaaatcatatgtcagttcaccttttgctatgtctccctgctttcagctttgtctccccttggacagagataactcttttctttagctttttcatcagctattataagtttttttcctccagttctaactattcttatggcctgatactaaaatgttttatcttaaaggtctaggagtgaatgttttcctccagtacaacttgattctgtactcttggcttttcttgatatgtttaaatttttcaatgtaaccagaaaatttctcatgcagttactaagaattatgtattcccctgctgtactcataatcctgaacacacttttcccatgtctgattaaattcaagcacttttcccatcaggtttattgaaatgggcttcccataaggagaagcagtcacactaccagtttttctttccatttctggtaactgacttaagaaacaacattttacattttatcaaaataattcccatgttgtctacattaggtttttaattgcttaaaaaaatagtgttaaggtttttacatccatacatcctcatgtattgcctttaaagtcttttgatgatttatttggctaaataagtaactattgttttacaatgacctgtggttctgttttaatcaaatgttttgaggcctttaacatttttgacaaacactttcaaaattaaattctaaattaagtctctgacttattgctgggggttatcaaagctctaaaaaattaatcactgcaaggttataaaatctttctacagcttccagtcaggtcatagactccagtatcactacattcagctccttaaaagggtccttagcaggtgttagtaaacaatccttgtgctggtaagctacagggtgttgacccttggtttagagggttagaggtcattggaacctagaaactttctatagaagcttttcctagctatagaaacttttggtgggagagtaggtaactcatcttttggtgattaaataaatctttctctttccatttggattctctaatataattctgttccataattgaaaatgactttcatggtataataagtcagcttaataatagaagatgctaacttttaggtcagtggttctcaacttgagaaattaatttttaaaatgttgtcagtgggctcccagcacacaagaatatcctgggtttggcccattcattggtattaaaaaagcaacaaaacaacgaaaaacccctcaggaaattctaacatatagctagtgttgagaatatgttaatattaaatataacaacacatgcacatattgtttattaattttaaatattatatactgttaaagaaaagattctacattaacaaatgttaatattaataatgtatataatgcataagatagctaaacaaaataggtgtttattcctatttatgcattgcagttaattcatccctttatatctttggctaaagaatgctgtctagttaatgcacttgtcattttatttgatttaatagtcaaaaggaacatttctctaattaaaaatgaaaaaacccctaaaattgtctccaaggaataggaattggaattatcatagaaaacaaaattagaaaatattatctccagacaaataatattgagctttttaaagggatctcaaaagaaaaatcagcatctacaaataatgctggtatggcttcttatcacaagagaagactgaactcaccaagatagtactggcatttggggggacacattcatgggcattgaaggaaatggagtatagctgagggaatgggaaatgatttgtggcttatagttctaccaccctgtcatccatttgaaagtactaagtaccataataaacataatccactttcccctattatttgacagccaaagaatacattgaaaatatgatccaagaacaaaatatacataccatggtttcagatccacctgcacagtcaagggcaaaatccacacctcccttggtcaattcaatgataacttcctggatcggtttatgtaagtctctaggattgaggcagtcagtggctcccagggctttagccttcacaaacttctcactgttgatgtcaatacctatgattctggaagctcctgctgctttacaacccattacagcagaaagacccacacctcctaggccaaagacagcacaagtcgaaccaggggtgacctgcaagcaggaaaattataaagtaacttctaaagcagccagtcccactttttttcttttaagagtcaggaggaagtgggggcatgaacatatgaattaaagacagcctgctattaaactctatgatatagccaatggaggaaatctgccaatgcgaaaatggatgcattactacttaaatttggagaattatttagtgttcattaagattataagaaacaaacccaagtaaaaataattcccttgttttactttttcccttcagtgttatctgaacaaaatttgaaaacccacacattctgaagggtttattgctttccttttaaaattggatcactattaatttgacatctatatttcgaatagtcctcatttggttgtattaatattacagtgatttacttgatcactccaaatcaccagtttggaatgaagtccaatttgttttgcatggcatgaaagcatttttattgtctgacctctgtttaccttccagcttcatccccatgatattcccagtacaagaactgcgaacagattgttgcactttcttctcatgccgtagttgacgctgctccctcagactgatgtacttttaaccttattttctttaattaaagtataacctatactcctaggcctgacttccaagacattctgtctatgaaacttttcttgatttttcaatcagaaatcaatgcctgtctttttgcttttcttttattatataatttataacctgccttgattgtgggtgtatggtgtgtttctttaaaagaccgtaaattttatgaaggcagaaactttttaaattccatattattatgaaagagtcttctgtatattgagtctttaataaatatttgtttcattgcattaaatggaaataatagataagatggtaagaaaagatgctgtaactggaatatgttattctacagactattatagcgatagaaaaatactacatagagaaatacttaatatttcctaatgaggatgcaaagctgttaggattaaaacataaacaaaaggaaaagagaaaatctgctcaaggtaagtattaatacattctaaattggaaacaaaattactaagcaacaggtaaactgcaatattttccttatttactataatattaggtatacacacctctggcttttgctactcagaggaaataataaatatgtatatatattgcaaatagtaagaatattgttcttatgatggcttctttactataatgttgtggcatgtgttcagtatgattcttaatatattgctccagagtctcagttaaaaggagcctgtgagtctcttaggaagtggaaatgcatttttcccattgcagcaatgtaactagtagttggattctcaggctagctcacaacagtgtataaatataatatgctgcattacttgtattatacaactggacccctgtgtgtaaaagtgcctttgtttgcagaacttaggtggggtcactataaattgcccccacaatttgcaagtgagtctacacacagtagatgattatctatctgcaagtaccactgttagaggacatttccacacttccaaaggtctctgtgtaatgttgtttaattggcagtaaaggatacaagcacatcaaaaagaaagaggggttctggtgatgttggtgtgttctcaataattatacagagaagttgcttcacttttcttcccagaagtaagttaaattttactaaagctcttgccttttgggcagaattactgatacttcactttccttaatttcttcctatcagattcatttctctctgaggatctcatgaggtggcttagcagctagaatctcttccttaacagtgggaagaacaactcctggaaatttaggtcgactttgactggatttaaaagaaagctgtacaattccacttctgtatatacaaccaaaggaaatgagatgtgcatacccatgttcaatgaagcattattcacaatagccaaaatgtggaaccaatccttaaacaaaaggaaaacagaaaatctgctcaaggtaagtttaatacattctaaattggaaacaaaattactaagcaacaggtaaactgcaatgttttccttatttatcaataatattaggtatgcacacctctggcttttgctccacaaatagatgaatagataagaaaaatatgatatgtatatacacaatggagtactaattatgcttttaaaaaaatgaaaatcctgttatggtgaaaacatggataaacctggaggacattatgtcaggtgaaataagccaggcacagaaagacagatactgcatgatctcacttatatgtggaaaagacaagctcacagaagcagagactaggatggtggttaccagagtctggggggataaatgacgaataggaggatgttggtcaaaggttacaaaatttcggatagagtggaggaataatttctggaatttcattgtacgctctggtgactataattaataataatgtattgtatatctgaaaattgctaagatagtagatttttaatgttctctccacaaaaagataagtatatgaagtgatggatacattattagcttgatttaattattctacagtgtatatatatatcaaaacgttaattgcacttcataaatgtataaatttttttcaattaaaaataaataagtaattaaaaaagaaagctgtagctgaacctctagtgctgatggcccttaaaaggactggagtagtagaagaggatggactgcatggagcccagcaaaggaagacttgaagagtgatacttcttccctaagtctctagcgccatacagcagaaaataggctttgactgccatgtgcacatctgctgtcaactccacccagctactagtacccttctctgattgtagtttggtttctaacacaattttttaaattttttattaatgagtaattgtgtgcgtaaatacatttttaaagggagataacatgttgatagcaaagggtagcatttttgtctatgtggcagataaaattctcaatgaagagtcatactttggtatcttggctactagatcaacctcttattgtggtgaggctgactttgtttccttgacactgaacaactctaggtaacctgataagaaggactttctggattacaaagccgaggaccaggcctcaccaggatgttttatgcacctggttttatttattcattcgttgaaaaattatcaagctcctgttatgtgccagggacaattccaggctctggagctatcacaatgaacaacagagagttcttgccctcaaggaacaaatagtacaataggacaaaaaaataaatgggagatttctctatagtgtgataagaatgaagacagaggctggtggtggctgatgcctgtaatcctagcactttgggaggtcgaagtgggaggactgcttgagcctaggagttcaagaccagcctgggcgacatagggagaccctgtctctataaaaaattaaaaaaatagccaggcatcgtggtgcatgcctgtaatcccagctacttggagggctgaagtgggaagttcacttgagcccaggaggtcaaggctgcagtaagcaatgatcatgccactgcattttagcatgggcaacagagtgagaccctgtctcaaaaaagaaaaaaatttggggtgaaaactgggagggatacccaaagcatggctgagagcctgaagtagatctctgagaggaagtgataagtggagtcagcctgaaggaggtagggcagtcttctctgcattgttgctggaagccaagtgtggaaagcccagagaccacagtgactgaagcctggagactcagagtggagccaagggaacagtgagtgcacagtggaaagggagaagtaggaagtcactgtagcctactgaggaatttgagctcaccctgagggaaaaatgaaataatgcaggaaaaataaaatcttcagacttgttgtttgaaagaccactctggctgcattttgcggttttgagtcaggaataaagatcgatgtcagggaggttcagataagcaggttgagatgtccaattgtgagatccctctttgatgtctctctagttctagatcagatgctttgtaagagtttctaaattctaacatgggattccagggacacatctggtcaacattacggctgctaccagagaccctcctttgaagccacaaagggacatgatgagtagcagaaatgaattactactgatggagggagataaatctgtagcaacagggagaagacaggggtggttgtgtgaagatggaagtgagtttctgtcatttttgttgccctttgactgagtcagctgtcctaggatgagcattcatccttaggagacatatttaaacaggctgtatttaaatcagggaagatctataacctaatatgttagtatagtataagaacatatgctgggtcaattatatgtaggctactgggccagatgttttacatatataatattattcaattatcctcataagtatttgtagtagatattattctagagggattaaataacttgcttaaaatcacagaggtaataaatgacacagccacagtttgaagataactaactctagttcatctgtatcacactgcctcctagtaacttctgttttacacaaactggtgtttaaccatttaccttggcattgttgattgcagccccatagccagttgaaaacccacatccaagcagacaaactctctctaaatttgcatcatcatctattttggcaagattgatatctgacaccacagtgtactgagagaatgtactggttccaaagaaatggtaaactggttttcctttgcaggtaaacctgctggttttgtcttccattagttgttgatcactagcaggacttttgagattactagaaaattaaaaaaaagagtgatacaaataaagagaagttataataaatggaacactgatcattttcctacaaaatatgttgagcattatatatttttgatgacaatttacaagacagaaaaattagggaaacaacaagacttttcacaaaatatagtttgttgaataacagcaaatttaaaaaataacagcaacaattttttaaaaagtgacagggtgtcatttcgtcactcaggctggagtgcagggaacaatttttttttttttagacggagtttttgctcttgttgcctaggctggactgcagtggcacaatctccgttcaccgcaacctccgccttccgagttcaagcgattttcctgcctcagcctcccgagtagctgggattataggcatgcaccactacgcctggctaattttgtattattattattattttttttttgagacggagtcttgctctgtcgcccaggctggagtgcagtggcgcgatctcagctcaatgcaacctccgcctcctgggttcaaggaactctcctgcctcagcctcccgagtagctgggactacaggcacgcaccaccaggcccggctaatttttgtatttttagtagagatgagctttcatcgtgttggccaggctggtctcgaactcctgacttcgctatccacccgcctcagcctcccaaagtgctgggattataggtgtgagccacctcgcctggccctaattttgtatttttagtagagacggggtttctccgtgttggtcaggctggtctcgaactcctgacctcaggtgatctgccagctttggcctcccaatgtgctgggattacaggcatgacccaccgcacccggccagggaacaaactttcattgaatgcttttgtgtaccagaaatgcttttaagggctttacatgtattaactcttaaaacatttttgttgtggaaaatttgaacatgtataaaagtagaaggaatagcataatgaacccttatgtgtccatgtcccagctccagtaaccatcaattcatggccagtcaggtttcatctattattcctccacaatatctgctccctcccccacattggaatattttgaagcaaatcccagatatcacgatttcatctgtaaaaacattaccatatatctctaaaggattactttaggtccacatttttgttgtctcttaattatcttaaattatagatcccttctccctctctttttccccttgcaatttatttgttgaagaaattgaatcatttgtcctatagagtttttctcattctgaattttgctcataacattcctgtaatctggttgaacatatttctctatccctgcatcccctcataaattagtatttttgatctaaacacttgatctgattcagattttatatttttgtggtaatactttataggtggtatcgtatatttcatttggaatatctgattatctctttttataacatttattagaaagaatttattggtattgcctaaatccattatttcattaaagctttgcaaaaaaaattagttctttgaatatctagaacaagtctatgaagcaggcattattttgctcctcattttatagatgaaaaaattgaggcacagtaatagatgtaagagtagtacaattttagcttcttaaataactgctttcaattagtgttaaggatgaaaggatccttctgtagtctagtaaagcaaaaacaagatgattaagattttagactccagagccatactgccggggttaaaaacctggctctaagacttataactatgttgccttggagtaaattactttactgtgccttattgtatccctctctcatccctgtagaagtagctattattctgaatttggcatttattatttcagtgatttgtttatgcttttactacatatacaaataaccataagaaagtatagtattgtttttgtatatgacactttactaaatattccttcagcaatttgcttatttcccttaacattatgtgtgtgagattattttatgttaatacatgcagctcaagtttagccatttttattgttgtgtagtagtccattgtgctactacatagcagttttaaaattcattctctttctgatggacatttgtgctgttttaaattgcttactctaataaacagtgttacaaagaacattccagcacatgtttctttgtgtgcacttgcaatagtatcttgtacacacctaggattagaattagtgggtggaaggtttgcacctcttcaaggccatttaggtaatgtcaatatgctttccaaaatattcattcaaatttatactaatactaacagtgtagagtgcttacctgattttcccacacaaatttgtgagtggactcagacaaaacttgcattttctacatagaggtgcataaagtggaattactttgtcacctagaaagaaaggccatatgttggatggtgcctaaggtgttacttatagcttctaccagataaatcagtggaaaacaccttttctttatagtatacattttatattcagtggaaagtataggtggctacagtatttcattaccttacaagactgcagattccccaacgtattgcatatattgtattttttaaaaaattactctgctaggcagtccagcaacaaatctatgttgatatcatcagatacagaactctgggactttgctgtcattgtgactctctgcatcatgactattgtttattacatttccaaacaccatgtacgaaacataacatccttagataataggagaggtaaacaattataggctaggtataaactttatatcattgctatgtttcacctttagattcactttcaaattccacatttttccactttttaataaattccaatttaatagtgacttctgtgcttcgatgcctgaggtctaatgatgataattcacattcattcaacatttaatacataccacgcaccattataactacttacatgtattatttcagaacttaattctcagagcaactctttgagacgagccctatttttattcacactatagaaaacagaaatctgagctgaatcacagaaaagtgacataactggccaagatcacatagccagtaagtggcagagctggggctaaagggattatattggccagactccttcattgacacaaaattttgggaagcaatttgtttgtacaatcttttttggaatggaaagatactaatatacctctaactttggagcattctcattaaaagagaaaagagtggcacggttcatctggcctgccaaatgaggattacatagcccatattccagtatctggaggatctgttgtaaaatgtggagtaaataatttcagctattggggtgcttcatttaggtattatctttatcttacaaacttccaaaaaaacacttcagctaacgttgacatatatataatatttctcactaaagctacctctaagtcctcattctttacatagtttgctgttaatattaaaatagtttgcttttttatatagaagttattataacatgtcatttaaaaaccttttattttacaccaggtgcagtggctcacatctgtaatcccagtgctttgggaggctgaggtaggcagatcacctgaggttgggagttcaagagcagcctggccaacatggtgaaaccctgtctctactaaaaatacaaaaattagccagatgtgatggctcatgcctgtaatcccagctactctggaggctgaggcacaagatttgtgtgaacttgggaggtgcaggttgcagtgagccaagatcgtgccacagcactccagcctggcacagagtgagactctgtttcgaacaaaaaaaaaagtctgggcaaggtggctcatgcctgtaatcccagcactttgggaggccgaggtgggtggatcacctgaggtcagtagttcgagaccagcctagccaacatggtgaaaacccgtctctactgaaaatacaaaattagccgggtgtggtggcacatgcctgtaatcccagctactcgggaggctgaagcaggataattgcttgaacccaggaggcggaggttgcagtgagctgagatcgtgccactacactccagcctgggtgacagagcaaggctccatctcaaaaaaaaaaaaaaaaggaaaaacaacacctttaattttagatttaagggtacatgtgcaggtttgctatataagtaaacttgtgtcacggaagtttggtgtacagataattttgtcacccaggtactaaacatagtacccgatagttatttttctgagcctctcctccctccatccttcatccttaagtaggacccagtgtgcctgtcattgccccatttgtgtccatgtgttctcattatttagctcctacttataagtaagaacattcagtatttggttttctgttcctacaatagtttgctaaggataatggctgacagcttcatccatatttctgcaaaggacatgatcttgttcttttataaggtgtcatttgttaaacatggaagtttcagttagagctaacctcataactttgcttcatgggacagtttctcagtgctatgtgtaaataaagtgaccacatttcctagattttattagacaattctgatttcaaatattctgtcctattgctagactgtgataaattgtgtctctcgttttactttggaaaagatggtccccttttgtaaatagagatcaattatagcatgccaagccaggactctatcaataattatctctgaaatattgtgacatttccattttttctgaataaaataaaatacctggtttgacgttggtcactcctggcccaatactttccacaatacctgcagcctcatggccaacgatcactgggaaagctaggccctcaaatttagaatcgataacagtggcatcagtatggcacagagaggtagcaatgatctacaaggcaatcacagactttaattgtgtttctgcaactatattattgggctggatgttacatataagattaggcttgatatcattttaaaactttataagacttctagaactcaataaaagaatcaccttttgaaaaaagaaccaataaaaatatactgggttagattattttcctcttataatgcatctttgttttctaccttttgctgttgtcagaaaatcataaaagagataggattggcaattattgcctccaggagaggaaaaaatcaaaggtaatagggcttattgaaatgaagttgaggtaatacaccttttacagttgagagaacaatatcaaatcaaggattgtctgaattaattaccaatgtatacctatattcttctttaaggttctgtcagtgagaatgtcccattcactctcatgtacagactcttaatgtgggggtcctcaaggaaaatataagcctggtcagcttgggaaaaatggggaaattgtccaaacttgccatcagtgatctcactccattccatgcactctcttctccctgtgacctactcctgtcccttcctctggatacccaggacccttcggctgcctagggcagcacgtcaggttttttcttctgtcttgttttcgatcaaattgtctatcttccttttaataacactttcaaataattagcaattggaaagcaaaaagaaaacctaactaattcaaatccaaagtgaattcctttgtctgattcttagggtaaatgattaatgttaagatcaattaaattttaagcccattatttgaaaattactaaaataatggatgatttattcctttttgggataatgcctgtttttgactgaatctaaaaatacagcttccctgtactagaaactccaaggcctctgaatcatagcacagaggattgacctgacagaagccaggtctccacttggggccctgtctgttcccacccaaggaaagtctccacttacctgaatgcgaacttcatgagccttggggggagctacttcaacctcttcaatgcaaaggggcttgcctgcttcccaggcgatggctgctttgcatttaataacctgaaagagagaaagaaaaggaagagggagatagagatagagattttgacagggttgggggtaggagagaggagatcatgagaaaaaattagaatatattgatactgtaatttcatgacaaagagttaaagagtttgtagctggatcttatagatattattttaaagacaagggatcttaaagaaaaataagaagttaaattctacattatagtcattacattttttatttcttgaaaaaaaaacaggtgtattaaagtttaccttgatataatgtctcaagtttttccctctataacagagagaatagatttatggagtttgaataaggtagatggcctataaaaatctattgagtgaactgtttgaaatcacctctgaattacctgagtcagataattgctggagaatagatgtgttttacatctctgcaactcgaagtgtggtcctcggacaagcatttattcacatcacttgggaatttgttagagatgaaagccctgcctcaaatccactaaatcaaaatctgcatttgaacaatatccccagagaattcattaaaagtctgagaaatgaggcttacatcattattaaatttatctgtaggatataaattaaataaaaatttcatctaattgtaagaatttgggtaaagatgaatgaacagaaattaaatatttaggattctataaccccaattttttctagcctcaaattatatttttaatttcaaatataagcaacattgaaagaaagtagaaagaaacaaacctataatcttctgttctaacactactatgcttacatttggtatacttttcccaaagtctttgaccacattaatgtatatttttcaatagttacataattttgaattatgtttttgaatattatttattttgtttcaaatgaagtatatattaattaacaggaagtttcaaaatgccaaggcctatcaagtttttaaagacaaaaaatagaataagattcatctgtaagctcatcacccactttatgcttttgatgcagattcttcgagtatccccaaataagatacattgtccatagtattttgtaatatactttttctactattaatatactgtgaacattttcccatattctcctgcaacattatttgtaacatatgcatattatattttatggttacagcacagttacttaaatctctcttcttttggccatttaaataatattaatattaactgaacacccttctaataaacattttggcaatccacagttaatttccctagaataaattcctggcataggggtcactcatatccttttgatcaactgtaagtcactgcttcctgagttcctgaaggaagctccttttagccaaacatacaaggacacagaaaagcacaaactgaacaaagatacagcttacttgcttactttgcccttggtgcccatttttctttgggaaactgtgttggaagtttctttctgagttaagaaagcttcaaactcctacccagggagttccgtgtcctataatgagctgtctttgaataaataccattcatgttgcttaattctccaatcacttccttttctcctttgttgctgtaattcacagccctgccggcctcttaccacatcatttgtactattggacttcagctgcaaacctcattgctcccagtgagctccaagattttttaaattcttttttcttttattgaaaaatataaaataatagagaaaagcccattaaacatataaagatgaattaacaaataattatgaagtaaaggaaatttctactcctcagaatcgcccatttaacttacctgttcttctccttcacaaccctgataatcacttccttgcatatttagtggtttactacctatttaagcttctctatccaatagtttaatctagcaaagcctttttatgaatggaatcatagtgtatgtattgtttcatgtcttttttctcccctctactctatgtgagaatcattcacattgcctgtggctgtagcttattttcattactctagaatattccagtgtatgaattgaacataatttattcatccattttcctttttgctgttttttttcctctttgcttatgatgaattagtggttacatacaaattcttttcatgtacttggttgcacatatgcttgagttgccttaaagaaaattcagagctgatattcagccagtacccactatgaaggccatgccaattatcaaaatattgaagtatttttattcagcttggtaaaaagtcactatcccaaatccccaagttccccttcaactctgttgcagccctgggggcccctatttagtcactgctaaggagctactctttttgtcccacctgatgtgtgagtccatcaaccagccctgatggttctgggtctctggctgtccccctaaaacagagtagtccctggaaccccagtagataaatacctagtgtccatctgacctcctgtggctgtggcctccagtgctgtgggtcagaactcccctggagtcacatgtatatggccatttgtgagaaatggagtttcctttctgtactggttgttaaatattttttgactaggagtggaattaaagtcttcaactttaataggcaaggccaaggaatttcacagaatggcttcacctaccagcagcagtgtatgagagtcctcgttgctccacatcctcacccatgcttggaattggcagactttaaaaatcttcttaatctggtcgtgtgtaaagatatctaattctgtttttaatttgtattgatctgattattaataaggataagcaccagtcctgtactggagtcagctcatactgattttgttgtgcttattctattaactactgagagatgtttagaaatcattatgattactctaattatcattacacgttgtatgtgtgtactgaagtatcataggtacttcacaaatatgtacaattctttctgtacatattaaaattaaaaataaaaatgaataaataacaataaaattattttaaataataactaaaaataaaaagaaacaaaaatacatcattattatgagtttgttaatttctgagagtacttttttttactttacatatcttgaagcttgatattacgtgcatgcaagtattctgtgttccatgtgttttaagaaatttaatgacatttttactatctttccctggcagtgtgttttcattatctacattatttcttttaatagtcccctagtattccaccatctcttaaatatttcagttgttctattaaacttttagaaagcgtaatttatactcgtttccactttttcactaaccacatttcactcaacttgtttgatttccatctccttgttctattgaaactgttttccccaatgcaatgcatgagttttttttagtttgctctgattggaacatctactgtggccaactaaccccttatatttccttaaggtgtgtctccaggttcctatcttgcatccccactctttctatttggatatggtcttttccctttttgaatctctgtagcactcgtgtttgcatgactcttcaggcttatacataaataggcaaatgaagcaaagtaagttttgcttcatttttgtctcatgttctgttacttgtgccttttttgacaacctgtttcctacctgtagcctccttaactgtagagattgtattttatttacatttcatatcctgaagagtatacttcagagccccgaaaaaatactaggtgattactaaatgctggtcaaattgaataatgaccttggaaacacaattggaattaacactcttttctgaatgcttgatatctgtcttttcttggtctttccttctgtgctgcactttgataaacttctttgaaggtaaagatggtcttttcctttctataaatatcaaaggatctgctgagaattgttttgagaggagaagggagaagaggtttcagaatagtaaatcctgggcatttgaatgtgagggcttctcctaatggaaaaaaagaaaatcatggattcttcttatgagaatggttttaccttttgtgacttttcatttttgggcttctagatgttttcaaaattcccaatgttatatatacctttagaaatataatttctctcccattatattagcataaataataatattttataatattccatcattctcaacttgaatacccaaatagcacatttgaaacccaagatgtttcaaattgaactcattgggtttctgcaccaaccactccttttttttgtttttttgttttttttttgagatggagtcttgctctgtcacccaggctggagtgcagtggtgttatttcggctcattgcaagctgcgcctcctgggttcacaccattctcctgcctcagcctcccgagtagctgggactacaggtgcccgccaccatgcccagcttttttttttttttttttgtatttttagtagagacggggtttcaccttgtgttagccaggatggccttgatctcctgacctcgtgatctgcctgcctcggcctcccaaagtgctgggattacaggcgtgagccactgtgcccagcctcttttctccttatttttaaaataattgtttattttctacatctaatgacatctctcctagattctaaaactttccttttcatgttaaaatctctgtaatcagttgcttcttactattgatggcatgtcatagtttaattagcaccatttttctttcataatggtacataaaattatggcatatctgacaattgatgtcttagccctgataaggtagagtatttgtaaaaatgtatagattgcaattcctcagcatttcacccatttgtcttttttttttctttgagacagagtcttgctctgtctcccaggctggggtgcaatggtgcaatcttggcttactgcaacctctgcttcctgggtttaagcgattctcctgcctcagcctcctgagtagctgggattacaggtgtccaccaccatgcccagctaatttttgtatttttagtagaaatgaggtttcaccatgttggccagacaggtctcgaactcttgacctcaggtgatccgcctgcctcggcctcccaaagtgctgggattacaggcaagtcaccattcctggcccatttgtctttttcaccctacacttctacattatggttcatttcctcactgtttctttttttcctgtttaaaaaaaaattgagataaaatttaccattttaaccatttcaaggtgtacaacttactgttttcaaaatatatttacaatgttatgcaactatcacgactactagttctagaacatttcttttttttttgagatggagtcttgctttgtcacccaggctggagtatagtggtgtgatctcggttcactgcaacctctgcctcctgggttcaagcgattctcgtgcttcagcctcctgagtagctgggactacaggcacctgccaccacacctggctaatttttgtatttttagtagagacagggtttcatcatgctggccaggctggccttgaactcctgacctcaggtgatccacctgcctcggcctcccaaagtgctaggattacaggcaggagccaccatgcccggccagaacatttcagtcacccaaaagaggccccatatgtgctaattcctccttccatttagcttctggcaaccactaatctattttctgtttctattgatttgcctattctggacattccttgaaagggactaataatgctggagagtgctgaaaatgctgaaatgctgaaaagtggtggacatgttagggcagcaggagcctaggagagccagagtaacatcattttcaaataagctctatcttaaaactagcaaggcatattccttgccagtcatgacctatggtcctaagatgtttaccactaaggaagcaacgcagcttggtaatgcctgcaaggacaaagtcctacaacagaaaagtccagatgttacaacacctataacaatatatgctttcaagatatagttatgcttcgatggacttacacattaagatatcaaggatagttttctttaaatcagtagaataatacatttagtcatgctgtcagcccacctgcacataggcacagcttagtttaatctttacataggcaagacccctatataagaaaaacttaaagacagtgcattcctctgctttcattttgaggatgctttactgggtgacagagtggctttcagtaaactatctcttctcacagaaatctgagactcaccttgaattccttcctgggtgagatccaagaaccttttcttggggtctggatcttgaaaagacccctttcttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccgaaaagacccctttctagcatcatcttctggggacactataaaaggaccttaagatgttacctaatgccaaggaaattcagtctgcacaacactcattggcccctctggtaagttgggtccatcttggtgtcctctattaggtttaggcaaagctgatattcaggttagagactaggcacatgaggttagagtccctggggtataataaaaatggaagtagccttgcaagatctttgccattgtgtgctttggattaatccacctgatcccctttgccaggtatggaaaagctatagttctcatcattttccagcttgatgcctttgcttttactgcagctctatgctggccttgtatggctgggcaagcgcttcactactttcacttttcatgcttgccatctgattaccacatctgaagttctctgtttctctcttttctttctgcctgttttgaatctgctgttattaggctactggcattgagataaagcttattgttcaaagttacttggagattttgtttttcttgtagagttcaaccaattctggctaaaatgtgaacattagaaactcatttgaaactgaagaaaaaaaaaggcaaaaaagctcttttttaaaaaaaccaaacccccaccaaagaccactttacccaaagttttggtttacatatttctttggattacttgttggatgtctgggtgatttccaattaagaaagtttatgatatgggaaaagatgtttctgaaattgtggaatggttttatctataaaatgctaacatctgacaaatatttcaggatttcctgcttcctaagtttctggattcatggatgagtgagtgacctttgttgtcccttctcttccctttcttgtcccttttcctttttgcactctgcttagccttctgaacccaagaagacactgagatacccacgttccttttattccccagggattgggggttaggggtccctggttgttggatcctttgggccacgtctgctgaggagcctggagttatgggatcctccaggtcggctgccaccctgttggacagggtttttcagcctttaggggtttagagttgcaatgtctccctgacggataaagtgtttgaggtacagagagatatttgtcagcacctactgcttcttggtcccccttgtcccctttttctgttgcatacttgctgtctgtgcctcactagtgatggatgtcgacctatgcttgcatgccctgaagttaatagctaccattttctttctgatcttgatgatttttgttctttgggttatttaatttggcatctctctggacaggattgcagagaaaagcctcctgggatctagtcttattgagaaaaagaatcattttgtcaaattcagaagttatctaaaggtcaactcaaattatgaacttgaaaataattacttatgaaacaaagtgagaaagaaccagtaagtagggaagagagagagagacataaagttatggatatgaagatatattttttggtaactcaggttataaagaaaagagaataattttgcatgaaaaaggatcttgtatggtaaatttctgtcctaaaataaaatgactgattaagaaaaagggaagtttaggacaagtcagaaagtccaagcttgctgtaggtggtctatataagttgtgataagctttgtgaaggggaatttatgaaaggaattttgtatgtgattaagttggttataattaaaaggaaataatttataatactctttctagggttagtcccctatgttaaaacaagattttcttaaggtgttgatttgctcttaatgaaattgcaagaaattttacttttaattttataatctgtttcttttaaaaatttctcaatcatatctcagttcaacttttctgtgtcctgctgctttcagctttttctccccttgagaagcctgagacaataactctctcctacagcatttttgttagctcctgtaacttttttcttccagttctaactgttgttgtggcctaatgctaaaatgttttatgttgcaagtttagagaagcaattctttcctccagtataatttgattttgtactcttggcttttcttgatatgtctaaattttcaatgtaatcagaaaactcatgctcttcccaagagtcacatattcccccgctctactgataaccttgaacacacctgtgtcttgttaaattcaagcactttttttcccatcaagtttgacttccagactatctaagtgagcttctcacaaggagaagcagtcatattgcagaagttctttttcgactttttggtaactgacttaagaaacaggatttcgtattcctatgtctttattaggttttcaactgcttttaaaaaacttgggatttaaaagggctaaagtttttacatccatatgaccttctgtaggttctctttaaagtcttttaattaccaatttggttaaatgagtaactattattttacagtgacctgtgcttctgtttttatcaaatgttttaagccttcatcatttttaacaaacatcctcacaattaaaccctaaatgaagtctgactaattgctggggattattaaagctatcaaaactaatcaaacaaagttataaaatctttttacagcttccagtcgggtcatggacttcattatcaccatctctagctcccttgtaaaaggttcttatcaggtactattaattaatactgtgctattaagttacagggctttgactccttagtacacatatgttagctaaagaaggcactgactcatgcaagtatctgacatcaaactcaagttaaccaaagccttgtctctggacctgggcaaaggcaacagagtaaacagctttcatgaaacacagggacaggcctgtattaataaccattaagatttatttaataattttgcctttacctgaaatcatccttatgttttgttttacccccagaatttgaaactatgaaatcctgccaggcccagagactatcacatgagattgtaaaggctggttttgaggagtaaaattaattcagaccctccaaatcaaggatggtacacagattcctaaatagctgaacaaaatgctgtgatttgtataactaattgctaaaagcccagattgcagtaggttgatgcatagaatttatagataagtcaatttcgtaactttgctttttggcttttggttttgggatttattttgcttaaaagaggtgttaaggttaatgaatgtctactcacttccattcccatctggcctagtgcattagttggctgtaagtcttttgactctaagtcccctagccatagagtttccagcaagggccatgatggatctgggacagataacacatctttgggacatgataacacacattcagcatcaatatgggacaaaataaaagcttggcataccttgacaaaaaggacggaatataaatgtaaaaaaataaaataaaatcctaagacccaacagaatggaccccctcttgatgaaaagaaataataataataattttaaaaacctttaaagtgtagtttaggccatgaagggaagctgggggtcacatatgtctcactatacatctcccccacctggaattcaggcacaatcgacgagcattaacgttgaaatagtgatcataagattgacagaacagacccttccattcttaggtatttatttatttatttttaaatttttgatagtttttggggaagcggtggtttttggttacatggataagttctttagtggtgatttctgagttttggtgtacccatcacccaagcagtgtagagtgtacccaatatgtagtgtttggtccctcaaccccctttcacccttcctcccaaatccccaaagtctttctcatgcctttgagtcctcatagtttagctcccacttatcagtgagaacagacagtatatggttttccatttctgagttatttcacttagaataatggcctccaactccatccaagttgttgcaagggccattatttcattttgttttatggctgagtagtattccatggtgtatatgttctacattttctttatccacttgtcgattgatgggcacttaggttggttccatatctttgcaattgtgaattatgctgctataaatgtgtgtgcatatgtctttttcactactgacttttttccctttggatactgggattgctggattgaatggtagttctacttttagttctttaaggaatctccacactgttttccacagtggtggtactagtttacattcccaccaacagtgtaaaagtgttcccttttcaccacatccacaccaacatttattactttttgatttttaaattatggccattcttgcaggagtaaggtggtatctcaccgtgctttttaaaaatttttatttatttattattattattattatcattattatttttgagatggagtctcgctctgtcacccaggctggagtgcagcggtgtgatctcagcttactgcaacctccacctcctgggttcaagtgattctcctgcctcagcctcccgagtagctgggactacaggtgtgtgccactacactcagctaatttttgtattttaagtagggatgggatttcaccatgttggccaggctggtctcaaactcctgacctcagatgatccacctgccttggctcccccaaagtgctgggattacaggtgtgagccaccgcgcccagccggaaaagattctttatggcaataagatgtcaaattataaacaggatctaagaccatgccaggtaagggttaagtctccaccccaagtaaacaatgtcatatgttacatgcatgttcattcaatatacatgcatcaggaccacgtccatagatattcatagctcccctgttcaatgaggggacttagtcttattaaaaacttggaaagagggaatccctcaaagattaattacaacccaaatggaagggcccctatcaggttatttttaagcacctccactgctgttaaatttcagttgaatgactagctgagtacacatgtccaaaattaaacctgtttcttgagtccctgcaggcacctgagaaaatcacaacccacacttgcgaacccctaggagacctaaagctgtggttttacaaataaacagataagtaacattcctactctttcctataggtactcaatcttcttaacaactcccatcccacacaggtttgcatccccagcagatacatatggctatgtggtcacccattcgatcagcctataaaagacttgtcttatttgatattgtgaaacccatggttatcagtgtatatgaaaatgtttggttcaggggtcaatgtacaatatgacaagcaaagtcctctaatacacagttatataaaatcactcacctgagagccaagtggacaattggccttatattggctggagttggagccccagagggaaaatttgcctattattaggcaactcttcaaaactttacttattcgtttctaaacactgtctcataaaatgggggatgctttagatgaattaagattagcactagattacttattcgttgaaaattagcactagatttcttattggttgaacaaggaggagtgtgcaccataatcaatataacctgctgcagttatgtaaacacctcaggtcacatagaagaagatatacagaaaatacatgaacaagctgtgtggttgcgtaaatataaccaaggcaccaatcccaactgtatctggtcagccattagaagcaccctcctgagtctcacttggttgttgcccttcctaggaactttgatagttgtcttattattaatctttggcccttgcttgtttaaattcttggtaaagtttgtgttttttagattacaacaattccacataaagatgatactgacacaaagcttccaatccatcccgtcttctgaaccgggaaataaagacaccctgcctttaggtgtctttagatctagatcaggcatctagagatttttactcctccaatacttggcagggtctatgcccgtagactcatcaggataccatgtaaatgaggacctcccttggtaccccagaggccaactgtagacccttatgagaaaatcctgtccccaaaatgaacatccactgtcagcaggaagaagttacagaagaccagcctttgcccttacgattaagggtcctcttgtaagtagagaggggaatgttaggaaagcaggagcctaggtgatccagagtgacaccattttaaaataaactccacctgaaaactagcaaggcatctgcacacatctgtttagcaagtatatacttctgtaactggaataaaaagcgttattttagaatatgcctatagtttgtaataattagccgagggaaaaaaagttcacattggtgtaggaaaagtgccctaatggtcatgggtaataatgggaccgtggttctggtcagtgatttgatggaaggggtgtagataatatattgttgtaaataataaaaataaaaaattgttgtaagtaataaaaataaaataatattgttgtaagtaataaagtaggagaaatatttggtcttttgcttttgggttagtgcaacagtagtaccattacttggaggagaagttagagaaggacaagaataggcttgaataagatgagtgagaagagagaaaaattccgtaagtggagatggccagggaacaccagggcagcagaatctaactctgaatttaatgctgttgtctgttcatattgcactgcgctgtaatctccctatctttcctaaaccattggcaaagtctgctatccactggggccttgggtcggtggtgctttgggaaataccagaagagggaaagtacggcaaatgtgcagtgtcacagatgataggaggaaagctggccagtgggatgattaaaacaatttcggtgggagtgggaattcagaccatgtaaatggtctgaattaagaaaatttcaagaaacaaaaaatgtttctaatgagccaaagtgaaagctcttcatgatttctttatagaggctctctagtgcttgtcctaatttcctgaaatctcatgggtatcttactctcctggtgcccgcctcaaacattcactgtagcaattatatgagcagcctagagaatcccaatcccagtggtcttgctccctggatctactttctcttaaaaatcattcccctaagtttccgtcacttggttgaagtttagtagatatctccacatctccagctagaacagcaccagaatttcaggactagggcaatagagtctgatattaaattctatttctatctatctatctatcatctatctatctatctatctatctatctatctatctatctatctatctacagaacaatttgtgggatagtagctttggggtcccagatctaggatgggcctggtcctccatgctggttctcctgggtgatatttctgttagtttgaacagtaatcacacttttattactgtttcatcttttttttttcactcttagactgattttatcatgtgtataaaacatacacacacctacatctcaaggataaacattaatccttgaaaaatatgtggtctaaaactatattgaggagagaaagataggacactttaattgccacatgattaacacgaggtcaccacacagctttcacaaatctacaagtcattctatttaggctgagtcaagttctcccttgggccagccagagcacaaataatggagcaatgtgactcttcaatgacagatctctgatttccagaaaagagactttgaaatacccaattctagtaaatatgcaattaaatttccagctaaatgacctttgctcctgtagtcttcatcttggggaagggaaagaagtcttattctgtttaatagtttgatttttataatagggtttgtctctgttataaatcttgtttgatatttaaaatgttagctaagagaaaacttctgtttgtttttatttagtgggaagaaactaaccctcattgagtgcctagttaacatcaggcactttgtacacataatcaattgaatcttgaccacaaccctgtgaggtaagtattatgtaccatattaacaaataagacaacatgcttaccccgtttgatcttttcagtgtttgttagggaagcagaggtttgatttgaagtctgtttgattacaaagttcatgtttgctgtcaaattgctgatcttgaaagttttaggatgttcgatgaaatttgggctttgtagtctcccctctcttgctgttatctgtaaatagaactttgagaaattgttcagttttatgtttgagagattgtttacatttgagattttgtactgttattgttgtaaagttaatggttactctatcggattactactttaggtcatagttagaatgcaggaaaaatattttttcatcattagatgagtatctgtaagtcaacaattcatactaatataattattttagtattgagataccaggcaaatataacttttctgtattactcagattttacttaaacattacctcttcaaggtgggcctccctaaatctctcagactaggtcaggaccctgagttacaagccacctatacttttccttcatagtactttaaacttttattaatactttcaaaatttggtgggctcacttttatctcagtttcatcttgcgatttctctgggatgaatataacatgcaagactgaagtgcacttgcagaatagcagggaaacgttcacagaatggacctgagctgccctgaggcagggtcagtgtaatgggttattcctcaagaaaatgaaggtcagagactggaagataatgaagaaagagacactgagttgtcaaacatcgcatatgttttattggatattaatgaaatacgaaatgagtgatcatatgtcaaacaccttcacattctgctagtggtagaaacaaagcacagtcgtcaaatcaaataaaaaaacctaaaagccagagaacatagctctaaagacaatgaatgccatattttctaaaaggcttagtacaaatataaaaatatctaagtattttatacacacacattgctattttagtatttacagtttatcttaggactatactttcagagttcatttctacagttcgttacagcttacctcgaaaactaaaatctgctttccaatctaaaataagtctaccttttcattctggcttggaacagccaataatctttttctaatatttaccacaatttgtaatcatctattatttgtgtgtttatgtgtttaatgtcgattccccttatgagactgtaagctctgtgaaggtaaggaccgtgtctgttctgttcaaatcatgtactcagtgcctccctactaataatgcctgacctactgtcattttatagactacttgtttactgaatgtggagtgactagggccaggaacgtctgcacactgagccagcttgaaataatgacagaataaatttggcctctgtagcatgaacgttaatgttgcttaaaaatctttcttgttgaccgggcttggtggctcatgcctgtaatcccagcactttgggaggccgagatgggcggatcatggggtcaggagatcgagaccatcctggctaacacggtgaaaccccgtctctactaaaaatacgaaaaattagctggcctggtggcgggcgcctgtagtcccagctactcgggaggctgaggcaggagaatggcgtgaacccgggaggcggagcttgcagtgagccaagattgtgccactgcactccagcctgggcaacagagcaagactctgtctcaaaaaaaaacaaaaaaaaaaacaccaaaaaccctttcttgttaaaaatcgtttcctttaatcttagatctgcatttagtcattgtacgttttgcagatccatggatgattctgggtttagttctttgtgagactgccagaaactcccagaggctggatctatgcataaagagaggccattggagagaatgtctactgaattgctgaagacaattgctaccgagaatagatcgtaacttaggaagaaacaattcagtaccaaaagagtaattggagcccttctggaaaacactagtaaggtacctcaagacttgtagatgctagataaaaatagcatgctgttgaagacttttaaaggcctaattttacgttgtgcacatgtaccctaaaacttaaagtataataaaaaaattacataaataacgtttgttatagatgtaagttagggtggttttaatctatcttccccaggtaaataactgtataattatattttgataatggccagcaggtctttacattcttcaggttttctcttccagatatatgtactatctcttggtctatagatggcactctagctatcaggataccatgaaaaaaaatctgggatattggaaagggcacatttttttttgaggtcatcagggtgctcaatgcaaaccatggttgaacacttaaagatgtccagtagctgcttgaagatttcctgataaagagctacaagcaccatgttctgccagcagtcataggcacttggattttctctcttcagatttagcttcttctccttttgtcaaactgcctggacagagatgcaattgctcctggtcctagagtctgtccacagccctcaactttctagttgttatctccccagagataatatgagttgtaatcttccaaagatgctagatgtctagaatcatttccagaatgctccccggaccatcataaaaataaagcacctgctaattccccccaggactcaagtcatgcctgttcatgtatcttccattcaatttgcagcatatctgtggtttaggacagtctttctcgagtgatccatagtgaaggatgactttttgtttgttttattttcagtgtattgtggactggtactttgtgtaaaatataataaaattagttgttagaaatgtaaaatcgtaaataaaaacagacatacaaaatacaaactgcattttttattagtagattcaaaagacaaaattactctgccaatgtgctatagtagtttcttttctgacatttaaaattcagattaaactttatttaaatcagaaacacaattcttaaaaattgcatttagagtcaagatcccttttataaccctcttgttataaaaatcagaaggaatatttgtaagtaaagcagatatctctctaggttaatgagaccagatttgactttggattttgtactttaaatagattctagaagatagatgaaaaaatatgttatttacagaaaaccgcatctacctgtgtattcagaggcataaattttttgatggaaatgacttcagtacacgctggaatctcagaagcaattttcaaagagcttagttttattttcttggattctaagaatttctaaaatcctttttcatcctcaattttgggagccaaataatactttaaatgttccatatccggcaatcttatactctacagcaaggggtgcatctgcagacatactgagtgttactgggaagagagagtggagtgcctgttataaagaaatttaagtaacttagtgcaaaagttagctgaactggcccattcatcattatggcaacagcctcctcttctttattgtaattacttgtttgtggcaatgtttccatgtccaagttctccatttgcagaaaaattcactccatcttttgcacaagaaattatagcagactctccaatatgactgagatcttggcatatatgaacaaattcactagaatgcatctttattacacagctgtactcttgttctggaatttcaagttgctcaacatctagagtcattaacttcaattcacagtctaaaagttctcttgatttagtgcttcaaattctagcaccaagagatccatagtaccttcagccctccatgtagtgatgtcttcactgccattgttgtattttagcattttggacatgctggtgaggctcatgctcatggctaggttgtggtcacagtggtatgtgttgaagccctggtcacacagggttagctgcactaaggaaatgtgtgatactttcatgctgtgtaggttcacctgcttgaactgttgtcccagcaggcctatctctcacattgaatagggctgactgtgcaactaataagatgttgtggagatgacagtgtgtgacatctgaggctatgtcataaaatacattgtgacttctcactgtttctgggagaagtcagctttcatatcacaaagacactcaagcagcactgtgaagaggcgcaggtggtaaaactgaagaccttcacaaacagccagcactaatttgccaaccaaatgacggtctttggaaaacagatcctctggcctcaggcaagtcttcaaagactacagtcccagtcaacctttcactgcaacctcatggtaaaccccgcactggtacatcaagctgctcctgaattcctgactcacagaaactgtgagagaataaatgtggttgttctgggacactaggttttggggtaatctgttatgcaccaatagataacaaatagagaccagtacataaatcaatacattacttccatctgtgtgataggtgttatgatagaagtagaatacaaggtgtggtacagacagagcggatctgaagtagtagcctgttgtcttagtctgttttgtgctgctataatggtatttcacagactgggtaatttataaagaacagaaatttattctctcacagttctagaggctggcaggtctaaaatcaaggcacggtcaggttagggctcagtctctctgctttcaagatggtgccttgagcactgcatcctccagagaggagaaacattgtgtccccacatggcagaagagcaggagaggaaaggagacaaatgagaattgggctcacccttttataatagcattaattaattcatgaaggtggagccctcatgagctaaacacctccttttaggttctatcttccaacactgttgctttggagatgaggttttcaacaagttagctgaactggctcattcatctttatggcaacagccccttctttattgtcattacttgtttgtaacaatgttgccacttccaagttctccacttgcagaaaattttactccatcttttgcacaggaaattgtaattttggggacatattgaaactatggcatctaccaaattagtaactctaccgagggaatgctacaattcaagttttcatgttttccacaagcctgctataaattattacttgttgattacaaaataatcagcaaaatacaagtatttattcctttgtacatggaagcaaccaaacactttttttttggaatgaaggtctacaagtgatgacaatctatatttgtcttcctggttaagtacaactgtaaccaggggggtggactcttgaattcatgtttctctttattttttcaatgttgagaaggtaaccaacaatacatgtggccaaataaaaagctttcacataaaacatttcaaaaatttttaattcattgatcctctccttccctcacccccaataaattttttagttaactgggatgcctcctcattcacagaatgaaggacccatgctagcatttgggttactttggtggcaatgtcagctcagactctgcatctgagagttctttaaagatatgggtatttctggccaggcgtggtagcacaggcctgtaatctcagcactttggaaggccaatttgggagaattgcttaagactaggggttcaagaccagcctgggcaaaatagcaagatcctgcctctacaaaaaaaaaaaaaaaaattagccaggctttatagcaagtccctgtagtcccagctacttgggaagctgaggtggaaggactgctcgagcccaggagtttgaggttgcagtgaactatgaatgtgccactgcactctagcctgggtgacagagtgagaccctatctcaaaataaataaataaataaataaataaataaatacaagcatttcccctttccccatatatattaatactggtttatcagtctagggaaggtctgagggaattgataatgtatacaattactgtgtgttgggttctttctgcagaggacctagccttgcttcaactgatgggctctggatttgagaactgggttaggtttggaaactggataaagagattataattttctattgtggcagctgacatcagcctttggctcactcattattgatcttcttttgggtgtgcaggtcaggcagtaccctcatccatcttagatctaggcacaccatgatctattaaccatcactatagatccctgtatgtcacagccccctggtttccattcaacctttgttacctatttggataactacatctgtctttctcttgatggctaagtagtgcctcctggcctctgctgtttcataatcctatcatccctgaatcctaggggcttccctatcattatccctggtgtacaaagcatagacactgccaagcctctcaatgaggccagtgcccttcatccccagcccttgcaccactttgcatttcttattgctttagtaaaaggggtgttcccttttgattctcttgagaaacacggtcatcttctggattttcaggtctcatatgataggtccagttgaacattcccacctctctgagcctcttgacttcttccttagcactcttccaaagcatttctggaatcttcacctgatttgttgtaggccataatttcccctctgcccccaattttaaaggagctatcccagtggcacagaactgattccagatgtctttcttggggtactacttcctcagttgcaggagattgccccgatttcaacaacctctcccttatattctgctcccctggctgagcatgctcatgattgatgtctaatatggtttttctattcctgcaggtacatatgagttgggtcctatagtgattttttggtgaactggttccctagtcaagctgagatttgattgttgaccttatttattggcctagaaaccatgtagggacatgaggacatactttgaggaggataacatcatcttttatttaaaaaaaacattatttttaattttttatgggtacatattaggtatacatatttatggggtacatgagatattttaatacaggcatacaatgtgtaatagtcacctcaaggtaaatagggtatctatcacctcaggcatttgtcatttctttgtgttaggaacattcaaattccactcttttggttattttaaaatatacaacaagttattgttgactctcctgttgtagtttcaaatactagatcttattcattttatctaactatatttttgaacctattaaccatcagggcatcctctgctaccctttcccactacccttcccagccactggcaaccatcattctaccctctatttccatgagttcaattgatttagtttttacctgccatgaatcagtgagaacatgtgaaatttgtctgttttgggcctgtcttatttcattgaacataatgtctgccagtttcatttatgttgtggcaaatgacaagacttcattcttttttatggctgaatagtactccactgtatatatatatatactccattttctttatccattcacctgttgatagacacttaggttgattccaaaccttggctatattaatagtgctgtgataaaaatggcagtgcagatatctctgggatatattgacttcttcgcttttgtgtatatacctagcagtgggattgttggatcacatggtagttctgtttttagtattttaaggaaactccacactgttctctatagtgactgtactaatttacattgccaccaacagtgaacaagagctcccttttctctacatcctcaacagaatttgctattgcctctcctttggataaaagacatctcattgaggtgagatgatatctcattgtacctttgatttgcatttttttgatgatcaataatgttgagcacatttttatatacgtgttggcaatctttatgtcttattttaagaaatgtctattcagaccttttgtttattttattatttgtttaatttctattttttaaaaatatatttttatttcaacagcttttggggaacaagttgtttttggttacatggatgaattatatagtagtgaattcattttttttaaatgaaagcaaatttattaagagagtacaggaataaaagaatggaaacatgggctgttcaactgagtatacttttagttatttcttgattatatgctaaacaaggggtggattattcatgaacttcccgagaaaaaagtgggaaattcctgaaactgagggtttctcccttttttgaccatttaaggtaacttcctgatgttgccatggcatttgtaaactgtcatggcactggtgggagtgtctttttagcatggtaatgtattataattagtgtataatgagcagtgaggacaactagagatcactttcaacaacatcttggttttggtgggttttggccagcttcttacaacagcctgttttatcagcaaggtctttgtgacctgcatattgtgtcaaccctccgtcttatcctgtgactaagaacacctaacctcctgggaatgcagccctataggtcttggccttattttacccagtgcctattcaggatggaatctctctgggttgagactggcaatcatctgacatatttcccccctcccttttacaagagaacccttaatcctaagggttgttgagggacaaagatccatcttctgtaacttcttcttcaggctgaataggggcaatgatattcttgcctaactattaggatctcttgtatttgaggtagagaggagctcagtcacaaggcatccatatactgagggtcattcataactctgaattctgacaaaagatgatatctggaagattaataagtgttcaatttaagaaaacattgagtaagcttatcctgcattcctacacaaagagtacaacagcaatatattccacaacagtaaagcaaataagcaacactatcccaaataaactaaataagaaggctttccatgaactgagcaactgttgaaaccaagctgatatgggattgctagctaattccaatgtgtgcccagaactagaatattgatccaggtttttacattacctatccctcttgtttcttttgagcagcagccagagatcactgttggtttacaggaataagcaaagtcagtctaaagggcagaaaaaaaacctaaaaaacaaccgacgagactagaatatattataataacagatgtgccatagtttttgaaacataacttttctctttccagtcttccatttttactaaagacaaatcataataggacccatttgtttgcaaaagtaagctttagtcttatacttggcccgattatttgtataaagtgcagcaagaagaattatttgccacatagggttttaaaattagctttgatgtatctttgttccataaaaggaatatcagataagccttttttttttttttttaagcagaacccagcaatgggtttgtactatcaaattcgtatactttaaaggtaaatttctctcctcttcagataccaagataacttggggctcctgggcctgtcagaaagtgacattttctgcttaccacaggtcaagaacactgtacagggattgtgtagacaaggtatgaggctagttttcccaagcggcttttattggctctataagtcaagtttgattccttatgagtctccaaattcattatagcactctgtatgcctttgtgtattcatagcttagcttccacttataagtaagaacatatgctatttggttttttattcctgagttacttcacttacaataatcaatggcctccagctccatccaagttgctgcaaaaataaattgttttgttcctttttgtgtctgagtagtattccacagtgtgtatataccacactttctttatccactcattggttgatgggaacttaggttggttctatatcgttgcaattgtgaactgtgctgcaacaaacatacacatgcaggtgtcttattcatataatgacttcttttcctttgggtagatacccagtagtgaaattgctgaactgaatggtagattgacttttttttttaaagactctccgtactgttttccatagtggttataccaatttacatttccattagcagtgtataagtgttccctgttcaccacatccatgccaacgtctattgtttttttaactttttaataatggccattcttgcaggagtaatgtagtatctcattgtggtcttaatttgcatttctttgattattaatgatgttgagtatttttatatgtttattggccatttgcatatcttcttttgagaaatgtctatgtcacttgcacactttttgttggaattgtttgttttttcttattgatttatttgagttccatgtagattctggatattagtcctttgtggatggaaggtttgcaaatattttctcccattctgtgggctgcctgtttgctctgatgattatgtcttttgctgtgcagaagctgtttaatttaattaggtcccatttgtttatttttgtttttgttgcatttgcttttgggattttagtcaataattctttgccaagaccaatatccagaagagtttttccaaagttattgacgagtagtttgtaaggttttgggtctcagatttaagtcatcgatctatcttgaattgattcttgtacaaggtgagagatagggatccagtttcattcttctacatgtggctagctagttttcccagcacaatttactaagtagggtgtcccttccccaatttatgtttttgtttgcttgaagatcagttgtttgtaagtatttggcttgatttccgggttttctatctgttccattgatctatgtgcctacttttataccagtaccatgatgtttgttaactataaccttgtaggatacttgaagtctggtaatgtgatgcttctagatttgttctttttgcttatgattgttttggctatttgggctcttttttggttccatatgaattttagaattgttttttctaagtttgtgaaaaataatgttagtattttgatgggaattgaattgaatctgtagattgctttgggctgtaaggttattttcacaatattgattcttcccattcatgagcatggggtgtgtttacatttgttcatatcatctatgatttctttcatcagtggttttaggttcttcttgcagacatctttcacctccttggttaagtatattcctaagtattttattttattttggcagctgttgtaaaagggattgagttctttatttgattatcagctttattgttggtgtatagcagtgatagtgatttgtgtacattaattttgtagcctgagagtttactgaatgtgtttgtcaaatccaggagtcttttggaggagtctttagggttttctaagaatatgttcatatcattggtgaagagtgatagtttgacttcttcttttcagatttggatgccttttagttctttctcttgcctgattgctctgactaggacttccagtactatgttgaagagaagtggtgaaaatgggcatccttgtctttttccacttctcaaggaaaatgctttcagcttttccccattcagcataatgttgactgtgggtttgtcttttattggcttttattacattaaggtatgtcccctttatgccaactgtgctgagggttttaatcgtaaagggatgttggattttgtcaaatgcttttttgtgcacctactgaggtgatcatgtgatttttctttttaattctgtttatgtgatgtatcacatttattgacttatgttcaaccatccctgcatcactgagatgaaacccacttgatcatggtatattatctttttgatgtgctgttgtatttgtttagctagcattttgttgaggacatttgcatctatgttcatcagtaatattgatccacagttttcttttctcattgtgtcctttcatgattttggtatcagggtgatactggcttcacagagtcattcaatgaggattctcttttactcaatcttttaaataactttgataacattggtaccaattcattcaatgtctggtagaattccgccatgaatccatctggccatgggctttttcttggttggcagtttttttttttttaattactgattcaatctcgctgcttgttattggtctgttcagggattcaatttcttcctgatttaatctaggaggattatatgtttccaataatttatccatttcctctaggttttctagtttgtgagcatagaggtgttcatagtaatcttgaatgatcttttatatttctgtggtgttggttgtcatgtttccagtttcatttctaattgagattatttgaatcttctctctctatttcttcattaatctagatggtcaataaatttcatttctcttttctcttttctttttctttttattattttttttaagacagagtttcattctgtcatccagactggagtgcagtggtgtgatcttgactcactgcaacctccacctccaggattcaagcaattctcctgcctcagcctcctgagtagctgggattacaggcaccgaccaccacacctggctaatttttgtatttttagtaaagacagagttttgccatgttggccaggctggtctcaaactcctgacctcaggtgatcctcccatcttggccagagtgctgggattacagatgtgagccaccgtgcccagccaattatgtttgtcttttcagagaactagttttttgtttcatttattttttgtatttttttctttgtttcagtttcattcagttctgcactgatcattgttatttcttttcttctgctagctttaggttcagtttgtttatgtttctctagttccttgaggtgtgatgacaggttgtcaatttgtgatccttgtgatgtaggcatttagggtgctataaattttcctcttagcactgcttttgctgtattttaaaagttttgagaacttgtgtcattattatcattcatttcaaagaatttttaaatttctatcttgatttcattgttaacctgaatatcattcaggagtagatttttaaatttccatgtatttgtatatttcttggtgttccttttgtagtttctttctttttttattttattattatactttaaattctagggtacatgtgcacaacatgcaggtttgttacatatgtatacatgtgccatgttggtgtgttgcacccattaactcgtcatttacattaggtatatctcctaatgctatccctcccccctccccccatcctatgagagaccctggtgtgtgatgtttcccttcctgtgtccaagtgttctcattgttcaattcccacctatgagtgagaacatgtggtgtttggttttctgtccttgcgatagtttgctgagaatgatggtttccagcttcatccatgtccctacaaaggacatgaactcatccttttttatggctgcatagtattccatggtgtatatgtgccacattttcttaatccactctatcatggatgggcatttgggttggttccaagtctttgctattgtgaatagtgccgcaataaacatacatgtgcatgtgtttttatagcagcgtgatttacaatcctttgggtatatacccagtaatgggatggttgggtcaaatggtatttctagttctagatccttgaggaattgccacactgtcttccataatggttgaactagtttacagtcccaccaacagtgtcaagtgttcctatttctccacatcctctccagcacctgttgtttcctgactttttaatgatcaccattctaactggtgtgagatggtatctcattgtggttttgatttgcatttctctgatggccagtgatgatgagcattttttcatgtgtctgttagctgcataaatgtcttattttgagaagtgtctgttggctgcataaatgtcttattttgagaagtgtctgttcatatcctttgcccccttttcatggggtggtttgatgttttcttgtaaaatttgtttaagttctttgtagattctggaatattagccctttgtcagatgggtagattgcaaaaattttctcccattctatagggttgcctgttcagtctggtggtagtttcttttgctgtgcagaaagctgtttcgtttaattagatcccatttgtcaattttggcttttgttgccattgcttttggtgtttcagacatgaagtccttgcccatgcctacgtcctgaatggtattgccaaggttttcttctagggtttttatggttttaggtctaacatttaagtctttaatccatcttgaattaatttttgtataaggtgtaaggaagggatccagtttcagctttctacatatggctagccagttttcccagcaccatttattaaatagggaattagttccccatttcttgtttttgttaggtttttcaaagatcaaatggttgtagatgtgtggtattatttctgagggctctattctgttccattggtctatatctctgttttggtaccagtaccatgctgttttggttactgtagccttgtagtatagtttgaagtcaggtagcatgatgcctccagctttgttcttttggcttaggattgtcttggcaatgcgggctctttttaggttccatatgaactttgaagtagttttttccaaatctgtgaagaaagtcattggtagcttgatggggatagcattaaatctataaattatcttggggagtatggccattttcatgatattgattcttcctacctatgagcatggaatgttcttctatttgtttgtgtcctcttttatttcgttgagcagtggtttgtagttctccttgaagaggtccttcacatcccttgtaagttggattcctaggtattttattctctttgatacaattgtgaatgggagttcactcacgatttggctctctgtttgtctgtttttggtgtgtaggaatgcttgtgatttttgcacattgattttgtatcctgagactttgctgaagttgcttatcagcttaaggagattttgggctgagactatggggttttctaaatatacagtcatgtcatctgcaaacagggacagtttgacttcctcttttcctaattgaatacctttatttctttctcctgcctaattgccctggccagaacttccaacactgttgaataggagtggtgagagatggcatccttatcttgtgccagttttcaaagggaatgcttccagtttttgcccattcagtatgatattggctgtggttttgtcataaatagctcttattattttgaggtatgtcaaattaatacttaatttattgagagtttttatcatgaagggctgttgatcatagtggataaggtttttgatgtgctgctggattctatttaccagtattttattgaggatttttgcatgaatgttcatcagggatattggtctaaaattctcttttttttgttgtgcctctgccgggctttggcatcaggatgatgctggcctcataaaatgaattagggaggattccctctttttctattgattggaatagtttcagaaggaatggtaccagctcctccttgtacctctggtagaatatggctctgaatccatctagtcccggactttttttggttggtaggctattaattattgcctcaatttcagagcctgttattggtctattcagggattcaacttcttcctggtttaatcttgggattgtgtgtgtgtctgggaatttatccatttcttctagattttctagtttatttgtgtagaggtgtttatggtattctctgatggtagtttgtatctctgtgggatcggtggtgatatccccttcatcattttttattgtgtctatttgattcttctgtcttttcttctttattcgtcttgctagcagtctatcaattttgttgatcttttcaaaaaaccagctcctggattcattgatttttgaaaggtttttttgtgtctctatcgccttcagttctgctctgatcttagttatttcttgccttctgccagcttttgaatgtgtttgctcttgcttctctagttcttttaattgtgatgttagggtgtcaattttggatctttcctgctttctcttgtgggcatttagtgctataaatttccctctacacactggtttaaatgtgccccagagattttggtatgttgtgtctttgttctgttggcttcaaagaacatctttatttctgccttcatttcattatgtacccagtagtccttcaggagcaggttattcagtttccatgtagttgagaggttttgagtgagtttcttaatcctgagttctaattttattgcactgtggtctgagagactgttataatttcttttcttttacatttgctgaggagtgctttacttccaactatgtggtcaattttggaataagtgcgatgtggtgctgagaagaatgtatattctgttgatttggggtggagagttctgtagatgtctattaggtccacttggtgcagagctgagttcaattcctggatattcttgttaactttctgtctcgttgatctgcctaatgttgacagtggggtgttaaagtctcccattattattgtgtgggagtcaaagtctctttgtaggtctctaaggacttgctttatgaatctgggtgctcctgtattgggtgcatatatatttaggatagttagctgttcttgttgaattgatctctttaccatcatgtaatggccttctttgtctcttttgatctttgttggtttaaagtctgttttatcagagactagggtggcaacccctgattttttttgttttccatttgcttggtagatcttcctccatccctttattttgagcctatgtgtgtctctgcagatcagatgggtctcctgaatacagcacactgatgggtcttgactccttatgcaatttgccagtctgtgtcttttaattggagcatttagcccatttacatttaaggttaatattgttatgtgtgaatttgatcctgtcattatgatgttagctggttattttgctcgttagttgatgcagtttcttcctagcctcgatggtctttacaatttggcatgttttttccagtggctggtactggttgtttctttccatgtttagtgcttccttcaggagctcttgtaaggcaggcctggtggtgacagaatctctcagcatttgcttgtctgtaaaggattttatttctccttcacttatgaaacttagtttggctggatatgaaattctgggttgaaaattcttttctttaagaatgttgaatattggcccccactctcttctggcttgtagagtttctgctgagagatcagctgttagtttgatgggcttccctttgtgggtaacccgacctttctctctggctgcccttaatattttttccttcatttcaactttggtgaattcgacaattacgtgtcttggagttgttcttctcaagaagtatctttgtggcgttctctgtatttcctgaatttgaatgttggcctgccttgctaggttggggaagttctcctggataatatcctgcagagtgttttccaacttggttccattctccccatcactttcaggtacaccaatcagacatagatttggtcttttcacatagtcccatattttttggaggccttgttagtttctttttactcagttttctctaaacttctcttcttgcttcatttcattcatttgatattcagtcactgataccctttcttccagtagatcaaattggctactgaaggttgtgcatgcgtcacgtagttctcctgccatggtttttagctccatcaggtcatttgaggacttctctacactaattattctagttatccattcgttgaatctttttcaaggtttttagcttctttgcaatggattccaacatcctcctttagcttggataagtttgatcgtctgaaggcttcttctctcaactcgtcaaagtcattctccgcctagctttgttccattgttggcgaggagctgcgttcctttggaggagatgaggcgctgtgatttttagaattttcagcttttctgctctggtttttccccacctttgtggttttatctccctttggtctttgatgatggtgacgtacagatggggtttttgtgtggatgtcctttctgtttgttagttttccttctaacagtcaggaccttcagctgcaggtcttttggaatttgctggaggtccactccagaccctatttaccagggatcaccaatggaggctgcagaacagcgaatattgcagaacagcaaatgttgctgcctgatcgttcctctggaagcttcgtctcagaggggcaccttgttgtgtgaggtgttagttggcccctactgggaggtgcctcccagttaggctactcaggggtcagggacccacttgatgaggcagtctgtccattttcagatctcaagctccatgttgggagaaccactactctcttcaaagctgtcagacagggatgtttaagtctgcagaagtttctgctgccttttgttcagctatgccctgcccccagaggtggagtctacagaggcaggcaggcctccttgagctgcagtgggctccacccagttcgagcttcccggctgctttgtttacctactcaagcctcagcaatggcgggtgcccctgtagtttatttcaagttttcttccaccacgcctggcttcattctgccaatctgcgaagatacttgatataattttgatattttaatatttattgagacttgttttgtggtctatcatatgacctatcttggagaatgttccatatgctgatgagaagaatgtatattctgcagttcttgggtagaatgctctgtaaatatctgttaggttcatttcttctagagtgtagtttaagtctgttgtttctttgtggactttctgcctcagtgatctatctagtgctgtcagtgggatattgaagtcccccattattattgttgatgtctatctcatttcttaggtcaattagtaattatttttttgaatgtgggagctgcagtgttggtgcatacagagttaggattgtaacatcttattgttggaatgatctttttatcattatataataatcctttctgtctttttttggttgttgctttaaagtctgtttcatctgatataacaatagttactcctcctcacttttggttttcatttgtgtggaatatcttttaccatccctttactttgagtttatatgaatccttatgtgtatgtgggtttcttgaagacagcagttatttagtttgtgatttttaaagtcagttctgccaacttacattattattattttttgagacagggtctggctctgtcacccaggctggagtgcagtggcaagttcatggctcactgcaacctccaccttctgaggtcaagccatcctcccacctcagcctcctgagtaactgggactacaggtatgtgtcaccatgccaagctaatttttgtatttttggtagagatgggtttcaccatgttgcctaggctagtcttgaactcctgggctcaggcggcccacctgctttggcctcttaaagtgctagaattacaggtgtgagtcaccacgcctggcctcattctgccaatctgtatcttttaagtggagcgtttaggccatttacattcaatgttaatattgagatgtgaggtactgttccattcaccatgttaatttttacctagatactttgttttttcattgtgttgttttatagcccttgtgaattttcaggaggttctattttggtgcatattgagcttttgtttcaagacttagaacttcttttagcatttcttgtggggctggtctgatagtaacaaattcactcagcgtttgtttgtctaaaaatgactttattttttcttcatttataaaacagttttgctacatacagaattcttagctgacagttattctgtttaaggaggctaaagataaatccccaatcgctctggcttgtaaggtttttgctgagaagtctgctgctagtctgacaggtttttctttataggttacctaatgcttttgtctcactgctcatagaattctttccttcatattgattctagatagcctgatgagtatatgccttggtgatgatgtttttacaatgaatctcccaggagttctttataattcttgtatttggatgtctaattctctagcaaggccagggaggtttccctcaattattccctcaaataaattttccaaactttttgctttctcttctccctcaggaacaccaattatttttagatttgaccattttgcacaatcttatatttcttcctgactttgctcatttgtttttattcttttttctctatttttatgtgactgtgttaatttgaatgccttgtcattgagttctgaagttctttcctctccttgttctagtctactgttgaaactttccactgcatttggtaattctgtaagtgtgtctttcatttccagaagttctgattggcttttcttcaatatatctctctctttagaaaattttttatttatatcctgaattttaaaaaaagtttctttatattggttttcacctttctctggtatctccttggatagcttaataatcaaccttttaaattctttatcttgtacttcaaagatttaatcttggtttggattcattgatgaagggctagtgtaatgttttgggggtgttatagaaccctgttttgccatattaccagaattacttttgtagttccttctcatgtttgtagactatttttcatgattatccttgaatttatttttgctttgactgtttttttaaatttctttttcccaccttaaggttgtgacttttatgtttatagtttactgtagcataacttggctcttggtgctctcaggggtgaagactctctatgagttacttagttacagagagtctttgtgtgatgaatttctcagatgctggttgtagcagcaatgtgctcagtgtgtgagcaagttcaccctctcctatagtgttgaaatggcagaggtctcttgaagcttatctaattcccccatgttgtacacttatttattatttttttcccacagtattatatttactgggttgaatagttcaggcttcagcccagtaggagagctttccacaggtgaaagccagctgtggctaaagcaggtgggtaaatgcaatacctaatggtgggcagaggtcccagacttgacagatgtgactgggggagcactcagtgaaatacactgaggtcttctcagagagaaggaccagagccacttcacctcccctgccaggcccacaggaaagctgttcacctctcagacacactcctgacccagtgttctggctattcaaatcagagaggtacctcctttcatctgcaggaatattgatgttccaagtggagagaaactgtgactctgcctcctgtgtaggcctgcatttggagggtgctccttctgtggggatgcagtcaccttgaagtgttccagagaggtctgtaggtgcatccataccgagctcttgtgagaaaagccccagctgtatctacagtggtggataaggggaaaaagaaatcttctccaagactcttcatgagcaccagggctgcctgattgtggaggtggagctgcacactttccctgctgagcccagtactgccaactgtgcctctgctgaaagagacttcccaccagcagaaagatttgggactcaaggcctgctgtctggattcttttgtcttaggcgagggtctagctgcccattccaggctggtgcaggtgaatgtttgcaagaggtctagagatatgacctgtgattaagtctcccagcagtgggtaccagtactagtctgatgggggtgccaggggagtgacatagactcagtgagattccttgtttatagatagccttagtgtgttggctttctcaaatgctctttgtagtagtaatgaagagttcacatggacagactcagggcctcctggttagccagagtgctgcaggcgatggtgatagctgaggtcatgcacaagttttatccttcctgggtgcaatgttattctaccttgaaatgctataatgctgtgttgattggcctccagccaggaggtggcacttgcaaaagagcaccagttgctgtagtagcagtgggatttttgtttgccttatgttacccaggagcagtaatctggtttttcatgtgataggtagggccataaagcttccaaaagtttctatcctttgttttaagctaccagggctagtgaagggggaaagtgaggttggggttttgtcaggcaggctcgtgcttttactctccacgtgtggagcagccctggtgtgagttgtggggtggttctctggctactgggataacgttccagagagaagcattactgcttctgctgcacagaagtgtttgtgcagggagtgaggagtaacagatgccagtaaaactcacctagctcctcagcacttggtaagccatatctcagacccgcagttttctgctagtagcagcgagctaagttccaggcatctatgctcagaactcaagacttacccagccgtacactttcccagtggagagggcaaccatggctttgaggccttgcccctccaagttttcccacagagccagggtgtctagctcctgtgctcatggatgcagcacacttgccacttgccccttggttctgtccaaggatgttcttccccacttgaggttatattgtgaaattcagttgagagcttctttcaaccagtgactactgcctgagtaacttggcagacttccatgaggtcccctatgaggcaaaataaggaatagcttcccctagtttgtcctggacactgggaataaattgaaggatccttctgctgccatttctacttttagttttctcagtgccccctaaatgagttccagtgctgagtagcactaatgccttccctcttggcctggatttccagtttccccagtgggggtgtatatcctggaggcagtctctcactctctcacactccggagacttacagttttccacctggctcatggtgtaggctacagcctgtcacttcttttaaataatctacgaatttcagtttccctgttaagttcctgcattgcttcttggaaaacagttcacagcatgaacatctgcacactatcatgtctttccaagtgggagaggcatgctaacactgcctccaatctgctatcttggaagacaaaaatcttttgcccattttaaaattagattattagatttttttttctattgagatgtttgagctccttatgtattcttgttattaatcccttgtcagatggagagtttgcaaatattttctcccattctgtgggctgtctcttcactttgtcgattgtttcctttgtcgtgctgaagcattttaacttgatgtgatcatttctgtccattttgctttgtttgcctgtgcttttggggtactacttaagaaatttttgcttagaccaatgtcctggagagtttccccaaagttttcttttggtagttttgtagtttgaagtcttagatttaagtctttagttgattctgatagatttttgtatatggtgaagatagagatctaaatttattctgctgcatatgcatattcagtatttttgttgttttttgagacaggctatcactctgtcaccaaggttggagtgtggtggtaggatcatggctcactgcagctgtgatcttccaggtgcaagtgatctttccatctcagcttcctgagtagctgggactataggcatgcagtaccatgcccagctaattaaacaaacatttgtagagacagggttccacactgtttcccagactgatctctaactcctgggctcgagtgatcctcccacctcaggcttccaaacattttttttttcttttcaactttaattttaggttcaagggggtacatgtgcaggtttgttacatgggtaaattgcatgttgtgggagtttgttatacagatattatattatcttatattatatattatattatattatatattatacaaagaattatgtcactcaggtaagcagcatagtactgataggtagtttttttattattatgctttaagttccgggatacatgtgcagaatgtgtaggtttgttagataggtatacatgtgccgtggtggtttactgcacctatcaacccatcatctaggttttaagcccagcatgcattaggtatttgtcctaatgctctccctccccttgcccccaactcttcaacaggccctggtgtgtgatgttcccctccctgtgtccatgtgttctcattgttcaactcccacttatgaatgagaacatgcagtgtttggttttctcttcctgtgttagtttgctaagaatgctggtttccagcgtcatccatgttcctgcaaaggacatggacttatccctttttatggctgcatagtattccatggtgtatatgtgccacattttctttatccagcctatcattgatggacatttgggttggttccaagtcttcgctattgtaaacagtgccataataaacatacgtgtgcatgtgtctttatagtagaatgatttataatcctttgggtatatacccagtaatgggattggagggtcaaatggtatttctggttctagatacttgaggaatcgctgcactgtcttccacaattgttgagctaatttacagtcccaccaacagtgtaaaagcattcctagttttcctcatcctctccagcatctgttgtttcctgactttttaatgattgccattctaactggcatgagatggtatttcattgtggttttgatttgcatttctctaatggccagtgatggtgagctttttttcatagatttgttggccacataaatgtcttcttttgagaaatgtctgttcatatcctttgtgcactttttgaagaggtttttttttttcttgtaaatttgtttaagttctttgtagattctgaatattagacctttgtcagatggatagattgcaaaatttttctcccattctgtaggttgcctgttcactctgatgatagtttcttttgctgtgcagaagctctttagtttaattagatcccgtttgtcaattttggcttttgttgccattgctttggtgttttagtcatgaagtctttgcccatgcctatgtcctgaatggtattgcctaggttttcttctagggtttttatggttttagattttacatttaagtctttaatccatcttgagttaatttttgtatagggtgtaaggtgaggggtccaatttcagttttctgcatatggctagccagttttcccagcaccatttattaaatagggaatcctttccccatttcttgtttttgtcaggtttgtcaaagatcagatggttgtagatgtgtggtgttgtttttgaggcctctgttctgttccattcttctatatatctgttttggtaccagtaccatgatgttttggttactgtagacttgtgtagtttgaagtcagatagtgtgatgactccagctttgttctttttgcttaggattgtcttggctatatgggctcttttttggttgcatatgaaattcaaagtagttttctctagttctgtgaagaaagtcaaaggtagcttgatgggaatagcattgaatctatatattctatatattaccttgggcagtatggccaatttcacgatattgattctttctattcatgagcatggaatgtattattattattatagtttaagctctagggtacatgtgcacaacatgaagatttgatacataggtatacatgtgtcatgttggtttgctgcacccatcaacgacgtcatttacattaggtatttcttctgatgctatccctcccccagccccccacctcctgacaggccccagtgtgtgatgttccccgccctgtttccaagtgttctcattgttcaattcccacctatgagtgagaacagagcatggaatatttttccaattgtttgtatcctctcttatttccttgagcagtggtttgtagttctccttgaagaggtccttcacctcccttacaagttgtattccgaggtattttattttctttgtagcaattgtgaatgggagtt

SEQ ID NO: 51 - DNA, 196151 bp, Homo sapiens
ctgccccttgttgcctccagggactatgaaggtgaagatgtacctagaagaccctcgagatgaaaagcagggagacagcaggaggggaaggaaagggtctgaggggctcaccaattctttgtgctccttggtgagactggagggcagggtgtccatgtaggaatccttcaggggcttccagcctagttgatggggctccatgtagatcatcccacacctgggaagcacagaggaccagtttaggtgctcgcttctttgttactaatacgggttaacatttattgagcaatctactgcatgtcaggcaccatgctaggcattaatggatcttgacaataacctagtcccctgggtttacccacgttgaatcttgtgttcatctgccccttgatttctttccttcatatacagttttatagcatttctatatgttcctaaaatgtttatttgtttgtttggagacagtgtcttgctctgttgcccaggctggagtacagtggtgcaatcttggctcactgcaacctccgcctccctggttcaagtgattctcatttctcagcctcccgagtagctggaattacaagtgcgtcccaccacacctggctaacttttttgtatttttagtagagatggggttttgtctttagtagagacagggttggccaggctggtctagaactcctggcctcaagtgatccatccacctgggcctcccaaagcgctgggattacaggtgtgagccacctcgcccggcctgttcctaaagtgtttatatttttattttagttgtttttaacaattaaaaaggggtaccatgttatagataatattttgatcttacttttattattactatataataataatatagtatataatagcatataaccatacagtatatatattattatatattagcacataataatatagtatatattagtatatagtataacattatattatatataatatactgtaattatagatataattatgtaattatagatgtaattatagatataacatatttatagatgtaattatagatataatatatttatagatataattacattattacattatctgtgttctatataatattgctaaggttttgtccttaatagagttactaagatttatttatatagttgcatgtcagtgcagttcttttgagtactttattatacatattacaatttctgactctattatactttattaattcactcttttgttgttgttgttgttgttgtttgttttttagatggagtcttgttctgtcgcccaggctggagtgcagtagtgtgatctcggctcactgcaacttttgcctcctgggttcaagcaattctcctgcctcagcctcccaagtagctgggattacgggcacccaccaccatgcttggctatttttttgtatttttctgtagtagaaatgaggtttcaccatgttggccaggctggtctcaaactcctgacctcaggtgatctgcccgcctcggcctcccaaagtgctgggattacagcataagtcatcgtacctggccaccaataactcgattaacaggcatttgggctgtttccaagtgcttgttactgtgagttctgccactatattttttgtacagatctcctgttgcacatgccaaaagttttccttgggcctgtacttaggagaatggctggctcttgggcatacggagattcaactttaggagataatatcaaactgtttccaaagtacttgctgggttttagactcccaccagtagtgtggactgagggctgattttatgacaaatctaaatgaatgacaaataatataatgctaagcaaattaacgcaggaacagaaaaccaaatcccgtatgttcttacttataaatgggagctaaacattgagtacacatggacacaaagaagggaacgattggctgggcacggtggctcatgcctgtaattccacactttgggaggctgaggcaggcagatcacgatgtcaggagtttgagatcagcctggccaacatggtgaaaccccatctctactaataatacaaaaattagccgagggtggtggcgtgtgcttgtagtcccagttactggggaggctgaggcaggagaatcgcttgaacctgggaggcagaggttgcagtgagtcgagatcatgccacgggactccagcctgggtgacagagtgatactccgtctcaaaaaaaaaaaaaaaaaaaaaaagaaggaaatgatagatatgggagcctacttcagggtggaggagggtgaggatggaaaaacaacctgattaactgggtgactaaacaatctgtaccccaaacccccatgccatgcaatttactcatgtaacaaagctgcacatataccccctggaacctaaaataaaaattggaaagaaaaataataataatgtagatgatctgcgagggcttcatcacatttgtgaaatttgagagctttctcttttgcttagggtgagtggagccacactgtcccccggggtgccagtgagggctgcctcacctgctcacagtggctggagaggcttgctcgaggtcggcgggctcgaagatcaggctcatcttggagttcatctggataatttccccactcatgagacacagctaaaagtgcaaagcagagggtagcagacaggggaaaggcttaaattccatctgcaagtaagaggtctcagtgcagacaaagctggtttgattcattccataaatatttcttgagcacttatgatgtcccaggcactgttatgcactaactcctaggtgcataaaataaaacacaaaatttcctatcctcttggggtttacattcttctgggagatgacagacaataagcaaaatatatagtgttcgaagtggtgaaaagtgctctggagaaaaatttagtagaagagggggttgcatctacacatacatatatctacacatacatatactatatagatccacacctaagtgtgtatttatttagtgatggccttcctacttcttaaaaaaatgtgtatagggaaagtcacaaataaagtataacaaagaggctgagcatggtggctcacgcctgtaatcccagcactttgggaggccgaggcgggtggatcacttgaggtcaggagttcaagaccagcatggccaacatggtaaaaccctgtctctactaaaaatacaaaaattagctgagcatggtggcacatgcctgacctcagtcagggttgagtgagctgcaattttaataggaaagccagggaatcactgaccttagatgcaatctcagatgaagaatcgagaagttatcagacctcaccaagtttcctggtccctttctcaatatttaacatagaacttaactgcaaagccacatcctatttttatttgctcaattctttcacaaaagacccatatttgaacacccgcatggactaatccatagcaggagggacaaaagcctttccataaattctttttatttttaatttttatttgcttttgagacaggtgttgctctgttacccagactgaaatacaatgacacatttgcaatcactccatcctcgacctttggggctcaagcgatcctcccacctcagcctcctgagtagctaggattacaggtgtgtaccttcacacgtggctagttttttattttttgttttttgtttttagattaaatcaatgtttccataatatattttttaaaattttttttgtagagacaggatctcactgtgttgcccaagctgatctcaaactcctgggctcaagcaatcctcctgtctctgcctcccaaagtgctaggatcacaagcataagccaccgtgcctggcccataaatcttttttagaatagagtgaaagaagctaggcacagtggctcgtgcctgtgatcccagcacagcactttgggaggccgaggaaggcagatcacttgaggtcaggagttggagaccagcctggccaacatggtgaaacccaatttctactaaaagtacaaaaaaaaaaaaaaaatagccgggcatggtggcacgcatctgtaatcccagctactaaggcaggagaattgcgggaggtggaggttgcagtgagctgagatcgtgccactgcacttcatcctggacaacagagggagactttgtctcaaaaaaaaaaaaaagaaagaaaaatcatcagaatttctagtgtgtagcaagtaaaaccctgtaggaagtagtgcaattacacaggaaagccttggaatatatactaagtcaatgacactgtttcctactcacgaaaatggattccagtgagatgtttaagttataagaaaggcctgaggcccttgtctcccaggggagaagaggaaatacgactgattcattctgctcatcctaatttgtgattaaaaacttccctgcatcttacttggcctgcatcaaacacaacttgaaacaggtcactgcctgcatccccaggaagatcacagctgttacaaggctgacaccaccaaccgcgtcatctctgaatataaagaaagctaaaacagacccacacctgtgactgtagtttcatttacatccagagcagaggaaaaccattaggaaattcacttattatgactctcttgatacttctaatctcaagaccaaccgatacatctgtacaattagtttatataatatagtccatatcatgtaataaaacatttccatttttgaatattatataatcaaaattatgcacatgctataattagtggatgtgtataatttggataattagccctttcgttgttgagcatgactcactcttagtcttgtgacatttaaacacagttagaaaatatattttgatttgataatgatgtatatccagtgaaggaattcttccttgagatgatgataaattttattttaaacagttatatagcacttgctatatgccaggcaccatcagaagaggtgtataaatagtaacttatctaatcttcgtaacagtataaggtagacgctatcgtccctactttacagatgatgaagttggggcatcaagagactaaatagcttgtctgaggttacatagctggaaagtggcaaggccaggatttgaacccaggctctctggctccagagtccaagctcttttagccaccatacatactgtggcgccatacttactgtgttatcactctactctacttatttttccaaagattggtggtatttttgcaaagattgctatattttccaaaggtcctggcatcagtttggactcctaactctactattgagctgtgttgtgttgggcaagttacataaattccatcccatatgcccccactttttttttgagacaaggtctttctctgttgctcagcttggagcacagtggcacaatgaaggctcacagtagccatgacttccagactcaagggatcctcacacctcagcctcctgagtagcaggactacacgcacttaccaccatgcccagttaattaaaacaaattttttttttgtagagatggctcactgtgttgctcaaactggtcttgaactcctgggctcaagcaatcctcctgtctcagcctctagaagtgttaggattacacgtgtgagcctatagggcccagcccatatgcacttttgcaatgtgacctgtctgcctccatcaagaggtgaagtctatttttccacttcctggtcaggccttgtgagttccttgaccaacagaatgcagagaaagtaatgcttatcagtttcaagcatagctcttaatatcttggaaacttccacttcctgactcttggaaatcacccaccacataggaagcgccactaccaagacaccaccaagtgaaaagcccaagccatgtgaagtggcctggaagaggaggtattatttttagagagaaagaaaaagagagagagaaagatgggccaaatatgattgtgccaccaggcattgagtgaagacgccatcttgaatgcggattttctagcctgagctgccccagctgacatcaaaagagagaccaactggccagctgagccctttcaaaattcccagcccacaaaatcatgaggaaaagaaatggttgttttaagccgttaagtattagggtagtttgttatatagcaataagtaaccaaaacatatcccgcaggtactatgtgcaatctcatttaagtatcaacaacctcattttattactacctttctacaaatgagaaaactgagattcagagaagtgatgtgacttgctcagtacaacacagctcagttgcagggctaggagtccaaactgatgccagcactaaggctcactattcaacgtggtctctaaacatgcttagcttaccaactacaagtacaaacagagcataattcatgaattgattactataatcctcctgtggggcatttattcttaatgtatacagaatacatacataataaatgtatgtctctatatagttttgatcaatcacttacttcaataaaagagtttatgtctcactcatggaaaagtcatatcagggtcaatacttacctttttattgtcatccagaacagtgttcatattttcaatccaaatagcatccactggcccatcaaatataatccacttgcgatcatcagagagtgaagacgcttgctcccggaaagcattggcaaggacaccatccatccactcgtggctcacttggtcaaagcacccatacagctgccccatcgtgatagccttggggttgatgatcttgtactccacagcaaactcctccatctgattggctgggcaagaaggttcaacaccagttataaaggctctggtgagaccagaaggttaaacaagagatgatgtcatctcaacaaccaatcaacttttataaatatgccatatgagggaagtccttcttataaaacatgtgctcagtttttatagagattgggatctggggccaggagctgtagtagctcacacccataatcccaatactcagggaggccaggatgggaggatcacttgaacctgggaaatggaggctgcagtgagctatgattgtgccaccacacttcagcctgagcaacagaatgaagccgtctctcaaaaaaaaaaaaaagactgactgagacatctggataggcaatgccttacattattgggttattatagcctttgatttctcaccatactttcttccaatcctcttttcaaatagggcaaatgtgccagtcagatccaggactacttgctgggcacagtggctcacgcctgtaatcccagcactttgggaggccaaggcaggtggatcactagaggccaggagtttgagaccagcctggccaatatggtgaaaccctgtctccactaaaaatgcaaaaattagctgggcgtggtggcgcatgcctgtaaacccagccattcgccacttgggaagctgaggcaggagaaacacttggacctgggaggtggaggttgcagtaagctgaggccatgccactgcactccagcctgggcgacagagtaagactctgtctcgaaaaaaaaaaaaatccaggactaaagaaatctgactgccctcacagaactcaagcaggaagggagagtgacgcctattatcagccctctatgtacctgctctcacagccaccctaagaaccttggcttttcaaactcaaacaggctgaaggaagaaattaaaaatgaaaagaacagatcagaaccttggctttgatttgaaatgaggaaacgggaaacagctgacaggtaaaaaggttctgaaaaatgatggttacttttctgtctctgaagggctagtttggccccgaaatcgttcttgactgctcagtgagtgtcatttgttcccaagaaatacacgctggagtattaaaactcaattggaacgtacaggctgatggatggcacagcatatgtatttaataacaaaaaaaaatcacaatgcttttatggaatccttcaaagtagggaaaagttgaagtgcttgagtcatgaactaaataaagaaccacctctgggccaggtgttgtggctcatgcctgtaatctcagcactttgggaggctgaggcaggaggattgcttgagctcaggagttcgagaccagcctgcgcaatatggcaaaaccccatctctacaaaaaatacaaaaattaggcgggcatggtggtgcatgcctatgatcccagctacccgggagcctgagataggaggattgcttgagcccaggaggcagaggttgcagtgagccgagactgtgccactgcactatctctaaaaaccattaaaaataattaaataaataaaaaagaactactctgcagcatcctgaggcaaacacagtggtagcctcctttttcttcactcagtttcttaaggtatattaaaatggtatattaaaggtatatttctttaaggtatattaaaatgctaaaaatattttatattttattatattctattattttattttgagactggatctcactcacccaggctgcaattgcagtgcagtgcgcaatcatagctcactgcagccacaaactcctgagctgaagtgatccgcccgccttggcccctcaaaatgccgggattatgggtgtgagcccctgttccctgcctcaaaatttgtatctaaatttgagatgcccaaattagttattaaggctaggataacccccaaaacataacctcaaaaacccaatcatcaaatgttattagaaaaaaaattttaaatgaaaaacttgaagcaatgcatgcacgaaaaggaaatgcttttatgaaactataggtttgtgttttataaaaacaaaacaaaacagacacacacacgaaaaaacccacaactgtttctctggcaggaaacatagtttccatttgttgcgtaggcactgtgctcagttatttacctgcatgctgttacttaattctcataacaatcccattttacagctgggaaaacagaggataacacaggtttagtcatttgcccaagtctgagtctgattcaaaagcaggagctcctatccttgactttaaaaggaaggaaagaagaaaagaagggaaggagggagggaaaaaactaaagggaagggaacaggaaaagaagagaatagaagcaaagaagcaaaaccatgcagtgatttgcttttagactaattttaaggccaatgacaagagtttctctttcactgggggacctttggagaaaccactgctcagcatttgagacaattcctccaggccttaatgatatgcacatgaaatcccttgttattatagaagcaccccgcccccaaccctttattttctgcttgcagacatctgtgtgccatgttctatttctagctctgacgtcacgatcgaggcctgacaagactagcagcctggcattatctccatggagccagccaactgagcgaggagttctgtcctccctggaagccagggatgtgagctttacctgcgtgtaaatcgccgagagctgcagccaacactttataagcagaggtcttgccgcccatggggtctcctacaatcatatagccatgtctcaccagcatcatttcgtagatctgggaggagacatcattcataaaagaagctaatcattgcaacgctcccccattgtgagttagtcagaagtcaatgaggaatgaggggtcagaagaggattctcacagttgcttctacctctggagaacttcggttcttttcatggtctattgtttacatatctttcagacgaaaaaatatatgtgtgtgtctcagattatttaagggatgggaactaccatttgctctgtacttgtctatgtgttaagaatcaactgataacccaaattatttaatctactccaatatcattgaccaccttttacaaagggtaagactgagcccaagagaggttaaatacttgcccaagttcatcagtgatggagccagaatttgcagacagggctatttgactttaacgcctctaatattttcatgacactattgccatttatttttaaagagaaaaagaaaatggcggtcattttagcaaattgtgtttctcctggaaactttctttcttgagatctaactgctttggtcatttgcatttatgtgaattttatggtttaaacaaatttgctcctttagactgtgactccctcagagaaagggaacacaagcagctttgtattttaaagattaagttcttattatttttcaccttggaggtgagtaataagaagcatctaaatgaaggtagtgacaacgggagtggtagagaaaggaacacatgtaattcagcaaatattttttgagcatctactatgtgccagacactgttctgggtgctgtagacagagcagagaacaaaacaaacaaatccctaaccattaagtagggttgacattcaggtaggtttgaaagctactgtttgaaagttacagagcagagaacaatacaaaatccctaaccattaagtagggttgacattcaggtggtttgaaagcttgactgtgcatcagaaataagagaggaaggctgggctgggtagctcacacctgtaatcccagcactttgggaggtcaaggtggggggatcatttgaggtcaggagtttgagaccagcctggccaacatggtgaaatcccatgtctactaaaaatacaaaaattagccgggcatagtggcacatgcctgtaatcccagctactcgagaggctgaggcagcagaatcgcttgagcctgggaggtggaggttgcagtgagctgagatcacgtcactgcactccagcctgggtaatggagggagactgtttaaaataaaaaacgaataagagaggaaaacattaaagattcaatagcctctcacattcttcctcacattgagacatcaataagtaaaagggcaggtagctccagaacccttgtttttgaaaatattaccttgtttttgtaaattggtactaagctacatgaaagttcatctgtagatccgcaaattactttgaaatatatcaaaaagtaagatggatggatggacggatggataaaaaataaaacaaatagtataaaatattaattgtaaaatctgggtggtgagtacatgaatgttctgcgtacgtttcgttcaatttttctgcatgtttaaaatttttcataataaaatattgaaaattaaagttcatgcctagttaaagaatggtccttctgcaaaatctcaatcataaattggggttcaaaattgggttaaatgagttgtgtcaaaaattagctcacttgctaatacagtaggaaaaagaatgattgtttttaccacaaggcagtgtgatctcagaatctggagacctgggtcctaacttcacttgtaactcacattgtgactttgggaaatgatgatgccaatggtgctgctgatgatgacggagatggtggagttgataatgatatagtatcaggtactatgtgtagcactttacacacctcttctctcaaaatgactccattttacagaggactgaggataaaagaggtgaactaatttgcctaaaatctcacagcaaaaaatgatgggatttgggaggctgaggtgggtggatcacctgaggtcaggagtttgagaccagtctgggtaacatggtgaaaccccatccctacaaaaagtacaaaaattagctggggggtggcggcacgcacctgtaatgtcagctacccaggaggctgaggcaggagaatcgctggaacctgggaggcagaggttgcagtgagccaagattgcaccactgcactccagcctgggcaacagagcaagactgcatctcaaaaacaaacaaacaaacaaacaaacacaaaaactgatggagtaagtaagtgggttttttggttttggttgtttgttttacctccatttctttcttcttttttttaagagtcagggtctcactctgtcacccaggctggaatgcagtggtatgatcatagcccactgcagcctcgaactcctgggctcaaacgatcctcccacctcagcctctcaagtagctgggactacaggcataggccattacgcccagctaatgttttacttgcatttctacacaggcacctctgattgctgtcacttcagttccaatctcctataagactttactgtttgctgacttcagcaaacagtaaaacaggcacatttatatgggctaaggaaccaacctggataattttccctataaaccaaggtactggctggagtttcatctttttgatgttatcattcagcactttcagaaaaacttcatagtctggctttggaagaacaactccaggaaataaatcagatataattccctgttaaaaagaatttaaaagaaagtggaaaggataaagtatcagatatatgacctcaacattttcctaaaatgagatgtatcaacaacagagatctttgaaaaattccagaccttatttttcttgcaccaaaacttttctacaattacaaatgaaaatgctatttataaaacataatttctggctaggccagaatccctgtgtaatccctgcactttgggtgaccgaggtgggtggatcacctgagttcaggagttcgagaccagcctggccaacatggtgaaaacccgtctctactaaaaatacaaaattcagctgtgcatggtggctcatgcctgtaatcccagctattcgggaggctgaggcaggagaatcacttgaatccaggaggcagaggttgcaatcagtcgagatcatgccactgcactctagcctgggcgacagaacaaaactccatctcaaaaaacaaaacaaaaacaaaaaaaccgtgtaatttctcccccaaataattttaaaagtcagcaaatatttaataagtctggattatcttccagtcactgtactaggaatgaacaagatagtaatgacttctgtccttatgaagctcagagcctggcaagtaagattaaattaaattacaaaaggaaactaattaaactggataaaaacacatatgtatacccaagagcaaatattatcctatcagtgaaaccatttttattaaaaatcaggcagagatgtttgctatctatcactcttattatttaacatttgcagggagggtatcaggtggcagagatgctggccaaagaatggaagatggaagagggtatggggaaggcaccaaacacaacatttcatcttccaacattgagccttggtcctcggccaaggtcctgaaccgctacatacctgaaacagagggacatcttgcgctaagaacttggccagattgacatcaagcaatgcccggagcagcaggacactttcattctcctctggatacttgagcttcaggtttcctgcggcagtaagcacagacttgacagcgcgcataccgtagtcatagtgatgctgagaggacagttgttccgagcacaggcggtaggtcgcaacgatcttctgggcgagactagaagggcaaagacatgtatgcggacacccagagaggactacgtcctgcccagcagacattcccaatatccttgtccttgccccgtcagcaaccaggcatgcccatggacttgatggagaagccctatcctttaaggatattttaatagagttaccataatgtggtatggaagcatgaaaaaaagcaagtgaacatatatgtataacatgtatggtatatgaaatgatacgtttttggccaagtgcagtggctcatgcctgtgatctcagcactttgggaggctgaggcaggaggatcgcttgaggccaggagtccgaggccaggagtccaagcccagcttcagcaacatagcgaggctctatctctacagaaaaattaaaaaatgagctgggcatggtagcatggcacctgtcatcccagctactcggaaggctaagggtgggaggagctcttgagcccaggagttcaaggctgcagtgagctgtgattgcatcactacactccactttggattttcagatgagattggctgcgttcagtgtggtatggctgtagactcattttggattttcagcgagtaaaaaataaactttgttatggtaagccattgagattcaggggtcagcgttaccctaactaatacacttatgcacttttctctcaaggagatcctctttacagaactgatttcctttaaaaacaaagactttgtgttgttcaccagcacccagcacagggctgggcataaggttggtgactcaataaaggtttgctaattaaataaataaatgaattgagtgagcaaatcaatgcaatcctggttactatagaaaacaaatgagttaaatgtcatatgactgaggcagcctcttggcctaggaagggtgatattctattgagaatttctgtagccccttggattataaacaaagacatccaggccataaagacattcattataacagaaagtcaattgacatgataaaatttggaatagatcaatacaagccattttgcaacgattattcataactcttggtgcatgtgttatatgtatgtgtgtatacacacgtacacacttgaagacactgatccgtgtataactgtgtgtcttagaaaactggacaatacttgaatgagatataacctagttaattggaggcaataaatgttatattaataatttttcctcttcaattctggaataattgcatatgttttatagtgttgcttttttttttttttttttttttgagacagggtctcactccgtcacccaggctggagtgcagtggtgaaatcttggctcactgcagcctccgcctccacggttcaagtggttctcctccctcagcctcctgagtagctgggattacaggtgcacgccaccaagcccagctaatttttgaattttttggtagagacagggtttccccatgttggccaggctggtctcaaactcttggccttaagtgataccccgccttgcctgccaaagtgctgggattacagacgtgagccaccacacccggccttatactatttgttgccttaagccatttagtaatgtgggtatggatgtgttagagtgagaggtgaggaagatatgagtagctactttctttaacagaactcaggtgtatgtaaagagacagcagggttccgccctgggaatctgggccatttccccgtcagaaatggggcaagaccaaggccagggctatgtgctctcagaccacccagtaagcagaagcaagtttctcaagcttctctctcttcttccaatgggcaaaccaccttgaatctgccacgcaaaaagccgctatttaaagtcctttagaatgcactggaaaacccatgtaacacaccttctggagtccagaaaccccatggagtagagggagatttctccaatgagggcgtaatctgggaccatcatggccactgtccggaacaaggcctggaaaagaaacaacaaatcagaatcggaacacgtgcagtgaatactgagggaacgcacattcacagaagcaaagggaagtagctttgcttcattcaggccactccagtgacaataaaggcaagaaggactgggggacaagtgagtgcagatggaccatcctcggtgggccaatgcatggctcaaccaacctccccactggccctatgcgggtacatgttgttacttacattgggtccctcaatggttctgtggaaggccctaggtgctggtacacctcattctcctatgccaaatgaggacacctcatagcatcactcaactgttggagcttcccagtgttcaacatggacatcagaagtcatttaggaatgcagaaccaatatgcatcagaagaatcccaaagccagacagattttttttttttttttttttttttttttaagacagagtctctgtcacccaggctggagggcagtggcacgatcttggctcattgcaacctccgcctcccaggttcaagcgattctcgtgcctcagcctcccaaacacctggggattacaggtgcccaacaccaggcccagctaatttttatatttctagtagagatggggtttcatcatgttggccaggcttgtcttgaactcctgacctcagatgatccaacagcctcagcctcccaaagtgttcagattaaggcgtgagctaccgcgcccagccagacagatcttgatttgagttcttgttttgctaccgactagcatgggcaagttatacaacccttgtagatctctattctttcatctcaaaacagactaactttaccctcttcatagagttatcatgagaataaatgatagaatgcaactgaagtgcttgcaagagtatgtggcacatagtaagtgttcagtatgcaccagctattgcattattatcttagatcttagaggagaagtaacttgcctgagtcacccagttagagctagagccagggctagaatctaggcttcctgacaccatgcctgggtgctttctactatcccatggcattgtgaaagctgcttgtgacgatctaatatggctgttggctgggatggatgcagggggtgcttacaaatactgggcagtaaaaaatgagaaatgtggctgggactggtggctcacacctgtaatcccagtgctttgggaggccgaggcaggcaaattgcctgaggtcaggagtttgagaccagcctggccaacatggtaagactctatctctactaaaaatacaaaaattagctgggcatggtggcgcatggctatagtcccagctactcaggaagctgaggcaggagaatcacttgaacctgggaggcagatgtggcagtgagccaagatcatgccactgcattccagcctgggggacagaatgagactccatctcaaaaaaaaagagagagagaaatgtggatccaaattctatcttggccttcactggcctatgttgacctagatgggaggagccacttgaagcatctctctgactcttttctcttctcagagagaagtggtccatctgagtaagtttccagggcaccagtcagaatgcattagtaacagggggtagaccatgtcctaaagtccgtggatatgggcgtagctgggtctctcttatcacttccacccaaggggatggaggaataaatttacccccaggtaggtacctccagaggtttcttttctttcgctttgttttttttgagatggagtttcactcttatctcctaggctgagtgcaacggcgctatctccggccaccacaacctctgcctcccacattcaactgattcttctgccttagcctcctgagcagctgagtgggattacaggtacatgccaccatgcccggctaatttttgtatttttagtagagatggggtttcaccacattggacaggctgatctcgagctcctgacctcaggtgatttgcccaccttggcctcccaaagtgctgggattataggtgtgagccgccacacccggcccagaggtttctattctaaaaagcacaccccacatgtatatctgctggcatttaccttgagattgtcgggcagttcagccctgccagcatacccggggttcatggtgatgaacacagcgcaggttgggttcagagagagctcagtcccttcaaagatgaatgtctttagcttccgaatgatggcttgttggatgctgaggatctgctgagcgaccacagacagcacttctacctggggtgagaatgcccggctgataagagcatctgcttctgtctgacaaccaccctactctaccggagtcctcccacatagcaaagaaagaacccaatcacccaaaaaccgcacctgcacattcaaaattaggagcatgatttggggttttggtaagaaaaaagaatataggtttgtgcatgtgtgcatgtgcgtgtgtgtgtgtgttaatagtttccatagtactttatctttgtttcaacacctagcatagtacttgacacacagtaggtattctgtgtttattggttcaaagatcagggatttttatatttcctgatctttattcatcatccaaagagaattatacactctttgtgatgcatcttttgtacttctactatagacttttagcacgttggtatttgtttcattaaattttttatttccctttactagatcgcaacagtctagacagcaagatcttttttcttttttttaattattatactttaagttttagggtacacgtgcacattgtgcaggttacatatatatacatgtgccatgctggtgcgctgcacccactaactcgtcatctagcattaagtatatctcccgatgctatccctccccactcccaccaccccacaacggtccccagagtgtgatattccccttcctgtgtccatgtgatctcactgttcagttcccacctatgagtgagaatatgcggtgtttggttttttgttcttgcgatagtttactgagaatgatgatttccagtttcatccatgtacctacaaaggacatgaactcatcattttttatggctgcatagtattccatggtgcatatgtgccacattttcttaatccagtctatcattgttggacatttgggttggttccaagtctttgctattgtgaataatgctgcagtaaacatacgtgtgcatgtgtctttatagcagcatgatttatagtcatttgggtatatacccagtaatgggatggctgggtcaaatggtatttccagttctagatccctgaggagtcgccacactgacttccacaatggttgaactagtttacagtcccaccaacagtgtaaaagtgttcctatttctccacatcctctccagcacctgttgtttcctgactttttaatgattgccattctaactggtgtgagatggtatctcatcgtggttttgatttgcatttctctgatggccagtgatgatgagcattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcaaaaattttctcccattttgtaggttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatcaagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagggtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcatgatattgattcttcctacccatgagcatggaatgttcttccatttgtttgtgtcctcttttattttgttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatactggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcggatattgaaccagccttgcatcccagggatgaagcctacttgatcagggtggataagctttttgatgtgctgctggattcggtttgccagtattttattgaggatttttgcatcgatgttcatcaaggatattggtctaaaattctctttttttgttgtgtctctgcctggctttggtatcagaatgatgctggcctcataaaatgagttagggaggattccctctttttctattgattggaatggtttcagaaggaatggtaccagttcctccttgtacctctggtagaattcggctgtgaatccatctggtcctggactctttttgattggtaagctattgattattgccacaatttcagctcctgttattggtctattcagagattcaacttcttcctggtttagtcttgggagagtgtatgtgtccaggaatttatccatttcttctagattttctagtttatttgcgtagaggtgtttgtagtattccctgatggtagtttgtatttctgtgggatcggtggtgatatcccctttatcattttttattgtgtctatttgattcttctctctttttttctttattagtcttgctagcagtctatcaattttgttgatcctttcaaaaaaccagctcctggattcattaattttttgaagggttttttgtgtctctatttccttcagttctgctctgattttagttatttcttgccttctgctagctttcgaatgtgtttgctcttgcttttctagttcttttaattgtgaagttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtacccagtagtcattcaggagcaggttgttcagtttccatgtagttgagcggttttgagtgagattcttaatcctgagttctaatttgattgccctgtggtctgagagatagtttgttataatttctgttcttttacatttgctgaggagagctttacttcccagtatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcattgatctgtctaatgttgacagtggggtgttaaagtctcccattattaatgtgtgggagtctaagtctctttgtaggtcactcaggacttgctttatgaatcttggtgctcctgtattgggtgcaaatatatttaggatagttagctcttcttgttgaattgatccctttaccattatgtaatggccttctttgtctcttttgatctttgttggtttaaagtctgttttatcagagactaggattgcaacccctgcctttttttgtttttcattggcttggtagatcttcctccatccttttattttgagcctatgtgtgtctctgcatgtgagatgggtttcctgaatacagcacactgatgggtcttgactctttatccaattttccagtctgtgtcttttaattggagcatttagtccatttacatttaaagttaatgttgttatgtgtgaatttgatcctgtcatgatgatgttagctggttattttgctcgttagttgatgcagtttcttcctagtctcgatggtctttacattttggcatgatttcgcagcggctggtaccggttgttcctttccatgtttagtgcttccttcaggagctcttgtaaggcaggcctggtggtgacaaaatttctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgcagagagatccgctgttactctgacgcgcttccctttgagggtaacccgacctttctctctggctgcccttaacattttttccttcatttcaactttggtgaatctgacaattatgtgtcttggagttgctcttctcgaggagtatctttgtggcattctctgtatttcctgaatctgaacgttggcctgccttgctagattggggaagttctcctggataatatcctgcagagtgttttccaacttggttccattctccccatcactttcaggtacaccaatcagacgtagatttggtcttttcacatagtcccatatttcttggaggctttgctcatttctttttattcttttttctctagacttcccttctcgcttcatttcattcatttcatcttccatcgctgataccctttcttccagttgatcgcaccggctcctgaggcttctgcattcttcacgtagttctctagccttggttttcagctccatcagctcctttaagcacttctctgtattggttattctagttatacattcttctaaatttttttcaaagttttcaacttctttgcctttggtttgaatgtcctcccatagctcagagtaatttgatcgtctgaagccttcttctctcagctcgtcaaagccattctccatccagctttgttccgttgctggtgaggaactgcgttcctttggaggaggagaggtgctctgctttttagagtttccagtttttctgttctgttttttccccatctttgtggttttatctacttttggtctttgatgatggtgatgtacagatgggtttttggtgtggatgtcctttctgtttgttagttttccttctaacagagaggaccctcagctgcaggtctgttggagtaccctgccgtgtgaggtgtcagtgtgcccctgctggggggtgcctcccagttaggctgctcgggggtcaggggtcagggacccacttgaggaagcagtctgcccgttctcagatctccagctgcttgctgtgagaaccactcctctcttcaaagctgtcagacagggacatttaagtctgcagaggttactgctgtctttttgtttgtctgtgccctgcccccagaggtggagcctgcagaggcaggcaggcctccttgagctgtggtgggctccacccagttcgagcttccaggctgctttgtttacctaatcaagcctgggcaatggcgggcgcccctcccccagccaggctgccgtcttgcagtttgatctcagactgctgtgctagcaatcagcgagactccgtgggcgtaggaccctccgagccaggtgcaggatataatctcgtggtgccccgttttttaagcccatcagaaaagcgcagtattcgggtgggagtgacccgattttccaggtgccgtctgtcacccctttctttgactcagaaagggaactccctgaccccttgcgcttcccaggtgaggcaatgcctcgccctgcttcggctggcgcacggtgcacgcacccactgacctgcgcccactgtctggcactcccgagtgagatgaacccggtacctcagatggaaatgcagaaatcacccgtcttcttcgtcgctcacgctgggagctgtagaccggagctgttcctattcggccatcttggctcctccctccttttttttttttttaaacagagtttcactcccagcctggagtgcaatggttagatcttggctcattgcaacctccgcctcccaggttcaagccattctcctgcttcagcctcccgagtagctggggttacaggcactcaccaccatgcccagctgatttttatatttttagtagagacagggtttcaccatgttggccaggctggtcttgaactcctgacctcagatgatccacctgccttggcctcccaaagtgctgaaataacaggtgtgagccaccgcgctcagccaagactttttttttttttaagagacaaagtctcactctcacccaggctggaatgcagtggcggcatcaaagctcacttcagcctcgaactcctgggctcaagcaatcctcctgcctcagcctcttgaatagctgaggctattttatttttgtagagacagggtctcaactgtgttgcccaggctggtctcagactcctgggctcaagtgatcctcccaccttggcctcccaaagtgtcaggattacaggtgtgagcctctgtgcctggctatacaaccatttcatgctcatctctgttgcatgaacttatgcagaatctctgatgtatagtagctgctcagtagctactatgggcaagtgaatgaattaatatgatggggagatggggctatgtgtataaaacatgcatctgtctccttgagagtccttttgtttagttcactgagtacctgctttggaggttcttgtgtctgccatacaagagatataaggccctgttattaaggggtgcagagccaagaaaaaagcccctccatgcacagcttctttgttctgcagcctagaggcagagttacctcgatcctgttgaactcatcaaagcacgcccatgctccagcctgtgccagccccttgaagaacttccccatagctttgtaatccaaaccatcggagcagttgaagaccacacactagaaagagggaggatgtgggtatcattcagggtggattccatcccatctgaattaccccgcaccattcaacagcagtgggctcctctctccttgctctgcttgaaggagctggggcccatgctgcctgttaatgctaaaccatcttaaagttgatgcctacttcccacaggaggggtgcagagagggcctggaagagagggaggggatagatggcatttgcttacctgcttagccaaggctttggccaaatctttggtggtttctgtcttgccagtcccagctggaccctctggagcacccccaaggttcagcttcaaagctcccatcagtgtcctatggggaagaaaatagaacttcagtgcttgaggtctaagacacaggaaagaaaccggcttttcatttattttgactcatacaaatatttaggttagtgcaaaagtgattgcagtttttgccattgaaagtaatgctaaaagccgcgatgacttttgcaccaaccaaatagttaaaatttttcccaattatatgagcaatacaatatcactgtattttactcggcattgtaacctcagagcccagcacagtgtccagcacatgagtggcacccatgaatatttgtttgaatgaataaatgaatacatgcatacctatataaatgaatcaaataaaagtgagaatactcataaactctacattccaaagatcaccagtgctaatggaatggttaaaatatatttctccaactagattatgaattcttttttttcttttgagacaggttctcactctgtcgcccaggctggagtgcagaggcatggtcacagctcactgcagccttgacctcctgggcccaagtgatactcccatctcagcctcccaagtagctgggacttacaggcacacaccaccacacccagttaattttcatattttttgtagagatgggattttgccatgttgcccaagcgggttggtctcaaacttctgggatcaagtgatccacccaccttggccttccaaagtgctgagactacaggcgtgagccaccatgcccagctagattatgaactctaaagttcaggaatcatatttgattccatttcataacctcagtaaattaatacagctcctggcatgtaataggtgcaagataaatgttagaaatgaatgatgtaataactgtggttccatggcccatggtatgagtttctatgttttcatttagcactctatcttgtaatcatttgaatatgtctctcccgaccccccagttagatttagggtttcttgaggtcatgcatggtgcacaggaaacctcaaaaaatggttgttgaataataagtggaataaataaatgaatgaagagcaaaaatcatagaccataaaaaacaagtggttgaggattttgaagggagaaaatactcccaagtattagttttacaatctaaaaaactctcactgtaaggaaatatataaaagcaaagaacatctaaacatcacaaaaccgacaagttcacaaaatcccgatctcaaaggctgagttccacagaaaatgtcagaggactttgctgagcacagaatggccagcttttttcatgagactggctggcagagcatagagaccccttggctacgttcttgacctcacttcttgtctatcttatggccataggatctccaggcaccatcttgattcctgccattggagagccctctacgttaagtcctgtgtcatgttcacggatgtgcaccaatattccacttgttggttcaaatacattgatttgcactagaattcctactgggttctcatgtctagcctgaagacctagtttgcatgcccatctttgggactatggagaatctaataatctgaagtgtgaagggtaaaggtaacccaagacatccctaactttcctccccagagtcttcttcccctggagttctccgttcacccctcagatctaggagctccagagtgtacctgtagcagcggtcggtgaggggtgtgatcaccagccggggggagtttcccaggtactcatagccatacaaggcttctgtggtgataatctgcacctgcacatccttggccacccagtagtagcgcagctgtgagatccattggaaatcattcagatcggagaccctgtcctcagataacttggccaccacgtcgcgggctgttgggacacagatgcagaaacacgcacacagagccatcagaactctccatctttgtaagctcctcagttacaagtggatgttatcaaggtcccccattctccaaactattttattttattttattttatttattttttgcgatggagtctcgctctgtcccccattctggagtgcaatggcgcgatctcggctcattgcaacctctgcctcctgggttcaagcgattctcctgcctcagcctcccaaatagctgggattataggcgcacgccaccacacctggctaatttttgtatttttagtagagatggggtttcaacatgttggccaggctggtctccaacttctaacctcaagtgatccgcctgcctcggcctcccaaagtgctgagattacaggcgtgagccaccgtgcccagcccaaacaattttagatttcacaagcctccttgcccacccccaacctgcaggcagcaatatctgttagaagctggtctttgctttctcccaaagccaggcagagaatctgctgcactatcttctctcagacagcacggcagaggtattaaaaggtgcgtgctctgaaatcagactggctgcgttcaaattctgattccaccatgacctagctatgtgactttgggtaagttccttgacctctctgttcttcagttgtgtaatctgtaaaatagggataacatagtacctacattatagagttatcatgaggattaaatgaatatataggtacatacatacatatctacagctagacacaatagagagagaaagagagctgtccttggcatatgaaaatgttatacaggtattagctattgttatcatccccaaattcttggaagtctgagccagagagctttgcaatgcatagtgactccaaattccatcctatttccagtataacccttttggtcccatttcaggcccctaggatatcctaggagaatgcaatcagcgtggccttatatagcaggggaaggaagcccgagaatccatggttagatgtatcctttccatctgggggcctgagaaaccagctgggagatacatttctagctcttcttttttctctcatgggaacgtaagccctgatttaattttatccaagtgacaggggccttgaagttgaagagtggatctaggctgatgagaatcattcattacgtttttggtaactcaggtggagagctatggagatctcagagctagtacagccgactcaaaattaggacctcagaaacgtcacttttcaaagggttgcttccattgagcctttccttcctctctgtgacagagtcttctttattacagtaaaataaaaaaccctgcagggaagagtccttgaagaagattatatccacagctttttcttccttcccaaggaatttaattcccctcctggctcttgggtgaatatataggggaaccacctgatacattctcccaaggaagagggtatagggcaggagtatggtatgcctgagggatccaagaggaaagcgaatttcaagggtttgagttggggatgccttcgctatacagtgtgtgtatgtgcacttgcatgtgtgtgtgtatgtgccattgtgtacatgtgtgcatacatgcatgcttgtgtttgtgaacccaaccacactggggtaccctgggcagtataaccacatctgcaccaattattcctaacagctgagtatgtggccgtgtgaagagcacattttcccttctccctccctgatgttatgctggtctacctaatgaaatcagattgaagtgagcattaacctgaggggagtgagatgccatgaaatgccaggagggagctgggagtgtgagcaagagactctgttcccaagcaaccagcctggtccagccctagtttccttggtgatggagtgagggtgtgggggtggtttgttttatataaagaccccagtttttcctcctcctcctcctcctcctcttcctcctcctcttctttttaaaggaggagctggaaggcatcctctctcaccacccactgcttgcaacattgcccatttccagtcccttaggcttggaagcagacagacataggcgattctgttgcttactattatagctgtatgcctctcagcaagttagttacctctctaagccccaggttctgaatctgtgaaatatctatgaaaatgagataatgtatgtcaatcacttagcacaaagcctggcacctagcaagcattcaaaaatattatctacggctagccaaggaaatgattccacgttggtgaagctcagaaatgactttggccatcattgtctcagtacaagccctgcttggagggtccctggaaatcaggttgcggatgggagaggaaacacaggtggagggatgcagagccctttggctctcatcttactctcagttggagaaagctctccctaatgaggaaggaaaccctgaattattccgtccaggagaactgagatgagcaagactagactgcttctcctggatagtcagtaatgacaggggaagccccctggcttaccgtggacatcgatgaccgtgagggccccgagagtgagtcgagctccactgctcagcttccctcgcaccagctggacaatctgcgcaatctgatcattgctctttttcagaaaatcctggaaggggcagaggaggggacaactggttacatttgactctcctctggtaatccccatgtcaagaaatggtaccatggaccaccggatggctcaagccagactcctgggtgtcatccctcaagtccaacttttccttaccccagtccttaatctctgaatgaattcctaatgcattatgctgaaagaggcaagatttggaaggtttcatactgcatgattttatttttatagtattgtggaaaaggcaaaattataggagtgagcagaaaataccttggtaattactggaggcttggagtagagaatgcaactgactacaaagggcctgaggacattttttttgggtggtgtggaactgtcctatatattgattgtgatggcctacacaaatgcatgtgtttatcaaaactgagaaccgtatgctaaaaaaggtgaatttcactgtatataccataaatcagaattaacctcccaaactggaaactttttcacattaaagagacaaaggagctataaaaacaaaatgcaacatgtaatcctagattgcatcctggaccagaaaaaaaaaaaaagacagtagggcaattggctaattttatttatttatttatttattttgagacagagcctgactcagcctcccaaatagctaggactacaggtgtgcaccaccacactcagctaatctttgtatgtttagtagagatggggttttgccatgttggccaggctggtctcaaactcctgacctcaagtgattcacccaccttggcctcccaaagtgctgggaatacaggcatgagccaccacgcccggcctgtcatttctttttcaagatgacaaaatttaaattagccaatttagaaaggtctatagagtagagaataaaatcgtatcagtgttgatttcctgatttggataactgtactatggttgtctaagatgttaatatatgaggaatctggatgaaagatatatggaaattctttgtattatatctttgtattatattttcagcattatttataagtttcatgttatttcaaattaaagaggcaaaaaataaaataaaaagaaaacttaaaaaggaaaaaaagtaagaccaccctaggttaaaatcctaccttccctactttctagctatgtggctcttggcaaatgattttatgcttctgagtctcagtctcctggtgtgtgtcaaatgcagattttttttttttttttttgagatggggtcttgctctgtcacctaggcaggagtgcacaggcacaaacatggctcactgaaacctcgacctcctgagctcaagcaatcctcccacctcagccgcctgagtagctgggaccacaagcacacaccatcactcctggctaactatttgtagagatggggtctcactgtgttgcccaggctggtcttgaactcctggcctcaagcaatcctcccgccttggcctcccaaactattgggattacaggcatgagccaccgtatcctgccctgaatctagatgattatagctgcctcttcaagctgtgttgaggattaaatgaggtagtgtatgtggtgttggggcttctccccacatctctcctacccacacccattgctcagctattatagaccgaagtgtcttcctgctggaatacaccatgctgttcatcttcaggcttttgcatactccagttcttctctctggaacactctccctcctattttctgctcagctaatccctacttatatttcaggtcttttcttagacaccacttttctgggaaatcttccccaatcctaacttccctcccctcactctcttactctttccttccttcttttttcctccctccctccctccctctctcccttccttccttccttctttaaaccctccctccctccctgcctccctcccttcccatacttactggatgtctgttctttccttatcacagttctgtaaaagagcctttttctctctcccactagactataaatccatgaggagagggactatgtctgtctcattcacatctaattaccttcgttagcagcagtaccagcacagagcagatgccaaatcaatatttgttaaatgaacaataaatggttggaggaagggaaggatgattattctgtgtcaacacctgcttcctttaggatacggagacacatcacacagcatgcatgcacaccagggcctggatgtatgacgggaaacattctccctaactatgggtgggaaaactggggcacatgaatccacctccatcacaaaaagtcagagataccatcacaaaagtcagaggattttagtttctaaagtttgaaatgatgtacgtgaaagcagtttgcatgtgtacagtgcaatatgtctattaggatttatcaatatggaatctgtataagtttaaacactggccaaatattaatgttctaatttcaatttatacagcaaaatataggaaattaaaacatattctaatccacagccaatcctctaagaggagtaacaggaggtctggtgagatattcatggagaatcaaaccatggaagaaaggctgagtatgaagttttcattcatccatttaacaaatatttggtcaggcatggtggctcccagcactttgggaggctgaggcaaggaggattgcttgaggccaggagttcgagaccaccctggccaacatagtgagacccccgtctctagtttaaaaaatagaaaaagtttaaaaacaaacaaacaaatccccaaatatttattgatcatctactctgtgctgggcactgtattaacccctggaaatataatagtgagcagagcagacatagcttcttccccgtagggtttacagcctcgtgtctaagtaccgaatcatttactggcatctcatttaaccctcccacaatattatgatgtgttgtgacaattccttgcatgttacagacaaggagcttgagagtcgggttaagttgctcatggtcacgcagctaacaagagacagtgtcaggatttgaactcaagtccatcaggtcttaacagtcaagcattggcatcatttggctgggaatatgtgtatttggatctgaggataaacagatgcttgagtatacttggtcacaagagaaagctgaaggcaggacgggaggtgggttcattcgggagggagtaggggtgatgagaaggaggctgtaaaggagaaggagaggcagatggtggccccttggcttaggaagaatataggaggtctcccctggtggaaattctgccaggttagcccccagaagccaagggtataagacttagaatcctgcagtccagaatttctgtctgggaaggactatgagaggtctcgtaccatagaattgcaggacagctcgaatcccaaattctccatcccactgtcctcatgggaaccctgatgtctgtgatgctgagaccaaatgatttttgtttagacaacaaaacatggctactctaattatacgtcattcaaatcctaattgatgcttggatctcttctgtaactttgcagcaagttcacttaccagtaaggtattttccgccagggcttgggacacctcctgggtccaaaagatggaggagacacagataaccacctgtccaggccactgtaagacccagtgatttcgagggacctggaaaagcacagtgggcatgttataggatcagttcacgtgtggtttaaactgagtttacgaaaacatgccccaaccacctcaccaccgcaacaaaaacaaaatcttcccccatcctcagacgctacaaggcttgacatctctggaattactgatttatgtcttcctttctgagttttatgaaaaagaaaaagaaaaaacaccaatcatctcatcaactttgcattttttccatgctcccatttatcaaatttttccatagttataatcaaggtgatgttcagagagttctcataactactgttttttaatggctacataatattgcagtgctgagtcacaatttttttagctgtttctccaccccacaattctttccctcaagctacagatcaggagcgggcaaactatgtatataaattttttcataaataaagttgtattgaaatacagccgcagcatacaaaagaatgagttcatgtcctttgcagggacgtggatgaagctggaagccatcattctcagcaaactaacacgggaacagaaaaccaaacactgcatgttctcactcataagtgggagttgaacaatgagaacacatggacacaaggaggagaacatcacacactggggcctgttaggaggtggggggcaaggagagggagaacattaggacaaatacctaatgcatgcggggcttaaaacctatacgatgggttgataggtgcagcaaaccaccatggtacatgtatacctatgtaacagacctgcatgttctgcacatgtatcccagaacttaaagtaaaataaaataaaatttaaaaaaatttaaaaaaaagaaatacagccatgcccatcatttaaatattgtctgatgcttttgtgccacaagggcaaagctacagtacccatttactatacatatgtgtcttataacattatgttgtataccttaaatatatgcaataaaatttattttaaaaaatagttgcattgggaatgtggcctgcagagttgaaaatatttactatctggctctttacagaaaaagtttgatctgaggataaaatttgatagatttgatttggatgaaataatttcatactggtaactgcttttctttaatttttgattcagagcatgtcataggaaaagggactggtctttcattttacaatgcaaatactgtgtcaagggacagcagggtcagtccccaggactttagtgtgagggtgttgagtattgctttgttctgtgggtgctgggaataagaaagtaagaaagttagagtcagtcagccgggcacagtggctcatgcctgtaatcccagcactttgggagaccgaggcaagtggatcatttgaggtcaggagttcgagaccagcctggccaacatggtgaaaccacatctctacgaaaaatacaaaaattagccaggtgtggtggtggttgcctgtagtcctagctacttgggaggctgaggcaggagaatcgcttgaacccaggaggtggaggttgcagtgagccaagatcgtaccactgcatttcagccctgggagacagagtgagactccatctcaaaaaaaaaaaaaaagaagaaagagagctagagtcgctcaacgtgaatgtgactacaggctgggtaccaagttattctgatagattcttttgtcttaagccttacgtcatacctatttccctttaagctttgggaacacaatgagttatgccactcagggcatctgtaaggtaaatgaattattaattggaagggactctaaatagacttcgtgccattaatcccatttgacaaaaaggactggtccgtggcaaccagagggttccagctaaccctcttctcttgcatcacctgcttctaactgccagtatttcaccaggaataggttcattgccccagggttcacaagtgaaggaaagagaggtgcagagggacaggttttggtagaaagcagagggtccagccaaactactgacacatgaaccttctccccaatgttctctttagtgcactagtgtcctggcatgtgtaccccggttcttgtttaccttgacatatgcttcaatcccaagtccaatgacttctcgcatactggccagcatcatctgctccacctgctggagccacttttccaccatgccctatggagcaagacagagagagggtgcagcagtcaaccaaagcccagagggagggagagtgggcagaacacagctttctctctggacacggctggagggatgccaaaggcttggcaccttttcaagtcaatattctctgtctccccgttctttttttctttttttttttctttttttttttttttttgatacagagtctcgctctgtcaccaggctggagtgcactgtcatgatcttggctcactgcaacctccgactccctggttcaagcgattctcctgcctcagcctcccgagtagctgggattacaggcgtgcaccaccaccgcggctgatgaattttgtatttttagtagagacggggtttcaccatgttggccaggatggtcttgacctcctgacctcgtgatctgcccacctcggcctccaaagtgctgggattacaggtgtgaaccactgcgcctggtctcttcttttttttttttttttttttatagagagagacagggccttgctctgtcatccagactggagtgcggtggcacgatcctggctcactgcagccttgaactcctgggcccaagtgactctcctgactcagcctcctgagtaactgggactacaggcacatgccaccatgcccggctaacttttaaatttttctgtagagccgtggtctctctatgttgcccaggctggtcttgatttcctggcctcaagagatcctcctgcctcagcctcccaaagtgctgggattacaggtgtgagccatggcacctggccttggccccagccaatattccaatattctttatctgcttgacacttattttctgtattctcagaagcatatgccttctaaaggggcgataggccttttttttttttttttttttgagacggagtttcactcttgtcacccaaggctggagtgcaatggtgtgatctcggctcattgcaacttccgcctcctgggttcaagcgattctcctgcctcagcctcccaagtcgctgggattacagcatgtgccactacacctggctttttagtagagacagggtttcgccatgttggccaggctggtctcaaactcctgaccttaggtgatccacccgcctcggcctcccaaagtgctgggattacaggtgcaagccaccacgcccggcccatttttaatacgcattactttcatgtcattttctgaaacagacaacttctcagaaggcaaatgaaacatttatgtcagttcataaaataaattgcatcttttaaatgaacagctctgattcatgcattattccagtgggtctcaaactttgctgttccttgaaatcacttggagatcttttaaaaaatactgatgactgactcccacccctagacttcctgatttaattggtatgggatgcaacctggtcatttggattttgatcaaaactccatagggaaattcaaatatgccccaaattattcagtgttagaatttcaggtaactgtagctattgacttcaggtgcttgtaagctagctggtgtctgcattggtaatgtgactcctggttgctgcagtttatacgcgtgggtggcaaaaacagtcaacaaagcaaggctcagcttgcttgtctatttccacttgagggtgctgtcactgagcagaaatggaagtaatttatactttactcattatataaggacatatgtatgaaaacctgagttaagttgcattatagctctcattgattctatgatgttttattgatctttaaaatgaatgccccaggaagctacctgtctaactgaatcactttcaactgaactctgcacatggaaatctaaacagcatcggctgtttggatctgattcctgcaattgactccacatcgagttgggttaaaatccacaaatttaatatgtcatgtggattgcagtggaatccccatcttagagatgggtacactgagactcagaaagattgagtaacttccccaaatcttcagtcgttacatcgtagaacccaagtgttccataccccaggcagtctggtgcttagtcccagtgcttagccaatacgctctctgatttactctgttatggagaaaagaaccaaaaatgggtaagaggagttaccttggcattagctgggtagattttctgtatgaatggaacagtttctttttccgagctgatcatgcccacaatttccagattgtctgtaaactcaagcttggcaattccttcaaagcacttcttcaagtgcggctgcactcggagagggtcctttgtctcggacaagatttccagcagctcatcgtttgataggaagaagaatctatttcaaagcaaagaaagatggtaactggaacctcttccaagaactttttctagcaaggtgatactttctgacaggtagtccgcacctacgtgaataccagttatgtcttgcggtcttcacaaaggcccactctcttttatcacttttcatctggggcatggaaggtggagttttgcttttcttaagagatgaggtcttgccatattgcccaggctagacttgaactcctgggctcaagcaatcctctctcctcagcctcctgagtagctgggattactggcatgagacattgcacccagcttggagatggttttgactctgagataccacacttgatcttagtcaaaagaccaagaagcgatggttttgagtctgacagcaagagaacgaataaaagctggcatgtgtgggtttaataggactgggggatgggtgctatcagttgaaaggagcccggatagaacagcaattctcagctttggctgcactttagaatcacctggggagcttatacaaaattccagagccacagtcccattgtccagagattctaatagaattgatctgggagtgcggctgatgaaatttgtatttttttaaatttcaggtcattctaatgtgcagtcagtgttgagaaccactgggtaggggcaggagagagagacttccttgtctttccttctctccatccgtgcaagaacattgtataggcatgatacaagaaagtaaatgttaataatgagcctatttacatgcagaggcctctaccaccttttatttattttatttatttttttattttattttattttattattttatattttattttattttattttatttttatttttatttttattttattttatttgagacagggtctgtctctgtcacccggcctggagtgcagtggtgcaatcctggctcactacagccttgacctccagggctcaagcaattctcccacctcagcctcccgagtagctgggactacaggcgcatgccaccacgcacggctaatttttgtatactttgtagagatggggtcttgccatgttggccaggctagtctcaaactcctgggctcaagtgatccatccacctcacctcccagagtactgggactgtaaatgtgagccactgcactcagccctttactatcttttaaattagagataataagacaatttcatctcttgttcaggcctaaaagcagcaacaacaaaccttcagaaaatgtccaatattcaaacctgtactgtgaccatcaggctgaaagttctatgatggagggattgtgtgattatggtctttaccaaatatggtggattacaaaaatggccacgatatttacagttcctctcatcaaggggtggagtctgttttcacatttctcaaacttgagctggctctgtgtcttgctttggctaatagaatgtaagtgaacatgagtctgtgcacgttctaagcctaggcatcaagaggccatgatgctttcactcttgctgctcttaggaaccctgtgaccaccaccatataaataaacccaggctagtcttctacaggataaaagacatgtggcccaaatacctgttgtccagccagtaggaagccaatgaccagacaagcaattaaggatgctgactgatggctgactgcagtcatgagtgagccccagtgaggccagaagaaccacccagccaagcccagctcaatctgccaacctagagaattctgagctaaactgatcatgtgaaacatgattgttgtttcacacttctaacttttggggtcatttgttactcagcaaagcaaacgaatacactgtatctacagtgttgagcaagtacaaagagtaataattatttgttgctgatcaactaacaaatatccagtgagatgtcaatttctcccactcccaagtgaaattcaaatgggtgatctctatggatatacactccctctatctccatcatgtgctataatgaataaggctcaatggccataagagtaataatacattcgtataatttaaaattaaaatctttttttagcaatctgtattttcaagatgaaattaacttaaattatgtgactatcaacaacattctcaaagtgtttgctgagagtgtttaattttattttataaaaatgcataaatattgaggtaggtgtgtgtgtgtgtgtgtgtgtgtgtgtgtgtgtgtgtgtgtttaacttagggtaaaaatgtggctcagagaggttaaatggctgaatatcttatccagacttcctgggtatcaattctagcttgatcattttaccagtcttgtatctttgggcaaatcattattttctcatttataaaacagggacaataataatgttcccaaacccataagagtattacaaagattaaattagttagttagtaagtgtaaagcacttagagcagggtcctggtgtaaggaaatgctatattagtgctattattcatatttttttttgagagagagtctcgctctgtcacccaggctggagtgcagtggcaccatctcggctcaccacaatctctgcctcccgggttcaagcaattctcctgcctcagcctcccagatagctgggattacaggcacccaccaccacgcccagctgatttttgtattttcagtagagacagggtttcatcatgttggccaggctggtctcgaactcccagcctcacgtgatctgcccacttcggcctcccaaagtgctaggattacaggcaggagccaccacgcctggtctattattcatattttaattaggaataacaggagtgggtctagaactagaagcccaaacctcaggtgtttcctgagtttaatctcttcccaagccttatgtgtcaaaaccagggttccttccactatactgtgctgtccaatacaaaagctattagccccatgtggctatttacattaaaaagtaatattaactaagttaaaaattggcttcctcagtcacctcaaccacatataaagtgctcagtggccactggcagctaagggctactatattggacagtacggacaaagaacattcctatcattgcagaaagttcattggataatgctgaattgaataaataccaaagatacttctgagtttgtttatttatttatttatttgagacggagtcttgctctgtcacccaggctggagtgcagtggtatgatctcggctcactgcaacctccacctcccaggttcaagcaattctcctgccttagcctcccaagtagctgggattacaggtgccccccaccacacctggctaatttttgtatttttagtagaggcggggtttcaacatgttggccaggctggtcttgaactcctgacctcgggtgatccgccccctcggcctcccaaagtgctgggattacaggcataagccaccgtgctcagtcatacttctgagtttctaacaaatcattttttgtttttttttttgttttttttggtaaacagcagggaactaactttgtctccatataaagaaacgctaaaatttatgtttcttaaaggtaaattaggatcaaacatcctaagtggggtcaaatgacatggagtgaccatcaatggtgaactagtcatggatagattatcaggaatgtcaggagtgagaattcacctttccgaaactaaccttctcctttttttttattttgagacatggtctgactctgttgcccaggctggagtgcactggtgcaatcttggctcactgcaacctctgcctcccaggctcaagcgatcctcctacctcagcctccagagtagctgggaccatgggcaaacaccaccacactggcttattttttgtatttttttgtagaggtggaatttccccatcttgtccaggctggtctcaaattcctgagctcaatgaatcctcccaccttggcctcccaaaatgttgtgattataggcgtgagccaccatgaccagcctggaactaacctaaaactcccttgacttttatgcagaagattggttcttgtgtggaaaaaaagagtcaaatatgtataagcatacctatcagaaactacaaaatttgatggtataaaaaaattgactggtgtttcttaaacacataggctaggtgctaaatgtttttacatgtgttagttcattaatgtgtacaacaaatacatgaagtaggggccattattatatcccaaatttacggtggagaacctgaggcttggatagatttgctggaggcctcaagaccactaggtagaaaagctgggatgccaaaggaggtctaattaactccaaaatccaggctcacagtcatgaatactctacccccgtaattaggaaaaataacagtgttggtttggacaacgtgtgcatttgacacccattgctgtccattcaacctcacgctaagtaaagatggtgaagccatgccccattcctgaaaactgtcttggagaatggaaaaccaggaaagagtatggactagattggttgaagccaactcttggcatgaaaaatgtaattctacctacatatggggcaagaatgtaattccaaataaaagaacaatgctggatacctggggaagaatagtctcttcttctccaagtaatcattcagccctttctggatgtcctccaagagaaagttggcttcttgaagcttctctgccatccgtggctggtcggctgccaccagaatcctgttatctttcacctgggttccatcaaaaaaagtgagactcatcataaggttcccaagttctgagattggtcattgtattgaatgtgtgacctatcaactgacagcactccttgtccagctaactgcctcctgatccccctcctaactgcacaggggtgaatgcttatggaacatgaccttgttcctctgatcatggttgactgggcagggattgggtactaaaaccaaccaaacccaattatattttaacccaaggagtttagaatccaaaccatgacattctatactagtttgggctgagtgagaattatgtttctctgtgtgacggagtgatagagaaagccagtcttgggggggggggtggggagggagagagagagagagagagagagagactgactaaggcagggccaggaaagaggagccaagatcagagagatggaaggagttcctaagagaagaggcttctgggttctagatccatcttttgtgaggcttggctgtgctatttggccttgggttccatgagacacccatttggtcttctcgtttcagctatcctgagtcagtttctgtcacttgcacccaaacaaccttaactaataaagaattggcttatgctggctggacaatctaaattccatttatctcactcccacaaacaaagcagggaagacaaattgctttgcagcaaaatctttttaagtgcaccccagtttgatcacacttgacttaagaaaggaaaatgatttgacctcataaaagatccctctaggtgccttgcacgcccagtgaacttaccatccttcaaggcttgatcccaacgttcctgctttagaggccttccttgacacgctgagacaactaaatcactcttctgcattctaataactatttgtatattacttttttttgggtggggggggggacagagtctcgctctgttgcccaggctagagtgcagtggcgcaatctgggctcactgcaacctctgcctcccaggctcaagggatcctcctgcctcagccttggaatagccgggattacaggtgcacaccaccatacccagttaattttttatatttttagtagagacggggtttcaccatgttatccaggctggtctccaactcctgaactcaagcaatccgcctgccttggcctcccagagggctggaattacaggcgtgagccaccgcactcagccaaggcagcaaattctatgaagacagaaatcatattcttgccaccttcaagtattttctgatttctagtataacacctgggtcattgtaggtactgaataaacatttgttaaataactgagtaaccaaatgtgggtaattgttggaattctaaaaggattcactataaaactgttattgcattatcctgtaacaaatacaaccttgtaagaaatgacagttaaataatacaaactgcctatagttactgcttgggaagtgggatttcaaaaggcttctgctttctatgttacatatttgtatttgctttttttttttttaattttttttgagacggagtcttgctctctctcccagcctggagtgcagtggcacgatcccaggtcactgcaaccgccgcctcctgagttcaagcgatcctcccacctcagccctccgagtagctgggattacaggcattcaccacaatgcctggctaatatttgtgtgtgtgtgtgtgtgtgtgtttttagtagagatgcggtgtttcaccatgttggccaggctggtctggaactcttgacctcaagtgatacccccgccttggcctcccaaagtgatgggattataggcatgagccatcgcactggtcatatgtttgcatttttaataataacaacttctgaaattagaagaagatataaaaagattgattttccaaaactctagttcatttacaagtttcaaggaaggtgactagaatgcataatgaggaaacatttgtatttctgctggtaagagttattagggtataaaaacttaccgcttgggacataagtgatttccagtaactatcaacaatgccaaatttcctcccctcttctggcatctgggctatgatgtcctctgaactgaagattggttccaggtacagccaggtggcttggcatttcaaccaggcatccaaattgtcttgtatgcgaattagcttttcttcccatttctgtgaatttagcatttcatatctggatcattaacctgccactctgcatcacaggcccatggagagagcaaatggatggagccgtacatttattcattcattcagtctgtcacttgtttaacaaatacttattgagggctccctatgctctggtcactgctccaggtgatgagaacatagcaatgaatgaaacacacaagagctttgccctttacggagctcacgtcctagcagaataattacaatagttatacacgtaatctgtgagaagtgatggtctgagtgctttaagtatatggaaccaattaaatcccacagccttacaaggtagatgtgattacaaaccgtgttttccagatgtagaaactgaaacacaacagtttagtaatgtgcccaaggtcacaccactagtaaggagcagagccagaatttgaacccaggtaatctggcttcagagtttgtgtccttagcctatgtcactgctacaaacaatgagcacaggaggccaaacccctatcttcgggtagcttacattctagattactaccataagatgcttcccaaatgcatgtgtatttggtgcattcaaatgccatcttctcttttggcagacagttgcaaaggctcagcatgccatatgctttcttggatggttattgctttcagccttgtgtcattaattaattaattaatttacttatttttgagacggagtttcactcttgtcgcccaggctggagtgcaatggcgcgatctcggctcactgcaacctctgcctcctgggttcaagtgattctcctgtctcagcctcccaagaagctgggattacaggcaccctccactatgcctggctaatttttgtattttcagtagagacggagtttcaccatgttggccaggctggtcttgaactcctgacctcaggtgatctgcccgcctcggcctcccaaagtactggggttacaggtgtgagccactgtatcatttatttatttatttttccaattaggacaaagtgactttctttgttaactgaacgtgaaaacctttcccctcctctgagaaacccagagctaacgaaacacctcaaagcattcaacttcatttcctcttacccggcattctgcttctattggtttgatgaatggggagccacacatggtctgggtctttatcacgtgatcatcaagtagcatttgaatgtcatcaattgcacacaagatgtttgtatcctgtaaataaagatgccccaccctgtcaagattgtgaaacctccccatttttcttttccttttttaaaaatttatttatttgagacagggtctcctcacccaggcctgagtgcaatggctcaatcctagctcactgcagcctcaaactcctgggcttaagggatcctcctgcctcagcctcccaagtaggtaggactacaggcatatgccaccatgcctggatttttttttttaagacagagtttcactcctgttgcccaggctggagggcaccagcagaatctcggctcactgcaacgtccacctcccaggttcaagtgattctcctgcctcagcctcctgaatagctgggattacaggcaaatgacaccacgccctgctaattctgtatttttagtagagacagggtttcactacattggccaggctgctctcaaactcctgacctcaggtgatccacccgcctcggcctcccaaagtgctgggattacaggcatgagccaccacacccagcctggatattttttttaagagatggggtctcactgtgttgcccaggctggtctcgaactcctggcctcaagtgatcctcttgcctcagcctcccaaagtgttgggattacaggcttgagccactgcatccagctacctccccatttttcatgctgatcccttaggacctcccagctcagaactccactctcatggagtaggaatctatgtcttgcagggaataggacttctactttcttccttgaaaatgttattaaagatatttaggctggacaaggtggctcatgcccataatcccagcactttgggaggctgaggtaggaggatcgcttgagtcccagaattcaagaccagcctaggcaacatagcaagaccccatctctaaaaattttttttttaaaaagacatttattgtccacctcctttgcagaagtcaaatacagtctaatccaagactcatagacataatctgctggggaggaagatttcttcccctttccctatattcctgcttcttcacttgctttcctggctctcctttcccttgggtaggaagatcggctgctaatctgactggttaggcctagacctgcggtttccacactgtgaactgatgtgccccggggcaccgcagccaactcagagtgaatgattctggttatttaaaaataaaatacagctattagtttttctttcattgtaggtgtatttttttcaaacagtgcctaagttgttagagcataaatccttattaagttgtttggacctaattactgcataaacaaagctattaggtatttcttttggcctaagggcactgtgaaaaaagtacttagacacaaagccattgtgaaccaagaaagtttggggacctttgtttaattaattaattaattaattaattttaattttattattattatactttaagttttagggtgcatgtgcacaacgtgcaggttggttacatatgtatacatgtgccatgtatttatttatttatttttgagacagtcttgctctgttgcccaggctggagtgcagtggcatgatctcagctcactgcaacctctgccttccagattcaattcattctcctgcctcagcctcctgcgtagctgggatttcaggcaagcaccaccacaccgggctaatttttgtacttttagcagagatggggtttcaccatgttggcaaggttagtctcaaactcctgacctcaagtgatctgcctgcctcagcctcccaaaatgctgggattacaagcatgacaggcacgagccaccatgcctggcttgttttatacatttattgggtcttttttgagacagggtctcactctgtcacccaggctggagtgtaatattgcaatcatagcttactgcagcctcaaattcctgggctcaagcaatctccctgcctcagcttcccaaatagctttccaagtagctggtgcacatcaccatactcagctaattattattattattattattattattactattattattattattattttgtagagagggggtgttgctgtgttacccaggctgttctcgaactcctgagctcaagtgatcctctcacctggacctctcaaagtgctgggattataggtgtgaggcaccaagcctgaccaagtggtcctgttttacaagtaggtaaggtctaaggtgtgccttaaaggccaggccctgtgggtggcactttttctcctgggccattgtggcaagcaagctgacaagggtctgaccctggggcaggtttggtctttctcgctctgttctcacttctttcaagtctaatctaggaggctaaatttgggcctagcatgtattctcttatctatgttttaccagtagctcagcattgggaggtatgttgggctattaataaagtggtttcttgatccccatttagctactgatccttgtctgtagttactttaggcaaaaactctgcagattggccaggtataagtgagctgttccccaggtctcctagcttatactcctcttgtcaccccaacagcctctatagcagtgtctaatccaagctgatcatgcagccacgcttctgagacccatggtggctgggtcacccttgctgggagaggctcagtaatgaggccctgtgccctcagctctcttccctctcatcagatcatgtatagttctgttgggtctcagaacatgataccccgaagcattgcaccttgatttgctgagtattttgaactgaaggacattggaaggccttggaagcaagatctttctgtccatctttttctgcctttctcctgctcctttatctttcccctaagacagtccatagaaactaaactcctcttgcccgaagcaagcataaaatcctgaaatatcactctgaccaagacagccggccataaggaaattctctgagcaaccttgtctgatagtgggtcacaagactgtcgttcctgagggggtcttgccctatgcctgggaggaaggactgctacacagagagaccaagaagaatctcaacagcaggtcttgctaggcttcccatggagtctagaccattataccatacgcttttgttcaatttcatttccatacagctgtccattcttcatcaaacctaagccccaaaacacagttttccctgggtcttcactttcgatggttccaaagtcatgtaaaactttgattaaataaaattttaatgcttttctcttgttaatctgtcttttattataggagtattggcggtgaatgaccttcatgctaggtgaagaaagggatcacaccttttcacccctacagctcttccttgagtgaaatcaagacactccaaccatttaaactgaatagggaaagaagtcacaagtagataacatgcagcctggggaaggagggaggcttgggagcttttggttctcaatctacattgcacatgagaaaaaccaggggtgcctgaaaaatacagatgcccaggcattctgggaggggaggagccaggaagaatccattgggagattttaaagcattccagatgattctacaatgcaggtttggaagcactgctttaggaatcaatggttgggcctggcgtggtggctcacacctgtaatcccagcaatttgggaggcggaggtgggcagatcacttgaggtcaggagttcaagaccagcctggccaacatgatgaaaccccatctctactgaaaatataaaaattagctgggcatggtggcgggcacctgtaatcccagctactcgggaggctgaggtatgagaatcgcttgagcctgggaggcagaggttgcagtgatccgagatcacgcagttgcactccagcctgggtgacagagcaaggctccatctcaaaaaaagaaagaaaaaaagaaccaatggtctgcaggatgtgtgtatcaacctgttgcctccatgatttacagctccccaagagctgcaaccctcatccctacctcacaccctatcccaaaagcaagccagaccctaacgacagctgagcaaatgctttgggtgtgtagcaccttcgcatgcactgtacaaactcctgtgttttctacaagtgcaagtgaaaagaaagaaacctacacccttactattcaaaattgatcaatattatctgggagcttgttagatctgcagaatcctagattccatcccagacctgctgaatcagaacccgcatttcaacaagatctccgatgattcctgcatgcattgacatctgagaaacactagtcattgtctgcccctgtgcttctgacgggactgggaagctttggaatggtgtacaagcctgcaccttcactgggaggtgctgatttagaggcttgcttggttcctttgcactgagaaagcctcttgctctgaatcaaaagacttgtctgatttgaagaatgaatctcttcggtggtgctgacaggaaaggtgactgacacagaaaggcagacagtaggaaacaatcaagacatgagcgattatttctctgtgagttctgttgccattctgaatgaatcgtttctgtaatctattgcataataaatggggctgctttcaaaaggggctgcggttgcagtgagactcacagtgtccctgtatttcacgaagctgaacgtcacgttaacccaatccaacttcattctatccaagtttttctccagagagtattccttgctggcagctgcaccaatgggctccaatctaaagagagaacacagcaacagcaacatcaacaggaggcagagaagacacatcaaaggaggaacttcaggccaggcatggtggctcatgcctgtaatcccagcactttgggaggccgaggagggaagattgcttgaggtcgggagttcgagaccagcctgggcaatatagcaaaaccccatctccactaaaaacacaaaaattagccaggtgtggtgtatgcctgtagttctagctactcaggagactgaggtgggaggatcgcctgagcctgggaggtagaggctgcagtgagctgagatcgtgatttcaccactgcactccactctggaaaacagagtaaaccctgtctcaaaaaaaaaaaaaaaaaaaaaaaaaagggaggaatttcagctcagtcttaggagaatctccaaaagcccttaatttgaccaaaaggtttactatcctgctctaagatctgccagctaccgccagtgttttgcagggtttctcacccttggcaccgttgactttttgggctgtgttatgggttaaatattgtctcctcaaaaattcatatattgaaattctaacccctaatatcttggaatgtaactctatttggagaaaggatctttaaagaggtaattaaattaaaataagtcatgagggtgggccttaatccattataattggtgaccttataagaagagattaggacacagacacacagagggaagaccatgtcaattcataggggaagacagccatctgcaagccaaggagagaggcctcagaagcaaccaaccctgcctacaacttggccttggactttaagcctccagaattatgagacaataaatttctgttgtgtaagccactcagtctgtggtatgctgtaagagcagcctgttcaacaaaaattatgagaggtcattattccggactgagctcctgcactagaccccagcagaccagaccaaaccaaaatggagtcactcacgctaaatggcatgtaatcaaactgaatctttaaggaaggagatagatcccagaacaggacagtttttcctgaaaacaggagattccagtctacctgactcagagaataaggaagttccctctgcttgaaccctcataaaaaaataacctgacattaattaatccttttttttcatattgttctgtttccttataaaacttaccattgtgctactgcccagtgggaactctcattctattttggaaaacagaggctgccctgattcacgaatcttgattaaaagccaattagactataactcaatttgttgctttgtcttttgatgagacctagcaaactcacataggctgaaataattgtcatggggagctgtaccgtaccttctagggtgttgagcagcatccctggtctctacccactagacaccagcagcagactccccagccctgccccatcttttgccagtcatgacaaccaaaaatgtctccagatatttccaagtgtcccttaagggtgggaaatggcccccagttgagaaccactgttgtaaggtcactaaaataagacctcttctttccatctttgtttatgccttatttgcccatattctgatttcttttatttttttttcccccagatggagtctcactgcgatgcccagggtggagtgcagtggcatgatcttggctcactgcaacctctgcctcccggattcaagcgattctcctgcctcagcctcgcaagcagctgggattacaggtgccctccaccacacctggctaatttttgtatttttagtagagacggggtttcaccatattggccacgctggtcttgaactcctgaccacaagtgatccgcccgcctcggcctcccaaagtgctggaattacaggcgtgagccaccatgcccggccagtattctgatttcttattcagattttgaacctctgttaatttatgtgatggctcttgctctacttcccatcccttcccttttcaaaaacacctactattttcctgatactgggtccacccgtccatggcccctctattccacagaaaggggcatagagggagagagagaagaggcaaacaaattcctttcttcttgtttccacatggagatctgggtcctaaaaccgaggtgtggcaaagaattggaaagccaagttcttggaagtggaaagagggactgttctctctgcctcagccctgtctttcattgcatccttgagtgtagaagagaccatctgatatttactcataggtcaggaaaccaacgctcagaggaagcaagtgacatgtccaaaatcacagagccagggagtcctggaactgggtattgacaccaattcctcctaatctgactcctaccctggtgtttcttcttccacccttatgatatgccttctcccttctcttacttagaaagagcaatagaactaggccaggcacggtggctcactcctgtaatcccagcactttgggaggccaaggcaggtgaatcacctgaggtcaggagttcgagaccagcctgaccaacatggtgaaaccccgtctctactaaaaatacaaaattagccaggcatggtggcgcacgcctgtaatcccagctactcaggaggctgaggcaggaaaatcgcttgaacccgggaggtgaaggttgcattgagccaagatcatgtcattgcactccagtctgggcaacaagagtaaaattccgtctcaaaaaaaaaaaaaaaaaaaagagtaacaactaatagaactgttcatatgtgttcaatcaaataggaccaattaaatagagcggagaaccctcatttagcctctagaagggaggaagattaggagcagaaaattacaaacaaggactgatcaggacctcagcagcgtggtcactgacttaaatatggcctgtgagaggtgaccaaaatgagtgtgcatatagggaataattaataaaggcaggtgccagcccagattagtatgagacaaagagtcacaaggcccagcctccagtactcactggctgtgtggctgtggccaagtcacttgacaggcctcaggtccccatatgcccctatcacaggctttggggttcaattaaataagaccaaatgctggcaccaggcctcatgaattaccctagggtatgacttagaatgcaaatgattgaacagatgagggactaatcagtctgggaattcatgaaatatatcaggagttgacctcacccaaaatgtgctggagaagctcattaactatgggctgtgatgaagctgcattaactatggtgtgggtggaatacatgcaatatcacacctccctaaatggtggtggctgagtccccagacatggaatcagttcaggtgacatgccttttctcctaatcctaactctaatcacctagctactctcccatgttacaaatggaaccaaggcgcacagaaggaaacaacttagccaagatgcttccacttctgaattggtcacagttgaacatgtgtgcatggaaagtataagaatagctgtatgtttatttgctcattcactgtctctggagaggggtttactttttcagcagtgaagggtcatggttaaggcctgcctggtaatggaagcctgcttatgttcaaatcttgattctttcctaagtgaaatgttcattctttcggttactagtgtgatcaatggctaataatctgaagtttatttcctcatctgtaaaatgagaataatattaggacggtaggacctaggacactaggtttttgtgatggataaatgtgttaaggtcgggcatggtggctcacgcctgtaatcccagtactttgggaggccaaggcagatggatcacctgaggtcaggagttcgagaccagcctgaccaacatgatgaaaccccatctctacaaaaatacaaaaattagccaggcatgatggcaggtgcctgtaatcccagccactcgggaggctgaggcagaagaatcacttgaacccaggaggcggaggttgcagtgagctgagattgcaccgctgagattgcaccattgcactccagcctgggacacagagtgagactctgtctcaaaaaataaaaaataaataaataaataaaaagggttcaggtatataaaatgctgagtgcagcataagtgttcaatagctagtgtctcttggaaacatcttactgggggaaagtgaggccctttggccaaaaaacctaagggtttttatcctaaacctgataaaaaacatttgcgtctctaggcctgctcgttaatgaggaacatagtggtggtattggagaggcatcacagtattcaggtggcagaaagattcaggagctgggaagtgccttaaattagacctgctctggtgcagtatgagtggggaattctcagcctttcatgtatcagaatcgcctggagcagtgctgtccattagaaatatagagtgagccacatatgtaattttaaagtttctcgcctgtaatcccagcactttgggaggccgaggtgggcagatcacctgaggtcaggagttcaaggccagcctggccaatgtggtgaaaccccgtctctaccaaaaatacaaaaattagccaggcatggtggcgggcacctgtaaccccagctactcgggaagctgaggcaggagaatcacttgaacctgggaggaggaggttgcagtgagccgagattgtgccattgcactctggcctgggtgacaaagtgagactccgtctccaaaataaaataagataaaataaaataaagtttctagtagccacattttaaaaatattaaaagacacaggtgaaattagttccaataatgtatttgactcaatatatccaaaatattatcatttcaatactaatcagtattaaaaattgttaggtattttgcattcttttttcttgtagtatgtcttcgaaatccagcctgtattttatacttacagcacatctaattcagactagctgcactgtaggggctcaatggccacatgtggccagtggatgctgctttggacagtgctgacctgaaggatttgttaaaatgcagactgcagggcccatctgcagaatttgattatgtgggttgggtggggcctgaaaacgtgcattctagctagttcctagctgacgctgatgcagcagatctgggtgccacactcacctaacagggtctccagtccaggcaatgcaacatctccccacccatcgccctgaaggaagtgtgaaaaagcaagtagggtcctgagaagctctgttctagaggtagcatccaaatggtaaaattctcacacacaaactccaggggaatttggagaagggaagaaagcaagagaaaagacttctttttttttcttttttttaaattaagatggagtctcacactgtcacccaggctgtagtgcaatggcgctatcttggctcactgcaacctccacctcctgggttcgagcgatcctctggccttagcttcctgagtagctgggactacaggcatgtgccaccatgcctggctagcttttgtatttttagtagaaacgggggtttcactatgttggccaggctggtcttgaactcctgacctcaagtggtccgcctgcctcggccccccagagtgctgaaattacaggcatgagccactgtgcccaggcgagaagagacttcttattggaccaggtttcacacaatcttaaagctcagagacggttgttgctttgtttgtttaaagaagaggaaaccgaggcacagaaaggctgaatggttttgcccccaatcactgagagctgggcttgaagctcaggttcaaagaacattaaaaaaaaaaaaaaccctttgaaataaaatccatgactcaattttctagtcacaacccatcagcagctctgcagctaaaaaacagaagcttcaccaatacgagttggtagctgcaggtaattaaatagccttaagccaccctacgccacaaggaaaaaaaaacaaacagcccgatatggagccaatcagatcactgtgggaacttacagatcctttgaccaaaaccttatctgaaggaggggataagcccttacttttcaacgaatttgccgaatccaaattcgagcatatttgagaggcaggtcgtttcggtgggctttatctcatagccaacaatctcactgatctgcaaagaaaagaggaaagcaaatgtttgttgtccgaggcagtgctgtccagtagaaccttctgtgatgatggagatgttctttttatctgcactgctcagcataacagccacgagtggcaggtggctgttgagcaccagagatgtggctagtgtgactgaggaatttatttttaaattaaattaaaaaaattttttgagacagtctcactctgtctcccaggcaacacagtgccatcatagctcactgctgctttgacctcccaggcccaagcaatcctcccacatcagcctccccagtagctggggccacaggcacacaccaccttgcctggctaatttttaaatttattgtagagatagggtcttgctgtgttgctcaaagtggtctcaaactcctggcctcaagcgatcctcccaccatagcctcccaaagtagtcacattacaggagtgagccgccacacccagctaattttaattagacagggtcctgctttgttgcccaggctgaagtgcagtggtgtgatcatgactcactgcagccttgacctcccaggctcaagtggtcctcctccctcgacctcctgagcagctgggaccactggcatacaacaccatgcctggctaacctttttctttttaaaaatttttttgtagagatggggtctcgctatgttttccacgctggtcttgaactcctatactcaagcaatcctcgcaccttgatctcccaaaaatgctgggattacaggtgtgagccatcatgcccagtcccttttactttgtaaaatgtggctactagaaactttaaaattattggctgggtgcagtggcttactcctgtaatcccagcactttgggaggctgaggcgggcggatcacttgaggtcaggtgttcaagaccagcctgtcaaacaggtgaaaccctgtctctactaaaaatacaaaaattagctgggcacggtggcaggtgcctgcaatcccagctacttgggaggctgaggcaaaagaacagcttgaaccgggaggtggaggcaggaatcagccgagatcgcaccactgcactccagcctgggcaacagagtgagactccatctcaaaaaaaaaaaaaaattaacacaaatggctcacgttatatttgtactagtcacagagggccagttttggcatctatcagtgcagtttctccctaagatcaaatgttaccttgttccatcttgctttttttttaacagttaaatttttattattttttaaatttttattattttttaaatttttctttttccatacttttttttttttgagagagagtctcgctctgtcacccaggctggagtgccatggcgcaatctcggctcactgcaacctctgtctcctgggtccaatgattttcctgcctcagcctcccaagtagttgggattacaggcgcatggcaccacgcccggctaatttttgtatttttagtagaaatggggtttcgccatgttggccagactgctctcgaactcctgacctcaggtgatttgtctgcctcggcctcccaaagtgttgggattacaggcgtgagccactgcacctggccagaccaggagatttttttataatgactcagaaagcacaaaagcaaggaacccagaagtagttaccgttgaaataacggtcttggaagaccaagagtgttataggcacatgatgaaaaaataaccaaaataacactaattgcaaataggacatcagaaatgcaccttagtgtagtgatccaaaaagccttttagatttgtggcttccatttcgtttgaaaccacagtagcaacccctttgctgttatctataaagtctgtgccccaaacgtaaggctctaactttttctacctacgttctgtaaatgaccagaacccccagcacagccatggccttgcttcagaagatccagcttctagacttgagtgctacagatggctcatccttcagatccccctgccagagctagcatctgtggcagtggatctcctaagttaggcatcagggcagagaatgacatccccaggcctggggctgtccccagggcggcctgtggtgtgacctacatacactgcagggaggaatgggctctgcctaggggcagtccggagagtatctaggggcctttgtcctttctgaacttgcctcttaactgctcagcccactgggcttccatttaggggctcactccttgggagccactgtcctagggctgtgctccccggccctctctcactgtggtttactgccccctactgcccgctcccttcctctgaccggaccttttttgcctttttgacttttccaggctgagtcaaacagtgtagaaaaattccaatcccctttcccaccaccaactagccatctgacaattcatctctccaagtctcagttttccaatccgtgaaatggagataataataatctccacttcaaaggcctgttttaagggtgaaatgtgagaatccaaataaagtatacaacacagtacccagcaccatagctggtactcagtacattttcaatatcatcattattattatggttagaatttttttactttatttatttatttatttatttattgagacagggtctttctctgttgcccaggctagactgcagtggcgcaatcacagctcactgcagcctcaacctcccaggctcaagtgatgctcccaccttagcttccctagcagctgggactacaggcatgtgccaccacgcccggctaatttttttgtatttcttgatggggttttgcagtgttggcccgggctggttctcagactcctgggctcaagcgatccacttgcctcggcctctcaaagtcctgggattataggcgtgagccacggcacctgactgggattttttaaatttaaattaattaattttttaaatagatgggtcacactatgttgcccaggttggcctcaagctcctggcctcaagtgatcctcctgtctcggcctcctaaagtgctgagattagtggtgtgagctacctcgcttggcctggttgggattttctgagtgcccacatacaagaatagcatcatagaggaagcaccaggtggagcagatggctttcccggccccgcggcatgttctccaaatgccatcgacaaggacactcttgatagtgccatctcatagagaaacctggcactaccagaggccacctgtcccacctaagctccctaacccccccatccccccgatgcaggtcaaagtcctagttaggctgggtccgtagagagaggcaccccgtgagcaccagctgacagcaactcctcctctgcggatccctctgctggggcgtttcaaaaccagaagtcatggccaggcactgtggctcacgcctgtaatcccagcactttaggaggccaaggcaggaggatcacttgaggccaggaatttgagaccagcctgggcaacatagtaagaccccccccatctctattttaaaaatcaattaattaaaattacaattaaaaaatatcccagccaggcacggtggctcatgcctataatcccagaactttgggaggttgaggcgggtggatcacttgaggtcaggagttcaagaccagcctggccaacatggtgaaaccccatctctactaaaaatacaaaaattagcagggcatggtggcacgtgcctgcaatcccagctactcaggagactgaggcaggagaactgcttgaatgtagtgagccgagatcatgtcactgcactccagcctgggtgacacagtgagattccacctcaaaaaaaaaaaaaaaaaaaaagaaaaacagaggtctactcagacagcctatctcttgtctatacatcaccccatcctttggttaggtctccagttcaagactttttgggaaactgaaagtagcttctccctacaaaaagaccctgactctctcatgtattaagagagtcttcctctctcttcctagggagaacaaagtgctccttgtcactgtgttgtcattgggtcctttcagagagaatttcctcagtcttatacgtggcttttttgtccccccgttacccaggctggagtgcagtgacacgatcatggctcaatgcagccttgacatccttggcccaagcaatcctcccacctcagcctcccaagttactggaccacaaatgtgcaccactacacctagctaatattaattaattaattagggagagatgggggtctcactatgttgcccaggctgggctcaaactatcctcctgcctcagcttctcaaagtgttaggattatggtcttgagccaccgtgcctggtcttgaatgtggttctgagagggggaattacaggccaagtcagagaagaatcttcccaaagaaagccattttcacttctaattccatacagagcgactcctggtaaaggatgtttcaaggccattgctagcccttggaagtgacaattattttagaaacacagtgagttttcttttttctgcttagtgttcacaccacacttatcaccctcacacttggttccttataaaaatcccagctatttttaaggagaatatttatttttctaatttgtaggcccaaagggctgaaagaggagtgcaaagttatttctgaacctgtttgacaataaaatgccacaccaaagtcatcctaagtgggaatcatctggtattattagcaacccccagggagagatgtgactttcttttttgtgtatcctaggtcaaggagcaaatcaaggtcctctcactgtattgaacatccctgttgcaccttggaggctcttggcctccaaaagcccatctgcttaggaagcaggaaggagaccctttgtggtcattggctcgaacaacactcaacgaaccacgaccaatgggggttccaaggaaagggccaacctgtccagggggcagggagttcattctcttccttcagaagtcttgccactctcatttgctatccctttgcccttaaatagagtctcctttcggaaaggagaagcttgacctagtaatgtttcctgccttcccaaggacagtcagggccaggcctgggctgcgctgcttgggggcgggcagtgattgatagaaacctgctgccagtgtcggtctttcattcctgggttgcaggaaatactgaggatgggaatgtactgcttgaacttatcgatcttgatcttcacattctctgctaagcgcctgggtgcaggcacatcagacaaggtcttgatcagtttatacgttgtcctccacatattccctatctcctccgcaatttgctcagcattcagtaagaagaggggtcctgaaatagaagagtgagggaaaggtcagaccatcatgtggatgttagtcatgcgtacctttaattccctgaacttagagctgtgcctcctgtcgtttggagattggaacacatacaggctttgaggatctgaaacctgcacttagccagtggaaccttagatatgatacaggacttttctaagcctcaacagtaactcctgtgacacaggggtaataatggataccctggaaggtgattgtggaaattcagtgagataatatacagtggctaacataatgcctggcatataatggatgtacaattagcatatcaatagctttttgttttgttttgtttttgaccagttgcaatggcttacacttgtaatcccagcatttggggaggccaaggtgggaggactgcttgagcctagcagtttgagaccagcctgggcaacatagtgagaccccatctctacaaaaaatgagaagaaaaagaaaaaagaaaaaaattgttattattggttttagaatctgctatagtagtaattaaaagtgcttcacaaaagccatgaaatattaaccatcggggaaaggtgaatggagatatgagagggaggctgaggcaggcagattgtttgaggtcaggaattcaagaccagcttgtgcaacatggttaaacctcatttccactgaaaatgcaaaaaattagccaggcatggtggcatgctctgtagtcccagctatttgggaggctggggtgggaggatcacttgagcctaggaggtggaggttgcagtgagccaggatagtgccactgccctccagcctggacaacagagtgagactctgtcaaaaaatatatgtattttaaaagcaaaaagtaacacctcattgtttaaacttactccaaaacactaatttccttccccttcctttattttgctaagaacctttagcatttgggtttcacatccagccaagacctttccatgctgctgcccctgcttggatatttcaaattggtattaactcttgctatgtgatgttgctaacttactcaaaaacacttcttcaggagtgctgaaactaaatctaacttcattaatttcacatgcttcatcaacccaacatttttgttgcgtgattaaaaatttaaattaaaaaaaagtatccttcatgcaccaggaaatattgtaggtgctgggctagaatagaaaggcacctacgcaacaagtgagtagcctgtacttgggagggtttggctgaattatcacggtgactttcccagtaggatgaataaagtaggtaaggctaacacttcattgttcccactctatagttgtaagagtgaagcacaaacagagtgacttgcctgggttatttgcaatcactcaggcaaagaggagtagtagtagcatttctattagaagcaatttccctctggttatgattatctagagacagcctgaactgacaaatttatatctacaacaagagagaagaacataaaataatccagggattttagacactgctatttgaagagcagttatggatccctttatccacatgacgtggtagcttctcacctcatagcttatggaaaggctatattctgaaattctaactctgatcttaaaggatgagacagcaggtggaaatttttgtagccctgtggatacagtcaactcagtcaagattcaaatatggaggttgcaggaaatattaataaattctagggtcctgtccagtccagaaattccagagttctaagaaacattgctgaagtcattcttcaaggttaatgatcttcagccccatgaatgtaaacaaataacttctaggcaaagaagcaatgtgaggccatgcaattaaccacgtctgcctattctaactccccactaaatgatcaaaggcagataataaagggaaaaacatgtgtctctactggaaattaaagaaggtgccatcaaaatgtgagctatagggagaaatttctgtaggatattcacagtagttttccaagtttagcaggcatcagaactgccaggagggcttgttaaaacacagatttctgggccccattcccagagtttctgagtcaggtctggagcgagggctcaagattttgcatttttaacacattctcagttaatgagaatgctgctttgtcctggaaccataccttgaaagccactgcaggggaaaagtggaagcgacactcactaggaatcccattgcagaacttgctgcttatccatggagagggatatgtctagcacagtaacagccctgccaaagctgacttttaacaaaggcagcttgatcccttgataaaatattccactcaataacagcagagtacacattcttttttattgcaaatagaacacttaccaaggtgaatcttattctgagtcataaaacaaacctcaataaattgaaaagaagtaaaatcatgcaaagtgtcttttatggccataatggaattaaattagaaataacaataaaaacataacaagaaaatctccggtgactagaaaattaaacaacacacttataaataatccataggtcctagaggagtctcaaaggaaattagaaagcactttaaattgaacaaaatttgtgagggacaactataaaggataaatttgtagcattaaaaaaggagaaatttctaaaataaatcatccaagtttctaccttaagtaactagaaaaagaagagcaagataaatcaaagctagcagaaggaaggaaatgataaaaataagaacagaaatccattgaaaacaaaaataataagaaagattattgaaacaaaaagctgtttccttggaaaactaaaattgataggcctaaaaaaaagataaacttctagcaagacaggcaaagaaaaaagaaagaagatgcaaattaccaatatcaaaaataaaagatgggatatcactaccaacctctcagacattaacagggtaataagggaatgctataaacaactcaatgtacataaattagaccatttttttttaaaatgaagccattcttcaaaaactacaaacttccaaaaacttattcaagataaactagaaaacctgaatagttttataactattgaagaaattgaatttatagataaaaaatttccaaaatataaaaacttcagaatcagatggtttcactggaaaattctgccaaacattagaagaagaaaaaaataacagcaaaacctgtataatctcatctaaaaaatagaagaaaacatttcctaacttattttaacaggtcagtgatacgctgatacaaaaaccacacagatacattacaaaaaaaaaaaaaaccctacagaccagtatctctcacagacactaaaattctcaacaaaatattaggcatggaaactgaatccagcaacacatgaaaataataatacaccatgtccaagtagggtttatcattggagtgcaaggctggtttaatatttgaaaatcaaacaatataatatacagtattaacagcctcaaaattttctgtaatttgcaacaacatggatggaactggaggacattatgctaagtgaaataagccaggcacagaaagacaaatactgtatgatctcactatttgcagaatctaaaaatgtcaatttcatagaaacagagagtagaaaggcagttaccagaggcttggatgaggcaaagggatggggaaggaaaggaaagatgttgatgaagggtacaaagtttcagttatactggagaaataaattttagtaatctattgtagtgcatggtgactgcagttaataattattgtatatttcagctgggtgaggtggctcatgcctgtaatcctagcactttgggaatcagaggcgggtggattgcttgagctcaggcgttcaagaccggcctgggcaacatggcaaaatcctgtctctaccaaaaatacaaaaaattagctgggtgtggtggtgtgcatctgtagtcccagctactcaggaggttgaggtgggaggatcacttgaacctaggaggcagagattgcagtgagccgaggttacgtcactgtggtccaacctaggtggcagagcgagaccccatctcaaataataataataataatgtcttgtatatttaaaagttcttaaagaatagattataaatgttatcatcagaaaaaaaatgataaattggtgagggtgtggatatgttaattagcttgatttaatctttctatgatgtatacatagatcagaatatcacattgaaccccataaatatacataactacttgtcaactaaaaataaataagtaaaaattggaaaaaaaaaagaaatagaaagaaaatccaccagaatcaacaaaacaaactcctggaactaataagtgattgcagcaggatcacaggacacaatattaacattaaaaagtcaatcactttccaagatagcatcaatgaacagtggaatttgaaattaaaagcatagcccaggcacagtggctcatgcctgtaatcccagcactttgggaggccaaggcaggtggatcacgaggtcaggagttcgagaccagcctgaccaacatggtgaaaccctgtctctaccaaaaatacaaaaattagccgggtgtggtggcatgtgcctataatcccaactactcaggaggctaaggcaggagaatcacttgaacccaggaggtggaggttgtagtgagccaagatcacaccattacactccagcctgggtgacagaataagactctgtctcaaaaaagaaaaaaaaaagaaattaaaagcataatactatttacattggcaccctaaaaattaaatttgtacttgggcaaaaatctaccaaaatatttgcaagatctgtatgaggaaaactacaaaaaactctgatgaaagaaatcaaagaagatataaataatggagagatattccataatcatggataggaagactcaatattgttaagatgccagttcttcccaacttgatctatagattcaacacaatcccagtaaaaatcccagcaagttattttgtggatattgacaagccgattctaaaatttacacagagaagtaaaagatccagaatagccaacacaatattgaaggggaagaataaagtcagaggactgatactagccagcttcaagagttactataaaactattgtaatcaaaaaagcgtggtattggcaaaagaaagtcacatagatcagtggaacagaatacataacccatccaaaaatagaaccacacaaatatagtcaactggtctttgataaaagagcaaaggcaatataatagagaaaagatagccttttcaacaaataaagatgaaaaaattggacatctatatacacacacaaaaaaagaatctagacacggatcttacacccttcacaaaaattaactcaaaatggatcatagacttaaatctaaaatggaaaactataaaattcctagaagataacataggagaaaatatggatgaccttggatttgagaatggctttttagttacaacacagaaggcacaacacatgggaaaaaaatgataaactaggaatgaaaagattctcccctgtaaaagatgttgtcaagagaataaaaaaggcacagtctggaagaaaatatttgcaaaaaaaaaaaaaaaaaaaaaaaaaagatctgataaatgactattatctaaatatacaaagaatttttaaaaattcaacaataggaaaacaaaaacctgaaacttaaaaataggcaaaagctctgaacaaatacctaatctaagaagatatacaagaggtgaataagcatatgaaaagatgttcaatatcattgccattaaggaactacaaattaaaaaacaatgagtggctgggtatggtggctcatgcctgtaatcccaacactttgggaggccaaggtgggaggattgcttgagcccaggaatctgaggccacctggggcaaattagtgagaccctcatctcaatttaaaaacaataacaacaacaatagccaacaacagataccactacacacctattaaaatggtcaaaactcaaaacactgacaacactaaatgctggcaaggatgtggagcaacaggaaatgtcatttatattggtggaaatacaaaacggtacagcaactctgaaagacagtttggccgtttcttacaaaactaaacatattcttatcatataatccagcaattgtgcttcatagtacttacctcaaaaagtgaaattcaaaaacatacatcatttacaatagctccaaaaaaggaaatatttatgtataaatttaacaaaacatgcataggagctgtatgctgaaacctgcaaaacactgataaaaagaagtaaaaggagaactaaataattgaagagatgtaaagtgtccattgattgaaagactcaatgtaataaagatgtgaattctttccaaatttatctatagatttaaaacatttccaacaaaatcccagcagagttttttggtatgtatagacaaactgattctcaaatttatgtggaaaaataaagggactaaaatactcaaaataaaattttaaaaagaaaaatgaagttagaagaatcacactatgtgattttaagactttctataaaaatacagttgtcaagttgatgtggtatcagtgaaaggcttgacatatagattggcagaacagaatagagtcaagacatcaacccacgaagatatggacaactgatttttgacaaagatacaattaagtggataaaaatttttttttcccaattactggaaccattggacatttatatgtaagacaatgaacttgaactaagcctcgtattttaaaaaaattaactcaaaatggaccataggtctaaatgtaaaacataaaaccacaaaaaatctagaagaaaatataggagaatatcttcatgaccagggttaggctaagagtccttagagatgataccaagagcacaatccataaaagaaaaattgatacgttggacgtcatcaaagttaaaacctttttctctgtgaaagacactataaagagaataaaaaaacaagccatggacttggagaaaatatttgtaaatcacataatctcacaaaatttataaagacctcacaaaactcaacagtaagaaatcaaacaaccaattaaacaaatgggtaaaagacttgaacagacacttcaccaaagaggatatacaaatgacaggtatgcacataaagaaatgttcaagatcattaggcattggggaaatgcaaattaaaatcataatgagacatcacaactacttatgagaatggctaaaataaaaaaatacaggccaagcacagtggctcacacctgtaatcccagcactttgggaggccgaggcaggtggatcacctgaggtcaggagtttgagatcagcctggccaacatggtgaaaccccggctctacgaaaaatgcaaaaattagccaggtgtggtggcatgctcctgtaatcccagctaaatgggaggctgaggtgggagaattgcttgaacccaggaggcggaggctgcagtgagccgagatcacaccactgtacaaagtatgacaaagtgacactccatctcaaatatatatatatatatggacaataatacccagtggctggttgatatggtttggctgtgtccccattcaaatgtcatctagaattatagttcccataatccccacatgttgtgggagggatctggtgggaggtaactgaatcatggggtcgagttttcccatgctgttctcatgatagtgaataagtctcatgagaactgatggttttataaagctcagttcccctgcacatgctctcttgcctgccgccatgtaagaagtgcctttgctcctccttcaccttccaccatggttgtgaggcctccccatccaagtggaactgtgagttcattaaacttctttttctttacaaattacccagtctcaggtatttcttcatagcagtatgaaaatggactaatacactgatgaagaggtggaacaactggaattatcacacattggtgagggatgcacaacggcacagccactgtggaaaacaaaagtttggcattttcttataaacttgcaaatatactttaaatataattcagcaatccactgctgggcatttaccctagagaaataaaaacttacattgacacaaaaacgttgacataaatatttacagcatctctatttataatagtctgagagtgaaaacagtgggtaaatggttaagctggtgtatccatagaatgggatactactcgcaataaaaggaaatgacctattgctacatccaacaactcggatgaatcttaaaggcagtgtgctgagtgaaggaagcagtcttgaaagattgcatactgtatcattccatttgtaggaggagcctcaaaaggacaaaactataggaacaatgaagagatcaatagttgccaggggttacaactggggggaggatttgaccacaaggagacagtccaaagaaatttattgagttgatgaaattgctgttttctgattgtagtgatgtttatatgaaagtcaacaactgttaaaattcatagaaatgtatgccaaaaatgtccattttaatgtatataaatttaaaaataaaatgtaaaatgtttttaaaatacaatacctatttctaataaaaacacttggtaatttataaatactgttttttttgagacagggtctcgctctgtctcccaggttggagtgcagtagtgccatcacagctgattgcagcctcaacctcccaggttcaagcgatgctcctgcctcagcctcctgagtagctgggactataggtgcacaccaccatgcccagctaactttttcattttgtttttagtagaaataaggtctcgctaagttgctcaggctggtcttaaactcctgagctcaagtaatccttctaccttggcctcccaaagtgctgggattacaggtatgagccaccatgactggctttcttgtgtttataaatactgaagcactagaaacttgctaaaggctcaaacctaagggtctctgatttttttttttttttttgagacaaggttttgctctgatgcccaagttggggtgtagtaagcagatcatagcttactgcagccttgatctcctgggctcaagcgttcctcccatcttagcttctcgagtagctgagactacacgtgcaccatcacacttggctgattttttattttttgtagagacagggttctcactatgttactgaggctggtctcgaactcctgggctcatgcaatccccctgcatcagcctctcaaagtgctgggactacaggtgtgagccactgcacccagacaaggatctctgattttgtcctctgttcttcaacaccctccacaggtgttatcattcatggctttgattgtaatctacacatcaattattccccaacataaatcccacccgccaaatctctctcctaaaatccacactgatacactcaattgctatttaatattcccatttgattgtttccaggtgcctcaaactcaatgtattcaagttgatgggtttttttttatttgtttgttttgttttgtttttttcccaacaaatctgtcacttctctttttcagtgatggtaataccaaccaaattgcctgagccagtcatctggaagttggttctttgctgttattatcctcactcatccctgaagtaagagaactaagtcttggagaagctaagtaacttttcccaaaggtcagctagtaagttctttaagcattaaaattcttacctctgaggcaataaaattcttacctttgagaggatagtaacctcttcctccctgccccttaacccatatcggatcaatcattaagtcctgttgattccaactcctcaatacctttctggaccccagatcctagagtaaaaggtagtttacaaatgtctatggcaccctggcaccctggtctttcctgaagcagcaccatcgtgaaactgccatctgttctcctaccatctgcaaatctaagtcgtgactctgggtggctgcctattgtgttttaccctggaaatagatctggctctttctccaccttccatttttattatcacatcagataattttgactgtggctgccttaatctggagtgtcagaatctgattaaaagtccagccagattcttaagtgcaaaccatatttcagaagtgactgggtggatcctccacctcatccccatctgtcccagcagagtgagatcaccacataccattcatccattcctctgacttgatgctgaactcataggctgtcgaccacagctgctcataaggtactttgttcttcagcatggcctgcagaagagggtaagtactcttctccttttccaatagctcttcctccttattgatcaactgcagggcaaaaggagatgctgtttatgggatgggttgttctcctaagccctcgaagacaccagggcaaattcctcagtgccttgaaaaccaagtggagggaaatgcttattcatctggagagtaagagaggaaactaaagcatgaactcaagcaagaatgtccctctgccacctccaaggaccttggcagctgaggtctgtctggttgaaactgtaggataatcagctacttgccctatcatctctgtttccactctatgacagccatatctccgttttcataattttcatatgtactttagctacatatatgatgttacctccttgtactgacttgcctcagaagtaagaattttaatggttattaaagaacttactagctgatctttggggacagttacttagcttctccaagacttagttctcttacttcagggataagtgaggataataacagtacctaacccaaagatgtgttacaggcattaagtgaaatattgcatatgaagctcttgaccattgctaagcacataataaatgttcaataaatgtgaacaattaccttactataatttcttctttggatgctcagtaactaataaagggaaaagtctggtgtcatgaagggatatgggaaaaggtagttgaaagtaccagtgagccaggtgtggtggctcatgcctgtaatcccagcactttgggagatgaggcaggtggatcacttggggtcaggagttcaagaccagcctggccaacatggcaaaactctctattaaaaatacaaaaaatgagctgggcatggtggcacacgcctgtaatcccagctacttggaaggctgaggcaggagaatcacttgaacccaggaggtggaggttgcagtgagatgaggtcacattactgcactccagcctgcgcaacagagtgagaccttgtctcaaaaaaaaaaaaaaaaaaaagaaaagaaaaaagaaagtaccaatgaaagaactggccaatgagttaaccaatactatccacctagtagatgctattaggaaataggaaattcacaaccaaggatcagaaccaatagaccagtacagtgtcataagtccccatctcaagatcccaaacctcaaactctgcaaacgcccgatttaggttctttgaaagctcattaagcttttcaacattgtgcttcatttcttctgtagtcatcacttcgcgcttcctaaaactttccagttctctgtggtagccctcaagtctcaactcaaattctgagcatctgaaaataaagacagcctggttacctttggactttgcattttgtgcactttcaaaacatcagcactgcttgcccatatttaagcctgcagacaatttgatcagttacctgcagatttcctcccccaatactcccaactccatctttctctctctctctcaagataaatgaagatgaaaaaataagttaaactacctataagaccacctcccagaaatcgagctgttgtgagcctgttggtggttaaacatttccagatattttcctgtacaggtaaatacgtataagatatatgtacacgtatacatactgtttattcattcagccattagacatttattattgagtgcctaatatattctataactgccctaggcatcaggaatatatttgcgaagtatgctattaagttctctaccttcatggagcttctattttaactgagggagacctagacaatagacatggatggatggatggatggatggatggatggatggatggacagatggatggatggatgaatggatggatggttggatgaatggatgaataaatccatagacaggacaaacaataaaatatttctgttagtaataaatgctctgaagaaaataaaatagggcagaatgactagcagacggaagtggagggctactgtagctacagtgaccaggagagacctttccaaagatttatcaacttcatccatattatcaacaaagcaggtctcaatgagaactgctccctttttctaatgaggtagaataatatagtgtgaagtggacagggtcttgagacaaacaagctagcttcaaattcccaccttgccacttagtagctatgtagtcttgggaaagtcacttaaactctctgtgcctcgggtagataaaacaaggatagaaaaaatgccagcttaatagttaaagtcaataagaacaacaataacaaaaaaaagctcagaattgagcctggtatacaatagtcaatacataagtgtttgctcacattcactaaaatgtaaactctataaatagttgatttttacttatttattaatttttacccagccctgttcaaggaaataaatatgtttcttgtctccttaattccttttagtgtcttcagcagttagaccatctgatacatggcaaataatcaatactcttcaaacaaataagggaacttgtcattgagatcagctatagtgacatttcataaatttggttatcctaagaatgcttaattctgttatggcagttttaaagttgcttttttcttaaacatgatttagagaattaattttcaagtggtttgagtctctctctctctctttatctctttctttctggagtgcagtggcacaatctcggctcattgtaacctctgcctcccagttttaagtgattctccagccacagcctcccaagtagctgagattataggtgcccgccaccatgcccagctaatttttgtatttttcatagagatgtggtttcaccatgttggccaggctagtctcgaactcctgacctcaggtgattcgcccaccttggcctcccaaagtgctgggattacaagcatgagccacatattccggcctccattccttttctcagctttttatttttgttttgtaataagctgtaattttagactctggtcagtgttcattttcaagaatatccttagtgtaaaaacatttcattcattcactcattaaaatggtgaacatccactataagcaaggaaccgtgttctatctgaatccttaggctttggtgaaacacaatgtcgggtgctctccctaagatgtcttcccttcttcctccagggtgccaaagtgttttcctttgcccttttatggcagagagcagcagctcacatccctgagtcatccatcgtgtaaatatcacataacttccagaaccacggaacctaccactgagttggatgaaatgatgggggagagaggcaatgcttattattcttctgttgtacatgcaattaggtgctgctaagtgccttttcacatcattaaattctttttgaagctccaaatactatactcacatagaaatctctgatgaaagcagttttgaattcctcccagagggcaactgcatgtaagctcagtgattaccttaaaatattactattattattgtttctaatttcttataattgctaagtacattatagtttccaaagtactttcatgtccccacaacacacacacatacaaacaactgctccttgacttacaatggggttacatccctataaacctattgcaatttgaaaatactggaaattgaaaattcatttaatacacctaacctactgaacatcagagcttagcctagcctatcttaaatgcactcagaacactcacattagtccacagttatcatctaagacaaagcctgttttataataaagtgttgactatcccatgtaacttattgtataccgtactgaaagtgaaaaacataatggttgtatgggtactcaacatatcactttcacaccatcagaaagtcaaagaatcgtaagttgaaccatcgtaagtcagtgactagctgtgtgtatgtgtgtgtgtatatatgtaaattccatacatatttcatataaataaattcctatatatatatcccaatatattatattccatagaataatacaatcattagcaaatagtaggcactcatgaaattaggttgaataagagttgtatttgtgggaccatttagagtgtaaggggaggattctggcaggaaatagaattcactcccatgttcaaagaaagatactttaaggattacttgcaggggtgagatatggataggattaaaggaacaaatagcagacagtgaggcacccagagactagcatcagagggaagccattaggacccccaggctggggacaatggaaactggaaccatggaggaggaggcattgacatcagagggatgcagctactgcctctgagccccagggccaggcagggagggagaggaggaaaagcttgctagctactctcccacctcctgcagggctctgtggacagggcccagcccggatccaacagacaagagaatccaacactgcagattgggcatcaccttccaggtgcagagccggagggtggggtaggaacagcaaatggagaataatcggcatggaaccccaaaaccattaatgtggactgggaaaataaagccagatttcttgcagaggaagcaagattgttttctcatgagatggatggatgcatgaatatggcttaatccatctcacaggctgttctcaggattaatgcaacatgatggacataaggatttaaaggttcaccgaagagaggggtgagcccagggctgccctgctgagcctcttctagagccgccctctgctggcccctgctgttaagagctggggaaccagcggatgagatcaagctgagagtcacccctcagaaggagacaaggacactctactcctctcgtcataaatgacaattgttcccattcctcacagagccacccctcactcctcctaacttcaacagcatttactgtctctaattggtcttggagtaatattctaaaatcatgcatgcaaaattgatgccttggaagttgagaagcgtttttctccccacagaggtccctgttcaaagggagaaggaagctgatagttttgggattcctaccacgtgctgtttaccacctaagcacaatctcagatcatctcatttcatccttcagcaccatgagagagggtctgattctatcccgttctccagatgaggggcacagagtctcaaaaagatgagccttctgtttatttatctaacaaaaaaagtgattttgccacccaagttgtaagtttacttatataacaaacctgcacatgtactcctgaacctaaaataaaagttaaaatatattaaaaagcaaataaagaaattgctgggggaaaatgattttactttcctggttagacataaaaaagtggtagatatatagagtggatactactcagccataaaaagaatgaattaatggcatttgcagcatcctggatggattgaagactattattctttttttttttttttttgagacagaatctcgctctgtcaccaggctggtttcagcatgttggtcaggatggtctcaatctcttgacctcatgatctgcctgcctcggcctcccaaagtgctgagattacaggcatgagccactatgcccggccaggagactattattctaggtgaagtaactcaggaatggaaaaccaaacatcgtatattctcactcataagtgggagctaagctatgaggatgcaaaggcataagaatgatacaatggactttggggactccagggaaagggtaggaggggggtgagggatacaagactacaaattgggttcagtgtgtactgctcaggtgatgggtgcaccaaaatctcagaaatcaccactacttactcatgtaaccaaataccacctgttcccccaaaaacctatggaaaaaaaatcagttccatagaaaagggtgtagagggtgtgtgtgtgggggggggcagggtgggggagttgggaggtatatgggaattctttgtactttctgctcaattttgctgtgaatctgaaactgctctaaaacatagtctattaatttaaacacaaatcaattccttccatcaggctaagttctgggctccagggccagtatccatccaggtggaggcaggaaaatacacacacactcacaaacacacacacacaaatgttttgcactccctggggagcacacttaggccacattttccaggtagcaactacatgggttgacccttcagccaaaactctcccatttggtgtagaaatccctgcttttatctattcttgtcctttcttgtaagtatttgcaggaactatggcagctcaagttgggagtgggagtttcttatgtgaaggggacagggtaattgatatgaatctgcaggtcataatcaaaacgtgaacctggagtgggtgtgtgtgtgtgtaaaaccatgtccatggcactggcccacttcacttgacattattggatttgtcagtatgtctatattttctatgtcgctggattaaaatctttatttagcagccaaacacacatagatgtctagaacagagcatagcacatcatgaaaatccgcaataaataccaactgaattgacaaataatgaatgaataagtgattacagccacattagctctgaataagaccagctgcaaaataggcaatttctcagcccccctgccatgcctttattatcttgatatcttgatatcttacagatctgtggtctccaatgtaaggctgacaatttcactattattattggggaggccgttataacatgccactagttttgcgtttttctctctgcaccaccaaattccaattattcaaggcaggaagggaagacattagcagaggttattacagtgaagcagtcttaaagaaaacatccctcagtgggaaaccaaaggaaatgccttctccaccaattgttttcagacttcgcccacacgttgccatggagtgagctgggggatggcttagacagaaccaggaacctgcagcatgggtgaagaagtcaggtctcatttccaagacaatcccagactctcccggtaccttttaatcagatccatttctgcctgatccctcttgtgaaggagcaagttccggctgttgtcaaagatatcttcaatctggtctggccagaggaacagagtgctgttcaatttgatgtcctcatctgcaaaacacatactgcctgctccaggacactgtttagcataggtcgggtcagcatgtggcgaattaattagacagaacaagaggtcaacaggagtggtgtgggggtggcaatgaacacatggatgagtgacagtgacatttgttgagcacttactaagggccaggctagaaggtagatgatattatcatccttgtttgcacagatggcaaacacagccattgagcctagtggtcaaggttacactgctagaaggcatcagagaggaattcaaatccaggtctaattccaaagcctgtgttctaacctctctgcttgattgccttcctaggctaggtctgagtcaagtcagaaacccagattgatgctctcgttccacagttcaaactatttcacttcatctgcatgtcggtttccctttaggttaaatggcagtcatggtatcaaagccaaatgccctacccattttatgactctggtgaattaaaatgtccaccctgggtttcctttgtgaatttcgggaggcagagcccacagtgagagtccacggtgtatccaggggtcgagggcacagctcgtgaacatgcaggtggatggttagggaaccacttttcactcccagtccccatctctccctcccatcaacctccccctgacatccatacattgtgaacaccaagtaattcacaggtattttcagatagaaaatggcttgttgagaggttattaacttttccttcagaatctgcttctcactttaaaactctaacttgacccaacaaactttcaaggagccctgactatttttttccttttacaatacacaggagcatgaagaaaagtgtctcggcctcttcaaaagtgggattgatgaagattacagatgggcggccaggggctgtggctcacgcctataatcccagtacattgggaggtcgaggcaggcagatcacttgaggccaggagttcaagactagcctggccaacatggagaaactctgtctctactaaaaatacaaaaattagttgggcgtggtggcacgtgcctgtaattccagctactcaggaggctgaggcatgagaattgatggaccctgagaggcagaggttgcagtgagccgagggtggcactgcactacagcctggatgacagagcaagactctgtctcgacaaaaaaaataaataaataaaagattacaggtaagtaaaatctactcatttaaaaaaatgattctgcatttggaagtgacttttccaggaacaccagacacagatgccaagacagggatctaagaactggaggtcggccaggccccatggctcacgcctgtaatcccagcacttgggaggctgaggcgggcggatcatgaggtcaagagatagagaccatcctggccaacatggtaaaaccccgtctctactaaaaatacaaaaattagctgggcatggtggcacgtgcctgtagtcccagctacttgggaggctgaggcaggagaattgcttgaacccaggaggcggaagttacagtgagcctagattacaccacagcactccaacctgatgacagagcgagactccatctaaaaaaaaaaaaaaaaaaaaaagaactggaggtcaagtgtctatctatgtctcctttgtgtctaacaagattccttttgtgtgattcaaattactgtggatatgagtataaaattcgtgcctctaacatatgggggcacttgaaaggcagctcttttatatttagtggtagaattcatataactatccttttgctcaacactttacccctaaatatataaatacatatagactatttgaaatgttatatatacaaatataaaatatacatataggtatgcatttcgatggtcacacatggcattggacttacacggcaagtctgcatagtccatcaggaactccagccgttcacttgcatctctaagttgcctcctgagtttgaacacagtgacagcactggatttctttaggaattcaatgagggataccagctccttagtgttggcaggaacctcactgactttgtctgcgatgtggctgtactgattacaaatgctacagaaaagaaacagccattgttatcatcatcatcatcaccatcatcaccatctaaaatgactttcttgtaagactccatgttcaaaatacataattcctatttgaaaaaaaaagaaaatttttttttaattttttccctgcctgcaaatccttgatggataatattcacatgcacactaaactccaggaataatagcagttgtaatgataataatacctgttatgtattaagccattatgaagtagcacaccccattctaatcatttacatagattaactcatttaatcctcacaacaattctaagaggtagatactactattatctatactttataatggaagaaagtgaccctgagtaacattatcgaaagcaacatggtatgtgggtgtcagagccaagatctgaacctgggttaattgactccaaagctcatactcttaacaaatacaccatactacctctcatacacagaacctagatttagaccaaaacaccaccaccaccaccagcaattcatcacattttgtgttgaaatagagcactaaattaatttttaatctttttttttttttttttttttgagacagagtcttgctctgtcacccaggctggattacagtggtgtgatagctcactgcaacctctgcttcccgggctcaagcaattctcctgcctcagcctcccgagtagctgggattacaggtgcctgccaccatacccggctaatttttgtattttaagtagagatggggttttgccatgttggccaggctggtcttgaactcctgacctcaggtgatctgcctgccttggcctcctaaagtgctgggattacaggcatgagccaccgcacccagccttaatcattgcttttaacagaacaacagtaagtttatcctcatgggctacaggtaatccctcttggcagagaaaatgttccattactgggactaccaggtctaactggccacttttcaaacataagactgaaaaatgatgttattatacagataatttgaatatgctctaatttatgcaaaagcaaatgactgacggtcttggcatcttaactacaattagaagcaaatcatccgcaatacgtccactcctagcacagagtggccctcaacaaatgttagcaatgataccatagttttgttattattacttgatcgtgacatgtttttttttttcttttttgagatggagtcttgctctgtcacccaggctggtgcacagtggtgtgatctcagcttacggcaacctccgcctcctcccaggttcaagcaattctctgcctcagcctccctagtagctgggattacaggcaccgcccccacccaccaccacacccggctaatttttgtatttttagtagagatggggtttcaccatcttgaccaggctggtcttgaactcctgacctcatgatccacccgcctcggcctcccaaagtgctgggattacaggcgtaagccactgcgcccagccctgttgatgttatttttaaggcagacagaaacttcagaagtcagccaccaacctggagttcagctgccaacctggggtgtctgcattcttagatattcctgggttcagaatgaggctcttattttcacttatattaaaaagacctaaggacattatacatttatttggataaggatgaatgcactgatcaactaaggcaccatgttgctttgatttgacaggaacaaatggatgattgcttaagggaaaaaaatgcatggctcaaactttccaaagaaagtctccaagtaggccgggtgtggtggctcacgcctgtaatcccagcagtttgggaagctgaagtgggagtattgcttgagccagggagtttgagaccagcctgggcaaatggcaaaactccatcactacaaaaaatgcaaaaattagccaggtgtattggtgagcatctgtagacccagctacttcgggggctgaggcaggaggatgacatgagcccaggaggtcgaggctgcagtaagctttgatcatgccactgcactccagtctgggcaacagagtaagaccctgtctcaattttttaaaaagtgtccgagtagtgtgaaggctgaaaaccttttgctgtcctcgtcccaaacccatatcctataggcaaagaagctgaagatacaggctgggtgcggtggctcacccctgtaatcttagcactttgggaggccaaggcaggcagatcacctgagatcaggagtttgagactaggctgaccagcatggtgaaaccctgtctctactaaaaatacaaaacattagccgggtgtggtggcacacacctgtaatcccagctactcaggaggctgaggctggtgaatcacttgaatctgggaggcggaggttgcagtgagccaagatcatgccactgcactccagcctgaacaacagagcgagactctgtctcaaaaaaaaaaaaaaaagaaagaaagaaaagaaaaagaaaaagagaaactgaagatccaagagacaaggccagctattctggctccaaaaccaagaatctgacctcttcatcaatgaatgagaaagctgcttgcacatggactttgaggtcaaaatgggttaattcccagatatgccactgcctaacctgtcagagtctcagtgtcttcatcaacacgatggggaaaataatgaacaacctcttagggctgttgtgagttcctgattagatctattctgtgcagggtacttatatggtgcctagattataccatgtgctgggaagatggtcactagtattattattaatttgctgatgattttctgatatgtattttgtaaaacttatagtactataaaatgctaaaattacacatatatgaataatacagtatacaatataatattaatagcggtgattattactaaatcattttattttacatttatttattctgaggtagggtcttgctctgtggcccaggctggagtgcagcgcctcaatcataactcactgcagccttgacctcctgagctcaagtgatactcctgcctcaacttgcatacctctctcttttttttttttctttttttttgagacagagtcttattctgatgcacaggctggagtgcagtggtgtgaacatggttcattgcagcctcgacttctggggctcaagtgatcctctcgcctcagcctcttgagtagctgggaccacaggcacatgccactatgcctggctaatttcttaatttttatttttgtagagatggtatcttcccatgttgcccaggctggtcttgaactcctgggctcaagcaatcctcctgcctccacctcccaaagtaaacccaatctcatgttgggactatagacgtcagccatggcacctggccactaaatcattttagtctatagtttaaagtgctttgaggaagagagctaggataacatggaataaccattttctaaccttcaaatagagacacagtagaaggcagttgccatctcagccaagcatccattacctctttctgtaacaacacctatgtattatcggggacccccacccctttcagctcatgtggtttaggtggtgttgacacccatcccagagatgggaacacccagccagatctaagccatcctcttggccagtgtttgattcaatgttgtacaaacgacctaagtcaggccaacctcacatgggccaggacttttccaaggatgatagaaaaagaaattttttgcctcctctggataggaatccgggaggatgtaagcctggagctgcagaagcccataaactggagagaacctgttagagaatggagccaacgtggaggaaagccaagcagagagagaggaattgcatcctaattgcagcattgagggcctgaagctagaaaccctaaacttttcaacatgtgagccacaaattccctttttaacccaagctagtctgtttgagcttctatccattataaccaaaaacatcttgtctaacacgtagttgtcagtaaaataaaggcataatatagagtttaagattgaacaatggaaccaaacatggtggctcacacctgtagtcccaacagacttaggaggttgaggcagggggatcacttgagcctgggaggtcgaggctgccatgagctatgatcgcgccactactgcactccagcctaggggacagaacaagaccatgtgtctaaaaaagagaaagaaaaatgatatgcaaatagaggcaggaggattgcttgaatctaggaatttgaggctaccgtgcactgtgactgtacctgtgaataaccactacaatccagcttggacaacatagcaagaccctgtctctgaaaacaattagaaaattcgccagccatgatggtggatgcctatagtcctagctactcaggtggctgaggcaagaggattgcttgagcccaggagttcgaggctacaatgagctatgatcaggccactgcactccagatagagtgaaacctccttttgaaaaagaaaaagattgaacaacagaattcccggacctatacagcagaattctgcctaggagtgattctaaggaaaatgcgcctgtaagcactttgtgtttcaaaatatgtgctagatgaacagtgagaagggcctgtgacctcagacagacaagcccaggaagcagtttgcattctcctgaatttgcctgcaagaagacaaaagcttcaggatcagagacaaactgctaacaaatgccctccacccgcctactccaacccccatgtcgctttctcttgactgttcacctcctagcctgaacctgaattcctcactacccttacttaggggcagaaaaaacttgatctagaaaataatctgttcattgctggaaggtgcaagttctggtcactttttcgtctccagttggtgccaaataccattgctatttgtctgcacagaattacaatacctggtattggtgtctcggtttacatccacttggaattgaatcagatggtctttaagattttgagctcgctcacagagatcatgatttagggccgtagcatcaaggcagaacatggctaaaggcacggtgatgttcatggatgcaatttcatttctccgtttctttatggcattgatcttctgcagaaaggagcacattcagtagcttgatttgcccttgagcctctcccacttgcccccagcctaacccctggccaaccctagtccaatgctgagcatggtctatgcaccaaagagacactaactgctcattggattgtctgcagcacatgtcaccaaggtataaaatctcaagtggcatttcctaccgtcacaaaatcatcaatgtcatgattttctttcaggaacgcagcgatgttttgctctgccgtgttatccaataagtcaacatactttttgtagacatttaaatatcttccatattgaagggtgtgaaatcaaacacacaaatataagtcaaccaaatcagatgagtcagagtggcaaatgaagacatagtagcattttaaaaaatgtagcccaagccaggaaagagaactataatgtggcaaaagtttcattaaacagagaactcagaattttggctctgattttcagtttcaccacttcctagcagtgtaaacttagacaagatatttcagtttttcaaggatgggtgttgtattagtccattttcatactgctgatagagacatactcgagactgggaagaaaaagaggtttaattggacttacagttccacatggctggggaggcctcagatcatggtgggaggcaaaagacacgtcttacatggcagtggcaagagaaaatgaggaagaagcaaaagtggaaacccctgataaaccatcagatctcattagacttattcactatcatgagaatagcacaggacaaaacagcccccatggttcaatgacctccccctgcgtctttcccacaacacgtgggaattctaggagatacaattcaaattgagatttggtggggacacagccaaaccatatcattctctccctggcccctccaaatctcatgtcctcaaatttaaaaccaaccacacattcccatgctgcccaagaccatgggaacccacctcttgcatcaatataacctggatgtgagacctggagtcaaaggagatcattttggagctttaaagtttgactgtcccactggattttggacttgcatgggccctgtacccctttgttttagccaatttctcccatttggaatggctgtatttacccaatacctgtacccccattgtatctaggaagtaactaacttgcttttgattttacaggctcataggcagaagggacttgccttgtctcagatgagactttgcactgtggacttttgggttggtgctaaaatgagttgagattttgggggactaatgggaaggcatggtttgatttgaaatgtgaggacatgagatttggaggggccaggggcaaaatgatatggtttggctgtgtctccaccaaatctcaacttgaattgtatctcccagaattcccacttgttgtgggagggacccagggggaggtagttgaatcatagggctggttttttcccatgttattctcatggtagtgaataagtctggtgagatctgatgggtttaccaggggtttctgcttttgcttcttcctcattatctcttctggcaacacctacacaaacatacccaggattaatactttgtatccctcaatccaatcaagttgacactcagtattaaccatcacagttgtctttaattttattttattttattttttgagatagactctcactgtaacccaggctggagtgcagtgctgtgatctcagctcactgcaatctcctcctcccagcttcaagtgattctcttgcctcagcctctggagtagctgggattagaggcatgtgccaccacacccaactaattttggtatttttaatagagacagaattttgtcatgttggccaggctgctctcaaattcctggcctcaagtcatttgcccaccttggcctcccaaagtgctaggattacaggcatgcatcaccaggccgggcccaatgtctttaattttaagtggaaatgatcattaacacctcataggattattgtaatgcttaactgtaataaagcacacacaaatgaattaatgctgtgcctgacatacaatgaatgtgctacaaatattacgatagtccctccttacccttggggatatgttccaagacccccagtgaatgcctgaaaccgcagatagtactgaaccctttatatactgttttttcctatacacatatatgtatttatgataaagtttaatttataaattaggcacagcaaaagattaacaataactgaaaataaaatggaacatataacaatataatgtaaaaataaaagttatatgaatgtggtccctttctctgtttttctcaaaatagcttgatattttccaaccttagttgacctcgggtagctgtaactgcagaaagcaaaaccgcagacaaaggggacgcctgtgattcctatcccttcttcaagtcccaaaattctaagcctaaatcttaagatgaaaatctaggactaattaacctaaaatctattaaataaaatcaaaattttctctgcctgtaatcaaatgacacaaaaatggctggacagtttccccaaaattggaggatgtgtttgggatggtctggtttaaaataagtttgaattaaaataaagatgatagtgagtaagcagaattaactttgtgggactcagtggcatgcttccaagaggtgatcaacactttagagactctgaaactgagatgcaatgagaaatccgtggaactgtcaatccagaaagacaaacaaccccatcaaaaagtgggcgaaggatatgaacagacacttctcaaaagacatttatgcagccaaaagacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacacttttacactgttggtgggactgtaaactagttcaaccattgtggaagacagtgtggtgattcctcaaggatctagaactagaaataccatttaacccagttgatcccattactgggtatatacccaaaggattataaatcatgccgctataaagacacatgcacacgtatgtttattgtggcactattcacaatagcaaagacttggaacaaacccaaatgtccatcaatgatagactggattaagaaaatgtggcacatatacaccatggaatactatacagccataaaaaaggatgagttcatgtcctttgtagggacatggatgaagctggaaaccatcattctcagcaaactatcacaggcacaaaaaactgaacaccacatgttctcactcatagatgggaattgaacaatgagaacacttggacacaggaaggggaacatcacacaccggggcctgtcatggggttgggggatcggggagggatagcattaggagatatacctaatgtaaatgacgagttaatgggtgcagcacaccaacatgacacatgtatacatatgtaacaaacctgcacgttgtgcacatgtaacctagagcttaaagtgtaaaaaaaaaaaaaaaagtagaaagaaagacaaaacgtgccaggcaaggtggctcacacctgtaatcccagcactttgggaggccgaggtgagtggatcacctaaggtcaggagtttgaaaccagcctggccaacatggtgaaaccttgtgtctactaaaaatataaaaatcggctgggcgtggtggcacatgcctgtagtcccaactacttgggaggctgaggcaggagaattgcctgaacccaggagatggaggttgcagtgagctgagatcatgccactatactccagcctgggtgacagagcgagatgccatctcaaaaaataataaaataaataaaataaaataaaataaaataaaaataaaataaaataaataaaataaaataaaataaaataactgtgtgtctaagagtccatgaatagggaaaacagaggtttcaaatagaatctcccaaatcaaattcacgagggcagggcttccaaatatgaggccatgattttttgactaggttagcagttgttctcaactggtggggacttttggccacacctgaagacattcttggctgtcacaaccaggggattcctgccggcatgcataattcctacaaggattctgctaaacagcccaccacgcacaggacagcccccacaatataattttccagtcaaaaatgtcagtagagctgcagtccaaaaactctgggttagcgtgaccatatctcttggtttgcctgggacagtccaggtttatacctgttgtcccatggtaattgttaacaacactcttttcactcgtaaattgtctcactttggaagctatttacaggatcaccctaaactagtgtgatatggtttggctgtgtccccacccaaatttcatcttgaattgtggttcccataatccccacgtgttgtgggaaggactcggtgggaggtaatttaatcatgagagcggttaccctcatgctgttctcgtgacagtgagttctcacgagatctgatggtttataagaggcttttccctcccccttttgctcagcacttcctcttcctgctgccacgagaagaaggatgtgtttgcttccccttttgccacgaccgaccgaccataagtttcctgaggccaccccagacctgcagaattgtgagtcaattaagcctctttcttttgtaaattactcagtctcaagcatgtcttcattagcagcgtgagaacggactatacatagtgactgctcacgtgtgcagctgtgagatgttttacagtgtgatgattaaaggacatggcctgtgggttcagataactgattctcgatccccaaatccaaaaagttctgaaaacagacagttgcctcaaaattcacttggtagcaaaagttggcctgaacagatatgaggctattatgtgaatatttataggtttccctgcagaaatatcaacatgttgccccagacctcacagaaactgcaggataatatatgatatacgcattatgttacttttatataacccagaaattttgaagtgccaaaacccatctggcttcacaactatcagataatggaggtggatctgtaattgaatttgaatcctggctctactaactatttgctatgtaacactgggacagttagagtttcctcatttgtaaagtgggaataaatagtaatactcatgtaagtattggctattcttactatgtatgtgttcaggtgtttgggaacaggaataccttattggatgagagttaagaacaccaaatcaatcccaaaaagctacatagctaataaatttataactcaacttacttgcaggggccaacttgatttttctgaaataccttgaaagtttgaatcaaaaaatcagaaacaagtttttcttctgcgttaacagttccaaggagcagattatatcctttcagctctgggaacaggacagattccacctgaagagtaaacaccacttttgcatgttgcaagacttaagaagggagatggtacccaaatgcaaagccttctctaatgcactcatttccagggctgccagctgcatttttactctatttcctcttagatagtgctggaatcaccctgctgtttcctctacctctgttctctctcctttccttcttgcctggattactcatctttcaaatccctgacctttcaagggtcttgtcctttgagagtcccccttgtcctgctcaccgccccacaacgctccagtggatgttggtttccctgtttcaggctcaccttctgaacttttcctgcttagcactcatcacaattgcaattagatgaatgtgtaatgagatgttctaggtgtgtcatagaatacaaattccatgaaggtctggatcatatttgacttcttcactgttatatccccagggcctagcaaaagcttggcacttggtaagtgctcaaaaaatactgggtgagtcaatgaatactatcgtagtgctcccctcctcccctactacccagttttcctctctaatgaaaattctggagacgtggattctaattctgaatctgccactgagggacaatgtgaccttaggtaaactacttctctcgtgggtttttttttgttttgttttgtttttttgagacagtctcactctatggcccaggctggagtgcagtggcacgatctgggctcattgctacctctgcctcctgggctcaagcgattctcctgcctcagcctcccgagtagctgggattacaggcatgcaccaccatacccagctaatttttgtatttttagtagagacagagcttcaccatgttggccaggcttgtctcaaacctcaagcaatccacctgcctcagcctcacaaagtgctgggattacaggcatgaggcaccacatctggcctaaactacttctctgaatccccattttctcatctgtaaaaaagaagagatgtactagattctcctctaagcccagagaaaacaaacgatggctttatgatcatgaggcactgaaagtatcttctgagagaattcatactctctaacttctttttatttatttatttttttaaagagatggtctcactctgtcacccaggctggagtgcagtggcaccatcatagctcctatgctatgtgactcctcagctcaagcagtcttcctacctcagcctcctgagtagctggagctacaggtgcctgcgaccatgcctaattttcttatttttatttatatttttgtacagacaggggctctctctatgttgcccaggttggtcttgaactggtggtctggcttcacaactttcagaaaatggaggtggacctgtaattgtatatgaaccctggccctcggctcagcctccaaaagtattgagattgcaggcttgagtctccacgtctagtcactctaactccctcatggcacgtgtgtgtctctgagaatgttctcacttgcatggctcatgcaggctgcaaagttcctgcctgggacccattgtcttccattgtcctctctgctaagaaagattttagtggctggtctcagaaaaggtcttcagagtgtttcagtgagttacatgggttatatgcctttgatggaaatgcatcaatttagaaagggggaaaatcaagtgcaaatgatctgtgtcttgtttggccaatccagaggttttgaaaccagtggaggagcaacttctttgctgcagccatactacagacagctgccaaaggcaacgagatggagggactggcactggtcaatgcgtgaatgaaatggtttagggcagcacaattggtgcccccaggccatgtgacagatcacaagtgggcaggataatggatcgtctcatgggaagaagtcttcaaacttaagaggatgaaatacctcttgctgctctttcaatgtggtggattctcttatgccctgtagagcagtctgtgaaatggagtcaagaacaatcgcattcggccgggtgtggtggctcatacctataatccccacactttgggaggcagaggcaggcagatcgcttgagctcacgagttcaagaccagcctgggcaacgtggcggaaccctgtctctacaaaatacaaaaataagccgggcatggtggtgcacacctgttatcccagctacttgggaggctgagatgggaggatggcttgagcctgggaggtagaggttgcctcccgggctcaagcagaaaaaaaaaaattcttttttttttttgagatggagtttcactcttgttgcccaggctggagtgcaatggcgcaatctaggctcactgtaacctccgcctcctgggttcaagtgattctcctgcctcagcctcccgagtagctgggactacaggcacccgccaccacacccggctaattttttgtatttttagtagagacggggtttcaccatgttggctaggctggtattgaactcctgacctcagatgatccagccatctcggctaattttttgtatttttagtagagacggggtttcaccatgttggccaggctggtattgaacgcctgacctcaggtgatccagccatcttggcctaccaaagtgctgggattacaggtgtgagccactgtgcctagcccctttaataattatttctcacaaatatgctttcctgctttctttctgtgtcttgaataatgctatttactctattttctattttcaaaagtctcttgttagcttttccctaccaacttttttttttttttttttgacagagtctcactctgttgcccaggctggagtgcaatggtgcaatcatagctcactgcacccttgaacttctgggctcaagcgatcctcctgcctcagcctcctgagtagctaggactacagacgtgtgccaccaccccagctaatttaattttgtagagatgaggtcttgctatattgcccaggctgatattgaactcctggcctcaagcaatcttcctgcttctcgacctcccaaagctctaaaattataggtgtgagccaccatgattgaccttaactaacttttaaaattctttttaaaccatatatacggcagatcttgcagtgagtgaaggtaacacccaccagttgccattcttaaagatttttcttagtcaacctgcaggactatgtttttaagtcttcactaaccagttcagagataaaacagtctgaggggcttaaggaggaagctagggctgtgggtgtcactagatggggaactcagtctacgttgtttttccttattgtctcgtaaagtcattggtattcacataggccttgttttcaaacctggtacaaaccatgtcttcttggcattgtaattcatcaaatgtagtaccggccctggtacctgccattgcagtggcagccgcgtgcatgctgggctctcctggctcagctgctttcacacattgccgatcagcagcagcagcagtgaaggagaacttaagtggtatgtatttcagctgtccccatacatagtcatccaaattacagggtcttttcttccatttccttcctagggatactggttgtaggagagctgcccagtgtttcttctcctcccacacacccagttttaatggagtacttagaaccctgtaagtaccagattgcaaagagaagaatgcttgggcctccttgcactgcaaccttgaactcctgggcattcgtttcacatgagcaaggcccatgtgaagcatacataatgcatggagagagtgagaaggtggaagggtgagggagctagccagcaagaccccacagatcccttccctatatggaactggacaatggccctttggtcataccaaccaatcagagggagtgaggaaaagatggagctaaaaggagttacatccatgtgcatgatcctgtctagtaataaaagtttgttaataagtgtctggaatttaattagtaactctaccctggaaagcaaactggaaagggcgtgggccaggaaaggaatggttattctctctagaagcctacagtggctaaaacataacaaaccaacaaacaaataagcacacagaagagtgaaacttcaaactgaaattgaaaaaaagttcttggcaagttaatggcaattgattcatgatggattattaacccacagatatggcttgggacctatctgattcattgaggttgacatcatggaggacactatactctctcacaaagtaggtctttttttttttttcttttttctttttttttttttggagatggagtctcgctctgtcgcccaggcaggagtgcggtgacgccatctcagctcactgaaacctctgcctcccgggttcaagtgattctcctacaaagcagctcttcgtgctcttgttagaagcacaattctgggctgcgtgaatatttctttatggtctaaatcatttgtctggggtcaaggggttatattcaggatatatctccaaagtgaagctcccttaactgaatatcccagcgacctgacttgtacaacctctttcaatacattttattcactaagtgaaaaaatcatgcaaatgaatgattaagtgactactataccttggggatcccattagagttcttaataatttccaggaaagagtcacgtattaattcccagcagccatcaaaagatggattgaagacaataatgggttcactgacttcaagtttgatcatgattagctgaggtatgaaaaacttcatctcttggtagggctccttaaaatcattcccatccttcaggagacataaggtagggcaagcgttacaaaattgggccttccaaaatcaagggagtgaattttatacattcatagaactacatgaggaccagaaaaggcaatgaagggcatcatacactgtttatatttaaaatatgggctggggctgggcaccgtggctcacacctgtaatcccagcactttgggaggccgagacaggtggatcacctgaggtcaggagttcaagatcagcctggccaacatggtggaaccccgtctctactaaaaaacacaaaaaactagccaggcatggtgatgggtgcttgtaatcctagctacttgagaggctgaggcagtagaatcacttgaacccaggaggcagaggttgcagtgagatcacgccgttacactacagcctgggcaacaagagtgaaactccatctcaaaaaaataaaaaacaaataaaatatgtattgggtatagcttagcccaccctgactccatgcactctccctttcccaaagcctttattcccttttgtttatgcggcttggtaattcctgcacccaatatctagatccttcccatccttcaaaattcagctaaaacatttcttcctttgggaagcctccctgtttctcagctggatataatctcctcccacttctgaacttgtgtatttctacttcctctgttttttttttaatttattttatttgtgtccttagagatgaggtctcactatgttgcccaggctggtcttaaactcctgagctcaagtgatcctcctgcctcagcctcccaaagtgctgggattacaggtatgagacactaggcccagcctagtatttttttctttctctctggtaggaatttatatgcgtatctcaacttgtctattctaaagttgagggcaggatctatgtctgatcacctctctcctccaaaatacctgagacagcatatagtacctaacaggtgctcaataaaaatttattgattcagtccaaaagtattaatcataatccatataaccccaaatggagttgctaatgagcatagtttattttagacactcaaaatgtcaaccttgctacaacagaaatattgacatagagctatttccaattccctacaaaagctctaacccaggatgccctcataaactacagcgcctaatgaaattgtcagaaggcagctgtaaagtacttcttacatagagatttctagatccatttaaagatgactgatgatatttggtgaatacctactgtatatcaaatacctataaattcccccctattttccagacacaggaagattttacatttccctttgtgtggaattttagagtgagattggcttccacccctgggtttcttatgcttagcaaagtagacaatcacaatgacatttatagattggtcttctttagagagctaacattgcaattcagccccactggtttctatatttttgagcaaaagaccaattgttaatctttattacttcatttggaaaacttaaccttttataaccaggtaatttttaatttttgttactttgttaaggtaaaatgtgcacacggcataaaattcaaaagaatattcatcgatttttaggctatccaaattcagggaatgctatggtgctttgaaaactaggacttagtgttttcagttttctctctttttttttttagacagagtctcgctctgtcacccaggctggagccaggcagtggcgtgatctcggctcactgcaacctctgcctcctgggttcaagtgattctcctgcctcagtctcctgagtagctgggactacaggcacacaccaccacacccggctaatttttgtatttttagtagagatagggtttcaccagtcgaccaggctggtctcaaactcctgacctcaggtgatctgcctgcctcggtctcccaaagttctgggattacaggcgtgagccaccgtgcctggccagtgtttttagttttcattttgacttccctaaaacagtttcatgaaagaatttcttaattaggtcaacaaagccttttgtctttagaggtgccccttgccaagaccaaagaacaaaaacccatatctacaatgaaacctacagcactccctcaatatcaagccaaagattgaaaacaaaccttttccaaccccttcttgtaaaagagaggatgaaaaaaatgattccttctccccaaactgtaagacatatgtctttcattttatgcaatttttctttaaattttcttaacaacttctctacttctgtacatttttaccaacttaatactgagtgattatctcaagaaagtttgccatgtatttaaggaaattatttttaaaattattccaatccacagctggactggacttcttaagattttatttatggttttatacctctctttaaaaattaaaaaattgatactgattaattgtacatatttacaggatacatataatgtatagtggtcagatcatggtaattagcatatctatcatctcaaacatttacttttttttttttttcctttttgagacagagtttcactcttgtcgcccaggctggagtgcaatggcgcgatctggtctcactgcaacttccgccgcctgggttcaagcaattctcctgcctcagcctcccgagtagttgggactacaggcatccgccaccatgccaggaaaatttttgtatttttagtagagacagggtttcaccatgatggccaggctggtcttgaacttctgacgtcaggtgatctgcccgccttggcctcccaaagtgctgagattacagacgtggcctgtaatgcacccggccacatttaccatttgtgtgtgtgtgtgttgggaacattcaatatccttcttccagctaaaagaagacatttttataaactaacaactgcctgatgtgggtggaagtcaagcatttcactttgtgccctggctcacagctgaggacgtacatgacagagtcctggctctaaccaagtaaccaggttattcccctcaaaaggtccaaatgcaggtccctgacttactttgtgtatcatgaaaagggaaacgaggtcctcaagtgacttaatgaccagctccctaagctgcagcgacatgaatgatgccacagaagcaaaatattcctcaatgtttcgacttgagtcatagttgctcttgggagcaaaatgaatccagtgctccttccgtgaggtaaaaagctgggcgcaggtggggatccacctgtaaagacagaagggtgtccatgtgagaagctcttctgggctccgaggaacccacttgccgtgccccctgagctcagtgatgaggcagatgggctcaatgtcccaccaagcagccttgcaaatcagtactttcaatttccagccaccttacctgccatgcctctttcttgggaagaaagtaataagatttgaattaagaggttattcttccattgagaatacccaaatggaaaggggatattggtggcacatcctgctgaaagagtctacactttcttcattataatcagagattggggtaaaggggcataaggaactagaatgttctgtccaacttctctctctctagcagatgcctggtctctgattcaaacttcatagggggaaagagagaatgaggagcaaagaaagaaaacatgaaaggagaaactccagtgtggccctggctgctcagaagttgatggtagaaatcagaaaaccaaaagaagaaatagccaagtgtggtggctcatgcctgtaatcccagcactttgggaggccgaagcgggcagatcacttgaggccaggagttagagaccagcccggccaacatggcaaaactccatctctacaaaaacaaacaaacaaacaaaaattagctgggcatggtgcatggtgacacacacctgtagtcccagctacttgggaggctgaggcaggagaatcacttgaacctgggagatgggaggttgcagtgagctgagattgtgccactgcactccaacttgagtgacagagtgagtgaaactctgtctcaaacaaacaaacaacaacaaacaaacaaaaagaaatagatgcttcattgtttctttcctcccatgtcccccagtttctaattcccagtggaaaccactggccttttcatcctattgcatcttttctctgatcgctaaaaaggtactactctagcaaccagagaagcactactactggttgtagtcatagaggtatgagatttattgagcagctattatgtgccaatgatagcatctacattttctctgctaaagaaaacccatctgcaggtattattatcactgttttacacaagggaatttctctggctgtggaggtagtcttgcaggcatttgcaaaggaaaaaggaattgtgtaaatgtatgaaacccttttgccttgaaatcttgaggccgtttatctggactatctgaatataagtcattcaaatgcattcccctgtaacacagcaaggtctaaagcaggggtccccaacccctgggccatggactggttgtaggaaccaggctgcacagcaggaggtgagcagcaggtgggcgagccagcttcatctgtatttacagccgctccccatggctttttttaaccgcctgagctctgcctcctgtcagatcagcagcggcattagattctcacagaagcgtgaaccctactgtgaactgcacatgcgagggatccaggttgcacactccttaggagaatcaaatgcctgatgatctgtcactgtctcccatcaccttcagatgggaccatctagttgcaggaaaacaagctcagggctccctctgtttctacattatggtgagttgtagaattatttcattatatattacaatgtaatcataaaaataaggtgcacagtaaatgccgtgtgcttgaatcaccccgaaaccatcccactggcccagtctgtggaaaaactgtcttccacaaaaccagtccctgtggccaaaatgggtggggaccgctggtctaaaggattcgaggaggaggaaatgggggtgacagcctcccagggaatggtgataggggaatttcaagaaggcagagggagaccaggcatggggcagaaagcagctggacatgaaaaaaagaggacacgaggccaggcgcggtggctcatgcctgtaatcccagcactttgggaggccgaggcaggcagatcacaaggtcaggagattgagaccagcttggctaacacagtgaaaccctgtctctactaataatacaaaaaaaaaaaaaaaatagccgggcatggtggcatgcacctgtagtcccagctactgggggcgctgaggcaggataatcgcttgaacccgggaggcagaagttgcagtgagctgagatcacaccactgcactccagcctgagtgacagaaagagactctgtctcaaaaaaaaaaaagacacgaaaggatgccagtgggacaaaccccaggctgggtaccagcttcatttcagagggttttcagtctttaagataccatggtgcagccccacttggagggcagatactgacttgttgagaagagtctggtgtgcctccaggcagtgtttctggatcacatcccaaaattcctgaggctgcagaggcaattttcccgctagtatttctgctgttcgaacaaacctgaggtctctgaatctgccaaaagagagggagaaatttcctaagctaaagaacgcttaataacaaatcccgcaggacaggttccaagggtgtgtgttcacgtttctcaatgaaagttaagcagaatcaaatgaattacaggatatgggaaagatgctgaggaggatatgggaggctgaggagggaggagctaagtcctaaagaacgcttgcagggaggagacaaatgaggtgacccaagagtgctcctgagccttagagatatgcctcactctgcataacccatcaagaagtggggctgtggcaccagctggagactcagctggctgagaacttgggtatcaaatggacgaatcaatgttctttacaacagtgaagacccagaggccaggaccaagcagaacatcttcatcatcaaatgggattcacccaagcctctgggtgagctcttgaaggtaactttgaggactgctttgatttaaaacaaagagtttatggatcccagcactttggaggctaaggagagaggatggctttgagctcaggagttcaagaccagcctggcaatatagtgagacatcatctctccaaaaacaaaacaaaacaaaacaaaaaaggccgggcgcggtggctcacacctgtaatcccagcactttgggaggctgaggtgggtggatcacaaggtcaggagttcaagaccagcctggccaagatgctgaaaccccgtctctactaaaaatacaaaaaaattagccgggtgtggtggcgggcgcctgtaatcccaaccacccgggaggctgaggcagagaattgcttgaactcgggaggtggagcttgcagtgacaggagatcacgccactgcactccagcctgggggacagagcgagactcgtctaaaaaaaaaaaaaatagacgcgctgggtgtggtggtgcacacctgtaatcccagctacttaggaggctgaggcaggaagatcgcttgaacccaggaggtcaaggctacagtgagccctgattgcatcactgcactccagcctgggtgacagagcaacaccctgtctctacaaagaaaaaaaaaaaaaaaaaaagcttgtggagccaaaaaagcctctttaagccctctaactcctgtcactgtgagggtgaagaaaggccaaccagtgagaagaaatgagagttttctccactacgaggggtatccttttaacacctaagtcagattctatctgctccaaaccctccaatgacttcccatttcagagtaaaagcgtgcctagtgactggggcccactaggtgctctgcaccctatgccatctctcttgctcctgtcctgcctgtcacctccccccctccccatctcctctcctacccacctccgtgactcacagtgttccaggcacgctcacctcatactgtttccaggccgtgcccacctgctgctgcttgggtcctgtgcacaagctgttcccgctgcctccaatactcatcccctcgacttctatggagctgactcttcaccttccagccttggctcaaatgtcaccttcacagtaaaggctacccatggctgggtgtgtggttgtgcaggatctgccccttccaaagggccagaatgggtgagtgctctgcttgtcaagaaatgcaccctggggctgggtatggtggctcactcctgtaatcccggcactttgggaggccaaggtgggtggatcatttgaggtcaggagttaagagactagcctggccaacatggtgaaaccctatctctacaaaaaaaaaaaaaaaaaaaattagccgggcctggtggcgggtgtctgtaatcccagctactcaggaggctgaggcaggagaattgtttgaacctaggaggcagaggttgcagtgagtcgagaccgcaccactgcactccagcctgggcaacagagcaaggctctgtctcaaaaacaaaaacaaatgcaccctggtgttaggctgcatccatcccattagtggacaggggtagcggggaggtttgttagattcaaacaagtgttttatgggcaagcagccccaccccagccccacacaaaccacactccctatccccattactctggctaatttttcttttcatagtacccatcaccttctaacatattatataatttatttacctaatatatttattgtctgttttccccctagaaaaatgaactcacttctgttctctactacactaaaacaatgcttagcacataaccaggacctggcacctatttgttaaatgaatgaatgaatgaatgactaaataaatgaaaaaaaaaaaaaaaaaacaaatgaactcacagtttggaagccaagagacagaagagcctttggacctaatatatatttattttctatcttatgcttgagtgacacctcctagaactattgatgctagagttgtccagagtatatcggtaggatagagcggctggataaggaagagcggaaactaataaaaagctctcatcaagccctccacttttttttttttttttttcttgagacagggtctcactctgtcacccaggctggagtgcagtggcgatcttggctcactgcagcctcagcttctgaggttcaagcaattctcctgcctcagcctcccaagtagctgggactacaggcacacaccatcacgcctggctaatttttgtatttttagtagagacagggtttcaccatgttggtcaggctggtgtccaactcctgacctcaggtgatccacccacctcagcctcccaaggtgctgggattacaggcatgagccaccacgcccaggctctcattgctgatttttttggttcagttgataaaattcttctaaatgatttcagttcactttggtgctgctgttgctggcataatcttcctcagggaaccatgaaaagcaagtggtaaaaagcctttcttctcagtgaagctataggctcaacaatttgccgtctttgctacgagatcaatttaaactcaggtacatgtgattatctattatcttctgaacttctttatgaagtttctggctattcatccagctctaagactgacttcctcactagtttctatgttaatttatttttttagctcataaacacgcttgtacttaaagcaataccttaatttgttgagcaattactgtgtgccaagcagcagtctaagcactttctttagctaacaactccaggaggtaggtattgttatgatgattcccatttgcatgtagaacacagggtcagactaggcggtggctcatgcctgtaatcgcaacactttgggaggctgaggaaggaggaattcttaaagccaggagttcaagcccagcctaagcaacctagagagaccctgtttctacaaaaaatgtaaaaattagtcagacatggtggcatgcacctatagtcccagctacttgggaggctgaggagagagcccaggagtttgaggctgcagtgaactctaatcatgccactgcaccacaccctgggtgacagagcaaaagcttgtctaaaacaagaaagcaagcaagaaagcaagaaagaaacagggtcacagaggaaggaaggaaggaaggaaggaaggacaaacagggtcaaagagaaagaaagaagaaaagaaaggaagaaagaaagaaggaaagaaaggaaggaaggaaggaaggaagaaagaaaagaaagagagatgagagagaaggaaggaaggaaggaaggaaggaaagaaagaaaaagaaaggaaggaaggaaagaaagaaaggccggacgtggtggctcttgcctgtaatcccagcactttgggaggctgaggcaggtggatcacctgaggtcgggagttcgagaccagcctgaccaacatggagaaaccctgtctctactaaaaatacaaaaaaaaattagccaggcatggtggcacatgcctgtaatcccagctactagggaggctgaggcaggagaaatgtttgaacctgggaggcagaggttgcggtgagccaagatcgcgccattgcactccagcctgggcaacaagagtgaaactccatctcaaaaaaaaaaaaaaaaaaagggggagagaaagaaaggaagagagaaagaaagaaaagaaaacagtcacagagggattaatttctctcaaattatactattaattagtaacagaacaagaaccagaattcagatcccattctataagttattactttatatggttccacttagttagaaaattacttcttttttctcaatgtcctgactgctgactggtacttccaatgctttagaaaattgaattcagttcaaagaaaagaatacagctatttcttttcactgatgggctctgtcctacgttgacttcaccccctcaattcctttttaaaatacaagcaaaactaaggatttgaaaaacaagtaggttctccaagccacagggctcccttaagactgaacacgttcaaagctagagatcctcccaaagcaaaatacatgagctactaataagttcggccaatcaaagttaagtaagcatatctgcctctaatttttctaatacaaaactcagatgggggcagctcatcatttcattagcctggcctttcagtgaactccggtgtcttcatcctctcaccaggatgtgtaccttcttgaagggctcactaaaaaaaccagagtcttccacctccaggctcactgcaattgatgcatagataaaacaaatgtcggatagccatccaatggattagtatgccgccataaaaaggaagcactcactactgatacaagcttcagtgtggatgaagactgacaatattgttcattgaaagacaccagacacaaaagatcatatattgcatgattccatttctataaaatgtccagaatatgcaaatccatagagacagaaaatcacttagtggttgggaggaaatgggggaaggtgagaatgcggagtgactgctaatgggtttctttttggggtaatgataatactcttgaattagacagtggtaaggattaaacaaacttgtgaatatattaaaaacttgcattgtgtactttcaaagggtgaattttatggaatgtggatatctcacttttttttaaaatgaaagaatgaaaaaaggtggcttctgtctcatctggactcctacaatttttttttttttgagacggagtttcgcaaatttaattattgataaatatacctgagagatcactgcttgccagccctgtactggcactgagttacataaaggaataagaccgtccgggcgtggtggcttacacctgtaatcccagaactttggggtgccgatgtgggtggattgcttgagcttaggagtttgagaccagtctggacaacatggtgaaactccgtctctatcaaaaaatacaaaaaattagctgggtgtggtggtgtgggtctgtggtcccaactactcagctaacttgggagactgaggtgggaggattgcttcagcttgggaggaggaggttgcagtgaatcgagattatgccactgcactccagcctgggtgacagggtgagattcgtctcaaaaaaaaaaaaaaaaaaggaataaaacccaagcccgcacacacttcataggctaaagggagacaaataagtaaatgttctattataaccaagggtgagctgggtgcgatggcccatgtctctaatcccagcactttgggaggctgaggctggcagatcacctgagatcgagagttcgagaccagcctgaccaacatggagaaaccccatcttgactaaagatgcaaaattagccaggcatggtggcgcatgcctgtaatcccagctactcgggaggttgagacaggagaatcgcttgaacccgggaggcggaggctgcagtgagccaagatcgcgccattgcactccagcctgggtaacaagagccaaactctgtctcaaaaacaaaaactgagggtgatgttgtaatggaggtaatgccaaattaacaattactggtgcttaagttatattagatactgttctaagtgctttggatgtagtaagttatttattcctcttatcaatcctatgaagtggaaactcttattaacattatcgcaaatttagaggtaaaggaagcaaggcacagaaaagtgatgcgaccacatatatgcctgtaaagcagcagagctaggagttagacctgagcaggctggctccaagtctgtgcaattaagcaggatattccagtgcttagagacaggcacagggtgccctggggacacaaaggagggccacgtaagcctgcaaggaaaggtgtcacttataattcacatgcatatttggcctagatttttttttctttcatttctctatgctgtcagggctacccccactgtgcacagcagaataggcttgcttacacgtggatgtggtcaagaaagggaatgaaaaaaaaagggagggacttcttactctgcaaaccacagttctttcagcctgagcatcatggggttcaccgtgtgcagatgctcctcgttccacttcttggcgctcctgtagacactgtgccagggcacaggggcccggatcactctttgaggaaacaagcgggggatgctctcaataaagagccgttttctctccattgggtccatgaggatgtaatcaactacaaccggaaagggcgaacacctcattattaagctctaagggttgtgctcttagcttcaactcatttagttttgtttttaatatagagacggggtctcactaagttggccaggctggtctcaaactcctgggctcaagtgatcctcccacctcagcctgccaaagtgctgggattacaggcatgagttgctatgcctggccttagagtcaactctttttatttatttatttatttattttttgagatggagtctcgctctgtcgcccaggctcgattgcaatggttcaatctcagctcactgcaacctccacctccgcctcctaggttcaagccattctcctgcctcagcctcctgagtagctgggattacaggtggctgccaccacacctgcctaattttttgtattttcagtagatacagggttttgccatgttggccaggttggtcttgaaatcctgacctcaggtgatccacccgcctcggcctcccaaagtgctgcgattataggtgtgagctagcacacctggccttagcttcaactcttagaatataaatgagcctctgtccatttgcaaggtcatgggtaatcccctgggtataattcaactggtgaagcttcactcttggtgtttgttttctttctgagggtattttacagaaaggaggagtgtgacttcacggtgtggagcacttagaatctggggttgagccctggtaggatgtctagtatcaggcaggacaatgaaataggatttgctgataactcattagtcactgattgatttctcacaccaaaatagatgcacacaaaaaaacccaccatggatgataccatccattatatttacaaatagaagtttaaagaccaaatgttttccatactaagaaaggttggtagaaaagcttcatagaggatgtaacatttgtgctgggtcataaagaacaagtagcaggctgggtgcggtggctcacacctgtaatcccagcactttgagaggctgaggtgggtagatcacttgaggtcatgaattcgagaccagactggccaacatggcgaaaccttgtctctactaaaaatacaaaaattagctgggagtggtggtgcgtgcctgtagtcccagctactcaggaggctgaggcaggagaattgcgtgaacccaggggtccgcccaggtaggtcttgaaatcctgaccaacctctgcagttgcagtgagcagagatcacaccactgcacttcagcctgggcgacagagcaagactgtctcaaaaaagaaaaaaaaaagaagtgtagaatctcagccaggtgtgatggctcatgtctataatcccagcactttgggaggccgaggcaggaggatctcttgagtccaggatgttcaagacaagcctaggcaacatagggagaccttgtcgctaaaaaaaaaaaaaaaaaattgttttaaacttacaaatgtagaatctcaggccccaggttcagatctactgaatcgcaatctgcattttaagatctgcaggttacagggatgcacgtgaatatgtgaagtgctggtgtagacatcagtgatggtagggggatgcaggactttgaattagcggttaaatgatgttttgggtatttccagtggaatcagggtggcaaatgacaaagtgagaagaaagaagatgccttccaggccaggcatggtgcctcatgcctgtaatcctagcactttgggaggctaaggagggaggattgcttgagcccaggagttccagaccagcctgagcaacaaagcaagaccttgtctctacaaaaataaaaataaaaaagaaggtgccctctacatagaagctccccagccccctttatgcccaccagccttaccgatgcttttcatgaggctacagtaatagtcattctccttctcctgcacgaggaccaccatcaggggctccaggaagggactcgtcagcagcgtgttagaaatcagctttgaaatccgaaccatcacttcaccctcctcaggggcaatcatgtctttgcgaattccattggtcagatagtaatagtatctcttccataaacaaaccaccagcgagaaaatggtcatgattggatcatgggttcaactgtcctgcccatcagctgccaagggaccccattcatacagcattcgtctgcacccttcacttgccataaccatgcattctgggcctgtcgcttcacactcatggcaagaagatcactggcaaattttccccaggacttcagaggattcaaccaaagccagagagatgtcagtggggtataaggaaggatttgtcaaataccacccagataggaacagtggagtgagtacagagtccagggatggaggtggcatatctggtgacctttaagaagaggaataacaggccaggtgtggtggcttacacctgtaatctcagcattttgggaggcaaaggtgggagaattgcaaggtcaggggttcgagaccagcctggccaatatggtgaaaccccatctctactacaaaatacaaaaattagccgggcgtggtggcgcacacctgtagtcccatctgctcaggaggctgaggcaggaaaattgctggaacccaggaggtggaggttgcagtgagccaaggtcatgccactgcactccagcctgggtgaccaatcgagactctgtctcaaaaacaaacaaaaaaacattagattttcctgatccagagctagaatttaccccccggaagctttcactcactggtcctgattctgccttctaaggtagctcagacaaacagggttggatttctgtctaaaaaaaaaaaaaaaaaagtaaaggaatgacaagctcctaaaatggcctcgaatcacataccctcctgaacagcaatgatctcctacaaaacactttgatcccatggcttctagctgtcagtggggaaaaataaccccaaagtccaagatctattgttgttcttttttttttttttttgacacagaatttcacttttgtcgctcaggctggagtgcagtggcacaatctcagctcactgcaacctctgcctcccgggttcaagcaattctcctgcctcagcctcccaagtagctgggattacaggtgtgcaccaccacagccagctaatttttgtatttttagtggagacggggtttcaccatgttggccaggctggtctcaaactcctgacctcaggtgatccacccaccttggcctcccaaagtgctggaattataggcatgagccaccacacccagctgatagttcttcttacccaagcaagggcttttgagtttcaaaagcaacataaacacacaaatgaaacaaaaatggccagtggaacctagtgacttcaggaaattttgtatatttagggtttgcctctgagctgctggatggctgagtggctctgggaatgactaatgtcagatagaggagaagcacagagtgtgaggaaagggcttgaagtctgtttttaagtttcagatcagaagaggttgctggccaggcacggtggctcatgcctgtaatcccagcactttgggaggccaaggcgggtggatcacctgaagtcaggagtttgagaccagcctgaccaacatggtgaaaccctatctctactaaaaatacaaaaatcagccaggtggggtggtgcatacctgtaatcccagctactcaggaggctgagacagcagaattgcttgaacccaggaggtggagattgcagtggggcaagatcacgccacagcattcaaacctgggtgacagagcgagattctgtctcaaaaaaaaaaaagaaaagaaaaagaggttgctgctgccagcctctttgttactctcgcctctctccaacgttagtaaaagcagctgctaacaggggagtattgcaaagcttttctgattttaagaactgcctgggtgcagggtgggggtaaaaagtgcttgttaaaatgcagattcccaggcccctcctcaggcagttagggtgtttaccaaggaccccaggtgacccttatcttcaggcaagtttcagaaatgctgcacagctcttaagaacacagagactggctgggtgcggtggctcacgccataatcccagcactttaggaggctgaggtgggtggatcattcaaggtcaggagttcgagaccagcttgacctacatagtgaaaccccatctctactaaaatacaaaaattagctgggcatggtggcagttgcctgtaatcccagctacttgggaggctgaggcaggagaatcacttgaacccaggaggcagaggttgcagtgagccgagatcgtgccactgcactctagcctgggtaacagagcaagactccctctaataaaaaaaaaaaacaacacagagactttggtatcagccagaccggctttcagtcttagttttgtctcctaccctgtagccctaagcacattgcttaaacagtctatactccactttccgcaactggacaatagagataatcatagaacctgggtctcaagtggggtcaagtagctatagagggtttagcagggaattttgccaacagcacatagtcactgtgagtttttattaatcattttattatacaccctaaacccacaagacatttgctctaaagttttattgttcttttaagacgggttggaaactccaacatctatctagagccaggcaggtaatgttaataagtgaaagttgtctagacctaagaaaataataaggaatggtgggaactatgacaaactgaagagtgtatttctcatctaaaggaggtagctactgcttagcaccaaatattttagttttctcaagagaagttggaaaatgtagcttgagactttcctcatgcttttttttttttttttttttttttttttttgagatatggtcttgctctgttgcccaggctggagtgcagtggcatgatcatagctgggatgcctgaggtgtcagagaaggggaccaagggataggttgtcttgtcctagaaagggttgtgaatccctccccctaccctttttttgagacaaggtctcactctgctgcccagactggaatgtagtggcacaatcatagctcactgcagcctcagcttcccagggacaagtgatcctcccacctcagcctcccaagtagctgggaccacagatgcatggtaccatacccagctaatttttgtagagattgggtttctccatgttacccaggctggtcttgagatcctgggctcaagtgatcctccccattcctcctcctaaagtgctgggattacaggcatgagtcaccatgcccagccacctcattctttttttttttttttttttttgagatagagcctcgctctgttgcccatgccgaagtgcagtggctcaatcttggctcactgcaacctccacctcccaggttcaagtgattctcctgcctcagcctcccgagtagctgaaattacaggcgcctgccaccatgcctggctaattttgtttttgtatttttagtagagacggggtttcagcatgttgaccaggctggttttgaactcctgacctcaagtgatccacctgcctcggcctcccaaagtgctgggattacaggtgtgagccaccatgcccagccacctcattcttaaaacacatctacaggccaaattcagcctatgatagagatcccatataaaatatgggatgctttgggatatacttatactaaaaagttattcattacctaaaatttgaatttaactatgtgtcccattttttgtcttgcaaaatctggcacccccagcctatgggccactatttttgcaacttatattctaaaaggactcaaggtatcaatttccatcacttactagggcagagaacatgtacacacactctctctccttctctctcactcgcacaagcacacaaacatgcgccctcttcagtagcctgtcttgggtctagactttggtgtttttcaaacatttcccaggtgattctgctgttctccctgaatttagaatcactgagatgccgagagtaaccctcagcaaaccgagggaaagggggcaacaggaacgtacctccaggtccgattcagatggcttcttttctttactttccatttccatctcctgctgtaacatgacatcgagctgctgttctggactcattggtctgcttcctgggaacgtcaaagatgtctttacctccttcttcatgggtgagaagattgacgtcttgaaggccaacttgatcctgaaaagtagacacagctcagcccttggtgtttggttctccagagaggtgctgtggtgttgcctactttccctagcctgatgagtgtggttctgcaaatagaagcctctctcctctgtgtcatctaatggcatgtgtgtatacttccaagatgaccctaatgactgaacacctcataggtattttagcatggttttgttcagttggtttatttttgtctacaatctcaaaaagcctggccaacatggtgaaaccacgtctctactaaaaatacaaaaatcagccaggcctggtggcatgcacctgaaatcccagctactcaggaggctaaggaaggagagtcgcttgaacccgggaggcagatgttgcagcaagctgagatcatgccactgcactccagcccgggcaacagagcaagactccatctcaaaaaaaaaaattttttttttgattaaagtgattcgtggataagaatatgattatctgggaatgctttgaagccaagaagcagagtgtggctttagtgagaccacatccttctgttcagcccaccgtcctgccttctctggtgcccacagtgatatcttacctagtggaatcctctttgtttctggaggaaaacttcgtttttttcctcatgggctctgatgagcttctatttcctggaagaatggagaagaaagacatcagtgatgggcaatggccttgggccattctccgtccacaggggcatgactctcggaacagtccaggagcacactaaggggagcggacatggtacggtgtgacgtggcaggagatgtgggctcaggtctcatgtgcatcactgattacctgtgtgaccctgaagaactggcttcatcactccggacctcagcttcctcaactgtaaagtggggatgtgcgtatcttccattcgttcatacatttggcaagaattaataactgcttgtttcatgtactctccaatattgtatgctctattttctaaacacctgttatattactgtttaatatttctctttaagtagacctgggcatttaaacttagtacatttggccaggcacggtggctcatgcctgtaatcccagtactttgggaggctaaggcaggcagatcacctgaggtcaggagttcacgaccagcctggccaacatggcgaaaccccatctctactgaaaaatacaaaaattagccgggcattgcggcgagcgcctgtagacccagctacttgggaggctgaggcagggagaattgcttgaacccaggaggtggaggttgcagtgagccgagatcgtgccactgcactccatactgggcgacagagtgagactccgtctcaaaaataaataaataaaataaaaaataaaataggccggacacggtggctcatgcctgtaatcccagcactttgggaggccgagacaggcagatcacgaggtcaggagttggagaccagcctgaccaacatggtgaaatcccccatctctactaaaaatacaaaaattagccaggcatggtggcacacgcctgtaatcccagctactcaggaggctgaggcagaagaatcgcttgaaccctggggacggaggttgcagtgagccaagatagcaccattgcactccagcctgggcaatgagagcgaaactccgtctcaaaaaatatacatacatacatacatgcatacatacatacataaataaaataaacttagtacatttatttttaaaagaaattttatgattatcacaaataaaaaataagtacatatttattgcaagtagaaaaaccaatatcatttgcaataaatagaaggtagctacaattaattcaataagtgatataaaaactatattattcaactttaattagatattacttcctaaagtgtctatctttgaacttctcaaaatagtccacatataacaacaatacaaaaatcctttttttttttttttttgagacagggtctcactctgctgcctgtgctggagtgcagtggcatgatttcagctcactgcaacctcaaccacccaggctcaggtgatcctcccacctcagtctcctgagtagctaggagtacaggcgcatgccaccacacctggctaattttcctatcttttgtagagacggggttttgtcatgttacccaggctggtctccaactcctgggggcaagcaaccctctcaataaacacaacaatcaaggtacagattcacaaaatggaaataatacagcaataacaatattgctccaaaataaatttttaagatcctccaagtacaaatgtattttaatgaataataagcagaaatcatctcaagcaaggacatgaataacagacaccagtgccgctctgaagaaagcatcttagtactttatattcaaagactctggcttgcctgagaattttggggacaatgaaacctgggaagcaatagcactagttcttcacagatattaataattttggactaagaaaattattaaagactgctacagactgaaagctaatgtcttgtcaaaattagtatgttgaaccttaatccccagcatgatggtatttggaggtgggactcttgggaggtgactaggtcatgagggctccatcttatgaatgagattgtgcctttataaaaaaaacagcaaaaagatttctcaccccttctcccatgtgagcatgcagcaagaagatagagaagacagatgtctatgaatcaggaagaggaccttcatcatagactgaatctgttggtaccttgatctcggactttacagactccagaaccacaagatatgaatttctgtagtttataagccactcagtttatgattctttgttatagcagcccaaaaggaactaagatgatgaccatgaaattaccaattagagcagcaaacttaaggttctgtgtatcatgatcttgaacatttgggcattaattatttgctacatgtccttaaagcaggaacatgcaaaagcagcatcctagagactgtgggtgtgtatgtaatacacaaataacactggtaagaaccacttgggaaaaagaaatcctccaagtgatattgaaagggctatgacaataagaatggaatcaggagttggaaaagggaggtagaaaaccataagtaatcagaaaatttgaaatggaaagatagtcatttaaacaaaaaacactcattagacatgaaaaactcaagactgaacagagttgaagagaaaattagtaaattggaagatgtaattaagaaactcacccagacgtagcacagagaaaacaatgaaaaatataaaaatgagtttgagacagagagcagatcaagagtgccaacatacatccaacaaaaattactaaaggatatccttatgccaatatacctatgcttggtgggaattaaattaatacatacaaggtgctgtggtaagcagcttccaagacagcccccaatgatccccatctcctggtaacacccctttgtggtgtaatcctctccccttgagtatgggctagaactagtgactcctaacaaatagaatgtggcaaaagtgacaagatgtcacttccaagattaagttccaaaaaagcctatgggttctctcttgctggctctctctctttctctccccctccctcgctctaagggaagccagaagccatgttgtgagttgttctaagggagagacccgtgtggcaagaaactggtgtctatggccaacagccagcaaggacctgatgacatgagtgagcctggaagaggatccttccctagttgcctttagatgatggtggccttggtgtatgccttgattgtacgctagtgaggggccctgagccagcactacaaattcagccatgcccacgttcctgccccactgaaattgtaagataacaaatactggttcttttaagccacagaattttggaataacttatcatgcaaacaataacacaagtacatagaacagtgcctggtatatgtaaatggtctataaatgttagccgtttgcaatcatttcctccatagataaggaggagagtgaggctttgcaaagtctccaaagttagcttcagcaaaaggggagccaggatcagaatccaggagtaaaaatttcactccaggccaggcacagtggctcatgcctgtaatcccagcactttcggaggttgaggcaggtggatcacctgaggtcaggagtttgagaccagcctggccaacatagtgaaaccccatctctactaaaaatacaaaaaaaaatagccaggtgtggcctgtagtcccagctactcaggaggctgaggcaggagaatcacttgaatccgggaggcggaggttgcaatgagccacgatcgtgccatggcactccagcctgggcgacagagtgagactccatctaaaataaataaataaataaaaatttcctccaaagccccattctgcaagggtgtgacactgccacaagtacctgatgatggcagcccctgaccggtcctgtccctagggacactgatggtggccggttggtagaccttcagcagatctttcagcttcaggtcctgggccatcaaggagtagttgttggcgatggaatcactgggtccacggtggtgatgctgttctttgaagggtgcagccaaggtccatgacgtgcgttgcatcaagggcgggtaaaagctgtgtgacatgacagtctacgaggtaagaagtgcagagtgagacacaatgaggaacatctctcgatgagcctgagctctgctcacactgaggctcacaagagttccaagtgccttatgctatgtttctgccttctgcacattcagtggaaagattgtctgaacagacaccaactgtacttctctgaccattgtaagcatgaattctgatgtcagggataatagcttgcattcaccagtaattttgaggcaggtaattgacatctctggtctttattccttatggacatgactacaaggtacaagcaattaccctcattttacaatgaaacacgcagaagttcagagagtttaaataacacagcagatcagtggacggccagattctaattcacctttggacaatggcatagctctctctcccacacttctgcagcctcttctgggggcaaaagcgaccaaagctactaatcctacttgtcaggtctgtttgactctccaccctcattgagtacctgccaaatacggagagaagtgggggatgcacttcacctcctcaccctcaacagaagagctggcagccaggtgtgcatacctgatagagtccagacggttcctcattagcagaagcaggcagaggaggcagctctggctgcccctgggagtggctcatgtgatgtatggagtcacttttggcgatctgtgggacatgggaacaaagtcacccttcaaaaattagggaagatttgcaagcctctgagttggttaggactaaagaggtccccaggaaaagttttaggtccagagttctggacctaaaacaaaacactcctctcattcccatccattatgtatgtttcatttatttaaaaattaacagataagggctgggtgcggtagctcaccccggtaatcccaccagtttgagaggccagggagggtggatcacctgaggtcaggagttcgagaccagcctgaccaatatggtgaaaccctgtctctactaaaaatacaaaaattagccaggcatggtggcgtgtgcctgtagtctcagctacttgggaggctgagacaggagagttgcttgaacctgggacgcggaggttgcggtgagctgagattgcactctgagatgtattgaagtgtatatacattatagagtgactaaatctaattatcatatgcgttaccttgcatggttattatctttgcagtgagaacacatctactctcatagcgttgttcaagaatacaatatattgttaattagtcatcatgctgtacaacagatctcttgaacttattccatctaactgaaattttatatcctatgaccatctccccaacccttccactcctgtttcttttttctttctttctttttttttttgagatggagtcttgctctgtcacccaggctggagtgcagtggctctatctcagctcaatgcaacctctgcctccgggggtcaagtgattctcctccctcagcctcccaagtagctgggattacaggtgactgccaccatgcccagctaattttatatttttagtagagacggggtttcatcatgttggccaggctggtcttgaactcctggcctcaagtgatctgccctcctcggcctcccaaagttctgggattacaggcatgagccaccacgcccggcccctgcttcattttttaatcattcagtgtctcctcctcggattcccttctatgagcaaatttgaatatttttcccccgtggaagagcccaaattctgaggacatccccagtaccctaccctcaggtatgattaaaggaggtgactttaaaaacattgactcttgcatttttttttttttgagatagtctctcactctgtcacccaggctagagtgcaatggtacgatcttagctcactgcaactgctgcttcccaggttcaagcaatcctcctgcctcagcctcccaagaagctggatgggtgcccaccaccatgcctggctaattttcatatttttagtagagacggggtttcaccacattggtcaggctggtcttgaactcctgacctcaggtgatccacctgcttcgaccttccaaagtgctcggattacaggcataagccactccaccaggtggactcttgcattttcacatgtgcaaaattccaaagagaaattcactcaggcagtggcactgaattttctgtgtatttaacacacacataagcaactctttatgattcctgcgaaaagaaaaagtgttatttcaacaatgtgggtgttgagtactccattccaaccagtgagtgcatactgtggagtgagcctcaggtaagggtcaacttgtggctcccacaatcactctcagattccaagtgaccctccacctctcctgagcagagaagaaagtgactacattattgaatgaaatcacatgtgtttttgtcttaagacttagcccctatatgcaaaacaaccacttcacctgggactagtgatggagaaactgcaacttgttccaacactagaagaaaagctgttggcctggacttattgagaggtgctgccgttcagcactttaaaggtggtttgagggattttcaagggcaattttgactctctgtgattttcaccttaggcattgactttggacttaactcctatataagatgagccaacatcgtatcagtgtgatttatttgggtgtgcaaattatgacatgcaagatcactgatgagggtgggatggggcagggggcatatgactattagctgtccctctgcccccaaccccttaaagatgactcaaattaaccatcattatctctcccggagcacctacctcattaaataacaacagaaaaacaacaaccgcagcaatactatctaccattattccaaacgattatgtgccaggtactgtacaacctcatgagatttttttcatacccgcattctagctgaagaaaatgagggtgagaagataggtaacacatcctagccatgtaattggccggcttgacttctaagtcagtgacttatttattattattattattatttattttttttttttgagtccaagttttcgctctgtcgcccaggctggagtgcagtgacacaatcttggctcactacaactgcaacctccaccccctaggttcgagcgattctcctgcctcagcttccttactgcatcatgcaaactgacagggacgctgttctcgggataatgaagaaagcaaaccgtgagcattttgcagaacacaatggaaagagggagaacctctgtagaaacaaattaaactaggctatgtcataggcttggactaaaacaaatacacaaacagtcataagtacgctgatagcagaaagcatcccagtctgtcgatcaggaacacatggggcacacacaacatgagcagatctaggcatcaattgcagaatggggctaaaagagttttcctggcaataaatggctaagaatcctctgtggcaccttcaagagatcgagattctcataagaactagctggttgtgcaaaattgtttgttaaaaatatgaatgcttggccagccgtggtagctaatgtctataatcccagcactttgggaggccgaggcgggtggatcacttgaggccaggagttcgagaccagcctggccaacatggagaaatcccgtctctactaaaaatacaaaaattagccaggcggtggcgcacacctgtagttccagctactcaggagactgaggcaggagaatcgcttgaacccagaaagcagacgcttcagtgagtgaagatcacgccactgcactccagcctggataacagagacaaactgtctcaaaaaaaaaaaaagaaagaaagaaaaagaaagaaagaaattaatgcttaaatcttctctttggtaaatttcaaggagctttcacttcagagcatattggcttagttattatctacaaatccactttagttttacaaagtttctatttaaaatgctcctctgggcacttcgctgtatggcaacctggtgattcaacacagatacaacagaaattctggaacttagattgggtagaactgtcactttgggcagcttattgctgattacacatgttgtatgtatgttcttcatggaggccattcccaaatgctcgtctgaggacgtgctacaccagaatcactctggtcttagataaaaatatagattccagggccccactccaaatcttctggatcggaatctaggagtgggggaccaagactctatgtttttaagatgctccccagaatattctaatgttcagccacagtcaaaaactgatggttggaatatatggtctaatgggcttggaagggaaggaaagggaagaacgggtgtctattcccggatttttcacagcaaaacttgaagatttccaaaagtctaattcagcaaaaatgatatttcaaagcagacaacaaaaaaatgtgatgaatacacttgttcagtcaagggcatctaacatgccaattggccctcttcccacatattcccaacacattaaaaatacaggtaaatcggccagacacggtggctcacacctgtaatcccagcactttgggaggctgaggcaggcggatctcctgagatcgggagttcaagaccagcctgaccaacatggataaaccctgtctccactaaaaatacaaaattagccaggtgtggtggcacatgcctgtaatcccagctactcaggaggctgaggcaggagaatcacttgaacccaggaggcggaggttgcagtgagccgagatcacaccattgcactccagcctgggcaacaaagagcaaaactctgtctcaaaataaaaaataaaaaaaaaaaatacaggtaaaacaagaaacgtcttaaaattcacacctaccttctgagatgagcaatccatgtcacccatggtgtccactctaattgtagctatttttttaaaatgaataaagagctttcagcttctccagggatgtgcctctcctatccagttggtctgaaattcacacttccttatagcataatggggatgacaccaacaatggaactttccagatgttctgaaagctctgttcatgaggttgcctctctgaggtcatagactttggcccgctgaggagttccctggtaaaaaaggagagaaagggaagctagagataaggggacagcactgggtttctgctgcgcttttggctctggttcctagtcccccagcggtggccacgcttcctttcccttgagtgcttctctcttggaaattttccagaaacacactgagttcactgcagaggaaagactgaagcagagttacacattaatacagagaagagggagactcacccctccaaacaacatcctggcagcccgaactgttctccctcctcctccctggactcttaacactggcagtgcttgtatgcaggcgctgggcacagtaaccatgtctcagcgtctgttgctaagggaaggaggggcctctgcggtgcctacatacaagactgggcatgacctagctctgtgagctggtgtctccctttgctggaggcccaggtgggcagcaggaagtgttggtgacagaagggaacatgggaaggtgtttagcaatgttccaggaataacagaggcaacagcaataaaagacctttggagacgtcgaaaagcacagagtatggtggttaagttcttgggatctacaattggacaggtcatacttcagatcctactcttctcattaattagctgtgtggcttggcaagttgtttaatctctccaagtgtcctttccgtctgtaaaatggcaataatgtgagtccctacttcatagggttgctttgaagggttaacgggataacgtgtacagagcgatttgcatatagtagaaggataactgatattttcccagtttttccccgtttttttttttttttttgagacagagtcttgctctgttgcccaggctgcagtgcagtggcgtgatctcagctcactgcaagctctgcctcccgggttcacaccattctcctgcctcagcctcccaccagtgcgcccagctaattttttgtatttttagtagagacggggtttcaccgtgttagccaggatggtctcaatctcctgacctcgtgatccgcccacctcggcctcccaaagtgtgggattacaggtgtgagccactgcgcccagcccagtttttccccattttaacactaagtcctgcatcctgggagcaatctcagtcctgggcaaactgggatagtttgatcacccaacacagtcaatgctctataaatgttgtggctaacatcaatattacgataaacacagaaatacatgtgcacatactcaaaagtaacaatattagctgccgcccgaatattaaaagcacatgttccatggtcactgtgaagttctctcaaaaccaagttagacttaatgagttttttgggggtgccatgcttgcatatctttttttttcattcaatttccccccaaacaccacgatattcccattttaaggataaggaatcaaaactgagagatatgggccaggtatggtggttcatgcctgtaatcccagcactctgaaaggctgaggtggatggatcacttgaggtcaggagtttgagaccagcttggccaacatagtgaaaccccatctctactaaaaatacaaaattagccgggcatggtggtagtcgcctgtaatcccagctacttggggggctgaggcaggagaatcgcttgaacctgggagggaggttgcagtgagcacagatcatgccactgcaccccagcctgggcaacaagagcgaaactccatctcaaaaaaaaagaaaaacaaacaaaaaaactgagagatacataactttcctaagtcgacttgactcataagtagcactgatacaattggaacctgtcctgatgaccccgagtccactgctctttccataacctacctgtccagaacacaaacattcccgagttcctatgaaaagcattgcatagtgagaggtgacagcgtgctggcagtcctcacagccctcgctcgctctcggcgcctcctctgcctgggctcccactttggcggcacttgaggagcccttcagcccaccgctgcactgtgagagctcctttctgggctgggcaaggccgaagccggctccctcagcttgcaggcaggtgtggagggagaggcgcgagcgggaacccgggctgcgcacggcgcttgcgggccagctggagttccgggtgggcgtgggcttggcgggccccgcactgggagcagccagctggccctgccggccccgggcaatgaggggcttagcaccccggccagcggctgcggagggtgtactgggtcccccagcagtgctagcccaccggcgctgcgctccatttctcaccgggccttagctgccttcccgcggggcagggctcgggacttgcagcccgccatgcctgagcctcccaccccctccgtgggctcctgtgctgcccgagcctccccgacgagcgccaccccctgctccacggcgcccagtcccaccgaccacccaagggctgaggagtgcgggcccacggcgcgggactggcaggcagctccacctgcagccccggtgcaggagccactgggtgaagccagctgggctcctgagtctgatggggacgtggagaacctttatggctagctcagggattgtaaatacaccaatcagcaccctgagtctaactcagggtttgtgaatgcaccaatcgacactctgtatctagctgctctggtgggaccttggagaacctttatgtctagcttggggattgtaaatacaccaatcagcactctgtatctagctcaaggtttgtaaacacaccaatcagcaccctgtgtctagctcagggtctgtgaatgcaccaatccacactctgtatctagctattctggtggggccttggagaacctttgtgtggacactctgtgtctagctaatctggtggggacttggagaacctttgtgtctagctcagggattgtaaacgcaccaatcagcaccctgtcaaaacagaccactaggctctaccaatcagcaggatgtgggtggggccagataagagcataaaagcaggctgcccgggccagcagtggcaagccgcttgatccccttctacaacgtggaaggtttgttctttcactgtttgggttcatgccgccttaatagctgtaacactcacggtgaaggtctgcagcttcactcctgcgccagcgagaccagaaacccaccagaaggaagaaactccgaacacatccgagcatcagaaggaacaaactccagacgcgctaccttaagagctgtaacactcaccgcgagggcccacggcttcattcttgaagtcagtgagaccaagaacctacgaattccagacacaatagaaccaagtacttccattttccccctttttctactccttttcctcaaagttgggctttccatcctttcaaaataaccctgagcttttccatctcttatattatgctctttatcacaaagtatacatacggtttcaaatagcatttggaataattgagacagtgggagagctggagactctggtttagacggaaatgggaagattatcaggtctcctatactgggtgtgaaacctcatgtcccaccaaaaacagcaactgtaatccaatgaagtgaaaaattagaatggggccaggcgcggtggcccatgcctataatcccagcagctggggaggccaaggcgagtggatcgcctgaggtcaggggttcaagaccaacctggccaacatggtgaaaccccgtctctactaaaaatacaaaaaattagccgggcgtggtggcaggcaccagtaatcccagcttcttgggttgctgaggcaggagaattgcatgaacacaggaggtggaggttgcagtaagctgagatcacaccattgcactccagcctgtgtgacacagcgagactctgtctcaaaaaaaaaaaaattagaatggtcctgatgtggagctaatggaccctatggcctgtgtgtgagtaggaggtatgctaccatctgaaatttagtgtgttttaagtctactagtgtttaaaactatcaaaacaatactaatggctttcgcttattgagcatatactatgccctgggactgctgctaggcacttagtagacatcatgtctttgaatcttctcaacaacctagaatataaatatcagtattttcacaagttttatgattgaggaaactgatacattaaactaacctgcccatagtcacacagctaggtcatcaggaaagcttgaacttggttatgaaatctgttccatggcttcaaccgaaaacctacatgtaatctgaggaaaggtggaaaataaagtatctgccaaagagagtgaaagtgacttcccccaggccacctcacctgtaccagaattgtttgttgtctgacaactttgtgttggataattcttaagaaaggatataggcttcaagtttctcaatcttctttttctttctttcttttttttttttttttgagatggaatcttgctctgttgcccaggctggagtgcagtggtatgatctcggctcactgtaacctccacctcctgggttcaagtgattctcttgcctcagcctccccagtaactgggattacaggcgtgtgctaacacacctggcttatttttgtatttttagtagagatggggttttgccatgttggccagcctggtctcgaacccctgacctcaagtgatctgcccacctccgcctcccaaagtgctgggattcaggcatgagccaccatgcccggccttgtttctcaattgggctgccagacaaaacagaaggtgcccagttaaattagagtttcagtcaaacaatttttcaggtaaaagaatgttttagggccgggagcagtggctcatgcctgtaatcccaacactttggaaggccgaggcaggcggatcacaaagtcaggagtttgagaccagcctgaccaacatggtgaaaccctgtctctactaaaaatacaaaaattagctgggcgtggcggcacatgcctgtaatcccagctactccggaggctttggcaggagaatcatttgaacccaggaggtggaggttgcagtaagccgagatagcgccactgcactccagcctgggagacagagcaagactccgtctcaaaaaaaaaaaaaaaaaaaaaaagttttagtataagcatgtcccattcaatacatgggctgtacttgtacttgtactaaaaagttacccattatttacctgaaattcagatttaattgagtgtcgtgtgtttttatttgccaaatctgccaacatggggagcagaggtcagcaaggttccaagttgcccctgcctcttgttatcaagagtttagggtcttaatctgttgctaaaaaaatttcacacatttcttattcagaggctggtattcctggcagctcattcctgaggcctaaaatagttgtttaagcagagcaacagtttcaatccttggaggctactatagcaaagtaccaaagtctgggtggcttataaacaagagacatttatttctcactgctctgaaggctggaagttcacaatcagggtgccagggtggtctggttccagtgaaggcccccttccatgttgcaggctgccaacttctcattgtatcctcacatggtggaaagagggtaagagagctctctgggagttattcttattttattttattttattttattttattttattttatttattttattttattttattttattattttattttattttattttaatgagccagggtctcactttgttgcccaggctagagtgcagtggtgcaatctcagctcactgcagcctccactgcctgggctcaagagatcctcctgcctcagcctcccatgtagctgggactacaggcatgtgccactatgcccggctaacttttgtatttttagtagagaagaggtttcgccatgttgcccaggctggtctcgaactcctagactcaagcaatccacccaccttggcctcccaaagtggtgggattataggtgtgagccactgggatctcttttataagggcactaatcccatttaggagggcttcaccttcatgacctaatcacctcccaaaaaccccatgcctaatcccatcacattgggggttaggattttagaggaacagacattcagtccattgcagcaagtaattgggaaagcataggagaggctgcgcgtggatttttttaacccaaccactgcatgttccttgagggccaagtcctgatgctatggagagatgctaggatcccagccctggaggaacacatgatgtgatggaggaagcatctatcacacaaagacaagcaaaactctgctggcccagccaaaaatgccagaggtggaaggaatttgaagattcacagagacgcccctagatggcactcttaaacaaaaatcccagtggaaaccctaactcagctttccaaagcaacttccatttagggaatgatgattggaaggctgtaatctaaggaaacacacacacacacacacacacacacacaatcttttcctgggtggggaacccagcattttgcagctgaacaaagtgcatgacgccagacaagattggctaaaacttaagaatttagggattcttgtctgtcctatccccaccattagctcttctttctgctattgtggaattacagcaggattctgtggtttatcatatcattgtcgtgatcatcatcataaatcatcatcccaagcaaatatttttgagcccctactctgtgcctcaataggtgctaagttctcgacagccacagccacactattgcaccagtcctcactacaaccctgtgattgcttctttttttttttttttttttttgagacagggtctcactctgttgcccaggctggagtgcagtgtcttcactgcaacttctacttcccaggttcaagcgatacttctgcctcagcctcccgagtagctgggattacaggtgcgcaccaccatgcctggctagtttttatatttttagtagagatggggtttcaccatgttggccaggctggtctggaactcctggcctcaagtgatctgcccacctcagcctcccaaagtgctgggattataggtgtgagccaccgcaccctgccagctttttgttatctaaagacttattttccaggttgctatggccacaggcaaagaggagaggtcggtcaacacaggtccctgtctggaaagtggctgagaactgtgcaacagcagaccaatggttgggcttatccctctctctaatttatggttgaagccatggttcagagaggttacttagtcacacagtaagttgccatcatgctctatagcagtggttctcacctcgggacgatggggccttccaggggacatttggcaatattttgagacacaactggaggtgggggggggcggttcttgtaactggcatctaatgggtagaggctaggatattgctaaacattctacaatccacagctcagaaacagaattattccgccccaaatgtcaatagcatactattcagaaaccttactctatagggcagatttggggccaggggaaacaggggctcctgctccgacttggatccatgcaaaccgaggaatttggattgatttatcttgtctctctcagcctggactttttcatgtgtaaaatggacatccaatccatctgaaaggatctcactggcttatgacattcgcatttgagcagtcatggttaaaaacttccagccagggtgatacttcatcacgtgtgtgtcttgagcgccagagacgttccagagcagctggttttaggcatacaggaggggaaaccctgacacccttggaaaactcattctcggctgccagtctgcctgtcttgaaggtggtctgagctttctcactccaagccagtcgtgtgggaagggacactctctgagcctcagtttcctcagctgtcaacctctcagggcttgttctagtggctccgaaagccagtgggagcgagcgcgctttgcaaagccttgggcgccgggccttggcgcgcctttgccggatccttccggccacgggcggggcgagcccagaggagaagagccgaggggcggtgcccgggccagggggcggaggcaggcggctctggctccctctcgggacgctctttccttcttcctcttgttcctcctcctgcctctcttcgcttcgcctgcaaacgcggtgggggctgctcggcggtcaggagcaggtgagagctcggagcttgggggtgggggtccgggtgccccgggtggctagacccctctcgccgggcggggacagaggaggagcgcgggggcgacggcgtgagcgcgctatcggggtcccacgcccgtagctttctgccccggggttagtgtaaggggcgtctcctgcttatgagtcgccgggacggggctgggagcgcacgaggagacacgattcctccccacccctaaatgcacactcaccccgccaccccccaacacacacacacatacacacacacactaccactagattaggtaaaatggtagctagcaccaccacaccccgagactgtgcccctttctggggaacctggggaagacgtcgaggcaaacctccctaggattattgaaaacgggcgccttcctcaccacccagcccctcttctccaccgaggtccccttccccatcgctgcagagagatctgcaagtatcaaagggggcttctttacccccaaattaataactaagtactcgactcccctctgagttcccattattcagtctctgtgccttctgggacgcggaccccctctccacctgcatttcactcccttcctcctctccttgggtctccctggcttttgaacgctgaaaggctgggcccggatggggaggggcggccagtgtgagctcgaggcgccctgtagctcccatcccccaaccagagatgtgacccctcctcccagcttgaactttcgaggtagccgttttcccctggaggttcgggggtgggagggccaggagatttatttggagccttggaaggggaaagggttagctggtgttggcctggcccagtcccccaggcgtgaagaaggcggggcactccttggccgcgccgggttctcgctttcccttctcgggagacagctccgtgcctggggaggcccctccgaggagtgagtgaccagggggtctgggaattggtggccaggtagacgcatttgaaggctgtggccgatggcattcgccccacgcactctctcatcggactccccaaaccggtctgggtggcacttgaggctcccaggccaaaggagacctgtaaggggaactccgcttgtttctgcttgctgcagagatgagattatgggaactgagtgctgggaacatcccaagttcaagacctacgccagaggcagcttcaaagagagaatgtggggtggtgggattagtcccctcctcaactttcccctccaaagggtttcttgttttacaaaagggaagtagcagaggatgtctagctgggatgattaaaatgtgctttaatttgcatactagaccctgtacagcttagtagtagataaaattaccccctatatgataaataaatgtgaggatctctcaattaattttggccacgtggacacaatcttttaagcatttgtactgtaggtcaggtcagtttaaagggagaaatggaaaagatatctctgtgtccagccagttctgggaaatataaaataagaatgattttttttttatatttgaaaactcaacaagggttaaaaaatatatctaatttaaccaattgcctttattaaaaataagtaaaaattgtatgagattgggacacccctcaaaattccaggcagtttagttagagtataattactgtggtgaggtctgcccccgaggtgcagttctccttagcagggatagacttacccacaagtaagtagatgatgatgtatggaatgatggaattgggagccaacctgtacagtaataaagaagagaaacaggtcaaggctactgttgtacaaggaaagctttctagggagaataaaaggcaatgagatttgaaatagtgtgttcagctttcttgctttctgtatattttcagcattttgtcaagctaaaaaataaacataagctgtcagagataatactattaacattttatcatctttttttaaaagtatcatacacatcttttcacatcactaaacagtcacactatcattttaatgactgaatttatcattatttaaccaattttctcctaatggaaatacagttagctactttccaatgttttgctagtcattatatgttataaacagggatgcaatgcacagccttttagtacattttgagatacctgttggattatttccatcatgttcctggaatataaattcctggattgaagtgtgtgcaatctgaaattgttgtgaatattgccaggttaccctccgtctgcatgcccaccatcaaggtatgaggatggtagaagctctcgtcgaaccagatggatgaagaccactaacggcttttgtttcctctggtaacagcaagagacagagcgacatgagagattggaccgcgggctgcactggagaatttactggtaggataattcatccctaaagagattgaagtgagcttcagaatggcaaaagaggagccccagagtatctcaagggacttgcaggaactgcagaagaagctgtctctgctgatagactccttccagaataactcaaaggtcagtttccaatcactatgtataatggaaaatcccaatataacactagcataaacaagatagaaagttatttctttctccagtagaaggaatttggaggtaagtcaagaatctttctggcttaccgccctgccatgtctatgctgtgaccttcaaactccttgtctgagatgactgcaagagcatcagccattgtatccatctttcaggcaacaggatttgaggaggggggaagagagaagtgcaagccacctacaatttaaggagacttctgggagtcgcacacaatacttccaattacatcccttaagccaacattgagtcatttgccactaatggcaaatgcaattctttagctggataaagaagtctgtgcaacagatatcatcctttttttggttttgtttggttttgttgtgaattttgccctatctgttaccctgaaaatgagagacaaaagcctacttcaagatttgagttcattgttccactaggaatccaggtccgatagaaatatgatgtgagtcacgtatgtaatttagaatttttctagtagccacatgtaagaagtaaaaagaaataggtaaaattaattttggctgggcatagtggctcccgcctgtgatcctagcactttgggaggctgaggtgggtggatcacttgagatcagaagttcgagatcagcctggcgaacatggtaaaaccccatctctactaaaattaccaaaatgagcaggtgtggtggtaaggcctgtagtcccagctactcgggaggctgaggcaggagaatcacttgaacccaggaggcggaggttgcagtgagctgagattgtgccaccgcactccagcctgggcgacagagcgagattccgtctccaaaaaaaaaaaattatttttaataatgtttttattcaacctaagatatcaaaaatatttcaacatgtaatcatttatacaaaattattaatgaaaaaagattcttgaaacattgtaccttcttttttgaactccctcttcaaaaccccccgtgcgcatattttacacttctagcacatttcaattcgagttagccactttttaggtattcagtggccactcagtggcaatgagacttcagatagcgttatgttttcttgcatatttatccttattgctttcttctatatgtctttcagcattttgtcagggaaaagaaaacagctttcagagataatactgttaacattttgtatgtcattctagaccttttttctatgcaatatacctataaaaatacatatgtatatgtaacaaaatgaactattttgtggtgtatttttttttgtattggatagcacagcgggtctactcgaagagatgcttgtttgcaatctacaacaataaattctggacttgctccagaatttatttggcactctttgtggatttaccaagctatttttaaattggacaagcagctttctcgccagctggcggggactcttgttattaaaagttagctcagtaagaagggtcctcctgcctgttccacatttacagctgattctcattaaccatggtagttacgttctataaagttactgcagacactgaattagcacataccaaaccatcgctcctaggggaaatacaggattcagttgctgtgagcctcctgttcacaacatttttgtcagctgatcagtacataacctcgttttatgtgtatttctgtttaaagacatgttaatatatattgttgatcattaacgttgaactcagggccaacaacagtactatgactcatgtcttaaacaaagctaatcacacacatgtattttctgcataaggcacatcacagccttctcatggttaggaacgctagagaacacttcagcactacacttggggaccattttcaacagtaaaatcaccaaactaaagcataaacgtggcactaaatagaccacagtgacacttgtttaaaggatgaaacaggaaggctcggtgtcaccttgcttgacctcagctgggaatgtacgtggcaggtgactccactttttgctgttgtggacgtgtccactaatgacctcaaaagcactgcaggccaggcgtggtagctcacacctgtaatcctagtactttgggaggccgaggcgggtggatcccttgagccagaagttcaagaccagcctggccaacatgatgaaaccccttctctacgaaaaatacaaaaattagctgggtgtggtggtgtgcgcctgtaatcctagcctcttgggaggctgaggcacgagaatcgcttgaacccaggaggtgaaggttgaagggagccaagatcacaccactgtactccagcctgggtgacagagcaagactctatctcagacaaaacaaaacaaaacaaaaagcactgccagtattcattttgaggttacaaataaatttcagtgaggaggcaaatttacaaatatggaatcatgagtaataaggattgactgcatatttcttggcactgactgtatgccaagcactgcactaggcattcaccctggccctgtctgaacttagttaatagtcacgttcacctgccttttttgtttgtttgtttttgtatttttagtagagacggggtttctcaccattttggccacgctgatctccaactcctgacctcaggcaatccacccacttcggcctcccaaagtgctgggattataggcgtgagccaccgcacctggccaccagtggttgtaaatggtcctgacccttcgtctttctcctgttaggaagagataatgaatcattgattgttttttgcattctgataccagggaatttgcctggctcctgaatcatccaagtttcagtcttcatgttctcaaatactggccactttgtccctagtttagaagccaaccgcctttgtctgaccttgggcaagtcacttaggctcactgaatttccatctccttttttaaaattttttatttattttttattgagacagagtctcactctgtcttccaggctggagtatagtggtgtgatcatggcttactgtagcctcgaacttctggtctcaagcaacacctccagcctcagcctcctgagtagctgggactacaggtgcacaccagcatactcagctaatgttttattttattttttggagagacagcatctttcactgtgttgcccaggctggtctcaaactcttggcctcaagcagtcctcctgccttggcctcctgaagtgctgggattacagaagtgagccaccatgcccagctgccatctcctcttttctaaaatgagcaatgtcaggctcagaggtttgttatgaagattatctgagatgctgtttgaagctttagcacagagggtggcgcataatgttgtcagtctgtctcagcctggccttcctgggctctgcagtgctgcactgtgcttacagagcctagattgggtaacctgtgtctacctccaggctggtgatggaaaatcacagtgcatgttactgaataataacctctcccactttccatctttccattgcatccccctctgttgccatgagaatgaaatgttaattgctacgttctacccccctgagtttaaatagtgttaggtcgttcttttttacctacctcgtagcattgtaggaagaaataaatgaggaaataatacgagaggtgcttaaagcagtgcccagcacctgagtgtttaatgaatgttctctgttattattaggtgtggttgaatcgtgtcctcccctcctgggacagactggctggagctcagctgtacttcctgggagaagacaatttctgggtttaatcatctgaatcttggtctctttgcatatctaaatgactttctctttgattatagagcccagactcggaaaagactaagaatggcggggcatggtggctgatgcttataatcctagcacttcgggaggccgaggcgggcagatcacttgaggtcaggagttcgagactagcctggccaacatggtgaaaccccatctctactaaaaaatataaatattagctggaaatcgcctgaacctgggaagcggaagttgcagtgagccgagatcatgccattgcactctagcctgggcaatagagtgagattccatctcaaaaaaacaaaaggctaagaaaaaggtggattccttaaggactgaagtggaacagtcttgcctgtttccttttatatccctgtgccatacagtccctaagtcctgtgtattccttcttttgtcattccactttcatacccatctacccctcccccttctcttccctctctgccatcagcctggacttgaccacagtatatcttgcctgatttcctgcaaatctttctacctgcctcttgcacatgattgctaggttcatatttcttaaatcattcctttaatcatgtcatagttctgctcaaatgacagcagtttgttccctgttttttttttcccagatgaaatttaaatgagtgctgtctagcagaaatattatgtgagccacatatataattttaagttttttaataattacattaaaaacaaaaagaaacaaatgagattaattttatttatttatttatcttgagatggagtctcgctctgtcgcccaggctggagtacagtggcgtgatctcggctcactgcaacctctgactcccgggttcaagtgattctcccgcctcagcctcccaagtagctaggattacaggcacgcaccactctgcctgactaatttttttgtatttttactagagacggggtttcaccatgttgaccaggctggtcttaagctccagatcttaagtaatctgcccacctcagcctcccaaagtgctgggattacaggtgtgagccaccgtgcccagccagagattaattttaataatatattctcaatttaacacaatatatccaaaacactataatttcaacaggtaatataaaaaagtattaatgagatattttgcatttttttttcttacacttaaagcacatctcaattctgatgccaaattttcattggaaatatttaatctctattcagattttataaaacttacaattcagcgaaatagattcacatacccaacctattggaaacatacttaaaatttttccaacaactgaatcaagtctcagctttaaaatttaaattaaattaaattggaaatccaggccatcagtcacaggaggagcatttcaagtgctgaatggcgcaggtggcctgtgatggacagcccggggataagctagcaagcccagtgtcctggtgtcccagcctcacaagttccttccgctgcacagcccttccctcgctggcgcagcatactcacgggtgtactgctgcctccctttcctggagagcccatctgctctccccactgtggttctttggattgtaaagatcaggtgacacagggagcatcaaataaggatgcatgtggattcgaactggaaagaagtcaggacctgagacagcgcaagggaccagcccacattctgtgtggtgactcccacggctcctccgcctctctttctctttcagctgccccaacacagcaggatctcactggactctgatgatggagtgtccaggctgggcagtgctggctccaaggtgattcctgctacagtcatctctggctagagaagcggaatagcaagctctttggtggcttttgtcagaatggtggggtagcaggaggcagtgaggtcagcgggcattatgccgtcctgtggcctggcagggagtgaaattggccatgcctcgagagtaatccttaggagaccacgctgaagcccaagaccaatggctgtggcttcttggcatggcctcttttatttaagcagggtgcagcttgcactttagttccttcagcatgaaccacaaacccctcctgccttccaactcgccctgaaaatcccactgtttaaaccacttgggtaaactcttcttcctaggaggcacatgtgttttggggacctgaattatgtcttcttttcatctgttggcctgcaaggccgtagggatgaggctcaggaaggaccagttatgatggaaggaggttctggaataatggttcctttcaagtgaacaggatctagaataccagtactgaggagagagaaggcgtggagcctaaggaggagagggggaaacccatctttgcggatttgcctatggccagctctgcgttaaagcagtctccctccattgagtcagatcgaaaattcctttttgcccggtgaaggaaaataaactattaacacaacataaacttgcattagtcacaggctgtggccaactatggtaaccaggttgatgacataaaagcatttttacttgatgtggtggcagctgttgcaagcattggacattctgagtccaagaccttaggtttgtttttttttttttgaaaaggagacttgcggtggggcgcggtatcccacgcctgtaatctcagcactttgggaggccaaggcgggtggatcgcctgaggtcaggaattcgagaccagcctggacaatatagtgaaaccctgtctctactaaaaatacaaaacttagctgggcgtggtgggggcgcccgtaatcccagctactcgggaggctgaggcgggagaatggcttgaacccgggaggcggaggttgcagtgagccgagatcttgccattgcactccagcctgggcgacaagagcaaaactccatctcaaaaaaaaaaaaagaaagaaagaaaagaaaaggagacttgctctgtcatccaggctggagtgcaatggcgccatcttggctcactgcaacctccgccttccaggctcaaacgattctcgtgcctcagcctccctagtagctgggactaccagcacgcgccaccatgcctggctgatttttgtatgtttaaaagagacagggtttcaccatgttagccaggctgttcttgaactcctgacctcaggtgacccgcctgcctccacctcccaaagtgctgggattacaggtatgagccaccatgctggccaggccttagcttttaatgctgagattttgccacttggaggctgtgcgactctagacaagtgattagcttttaatgctgagcttagcttttaatagacaagtgaatagacaagtgattagcttttaatgcttactaatagacaagtgattagcttttaatgcttaataatgcttttaataataatgcttttaataattataattataataaataatatataaataatataatacatattataattatatacatatataaatataatatatttatataatatataataatgctatatgaatattgataactaatattagtataatatatctaatataattatacaatattataattatgatttttatattacattacaattatatttttatatataattatatatatatttttaatattatattatatttttattttatatattataattataaatatttttatatttatatttttataaatataattatatttttatataaaattaaatataatttaattttatataattataaatatttttatattttatatttataattataatttatattatatatttatatttatatatttatatttatttatatttatatatttaaatatttatatttatagtatatataatataatatattatattatatataattataaacatatataattattatattataattataattataatgcttttaatagtaataatacttttaataataatagacaagtgattagcttttaatgctaatcactttaataatgcttttaataataataatgcttttaatgcttaataatagacaagtgattagcttttaatgctgagattttgcaacttggaggctgtgcgactctagacaagtgacttagttcattgcttctcaaactttaatgtgtatgcacgacacctggggaatcttgtttaaaaggcagtctgattcatcagggcctgagattctgcatttcctttttttttcccctttttctggagacaagatctccctctgttgcccaggctggaatgcagtggtgcaatccatagttcactgcaacctcaaactcctgggctccagtgatcctcccacctcagcctcccaagtagctaggactgtgggtatgtgctgctatgccaagctagtttttaaattttttgtagagatggaatcttgctgtgttgtccaggctggtctcaaactcctggcctcaagcaatcttcctgcctcgacttcccataatgctgggattacagatgtgagccaccacgcccagccagattctgtatttctaacaaactcctagatgatccaagtagctaagcctatttgtgtctgagtggcttcaactatgagaacctcagctgtaaagtaggaggcagatggtatgtaccttacatcaatgcacctttatgccgaagaggtcttctcaagagtgtgtttggcaggagagccatgactgggtctttcctcctttcacaaggcttgaccttgggtggggacctcagacttgccacctctccacagctgcctaagatagctgcctgggtgactcatgtcttgggagaagtcttgttgtagtgactttttttttttttttgagacggagtttcgctcttgttattcttattatcatttttgagatggagtcttgctctgtctcccaggctggcgtgcaatggtgtgaccttggctcactgcaacctctgcctcccaggctggagtgcaatggtgcaaccttggctcactgcaacctctgtctcccaggttcaagcaattctcctgcctcagcctccccagtagctaggattacaggcacacaccaccgtgcctggctaattttgtatttttagtagagacgggggtttcatcatgttggtcaggctggtctcaagctcccaacctcaggtgatccgctcgccttggcctcccaaagtgttgggattacagacatgagccactgcacccggcctgtagtgacttgttaatgcataagccttctggctttacgacttctgccttgtaattcccacagcttgggcagattcattcaacctggggttccgatgtgttacttatccctggctctttgtcctttgcctacaggtggtggcctttatgaagtctccagtgggtcagtacttggacagccatccgtttctggccttcaccttgctggtgttcattgtcatgtcggccgttcctgttggattcttcctgctcatcgtggtgcttaccaccctggctgctctgctgggggtcataatattggaaggtagcctgttccgtcattcacccctttagaaaataattcaattgggagaaaaatacttttggggccatttaaaaatttttttaaggggcggggtcttgttatgttgcccaggctggtctcaaactcctgggctcaagtgatcctcccacgtcggcctgccaaagtgctgggattatggccatgggctaccatgcctggttgtctgccattcttgtcaaaatcacatcaagcaaggcaacttatcagagtaggtaaaacatagactctggagcctgcattcaaatcccacctccaccactgtgatttggggcaagtggtttacctctctgagccttaaattcttaatatgtaaaatgcagatataataatacaatctcaaaaggttgttgtgaagattgaaacttatggctccataaagtccttagcacaatacacaatacatgtcacagagtagcttctcaatgaatgctagctattattattaagcagagaggccattcattccacagtgagttattgggcacctactgcatgccagatgcctcgctaggtactggagaccaccttcatccttcctcctgaagttccactaccaacagtcaacttctccctgtattcctaagttaaaattactgggaaagcaaatctgatttgctcactttgacttttcaaatcagatcacacaccccaggcaagtggccaaagagatggtggccagtgggtcaggtgatcacttctggtccattccgtggcttcccagagctaagagcacccagggctgtttatttgccccagggacaaggcagtttacacttgaaggagaaagtaggcatggtcagtggatgagccaaatacagcctggcagagtggtttttgagtaaatgttgatagatagatgggtgaatgcatgaatgaatggatggaggaatgaatgagtaccataagaaaggaaatttatagagaaaggagagagccattacattttggtggtaccatgcaaagctttacagcagacaagactttaaggatgcataacaactttgcctcagggtgggcaaggaagggccttttggacaggggaacagcatgtgcaaagcctctagaatagtggttcttgaacctgagtgtatttaaatcttttttttttttctagatggaatcttactctgtcgcccagcctggaatacagtggcatgatctcaactcactgcaacctctgccacccaggttcaagaaattctcctgcctcagcctcccaagtagttgggattacaggcatgccccaccatgcccgactaatttttgtatttttggtagagatagggtttcgccatgttggccaggatggtcttgagctcccgacctcaagtgatctgcccacctcggcctcccaaagtgctgggattacaggtgtgagccactgcacccagctccaagtgtgtataaatcttactttctttatcaaaatacagactttggatcttttgagaccaggagttcaagaccactctgggcaacatagcgagattccctccatctctttaaaaaaaaaaaaaaagaggccggacacagtggctcatgcctgtaatcccaacactgggaggctgaggagggcagatcactggaggtcaggagttcgcgaccagcctggccaacatggtgaaaccccatctctactaaaaatacaaaaaattagccgggcatggtggtgggcacctgtatcccagctacttgggaggctgagacagtagaatcacttgagcctgggaggtggaggttgcagtgagccaagattgcaccattgcattccaccctgggtgataagagtgagactctgtctcaaaaaaaagaaaagaaaagaaaaaagaaagaaagaaagaaaaaagtggtgtgtgtctgtagtcccagctactcagaaggctgaggtgacgggatcgcttgagcccaggcagttgaggctgtagtgagctatgatcatgccactgcactccagcctgggcaacagagcaagactctgtctcttaaaaaaagaaaaaagagaaagaaaatgcagacttccaggcctcatccagagagtgttgttttagtaggtctggagtggggtttagaaatctgaatttttcacgagcttccttgatgcacctgattctgatgcaggtggttggcaccacactttgaaaaacgctgatctaaaattttgcgaatctttatgaacaggcagcacacctgttgatgttctcttccttccagccttttcagggtccctccctgaaaccatcactgtggctgtgggaggagcactgggctaactggccactcacaaagcaaagggaaggatgtcagccatacaatacttgccatgttacttgttcttcatgatcttttccttctaccttttattcttttcccccccacaggccccacattatgaaaaaatgtattttccttgcacgtattagatggtaattcattaatattcctattcagagtgggaatggtatattaaaatggcatataaaatgctccataaaaatgaccaatcagaccttaagattaaaatgtgatggtttacaggctggattttcaaggatgccatcaaaagctgcatttagattttgctttagcctgcatgacctttatacctatagcttgtaggtaagagtaaataatggcatttattatgcactttgagacattagagataatttacctcccccagtactgccttggctgactcctcgaggggatccctttggaagtccatctctgaccttgagggtaagggaatctcaaactccagcacttatgggcaagacaaaatgagcaggctggttgtggtggctcacgcctgtaatcgcagcaccttgggaggccaaggcaggtggatcacttgaggtcaggagttcaagaccagcctggccaacatagtgaaaccccatctcctctaaaaatataaaaattagctgggcgtagtggcaggcacctgtaatctcagctcgtcaggaggctgaagccgggaatcacttgaacctgggaggcggaggttgcagtgagctgagattgcgccactgcactccagcctgggaggcagagcaagactgtctcaaaaaagaaaaaaaaaaagacaaaatgagcaaagcagcccatgtgtgatgcagtttgggaattggggggactggaggcaacgggagggccagccagttgttgccatggtttgatgcccactcaggtacccatatcgcctcctttttttaagtgatgctagaaatctgggtttttgtgggaaatcttcttactttaataatctgagttagcggttgttattttaaacagactgacccagggtctgccagttttcaacctgtttgagatgaacccttctcctaaccacgttctcctcctaggattggtcatctctgtgggtggcttctcactgctctgcatcctctgtggtttgggcttcgtatcactcgccatgtcggggatgatgatagcatcttatgtagtggtctccagcctcatcagctgctggttttctcccaggtaaatacatgtccatgaaataatttatttttttaatctttctacttttttgtttttttgagacaaggcctcactctgtcactcaggctggagtgcagtggcatgaacatagctcgctacagcctcaacctccaaggctcaagcagttctcctgcttcagcctcccaagtagctggggctacaggtgcatgccatcatgcccggctaattttaatattttttattttttgtagagacagggtcttgctatgttgcccaggctgttctctaattcctgggctcaagcaatcctcctgcctccacctcccaaagtgcagggactacaggcatgagccaccacaccttgctgagtaatttaatctttgccacttgaggggattttcacaaataaaaccataatcctagttgatgtccagaaggaaacttgtaagacccaggtgtttctcatagttccccatgtatgccaggcatcaggtgggaatttaccatggaattttaaacaaagcaattgctgtcattttccatcacgtatacacatttcattgtcatagcaactctatcagtattattgattccttttaaaagatgtccatttaatttacaaatgtcaaattaggtggttttctttggcggggtggggcagagaggcacaggagaaaaatgacccacgagacatgtctgtcacccaaagcggtacagtatgggagccgtgaatcttctgtccccaaagtctgtcaatcccctctgctcttgagaatgtgagtttctcaccaactgagtgtgagcctcatgtttgaatatatagatttttgttcctacaatatggctcttcaatgccagctacttcatctggggccttgagtgaaagaacagcgatctacttaaatgctggagggaaaagccagctatgttggcattactgagagactctgtgtttgtctacaatgtgccacccacctaagggattttcaaaggagatttattttaatgctttatttttgtcctttgtgttgattttagaatctaagtcccaagttcatcatacttcatttaagctcctgctaaattgatgatagtgctactgagcacttgctctgtgccagggactctcttaaacactttccaggccttatgtcatgtaatccttaacaatttagcccctttctattataaggaaaattaagccaagtcccttaagctgagagtagcacagaagggacttaattccaggtgagttaattccaaagccctcttaatcaagatacaaagtgactctctaaaacaggagttggcaatttctggaaagggccagacaggaagtatttagtaagtaatatagtctctactggaatttctggaaagggccagatagtaagtatttagtaaataatatagtctctactgcagttagtcaactctgttgccgtagcatgaaggcagcacagaccaggaagtaaatgcatgggcatggctgtgttccagtaaaactttatttacaaagacaggcagcttgctggatttggccaaccattgctctataagaactgatatcctgagttttgtttttctacaaaacagcccttgaactccttaccaaaagtttatcctgttattattcctatgttgaaaaataaagggtgaagtgggtataatataaaattgctcaaggatggctcttataggattgcttaattgaatcaaccctggagtcataatcaccttttcaaaaatcgctttgatcactcttagtcttttgtttgttcatttgtattttacttataaaatggggtcttgctgtgttgcccaggccattctcaaactcctggcttcaagcaatcctcccccgttggcctctcaatgaactggaattataggcgtaaggcactaactcactcccagtcttaaaagatgtaaaaggagaaatattggcctattttgcatattgagggtgatgcttctgaaataaaattcctccctgcctctgaacgctgctgtaacagggtgagttcttaaagattataccacaggaagtagcagaatctgactccctacttatcaatgaagaaattgaaaaacaaatccaggatttgtacttgatctccttatcttcccctattgctgccaaccaattgtttccacgtgggcagaggttcttaagctttttgttctcaagtcccattttaccttcttaaaaattattgaggcatctgaagagatgttatttatgtggttaattgtattaatagcactttgggaggccaaggagggaagatcacttgaggccaggggtttaagaccaacctaggcaacatggcaagaccacatctctacaaaaaatacaaaaattagccaactgtggtggtgcgtgcctgtagtcccagctactcaggaggctgagatgggaggatcatttgggcccaggagttcaaggctgcagtgagctgtgatcacaccattgcactccagcctgggcaacagagcaagaccctgtctcaaaaaacaaatgaaatgagctgaaatataaaataaataactaacatgacataaaactatatacaataaaataaattaaaataaacataacataaattacattaaatcaaattaaatattagctggtgcatgcttgtggtcccagctactcaagaggctgaggagggaggatggcctgagcctgggaggttgggggtgcagtgagctatgattgtaccactgcactccagcctgggtgacagagctagactctgtctggaaaaaaaaaaaaaaagaatattaataattatttctttttaaaaaattttcttcctcattgtttcttgttctgaaataattattctatgagaaatcatagcataaattttaaaaatatctattcatttaaaaggaacaatattacctgttgatataaataacaaattttaatgaaaagtaactatattttccaaaacaaaatgaaatttgtgagtggtattattttacattttacagatctctttcatatctgccttaacagttgtcagccggcttctcgtttgtgtggctgcattcattctgttgtgctatgttgtcctgtttggagtatttgaagaagacctagcatcactaacatgcggttgggagagggaggcaaagcttttttaaacgattgtggatattctatgatagtccaccaaaactccgtaagtgatagtttcttaaaggttagctgaaatgtgaaatttttctactctattttattgaaatcttcaggtctgtgtcacactttaaattgatctttatcatgcatgattttctaactttacccattggtcaatgggagaatatcaattcattgagtcatgcagatcttccaaatatattttgaaaaattgcactgttcccttgtgagagaatgtgagtgaaaaaggcatataataggtcatgttattgtgaacatggttttcatctgagaacccttgcattagcgaattcttttttttttttttttttttgagacgagtctcactctcacccaggctggagtgcagtggcttgatcttggttcacacaacctctcccttctgggttcaagcagttcttctgtctcagcctcccgagtagctgggattataggtgtgcaccaccatgcatggctaatttttgtgtttttagtagaggtggggtttcaccatgttggccaggctggtcttgaactcctgagctcaagtgatccacccacctcagcctcccaagatgctgggattataggtgtaagccactgtacccagcctgcattagtgaattctttataactcaaaaaaagataactccctcattaaatgatcgaaagcatggaatggggggaagaggagctatataatttatttcatgatttaatggaattttggccctaaaacataaaagataatacagcttaaatttttaaaaaagaaaagaaaaaggaaacaaaactgtaagtttcccttacatatgaaacccaactaaacaatatttagatcaaatacactgacctgcctcctatgtagatcagctagcctctgaggggcaaaaccacactgcttggttatggagactgcaagaccttccagggcctgcagctcaggagaagtaggggccctgggcagctgtgtttatttgcagagccaccaaactcactaccccatatcataatcttccaaaccagcctgagcataactagcttccttacatctttactaagaaaaggaaaggcttctttcttagttttttgttatcagggaggaatggtttaggtggcaaataatgaaaaaaaccaaagtagatactagtttaaacacacagggaacttttttttattgcttaatgaaaaactggagacagcccagggctggtgcagccagtgtggtatcaacataccaggcaccttttgccttcctgtgttgctatccttagcccattggtttcctaccttatggccacaagatagctgctgcagctccagatctaccagctaccttcaaggcagcagaaaaggagaaaaaaatggagtctgacccttttaaaaatgtgaataaaatatttcccaggacctctcaccactatacttcaaaagacttcattgactagaactttgtcagatggccgctggttgctgttctcctgattgtaggtctcacgagatctgatggttttataaagggcatttcccctgcacatgctctcttgcctgccgccatgtaagaagtgcctctgatcttcctttgccttccaccatgattgtgaggcctccccagccatgtggaattgtgagtccatgaaacctctttttctttataaattacccagtctcaggtctttattagcaacataagaacggactaatacaatcctcccccgaactcctttccatggaaggtgtcaagaaactaattgaaatcagaagatatggtctgaatccccgccctgccatgttttcagctgtgtggtcttgaacgggctgcttgacttctctgatttcagtttttgtccattggtaaaatagacaaaatggctactcttaatctaccattctcactgggttgttgtgaggacacagataattaagaaaaacataataaatatccaaattagaaaatggaaaaggggccgtaaccctactcctaacctggtcattttaacctcctgtgccctcagtttcttcatctgtataatggacataggcctggtgtggttgcaagaagcagctaaaaatcaggaaaaagaacatcatgtattcagctatgcacacttccaacgttgctctttactgaggccctagagctaacgatctcttcttgttatccgacaggccactgacacagcaaaacaccagttgtgactttctgccagccatgaagtctgcagaattcgaggggctttaccaggaatgagtgactgctcagaggccgggcttcttttcaagtactgctggatcatactcaccccttgggattatggcttagaagaagggggctgggtaggcaagcactccttggctgtgtcctctcgctttttcacttacttgtaggatcccgcagcagccaatttagggattgtgttgttcttgtgttggttcccatgtaaagaagcagcagagaaatgcgatggttcaacagctcgccctgccccaagtatgcagacttgaccttggcggggtcctgggcttctagagtctagcccgttgaccccaaagcctcagggcttatgtccaacggtcccattgggagcaacagtgattgtttatagttttttgttttcagaaatgagggcagctgttaattttttcactcatgtgaaacaaaatgaaaaaaaaaatccaaaacagaacaagcccttctgtggtatttgctttttatcagaaagaacagcaacatttggcctctccaagttggaaaatagagtccaaatgtaactttgtggccaagagtattttcaaaaaagtctaaaggtgtagtttccactgtaactgttgagtactgttaagtactgttaatcttttacatatttgcacttggtactgttgtattgttctaaagagcttgtcctttaagtaatttctttcttttttttttttttttttttttgtgacggagtttccctcttgttgcccaggctggagtgcaatggtgcagtctcggctcactgcaacctccaactcccaggttcaagtgagtctcgtgcctcagcctcccaagtagctgggattacaggcacccgccaccgtgcccggctagtttttttttgtattttttttagtacagatggggtttcaccatgttggtcaggctagtctcaaactcctgacctcaggtgctccacctgccttggcctcccaaagtgctgggattacaggcgtgagccactgtgcccagcctaagccatttcttaaaataaaaatgctaaaggactagtaagtaaaaataaaacttcctatgggatttcccagtggaattactgagtggtttatttgcgtggcatttcattaaatatttatttgggtgggctttttttctttactctttttcccttctgctccatacatcagacctgcctattcctctgtcgatttcatgactggtgctgggtaatagggatttttttagttgctcgcaatagacacccaattccacattactttaaaaagaggggtggtagggagaaggattagtttcactcaaccaaaaagccaaggggtagatcttgaggtgctgctgattccaggggctcaggtggtgtcattaagcatctctcacccctcatctctcagtatagctttcctcagtgtgagctgcttttgcaggcaggcccgccacccctttcggaggtcccaggagctccatcctgggcaagaaaactgcttttttccaacagtatatacaaatattctgggtttggctctgattggatagacttgggtcatgtgagcgaccccagaccaatcatggtggctaggaggatgggatatgcagatgggacagggctgggatggtggccattcaagaaacaggggaggcgatagatcagcccactattaatataactattaatattaacagttactgtttattggatgtttccttcattcatacaactgtctgatattatctctctatgctatctacccagctgggttctgcagctttaataatgaagaatgcaatggtctcccttctgaagttttctttctaatgcaagagtgagtgagcaagcatatctgttgctatgtaacagtttaccagcaactattggcttaaaagaacaggcatttcttatctcacattcttcatgtgttaggggtccaggcatggcttggctagatcttttgtaagcctgtgatcacagtgtcatcagggctgtgttctcatttggggtctgactggggaaggaccacattccaagctcacatggttgttggcagcatccagctggcaacacgacttaagccctccattccttgctgcatattcccctccccatgacagttcagtgtggtcaatggcttcttcaaagccatcaagggagagcctctcagcaagatagacgttacattcttagggaacgtaatcatgcatgcacaatcatgaacactggatcactttatctgtgttctgctggttagaaacgagtcccagaaaccaccacccactctcatgaggaggggatcacccaagggcaggtaaaccacagaggggaccatgggctctgccttaagagtccttactagggtccttagtagtccaccttgctacaacaagtaaacaaaatattagaccaactccgctgaagataagtaaaagggtggtaagtaattgggagagcatgctttagccacagcaatcagagatttcttctatttgaaccaaaacatgagttgtcaccatgccaagcacacagggagggtgttcctagcagagggcacagtatcccaaaggcccagagatgggaagaagcttaatgtgtttaagggaaaaaaatgatgtcagcatggctgggcctcatcatgcaggacctcatggagtgagtttacaccaggggtccccaaccagtaccggtccttggcctgttaggaaccaggccatacagcaggaggtgagcagcaggtgagcaagcattgctgcctgagcttcacctcctgtcagatcagcagtggcattagattctcataggaacatgaaccctcatgtgaactgcacatgcaagggatctaggttgcatgatccttatgagaatctaatgcctgatgatctgtcactgtctcccgtcacccccagttgggattgtctagttgtaggaaaacaagctcagggctcccactgattctacattatggtaagttgtgtaattatttcattatgtattacaatgtaatcataatagaaataagctgcacgataaatggaatgcacttgaatcatcctgaaaccacccccctacccacgcctcatccatggaaaaattgtcttccacaaaacttgtccctggtgccaaaaaggttgaggaccactggtttatgccaaagagcaaaggaaagacaatgaagaatcttacatgggagagtgacgtgatcagacttgggtttttaaagatcactccatggccaatggatttaaagcaggaaggctagttgggaggtctatggaggcccaagagcagagaggataattgtgacttaaaacttacactaggctgagcacagtggctcatgcctgtaatcccagcactttgggcggccaaggatcacttggggtcaggagttcaagaccagcctggccaacatggtgaaaccccgtctctactaaaaatacaaaaattagctgggtgtgatggcgggcacctgtaattccagctactcaggaggctgaagcaggcaaatcacttgaacctgggaggtggagattgcagtgatctgagatcgcaccactgtactccagcctaggcgacagagcgagactctctctcaaaaaaaaaaaaaaaaaaaaaaaattagggcaaatgtaatggagaccttcctcattttgagggccagcagcacttggtgatgatggagaaggaaagggggacacaaggtggcacctaggtttttagcttgagccagtagtggatagtgacactattgtaggagtgaaggacaagcttcctctctaccctctgaaggatccctgaaatgaactggcaatagacagatgaacaggagaaaaggcatattcaaatttattaacatgcacatgaacacaggagttccaaaaatatgagactcaaagaaaggccaaatgattgaaacttacatagagggagatgggggaaatgtaggcaacttgaaggattgtaaatgatttttaggggaattgaatggacccaaagagcaaaccacaatgagataccatctgaaaccagtcagaatggctattactaaaaagtcaaaaaataacagatgctggcgagtttgtggagaaaagggaatgcttacacattgctggtgggaaagtaaattagttcagtcactgtggaaagcactatcacaatagcaaaaatggaatcaaaaaatgtccgtcaatggtggataaagaaaatgtggtgccatatacatcacagaatactacacagttataaaaacgaatgagattgtgtcctttgcagcaacatggatacagctagaagccattatcctaagtgaactaatgcaggaacagaaaaccaaacaccatatgttctcacatataagtgggagctaaacattgggtacatatggaaataaagatgggaccaacagacattggggcctacatggaggtggagggtgggaggagagtgaagataaaaaaaactattgggtactatgcttattacctgaatgataatctgtacaccaaacccctgtgacatgcaatttacccatgtaacaaacctccacatgtactcctggaactaaaatgaaagttaaaaaaaaaaagcagacaatagtttgtaaattattttctttagaaactgaatgggacaagttatgggaaggtgaggggcagaactgcactgcaaacaaaggtagtcttattatgcagattaagtcttttaggtaatctctcagaattactctcggcaaaatagatgaaaagcccgagcatggtgacaacttttagtctcttctgcagtggttaattttttctggttattttggatgctaatccaccacgttgacttctgattaaccccagtcccatgaatgcctcctgattcctacttcactgttcctagtgtaagaacatgttgaccttgatgtcatcacacaaattataggctatgatacattcagcattcttgcctgtcctgaagggttgcctttaattggcttgctggagcaagcataccctttccctatggtatatgcgtagccctggtgtggggagtaacagtgcagagagctacctgtcctgccaccacctaagaccacacttgtgtctgtaagttccttcaatgaatcacccaaagtcaacacaatggatctgtctgcctccttctttggttcctcggctccctcagcatttgggaatcactttgcatattcacagaaattaagacaattgcatttcttttggaagaaattttcctcggtcagataagggaacttccagagaaagcctgatatggttaggctgcgtccccacccaaatctcatcttgaattatagttcccataatcaccatgtgttgtgggtgggaccaggtggatataattgaatcatggggggtggtttctcgcatcctgttctcctgatagtgagtcagttctcatgagatttgatggttttacaagggacttcccccttcactgggcactcattctctcctgccgccctatgaagaggtgccttccgccttgattgtaagtttcctgaggcctccccagccatgtggaactgtgagtcagttaaacctcttcctttataaactacccagtgccagatatttcttcacagcagcctgagaacagactaatacagagcccctccctgcactcaagatggcagaaacaagagaaggttagaaaatccttggttctgaagcagtttctaaggcctttcattttcctttaactcagaagtgctctgcatgccaaagtaacagactttggggtatccttgtctgtgtctcaatgggggctgtgtgaaaattcaacccctgctttgctcatattaagtcagatatgcctcttggatactaagaggatgtgtcaagtagacagctggcttagagggtacgtttgggctggggagtatttttggtgctgagagctttacacagccttcatttgggatgctctcccagagagtagccaggagatcatttcatagcatagttctgatcacataaacaccttactccaacctctgccaagggcaaagtgctttcccacagcacttagaagtgctaactctttcccctcatggatcaatccatgatcaaagaccaatcccagctgggcacaatgatttacacctgtaatcatagcactttgggaggccgaggcaggtggatcacctgaggtcaggagtttgagacctggccaacacagtgaatccccgtctctgctaaaaatacaaaaattagctgggcatggtggcacatgcctataatcccagctacccggaaggctgaggcaggagaatcgctggaacctgggaggcgaaggctacactgagccaagatcacgccactgcactccagcctgggtgacagagggagactccctctcaaaaaaaaaaaaaaagatcaatccaagcttctgcttcctgctacttctttatatgccatcggcctctggatatgagagagaaaactaaagttcaaaggactcacccaattcagctaagaaatgtgacatctaaatcaaggctgtgcagtgaggttattcattcaggttctgttctttacatggtctgggcctaaccttcaccgatcaaatgaagtgaaataaggtgcagaaccctagcacagtggctgacaccaaacaagcccatcaagaataattgtcaaggacgaggctcagtggctcgtgcctgtcatctcagcactttgggaggccaaggcgagagaatcacttcagcccaggagttcaagagcagcctgggcaacataatgaaacctcgcctctacaaaaatgaaaaaattagctggggatagtgttacatgcctgtggtcccagctactgagggacttaggcaggaggatcacttgagcccaagaggtcaaggctgcagtgagctacgatggcaccactgcactccacactggggaacaatgagaccttgtctccaaaaaaaaaaacaaagaaaagttgtcaaaatgcatggctacatgagtcatttaaaactgagtgaaacaggaagatgtaaaagacctgttgttaaccaagctgtggaggaccgttaaggacttcgggctaaggtccttacaaagatatccttagccttttagacacacagctcaatgtgtggccgattggaaaggtaattaatccccagagcataaaaacgatgacttttttacagttataatgttaatttatcagtatgtccaggtttcttgtttgtttatttttgagcattcgccatgtgctggatgctattttttttttttttgagacagggtctcattctgtcacccaagctggagtgcagtgacatgatcatagctcactgcagcctcgacctcccaggctcagataatcctcccaccttagcctcccgagtagctgggaccactggtgcccaccatcatactcagctaatttttgtattttttgtagagacagggtttcaccatgttgcccaggttggttttgagctcctgagctcaagtgatcctcccgcctcagcctcctaaagtgctaggattacaggcgtgagccactgcgcctggctgcggggggctattttaagcccaatacacagcaatacatgtttccagtgcgtcctcactacctcccattttagagataaggaaaccgaaagattgacaagttaaattgcctaagggcccatagaattagaagtgggattctaactgcagtttgtctaactgcaaaagacatcctaggctgggtgcagtggctcatgcctgtaatcccagcactttgggagactgaggcgggtggatcacctgaggtcaggagttcaagaccagcctggccaacatagtgaaaccctgtctccactaaaaatacaaatattgttagctggacatgctggcgggcacccgtaatcccagctactcgggaggttgaggcaagagggttcgcttgaacccaggaggcaaaggttgcagtgagtcaagatcatgccattgcactccggcctggatgacaaagtgagaccccgtctcaaaaataaaactaactaactaaataaataaatctagatcagcagttctcagttgggagtgattgttccccgcccccgccccccgccccaaccctcaaccagcacccccaggggacatttggcaatgcctggaggcattttttttgtttgagacagggtcttgcttggtcgcccaaactggagtgcagtgtcaaccacagctctcttgacctcccaagctcaaatgatgctcctgtctcagcctcctgcatagcaggaactacagatgtgtggcgccatgcctagctttttttttttttttttttttttttcagtagagatggggtctcactgtgttgccagggctggtatcaaactcctgggctcaagtgattctcctgccttggcgtcccaaagtgctagaggcattttttgttatcacgatatgcgtgcctgtgttgggtgctgctggcatgtaatgagtaggggccaaggatgctgctcaacattttaccaagcccaggacaggcctccacaaccaagaattatctgggcccaaatgtcaacagtgccagtcttgacaaaccctaacctcaacaaataataagaattaagagaattaggccaagcaagagcacagctggtggagagggggtcaaaattgaccaggtctgccccagagtgaccagtggcaatcgtggcatcatggaaacacacaagttcacagttgtgaaatggttcaggttgtcaaagagttttcgtatcagttaccatccttacctttcataacagtccagagacgttattctgctctcattcccatcccctactcttcagctgatggaagaggaaagcagggttaatggatgagtcacctgtggaagttctcagagtcagcaaatgactaagccacagaacccggttatcggcctcctagcccacgtgcagatcctttcctcccccttctgctgccttttttgttaaagcagaagtgacaacgacgaaacgttcggaagatggactacagtgtcccatggcagttgggagtcagccatccagggggtccatacactgcagagggcatgctccgtgtatggacctccaggctggagaggacatgctccgtgtatgggcctccagcagcacacattgtttgttcatgtttccaaaactcaggaggagactcaagccccagccacatgctctaggagtctctatgcccctgttaggagctcccgtgctggagtttcaatccccagctggaaaccttagaaaaaccatcagaaggaaacgcaactgtttcctaatgaaagcgtttcatctctgagccagtagagggagcgcacatccaggccatccgaagctggctcagccgagacttcaatagcaccgagggctggaagaagcattcaacgcgcgatccttgaacttgaatgagcctatgcataggagcctgttaaaagccaaattcgcgggcggatcacgaggtcaggagatccagaccatcctggctaacacagtgaaaccccgtctctactaacaatacaaaaaaaaaaaattagccgggtgtggtggcgggcgcctgtagtaccagctacacgggaggctgaggcaggagaatggcgtgaacccgggaggcggagcttgtagtgagctgagatcgcgccactgcactccagcctgggcgacaggtgacagagcaagactccgtctcaaaagaaaaaaaaaaaaaaaaaaaaggccagattctggccgggtgcggtggctcacacttgtaatcccagctactcaggaggctgaggcaggagacttgcttgaaccggggaggcggaggttgcagtgagccaagattgcgccattgcactccagcctgggtgacgagagtgagactctgtcaataaataaataaataaggcagattctgagtctgtaggtctgcatcaggacctgagttcctgcattgcttatcagccaccagatgaagccttccaccggccacaccttgagtagcaaggtaatagataacttctcccaccctctcccatagatggtggacctgaggcccagggagtttagactgcttactagaggccaaacagaaagactgcagtgctggggctagaacccatgactcctacagctggtgctcacttcatagcatcttccctgcccctctgaccctgaaacaggattcagggaagaggatccctaagtgtgggtgaggagtaagagactatactatctgctttgaatcaagcttctttatactctatttttggtcaagttacttcccttgcagaagtaccaatagaaattcaaagatgaacacaagcagactccaattcttttgggcctgagggagccaaagtaaaatagatttgttagtgaagtccctcttatttttggttagtacaaatttggcaagtcatccaaagaaaagcttacatataacttggtatgtttttatgaatgcaaattatagccatagactttctcctaagaatgaagtttcttagcttgaatcagtttagatgaaaaatgcctcccttaaaaaataagagctcctaaactctcactaaacatgaaatgcagaggcaagtggttctagggttgatttggggaacacaatgaagttatcaaggatttaggctttccattttttcgctccatcgttctcagggtgtctttagggttatttcctcatagttacaacatggctgccatagctccgggaatcacatcacataatcatatccaaaagcaggtagaaaaggggttagctgcacatacctttttttaaataaggaaaaagaagccccctctcaacttccccttaaatctcattgaacagaactgtattacatgctcacctctaaacagaagggaaatgggacgttatcttggctatctcatgccaagcaggattgtcccccagggtgtgctgtgcaaacaaagtccaggttctcttagcaaggaagaaggggatgaggtgggaaggaaaaagaaagggcaagaaaatcccttttaattaagccctacactatctgccccagtacacttgtgttttcgctgtatttattcacaaagtaagggtcttcatgtgctgtgtgagcaaaggtcaggaccaaggaggatttagttaaatctggaatctcagtcaggggttcatactcttgagataaggaaaagtaaccaatgctgcctaacagcccagcacccacactgcagtccctagacttagcagatggaacttgctataatgaggaccatatgtattcatttgctaaggctgccatagaaagtaccacaaactgggtggcttacacaacagacatttattttctcacaatcctggaagctgggagtctaagatcaagatgccaagcaggcttggtttctccttggcctgtagagagctgtcttctccctgtgtcttctgcctgtgtctgaatttcctcttcttataaggatagcaatcctattggactagggctcatcctattaactcatgttaatgcaattacctctttttttttttttttttttttttaggcagagtctcactctgttgcccagactggggtgcagtggcgtgatcttggctcactgcaacctccatctcccaggttcaagtgattctcctgcctcagcctcctgagtagctgggactacaggcctgcaccaccatgcccggctagtttttttttttttttttttttttagtagagacagggtttcaccacgttggccaggctggtctcgaactcctgacctcaggtgatccactcacctcagcctcccaaagtgctgggattacaggcgtgagctgctgcacttagccacaattatctctttaaagacccttcctccagccatattttgagattctgatgttgggacttcaacatatcgatttgcgggtcacacaattcagtcctccaattcagcgagcatacttctatttcctctgcaagtctgatgtgcaccttgctttaaaagagatacgattatcatgcttctcatcctaattttcaaagggctttctatcatgtgtgaatctcaggttccagtgaatgccttcttcgtgtctgtggatgtcatcatatgagggtattttttgacctgtttctgtgacgtattcatagagttcctgtaatcgaacagtcatggatcagcattcagaatatataaagaaaccctaaaaatcaataggaaaaggacttttaaaatctagtataaattaaacaaaggctataaacagacaattcagaggaagggactgcttcctgctgtgcagatggtcatcttgcggtatcctcacatggccgagagcagagagaggaagctcactctcctttctcttcctttaagggcacttatcccctttatgagggcaccatcctcatgacttaattaattcccaaagccccacctccaaatatatcacactgggggtaaggacttcaaaaacatatacactgggggtaagaacttcatgtgaacttgttgtggggggacacaattgagcccacaacaccgagaataagcctgagcacacaccttgtgccacaggctgcatgttctacctttccgcaacccctgtgctgcccacgatgagacagcttcccactcaacacatcatcactttcaaaccagaagcaatgttgtgctgtggattttctggttattgacacagtggtgggcactatcagaggtaattcacatctttgcatccaatgggagagaaactaaattccctgttgacttaaaagggagaaactgaggcagaattaaaagtagagagttttttggggccaagtttgaggattgcaaccccggagcatggattcaagttgacatgagttatagactcctattagcagcatttacaagtggatttctaaaggcaaaaaaggggggacagggagtgagctgatgcacagttctttgtcaggaattctcattgtttttcagaaataacattgatgtgtgattggctatacattgttaagctatagggtgtggttatatgtctggtgcagcattattaggttaacttaaagctacttgtggcaatagtaagcagtttcaagagatggatacttagctcaagggaggagtaggatgtgatgactgtctcatcttttttcctttttttttttcttttgagatggagtctcactctgttgccaggctggagtgcagtgacatgatcttggctcactgcaacctctgcctcccaggttcaagcaattctcctgtctcagcctcctgagtagctgggactacaggtgtgcgccaccatgcccagctaatttttgtatttttagtagagacagggtttcaccatgttgtcaggatggtctcgatctcttgacctcgtgatctgcccaccttggcctcccgaagtgttgggattacaggtgtgacccacggcacccagctgactatctcatcttactgtctctggccctgatagtttagaaggacttatatttctcagatcaaagttcttttcttttctcacccctgtctcaggacctgtattctcagcaatgcctcttctttcaactacgatacatcactgtttggaaatggaactagttgcaacttaagtgccaagttcctgaagctataaactgctccccatgcttttagatcctatgtgcaagcaacagtgtgtgtttgtaatgtgttgtctgtgatgaagtgtggtaggctctgccttcactagcacagtgatttctatccagggatatgtgtcagagtcatctgaggagcatggattagttttctttcactgcttagacaaattattacaagtttagtgggttaaaacaacatagatttattctgctacaattctgaaggtcagaagtttgaaatcactttcactggactaaagccaaggtgtcggtggagctggttccttctggaggatctaggggaggatccatttccttgcattttccagcctctagtgttcccctgtatcccatggcttatagccctttctccatctcaaagtgcatcactccaacctctgcttccatcattgtactgctttctccccatagtcaaaactccctcttacaagcacacatgcagttatatgtatggcctacctggataatttagataatttccccatctcaccgttttaccttaattatgactgcaaagtcccttttgccatattagggaaaattcacaagtcccagaggttagcacgtgaatatctttggggccatgatttagcctcctatagagcctaaacatgcttagactccactccctaaagattctagtttagtagatggtgtctaagtttttgttttttgttttgttttgaaatggagtctacctctgtcgtccaggctggagtgcagtggcataatcttggctaactacaacttccacctcctgggttcgtgattctcctgcctcaacctcccaaatagctgggattacaggcacctgccaccatgcccacctaattttttgtatttttagtagaaacggtgtttcaccatgttgaccaggctggtctcaaactcctgacctcaggtgatccgcctgcctcagcctcccaaagtgctgggattacaggagtgagccaccatgcccagctgatagtgtctagttttgtaggtggtgtctccctaaagattttagtttggtagatggtgtctaggccagaggtctgtacaatcaggtgtacattctaccacatatgcacttgattacatatgccttggtatatagcacacagacttattcaagtcacagttattgtccataatgttatctgagtttttatttagagttagaacagtgctattttcttgatgttgagatactccaatgctgactgggcagtgcctacatcaatacaacggttatcttgttgaaccctcacacgcttccaaattaggttgtgttccctttttacagatgcggaagcaggctcagagattgttctatctgcccgaggccacacagccagggagacgtagatcccgaacccaaacccaactcttgctctagagcctgcgcatcccacagaacttcctaatgcagaacagggcaggggaaagtagtacattacattacaggtgccttcccagggcacacaagtctgttttcaactcctgcaacctccaccatcaatcagaactgctcaaactattagaaccccaaagctccatcattctactcttgacacctgtatgacaattacagcccatcactacgtgataaaggagattgcaagcacactaacgtggttgaagcagcagtctctcaggatttaagctcgactctcttcccacacagttcctgtctgaggaggctgcctcccccatatatagtaggatgcctactttcagaaggcaagaacacgactttagtcaactgctcccaggctaccatggcaacaagtgttcatcccggcagctgctccacaccagcttggctttccactctcaaagttctgctttagcatttttggcaaacacatcagaaccaagtcacgctgtgggctgccttgagacccaggggactttgattcccaatatgactctatacaagtggaccaacttgcagctgagaggctctagctctgaaatcaaggggctgtgacatcctggacaagcttctttagggctcaagttgctcatctgtaaaatgtgcacttttaagccatgtttttcaagttgtgggtagtgactcagtattttaatttcctattgttgctgtaacaagtttgtttcatgccgttaagctatctcacaattctggaggtcagaagtctaaagtggtacagcagagctgtactctttctagaggctctatgggaagatattttcttgttcccctactagaggcggcctgtgttttctgtgactctctatcattccaatttctgcttccattgatacatcctattctgaccttgtttttattttgagacagagtttcactcttcttgctcaggctggagtgcaatgtcgcaatctcggctcactgcaacctccaactcccgagttcaagcaattctcctgcctcagcctcccatgtatctgggattacaggcgcccgccaccatgcccggctaattttttgtatttttagtagagatggtgtttcaccatgttggccaggctggtctcgcactcctgacctcaggtgatccacatgcctcagcctcccaaagtgctgggatcaccggcatgagccaccgtgccctgctgaccttcttgttttatagggacacttgtgattgggcccaccgggatgatcttaccatgtcaagacccttagtcacatctgcagagtccatgttgccatgtaaaactaatattcacaggctctagggattaggatgtaattcctagacatgggtcgggggtaggtgtcattcagggtcaggaagtcatttaagtggccatttttaaaaatgccattaaaaagcatggtacgtgagatttagttatgatatacaatgcaacttgataaagtcacacagaattttgaatctaaaactatttagcagaatgccttggatccttaaaagaaggtccaaagaaggcttttgatgagacaatttgagcttttgaccctattactctagaaatgccagaccctctacataaggtaggtgtggttctttccctacatcagagtcttatctgtaagacctaaccaaaggatttagaaagctaccttttaagtctgtgtggcagaattctagaacaggtgccgggcacggtgtctcatgcctgtaatcccaacactttgggaggccgaggcaggcagatgacctgaggtcaggagtttgagacaagcctggccaacatggtgaaacaccatctctactaaaaatacaaaaattagctgggcttggtggcaggtgcctgcaatcccagctactgaggaggctgaggcaggagagtcacttgaacccaggaggcgaaggttgcaataagccgagattgcacctatagaaaaccacaagatgaccagatagacatcacgatattcaacctcaaggttagatttttgaaaaacccaagagtataatgactgagctgacatttaaatccagccactagaagctttcatcacttattcttcctgccatacgtagatttgaaatatttccttgcaaaaattttagactcaagttttctagaatacaagtgaatttccatatatcttgaaggtctctaagagctgcagtataaagcagacactagtcatgttgatgacataattacttagaataagactggctaccctcaggacgaaggcctcaggagacggtcaagatcgaatgcaggtaatggaaaactcactctaggctcagttgaatggtggagtctgattcttggaatgttataactgagccttaggactctggcactttagtattcctttccctaccaaagaaagattgcttgtctttagttataagtgggaaggtaactaagtccttttaagctcaggaaagttgtaagcttgagtgtaacttgagttaggaattaccttgaagtaagttcttatattactttcttaggaacatctggtttcccttcccttaaaagaaggggggttggatttatgccagtgatcatgggtagcttgctggcttcttatcctgtgtaagagcttgtagactcaagtgtacccccagagctgggctatagctaaagccctactgttgactgggagtgtcagaggactcatgtattggggttagaggatcagaaggggccaaatgacaggaaacaattataccatgaacttccctatttgtatctatatacaaatcctgcccagaggattgtggctaggtactgcctctacactgaggaacaaaagaaatgatcccttgtcatctaatcttaataagaatgtggaaggcaagaggcttattttgactgctttatttagaagcccatttagtgatttgacacagtccttttctcgtacaggtagtagatgaagcctagagttgccaccacacctgcaaaggcagccacagcagccacagctttggaaccaacatctccagcagtcttgtgccctttggtgtccatagcacctacaaaggaagcagacatttgagtcttaagtatttttaaataagggtaagtggaagccttacataaggctccccagagaagggggtaaaactaagccttcaacaggcttatttcagaagtttgcaacattgaataaacttacctcgtgagccaacctcctcccctgtttcactcctactcttctccccactgctcccacttgcttttagatcagatgagccgacacctgggaagaacctgagagtttagtacaacatcttcatgctagtcgatgtggttagctgtcccctgagggtgtgatcccacaggttgttcattaaggctatctcaggtaagggtatgtgttaacaggcacaaactaatacacacttaagtttggccatagcatgttaagatgcacatgctctgacctaatcttgctagaaacatatcttaaatctttgactactatacaagaaattcaagaggattttttttttttttttttgtggccgggtgtggtggctcacacctgtaatcccagcactttgggaggctgaggcaggcggatcacttgaggtcaggagtttgagaccagcctggccaacatggtaaaaccttttctctactaaaaataataaaattagctgggcacagtggcaggtgcctgtaatccctgatactcgggaggctgaggcaggagaatcacttgaacctgggaggcagaggttgcagtgagccaagatcacaccattgtactccagcctgggtgacaagaacaaaactttatctcaaaaagaaaaaaagaaggattctagtatggactgaggacaaaactagaaataaacctatagatatccatgaatgaggatcatgactaaggtagagccacgtggaatcctaagggttctttgtacagatataaggtagataagacagattagagaccaagttctagatcagtaggtagaagctatgatcctacttgtgttgaagtgatttctagaagggtacacaggagacttaatagaagcctacttctgggaagagacttagtcttttattcttctattgtttagactcaccacgggtacatagtatatgtaagcactgaccgcttggcataaaaagctaagaacttgaatccaggaagtactccaggctttaggtccatacctctgaatgaggagtcatctgacaacaggagaatgggtcctgggaggctgactgtcattttctctgcttcagtggcccctgtggctggagacagatgatcaagtttgtgtttggcctctggaatagtggttcgagaggtgtgtcaatggaatgcttagaagtagaagctctctggagtattttgttcatgtggtttgtcttgcctttgcaggcgaggttatgccctttactgtagaagtgggatggattcttggggttgggtgtggtggctcatgcctataatcccagcacttttgggaggccgaggtaggtggatcacctgaggtcaggagattgagaccagcctggcctggccaacatggtgaaaccctgtctctactaaagatataaaagttagctgggtatgttgggggggttcctataatcccagctacttgggaggctcaggcaggagaatcatttcccttgaaccctggaggtggaatgagccaagatcacaccatcttactccagcctgggcaacaagagcaaaactgtctcaaaaaaaaaaaaaaaaaaaaaaaaaaggatagattcttaaagaactcatcgtctatagaactagacaagaaactgttcatcttagacctgtcacatgagtaaggtagactggaccaagttttgactgggccaacaagagctctgggcagtaaataaagtatgagttataccagtccttaagatcttctattctaaaaagttgatacttgctttgaattagactcacagaaacaggaatttgaagtttttacctcgcctgtgcctagaggacacagggcaggtcacagaacacagtggggagtcaggggagagtcgattacagattaaggcactgcagtggaagtagacctggagacagaagagagttacatggaatcgatgcactaacatttaacctgtccctggtgacttctgaatcacttaccaggctagagagcacgtgggcttctgatacaaaggcaaaagccttcatgtcaaacctctgatagtgatcaggatgggtcacagaggagccgactggatggaaggtggtctggtagttgtccaggtcatatgcacagctaggaggtatgcaccagggagggatgtcagtcatatgcatcttggagtcaaattcaatgtctgcccagatttagtcatacgtaatatcttcagaactattgccatatttaccttctaccagcacctttgttttactcagcatttcttacctgacctataatacctatgaaatcataagttgtatagactagttatattttaactattttagcagtacctgtttgccaactacatgagaagtacaaattatatcatttcagaagacactggtttcttggccaggtgcagtagctcacacctgtaatcccagaactgtgggaggctgaggtgggcagatcacctgaggtcaggagtctaagaccagcctggccaacatggtgaaaccccgtttctactaaagatataaaaattagctgggcatggtggcaggcacctgtagtcccagctacttgggaggctaaggcaggtgaatcgcttgaatctgggaggcggaggttgcagtgagctgagattgtgccattgcactccagcctgggggacaagagtgagacctcgtctcaaaaacaaaacagaaggcttagtaactgagctaccacagcttcaagaaagcaaaggtgcagttttagccaagtacacactattccataagaatgggtgagatccagttgtaggacaggacacggcaggagagctgtaaggttgaacacctatgtgtacaagtgtgtggctgcaacctcagagcatcagtgctcagattctagagtcagatggatattctaatacaagctccattgtttaagtattgttttgggctggttatttaggcagcaagctggggtttcttcatgaaagacgaagactagtacaactagtggatgtggaatacatagcactgtgcctggcatatggtaggtgttcagatggatagaggctagagaccagtctttccagatgatcaacaccatagtagagtcagactttctggggctttggaactcattccttaagattcaagaggtgattggaaggcagcatgtggccaagtgtggtggttcacacctgtaatcccagtactttgggaggccaaggtaggtggatcacctgaagtcaggagttcgagaccagcctggccaacatggcaaaaccctgtctctactaagatagcaaaaattagctgggcttggtggtgtgcccctgtaatctcagctacccaggaggctgaggtaggagaattgcttgaacccaggaggcaggggctacagtgagctaagatcatgccgcagcaccccaacctgggtgacagaatgagaccccatctcaaaacaaaaaaaaaaaaaacagaaggcagaagagtcccaattagaaaacaaggactaaatctggatctcacatgactgaatgctgctctaaagcccaagagggtttattcccattactggcaagttttgatggattagctgggtaacctgatagtacagggagtacctacccatccacgacaacgttccactgggggaaagagtctggatccatggtggacgtcgcccagcagtcatctaagaccagcttgatgttggggtcatccctgtttaggactctcacttccatgtaaattggttggcggaggaatctcactagagggtactcgttttccccataaggttgttggtaggaattatctgaaattgaatggtattcaagtagttaatggctgcaacacagattcataggtcatcactgctccattagtctggcagtatcaggatgttcattttagggagaagtttgagatcatttaagcaatttcacagactgcaatctcttacctgggtagctttgcaggatcaaggtaaatggacccaacttcactgaggccactggaggagtaaggctttcaacgttgatgtttagtagcatgtcattcctgctataagaacacttcactgtcattctgtaagagtttggagggaaggtaggtacagaaaatttcaggttaaaaaattgcttgagtttaaactagagcttaagagtcaaatagcaattttatctcacctgaactcactgtctctagatattttgcttggaggaaaatccgtccagagagcatgtatttcgttttcatagacgactttatcatcttcgaacttaaatgtcagagaaagtgggttagcagccagttatgtcaaagatgagacttaacctcgtgccatctgccagtactaaccttatatctcgttccacatccattcaggggtatgtggaaccgtaccagcccctgagactgagcctcaaagacaggctggcaggatgagtttcccaccctcagagtacccaggtcaagagctggttgtgtttggtagctgtagacctcgacgtccataaacccatcctgggtgcacagctcccctgtaactagacagcggtgaaagtttagagaaaataagtttgtctgccctgtgatactgtcatctcccaacctgatatgctacgagggagaaattctaatttagcaggaggcatcagaatctgtcttgaagtctttatgagggaaccttgatcagcagcttgaattacaaagggagctgaagttagttgattgttctatgtgagagtaggacttttcatccaaaggagggaccagtagatgtaggaagaagtgctatatggtataagaccagtgagaatcctgatgaagggcaggagttgactcaaggttaaacttaatgtggctttaagtacagcgcctatgttattgtatcctttctttgtatactcacaaatcctgagtagtttggggagaaactgaggcaggagctggttttcctatttgatctgacctgtgcagatcacattaaacagaagcacatggtggaggcaatgctaaacaagagatattcactctatttaagaatttgtaggaattttggggtgggggggtacttaaacttaattctaattagaagtttgaatattcttacctagatgtcaggttcaggctcctaagccaaaatatctagattgtttaaccatggagcagttgccataaaacctacctatgtagggatcttaaaaatatcatacttaggaccccatcgtagcagctacactgtttctaatctgactagtctttagtttcttcagtctataagcaatagatcagaatctgaccttctatacatttgcccacatgtacaagagccaagggagaaaaaaggtagaacatgattttaataaaaggtctttacctatagaaacgggtgactcacagagacactcaggatagatcaccatggatactgtctctggccgaaggagaaaggtcagcttgagtgaagctaagtagaactgatggagtaggcatttttcagataactgaaatgagaaaatgtcaattagcagccacagtccgttggggcccggaaccgtcacagggaggcaggaagcaagtccactaaatacttgcaggacacactccagacttatctgggctccctttaaaccaaaacaagagagaccctatcacttcctcagatctggatgtatccccaggcagatttattgctttaaactcatgccctggagtacccagcactgtactctttgtacgaggcactaaagcttgaattagcagatcaaattccaaagaatagtggaatcctctgccaagccaggtctgagtcaaaaggactctacagatgttataaaatggtattgcataatatgtacccccaacctaagattattctctggtatccctggcagttctagtgaagactaacctcaacagcaacagtacgggacccttttgtttagatcaaggtgtcctgttcgttgaccaggacagattcatcattaggtatttgacaagtagttgctactactcagttggggccttagacagttttaagacttagaaagacttagacgatttttcatgacagaagttaaagaggttttgtgttagagaatgaactttagttacttgatatttcacttatacaagatgatcaaatgaggccttttggagtttgaatctgttatgttggcaattagagctcacgggcaagttatcagccgtatgaggactacccacaagagtatacttcaagtcaggacccggtggagttcagtggttgacaattgaacatactttcgttttgagcagagttttgctgaaatgcaatttcatgccatttgttgcttctagatcaattccattgtcatgcagctggctcacatcaatgttctggttttcaaagctcacagacttaagcttcccaggaaactctggtatggtgagagtcatgtgtgtggcattgcaggtcacaggatctagaaggaatgacaacagaatgcccattaccagccttgattaagcttctaggacaatgtctcccacactgaggttgcagctatctgggaccttacctggtgcacaaatagcttgtgaagagaagatcaccttctgtccaggagatataaatgtaagcttcagagacaccatgtagagatgactgttaccttgctagggggagaaataacagtgatcttcaaaaacattggttacttgaatctctaaccagtaagaatcatcttggcaagtatatatccaagtaatgggcactactttgacacaagtaggatttaagcatttgtctaatgactaatttgtctaatctggaggtatattagttttaaccttgttctaacatctggaagaatgttgtctagatcacctgtagccaatgacttctaggcagataagatctgtccttaccccatatgactattttaaagtatcagcagccagacaatgttttcaagcctcaatccatttgtgttcttactgggagataggactgttcttgaagtggttggcatttgagcacttacatctcaggacctgtcctaagtactttaggagattaattcatttagtgcagtgttcagactattggcctggaaagcaccaatacttgctataaaacaatataggacaatgacaacccaaacagaaccccttaacccataaagctttcaggaatatgcttgttctgtgttgtactatagatttaagactatgggaaagagactagattgaggtaaggattatgtatttttgagaaatggtctcgctctgtcgcccaggctggagtgcagtggtacaatctcggctcactgcaacttctacctcctgggttcaagcgattctcccacctcagcctcctgagtagttgggattataggcatgtaccatctcacccagttaagtttttgtgtttttagtagagacagggtttcactaaacagacagggttggccgggctggtcttgaactcctgacctcaagcgatctgcccgcttcagccttccaaagtgctgggattacaggtgtgaatacccagcgaagtgtttggcacttaataggcattaaaatgggttgtattataaattaatgtgaagacatggttgagatcatgcttcaatttaggaatactggcctgtgctttggtggtacaaagccagacttccacacctaccacatagtgagtcactccagtggcattgaatggcacatggaaggtcatcctgtggttgtcaatcaagaggctgaagccttccttcatggcctctggcagggtcagagttttggctcttgcaccatcaccaacctcaatgctccatcccatctgaactttggtcccctgaagtcaaaaagctttgtttagagggctggtgctcccttaaccaagtctctggtagtctaacaatttatcaggttaaaggtaatatcacctttaacatagaattaaaggttattaaggtctgatttttaaaatttgcttcataccttactgtcgtcagccaagccagagaagacccgtggcaaggaaaactggaagaaaagaattgtgatgtaagactttgatttggaggtagatgtttccgaattcatgccagaaattgctgtgtggttgtcataccaaaaggcctgctgtgggatgcagtggaagaagcacatgaaccctgactgtgcccttagatgtcattatacttctttgaacttctgatcccaagaggcagctggaagatctaagctcctttccagttgtaagttgggacacatttctccccccaagatagagtttcgctcatcgcccaggctggagtgcaatggtgcaatctcggctccctgcaacctccgtctcctgggttcaagcgattctcctgccccagcctcccaagtagctgggattacaggaatgtactaccatacccggctagttttttgtatttagtagagatgggttttcaccatgttggtcaggctggtctcaaactcctgacctcaggtgatccacctacctcagcctcccaaattgctgggattacaggcatgagccaccatgcctgaccaggacaatgttcttaaacgtttgccctttcaccaatgtccatagaaatcaggtactatgtaaaagccatgcagttctatcattgttattgagttgcttttatgtcagtgttatttttagttgtccattgttgacattagccatgttagactctaaacccatgaagatgtgactgggtcgttttgttcacttattgtatcttagcatctagggtagggcctggaacatggcatgtattccatttgtcagatgattagtgtgagtgcaactaccaataaaaccctattgccatgcatgatgtgccaagtaccatgtatataccctcagtaaattcttagagccaccctgaggtaagcattattgtcccatcactttggacttggaaacaaagcctcagggtaaagttaaacctcatcacacagaaaattagcaagtacaggattaaatcatggtctgatttctaagccccgccctggttagatcatcatcatattccccctgcagtagccatataccccgagcagtcagcccgtttcactcacagacatgaaatccttctggcagattgtagatgctgaaagcccctgggtctcttctacttgcatagctggacagaagaactgatacatgacagctccgtgtcttaaggcagcactgttgttcatgactctgatggtcatctggtgtccaccatgctgtgtacagatagcacagtgggaacagagtaagtactgtacccccatgggattctagaataccatctgacccatctgagtgggaaaacccttaaagttactaataccacaagtgctggaaggtacctcattcccgtaccaggagactagctagcccattgtaatctgttagtgaagactcatgctgataggccagttttagcatcaggaaatggagttcagtttctatttctcttatgtgtaccctatgtctcagtaccatggtcctggctgaatggggttggtatggggcttctacccaggttatctgaatacttgttaagcacctaagtagctgccattgtgctgggtagagctacccttgctattacccctgaccttaggaaactcagtctaaaagcaggggtcagccaacctttttccattatgcattagcaactgttttagactcatgtgagccacatgaaatccatagcatatttccttaaaagaactttaaaaagataaaagccagctgggcatggtggctcattgcctgtaactccagcactttgggaggctgaggcagactgactgcttgagctcaggagttcaagaccagcctgtgcaacatggtgagagactccatctctatatatatattaaacacacacacacacacacacacacacacacacacacacacacacaccacaaaagttagctgggtgtggtggtatatgcctgtggtctcagctactgggcaggctgaggtggtactgagacatagggtaggggattgcttgagtccgggaggtagaggttgcagtgagccgagattatgccactgcatgccagcctggacaacagcaagaccctgtctcaagaagattaagaagataaaacccattcttagtttgaaaaccaaaccaaaacaaaaacaaacaaaaacacaaaaaaaacccatgaactaggcacagtggttcatgcctataatcccagtgctttggaaggctgaggtgggaggatcccttgaggccagaagtttgaggccagcctggacaacatggtgaaatccccattttgacaagacaaagattagacaggcatagtgttgcatgcctgtagccccaactagttgggaggctgagacgggagaatcccttgagcccagcagttctaggctgcagtgagccatgattgcagccactactttccagcctgggctacagagcaagcctgcctcagaaagagaccatggactgcgtttggccatccacaggttatggcttgcagacccttagtctaagggaatgcgactccaagacctctaatgttgagaaggtctgttttagaaggaaattatcaggtttttcatgaaggacctatgattacttcattgattgatcacagagggctttaggggaccagatgacttacagttcaagcctgtttacagagtagggtctaagactgtatctgtacaaagcttagactgctgaccacctgcatcgtaatcagatggtatagactgttagatatgcagattcccagaactcaccccaggcctatgtccaactagtcaaacccaaactttccaaattacaacttgctagcttctgcttagacaggttgcttttattgctcctaatattcctgattgggcaatactgttgcttggcaatagaaaaacccttactgcttagctgctgtttgccttttaacacctgtttctataggtcagatttctatttgctagcaccaaaatagccttccatctcatgttggggttcacagatcaaaatagctcgtgtttcatcacttgttgtatccaggttctgcaccaggtcttaatctgtagaacatcattagtcttcattacccccatggagcaggcaccattactctcatcttctaatgggcaaacaggcttgaaagggctcacttggtggaaattacacctgattagtggtagagccagggctcaagggctcaagtacttgaatgccagggtttctcatcctcaacactgacatctcagtcctggtaattctgtgttatggggaggagacttgggtaatgttggttgtctgccagcatctttggcttgtatccattagatgccagtagtagctcttctaccttcagttgtgataaccaaagatgtttctagatgttgtcaaatgtcccctggacagattccccccaccctcctccagacagttttgctcttgttgcccaggctggagggcaatggagcaatctcagctcactgcaaacctctgtcccctgggtttaagcgattctcctgcctcagcctcacaagtagctgggattacaggtgtgtgctaccacacccagctagttttttgtatttttagtagggatggggtttcaccatgttggccaggctggtctcaaacttctgacctcaggtgatccacccgtctcagcctcctaaagtgcagagattataggcgtgagccatcacacctggcctagacagattataatagaaaagaagagccacacacgagacaccacccccttggttgagagccactgctttactccaaagagaaagttcttagccaagtttactgccagtaactcttaggttactacgtacttccccaagaactgctcaaagcaatgacttaccactctcctggtacagttatcataggtagccctcagggtgagcttttctgggtccaggatgtaagtgcagttcggcatgtcgagaccaagaggatctgccaaggccagagcaggttagacaggatggctgagtacatttcagtgacagtccaaagctatagagtcaagaccaccagtccatttctaaggtacttcagtcccttcacttccgccccaactcagtgatagaacttgagctttgagatggtatgacttgcagccagaggcttcccagagatgctggcataagacacactttcgaagacagacaggtcttccatgctgggtggcttcatgcaaatcaggtatccccatggcatcatgggagttggatgccgttgctgcaggagtttgggtactctgctccccaaacaggattgacctaagccaaaggctgtctgctaatcaggactatgaggagataacacacgttacctacccaccacagatgcatgccatttcttggtgccaggactgcttgggaactccactgttatttccctttcatcgcaagtgacagtgcctaaggagcaaaggaagcatttgggggctttgagtcatgagtgatgcaactcctacaaaagtgtatagactcctctcagatgggagggattccagatgagggaggcaagaatcgtcccctaccctgggagagctcacaaacaagtgaccaagacaacaatacaatatgccaagaactgtaaggaaaatatcaggtacccagggcttttgaagtgttccagtaagaagcccaggttagggttgacaagcaggtctgtaggagccaggtcaacaccttgacagtggagcagatggaggcaggcccgaaaaactgacaaaagctttgtcaacaggttttgcaaattgatgttaaacaaagtcctgggtaagtcccaggacttttatttatttatttatttattttgagacggagtctctctgtcacccaggctggagtgcagtggcacgatctcaacccacctcaacctccgcctcccaggttcaagcgattctcctgcctcagcctcccaagtagctgggattacatgtgcccaccaccacacccagctagtttttgtatttttggtagagatggggtttcaccacattggccaggctggtctcaaactcctgagctcaggtgatctgcccgccttggcttcccaaagttctgggattacaggcgtgagccccggcgcctggctgcatttttttttttttttttaaagatcaagttttgcccatcatctgctactctgcagcctctggctcaggtgaacgtcaagtgagcagctccagttttgcttgttatgtcgatgttttccttaagcatgagtttgtgtttgaagattgctgctcctaaagatgagggcttagtgtggtggtttgctgttctgtggataccataaagcttgaggcagtgagggattggaaggcagtgcaagtgtttgagttttcatttagcaggtatagtgagtctacaggttagcagaagaaagatccagtaacctgaccaaggtaataaagggggtgaatggaggttgtctgagccaggcctgtgtttcttggccagctaggccttccagctgcaacctgttttctctgctaagaagacttctgtcacccaagagacatacctggaaaggcaggatttaccaactgagaaacatctatggagttccctgaagtcacaagggcgaagaagagagaaatcgacctgtaggtgctggaaagagacagggagatagtcaaggaagaatggactttaacaaacaaagctaccataccccctccctccacttccagaattactcacctccagcctgcattgaaccagcctgagggactccaagagcctcctctctgcctgcacgccatagcagaagacactaccagatcaaccaggtagagggtaggctgctctgtgtttttatagcaggaagccagccgcatccacaccctctccccattgggggcacctgaatcttgtcccattctcccagctgaaacggaaggattggggaaggaagtggcctctgattcctgacagcttgcgccgggtattctgccagctgccctgtgggccaggcatgaaatcagagtttgctgaaatcagctccaggtgagtgaattggtgttttccctataactatgggggaaattaggatcttttgggcaaattatttacaactgcaatgtagagccaaagagaatcatgggctttattgagaaaaaaacaagtcttgttcacaccactacattttttttttttttttgagattcagtttcactctgtcacccaggctggagtgcactggtgcaatctcggctcactgcaacctctgcctcctgggttcaagcaattctcctgcctcagcctcctgagtagctgggattacaggtgcacgccaccacacctggctaatttttgtattttgagtaaagattgggtttcaccgtgttggtcagggtggtctcgaactcctgacctaggtgatccacgtgcctcggcctcccaaagtgctgggattacaggcgtgagccattgcacctaccctaaaaccttttaagtaacatctagtcttctggctactgcagaagttaccctgataatgcacaggaagtgtctttaaaaaaatgaatgaagccttgttgacccccaagtgtaaaagcttaagcttaccgcaaagatacaatttcagaaggatacagagaaaaggcaaaagtcactcataatagtgccactgctaatatttaggtgagtaactttagacatgtttctacaaacaccacacacaatttttttaaaacactgggaggaaagtttaaatactgttttgtaatctgctactgtcactttataactattaaacataaagctctctgttaccattttagggtggcataatattcaatttgagataaatctgtgtttatataatttccttaattatgagcataaggtggcttgtaatttttcatcattataagcagtaacatgatgagcattctgatacatatccttgggtaaccctcaagataaattcctcaaagtaaaacttctgggtaaaagggagtagtgatctaataagaatgttatattgttgtaaagcacttggaagtttcccagtggggaaactgaggcaaggcaacttgccccaacaatgtcagggaccaggtggagaactcagatttcctgaggcctgatggttgtgttttttcaacatctctcacactctttgagataactagatgtctgcagcccatgttccaaaataggtggatataaggcttagactccattcaagtggtgggtgacacttgcaattattaggctggtgcaaaagtgattgcagtttttgccgctacttttatgtatgtatgtatgtatttgagatggagtcttgctctgttgcccaggtgggagtgcagtggcgcaatcttggctcactgcaacctctgcctcctggattcaagcgattctcctgcctcagcctcccgggtagctgggattacaggcgcccaccaccaagcccagctaatttttgtatttttggtagagacagggtttcaccatgttggccaggctggtctcgaactcctggcctcaagtgatccaaccgtgtcagcctcccaaagtgctgggattacaggcgtgagccactgtgcccggccctttgccactaattttaatggcaaaaactgcaattatttttgcatcatcctaaactgtattgattcatgtgttgcctttgaggtgtaacctgaggcatctgaaataacattggagattaactgtttccctgacttccttgatcaaaaggatcacatggagctctcattaatatcacagattccagggtcccacccaaaagctgctgaattagactctccagaagatgtgcctgggaaatatttacttaacgagcaccacaggtgattcttataatcaggaaaacctggaaaatacttggagggagcgaggcgagaaaatctgtggtggccagtggttaacctccttacgggaattgagtagattacatcccagcggaattgggaagaaggagcaaaatacagataagtttttggggatagagatggtaaaaggatttcattttatagccaaagcatgatagcaatagtttctccttctatgcatatttttctgaaaagtggcaccttttctacaaatataatttattgccacaatggttaagactatgataagacattagaggaaaaaggagcatagacgtgagactcagagccctattgagaaggtggtcagagaagtgatgggttaatgtgcttattcagcctccctcagaccccacctcccttcccaccgcgctactcactcccctcgagatggtgtctttctccagagcgggaagtttttgccttggaaagggcagctttggtcagagcccccaaatttggggtttctaaaaggttaaggggcagcacagagaccccaagcaggagatgtggtgagaaagcccgctgtgggctggtgaagctggtatgtgcaccagagattaattttgtttgtctcacctaacccagacctgtggtgtgctggggacagccaccgaacaaatggctctgggcccaggagcatccatgtctaggattctgctccggaaaagcaggaagctaccatctgttcagcaactgactttgaacacaggaagaaatagctgctccgtaaaacagtgtctcctatcaggaggtaggaaaaactaaagttattacaaaaatgattcttaacattctgttctcacttataagtgggagctgaacaatgagaacacatggacacagggaggggaacatcacacactgggtcctggtgacaggggttggggggtgggggcagggagagcatcaagataaatagctaatgcatgcggggctcaatacctaggtgatgggttgataggtgcagcaaaccaccatggcacacgtttacctatgtaacaaagctgcatgtcctgtacatgtatcctggaaattaaaattaaatttaaaaaaatattgcgctaaataggcccggtgcagtggctcacgcctgtaatcccagcactttgggaggctgaggcgggtggatcaccagaggtcaggagtttgagaccagcctagccaacatggtgaaaccctgtctctaccaaaaatattagctgggcatggcggcacacacctgtaaatcctgctactcgggaggctgaggcaggagaatcgcttgaacccaggaggcagaggttgcagtgagccaagattgtgccactgcactccagcctgggcaacaagagtgaaactctgtctcaaaaaaaaaaaaaaaaaaaaggcagtaaacaaacagcagacctcgttcaaatatatgtgttccacactcttttcaatgaacctcttaaagtttgctgatttattattacaaggtgttccttctcctcttctctgccctgggttctatgtatcatgaaaccatttctctcttgctaatcacaaggcatttcttgacggggttctcatacataaaagaaagactatagttttgttgttgcctcatttgggcagatgtcttcctttctgaagtgtggttcttataaatgacagtttataattcttaaattctgaatctgctgcccttgttttccacaacaattataaaagtatttataaaagacaacctaaatatcaccatctagagatggttggataaactatggaatactcttcagctactgcaaatgattctatgagttcgttcagatctgtgagtactgacatgaaagatgtctgcaataaaactggaatttcagggctatatatctactatgctttcatgttttgctttaataggaaaatgaaaaacctgtcgacctaaaggaaggagaagagaatatagttttaaagagtttacttgaggcaaagtgtggacagctgcccaggaaacacttccaagttgccttggtgagttctccacttttgtcacaagtgggtgttttttttgttttgttttttgttttttttagacagagtcttgctctgtcgcccagactggagtgcagtcgcacgatctcagctcactgcaagctccgcctcccaggttcacgctattctcctgcctcagcctcccgagtagctgggactacaggcgcccaccaccacgcccagctaattttttgtatttttagtagagatggggtttcaccgtgttagccaggatggtcttgatctcctgaactcatgatccacctgcctcagcctcccaaagtgctgggattacaggcgcccaccaccattcctggctaattttttgtatttttagtagagacggggtttcaccatgttagccagaatggtctcctaacctcgtgatccgcccaccttggcctcccaaagtgctgggattagtggctgatacagtgtttcttgactcattgatttacagaaataacactgattagctgggtacagtggctcacacctgtagtcacagtgactcaggaggctgaggtgggaggatagcttgagcccaggacttttaaggcagtctgggcagcatagcaagatcccatctcaaaaaaaaaaaaaaaacactgattagtgattggctatacattgttgaactatagggtatgattaatggcgtccagcatatggtatgagttatgatgtccagtgtatggcatagttaggttaattttatggctacttggtgtcagtctagagcccacatatcaagtagctccaagagataattactgagcccgagggagtgaggtgtgactgctgtcacgtttcaatgcctctctgggcctgataatttaaagggacttgcattcttcagataaaaagtttcttttctttctcaaacttatgtgtatatttatactttatgtgtctgcatgtgggtctatacatatgtatttggattacaagtcaagaaagttgtcccagagaatcgacagcatcatccaggaaaggagagggttgccagggtccggggagtccacgtggctgtgctgggcatttgcgaccattgtctattctgacttgttcgtgcttttgctgtatgggttttaaatacattgaatatcatcaccgggaataggattaaggagatgggagggttggagcacagaaaacaattccccaaatgtgcctgggcatgccaagtgctttggaaaattaaaaggcttcagaaataagcctcagaatcaaggtctctctatccttgccttgttccctttccacccccaaagtacaggaaggaactctctctggggaaaaaaaaaagaaagctccttcttttttttttttttttttttggcagggctttggtcttgttgcgcaggctggagtgcaatggcatgatctgggctcactgcaacctccacctcccaggttcaagtgattctcctgcctcagcctctcaagtagctgggattacaggtgcacgccagcaaccatggctaattattttttttttcttgtatttttagtagagacagggtttcaccatgacggtcaggctggtctcaaactcctgacctcaaatgatccacctgccttggcctcccaaagtgctgagattacaggcatgagccactgggcccagccaaggcagcttcttaacagaagaaacactattgccttctatcccctccctgaaatctcattatctatagcaggaaaggagactaaggaatgtaaccacacatggacagacttttccacaagataatgtcagcctctgaagctcagtcaaattccaaagataattatgtacaagttaatttctctctccctggtctgttcattctccctgataatcattattgcccctcaagagaattgtctacagtccccatctcctccctcccctatgaaaaactgtatatacagccaggcacggtggctcacacctgtaatcccagcactttgggaagccgaggcaggtggatcacctgaggtcaggagtttgagaccagcctggccaacatggcgaaaccctgtctctactaaaaatataaaaaattagccaggcatggtggtgtgtgcctgtaatcccagctacgcaggagtctgaggcaggagaatcgcttgaacccggcgggcagaggctgtagtgagccgagattgcaccactacactccagcctgggcaacagagcaagactccatctcaaaaaaaaaaaaaaaagaaaacccaccgtatatatgcatctgtgccccactgagggtttaggggcaattactctgtgattcccaccttcccctgcacattaataattttgtatgaatttttctcttattcatctgcctttggtcagtttattttcagtgaactttcagagtgcaaaggtgggagttttcttccttcagcccttaaagaataagtaactcctgcctttctgactttgagggagaagaaaaggaaaaatcatttgggataaacaggctgcacctgcacacagataagcaactttgtctaattagcgagctcctaggaaaaagtttcctccccttttcagacatatccatggtgggaacttacacagggaggaggggggcttacctaaaacaaacccgcagttatcaaaacaagagacgcaggctttgtgcttgcctagatacatgcccacagttgcgtaagataccgggagttgcacagacagctttactgatgagaagttactcaaactgctagagatgagagaggagtttcttaaaaaagcttttgaattcagctgtaacctggcaatccacttggactcccctctctgctgcagagaatttttttctttcacttattactattcttttttgagacggagtttcgctcttgttgcccaggctggagtgcaatggtgtgatctcgggtcactgcaaactctgcctcctggattcaagagattctcctgcctcagcctcccaagtaactgggattacaggcatgccccaccacactcggctaattttgtatttttagtagagatggggtttcatcatattggccagactggtctcaaattcctgacctcaggtgatccacccacctcggcctctcaaactggtgggattagaggtgtgagccaccacacctggcctctttccctcattaaactttcactccaacccacctttgtgtccatgttccttaattttctaggaggtaggacaaagaacccagggtactagttcagacaatgagaaagtctacattaaggtgcattggtgaggttccaacaactttattccctctgttttggttgaattgttttagtgataaaataaccaattaaataattatagactgggcatggtggctcacgcctataatcccagcactttgggaggctgaggctagaagataacttgaggccaggaattcaaaaccaccttcgacagcatggcaggaccctgtctcttaaaaatttatttagttagttagttttagttttttgagacagagtctcactctgtcacccatgctggagtccagtggtaccatctgtgctccctgcaacctctgcctcccaggttcaagctattcttatgactcagcctccccagcagctgggactacaggcgtgtgccaccacacctggctactttttgtatttttagtagagatggggtttcatcatgttggccaggctggtcctgaactcttgacctcaggtgatccatccgccttggcctcccaaagtgctgggattacaagtgtgagccaccgtgcctggacaaaaaaaaattttttttaataataattttgactgatttctgagtgagctacctaagttacagagtctaaggctcaaggatgaaaactcagtagtataaaggtaaaaaggcgaaatgaatggatccggaacttgaggctttgaaacaaagtccaactccctatggtaaaatgaagatattaagaggtttaatatctaaagaggtttagtgacttgctccaggtcatttaccaagttagtagcagatagagctccagtgagaaaccaggtctcctgatgcctctccctgccctttctaattcatttcaattttctctctctcgctgtgtgtgtgtgtctgtgcatgcgggggtgttttaaaactctgtgcttctcttgcagttcacttgtcttttaaaagtacaagatgacattaattagaattttagcagtataagataaataatataaaaacttctcccagttatgctaatgcagctcaaaatagctttcaaatatcaaatatgaatttaacttggaaaaataagatagactatgtcaatgagaatgttctcgaacatcatatggtagttcctttaccaatctaatatacaatgttaatgttgttttccccttgggtcctttagacagatccaagttgaatgagccttctgacagtaataaattcagaaagaactaggatgaaagctttatcgatctataaatataaaggtagggcggcatcaatatatggaagacagaaggcccagaagtcttttttttttttgagatggagtcttgctctgtcgcccaggctggagtgcaatggcgtgatctcggctcatggcaacctccgtcttccaggttcaagagattctccggtctcagcctcctgagtatctgggattataggcatgtgccaccacgcccagctaatttttgtacttttagtagagatggggtttcaccatgttggccaggctggtctcgaactcctgacctcaagtgatctgccccctccagcctcccaaagtgctgggattataggcatgagccaccacaccttgcctttttgtcttttttaactgttgttgctttaacgtctgttttgactgatacaagaatagctattcctgctcacttttgatgtccgtttgcatggaatgtcctttttcacccctttactttaagtttatgtgagtccttacatgttagatgagtctcttgaagacagcag

SEQ ID NO: 52 - DNA, 150298 bp, Homo sapiens
ttgttaaataactgagtaaccaaatgtgggtaattgttggaattctaaaaggattcactataaaactgttattgcattatcctgtaacaaatacaaccttgtaagaaatgacagttaaataatacaaactgcctatagttactgcttgggaagtgggatttcaaaaggcttctgctttctatgttacatatttgtatttgctttttttttttttaattttttttgagacggagtcttgctctctctcccagcctggagtgcagtggcacgatcccaggtcactgcaaccgccgcctcctgagttcaagcgatcctcccacctcagccctccgagtagctgggattacaggcattcaccacaatgcctggctaatatttgtgtgtgtgtgtgtgtgtgtgtttttagtagagatgcggtgtttcaccatgttggccaggctggtctggaactcttgacctcaagtgatacccccgccttggcctcccaaagtgatgggattataggcatgagccatcgcactggtcatatgtttgcatttttaataataacaacttctgaaattagaagaagatataaaaagattgattttccaaaactctagttcatttacaagtttcaaggaaggtgactagaatgcataatgaggaaacatttgtatttctgctggtaagagttattagggtataaaaacttaccgcttgggacataagtgatttccagtaactatcaacaatgccaaatttcctcccctcttctggcatctgggctatgatgtcctctgaactgaagattggttccaggtacagccaggtggcttggcatttcaaccaggcatccaaattgtcttgtatgcgaattagcttttcttcccatttctgtgaatttagcatttcatatctggatcattaacctgccactctgcatcacaggcccatggagagagcaaatggatggagccgtacatttattcattcattcagtctgtcacttgtttaacaaatacttattgagggctccctatgctctggtcactgctccaggtgatgagaacatagcaatgaatgaaacacacaagagctttgccctttacggagctcacgtcctagcagaataattacaatagttatacacgtaatctgtgagaagtgatggtctgagtgctttaagtatatggaaccaattaaatcccacagccttacaaggtagatgtgattacaaaccgtgttttccagatgtagaaactgaaacacaacagtttagtaatgtgcccaaggtcacaccactagtaaggagcagagccagaatttgaacccaggtaatctggcttcagagtttgtgtccttagcctatgtcactgctacaaacaatgagcacaggaggccaaacccctatcttcgggtagcttacattctagattactaccataagatgcttcccaaatgcatgtgtatttggtgcattcaaatgccatcttctcttttggcagacagttgcaaaggctcagcatgccatatgctttcttggatggttattgctttcagccttgtgtcattaattaattaattaatttacttatttttgagacggagtttcactcttgtcgcccaggctggagtgcaatggcgcgatctcggctcactgcaacctctgcctcctgggttcaagtgattctcctgtctcagcctcccaagaagctgggattacaggcaccctccactatgcctggctaatttttgtattttcagtagagacggagtttcaccatgttggccaggctggtcttgaactcctgacctcaggtgatctgcccgcctcggcctcccaaagtactggggttacaggtgtgagccactgtatcatttatttatttatttttccaattaggacaaagtgactttctttgttaactgaacgtgaaaacctttcccctcctctgagaaacccagagctaacgaaacacctcaaagcattcaacttcatttcctcttacccggcattctgcttctattggtttgatgaatggggagccacacatggtctgggtctttatcacgtgatcatcaagtagcatttgaatgtcatcaattgcacacaagatgtttgtatcctgtaaataaagatgccccaccctgtcaagattgtgaaacctccccatttttcttttccttttttaaaaatttatttatttgagacagggtctcctcacccaggcctgagtgcaatggctcaatcctagctcactgcagcctcaaactcctgggcttaagggatcctcctgcctcagcctcccaagtaggtaggactacaggcatatgccaccatgcctggatttttttttttaagacagagtttcactcctgttgcccaggctggagggcaccagcagaatctcggctcactgcaacgtccacctcccaggttcaagtgattctcctgcctcagcctcctgaatagctgggattacaggcaaatgacaccacgccctgctaattctgtatttttagtagagacagggtttcactacattggccaggctgctctcaaactcctgacctcaggtgatccacccgcctcggcctcccaaagtgctgggattacaggcatgagccaccacacccagcctggatattttttttaagagatggggtctcactgtgttgcccaggctggtctcgaactcctggcctcaagtgatcctcttgcctcagcctcccaaagtgttgggattacaggcttgagccactgcatccagctacctccccatttttcatgctgatcccttaggacctcccagctcagaactccactctcatggagtaggaatctatgtcttgcagggaataggacttctactttcttccttgaaaatgttattaaagatatttaggctggacaaggtggctcatgcccataatcccagcactttgggaggctgaggtaggaggatcgcttgagtcccagaattcaagaccagcctaggcaacatagcaagaccccatctctaaaaattttttttttaaaaagacatttattgtccacctcctttgcagaagtcaaatacagtctaatccaagactcatagacataatctgctggggaggaagatttcttcccctttccctatattcctgcttcttcacttgctttcctggctctcctttcccttgggtaggaagatcggctgctaatctgactggttaggcctagacctgcggtttccacactgtgaactgatgtgccccggggcaccgcagccaactcagagtgaatgattctggttatttaaaaataaaatacagctattagtttttctttcattgtaggtgtatttttttcaaacagtgcctaagttgttagagcataaatccttattaagttgtttggacctaattactgcataaacaaagctattaggtatttcttttggcctaagggcactgtgaaaaaagtacttagacacaaagccattgtgaaccaagaaagtttggggacctttgtttaattaattaattaattaattaattttaattttattattattatactttaagttttagggtgcatgtgcacaacgtgcaggttggttacatatgtatacatgtgccatgtatttatttatttatttttgagacagtcttgctctgttgcccaggctggagtgcagtggcatgatctcagctcactgcaacctctgccttccagattcaattcattctcctgcctcagcctcctgcgtagctgggatttcaggcaagcaccaccacaccgggctaatttttgtacttttagcagagatggggtttcaccatgttggcaaggttagtctcaaactcctgacctcaagtgatctgcctgcctcagcctcccaaaatgctgggattacaagcatgacaggcacgagccaccatgcctggcttgttttatacatttattgggtcttttttgagacagggtctcactctgtcacccaggctggagtgtaatattgcaatcatagcttactgcagcctcaaattcctgggctcaagcaatctccctgcctcagcttcccaaatagctttccaagtagctggtgcacatcaccatactcagctaattattattattattattattattattactattattattattattattttgtagagagggggtgttgctgtgttacccaggctgttctcgaactcctgagctcaagtgatcctctcacctggacctctcaaagtgctgggattataggtgtgaggcaccaagcctgaccaagtggtcctgttttacaagtaggtaaggtctaaggtgtgccttaaaggccaggccctgtgggtggcactttttctcctgggccattgtggcaagcaagctgacaagggtctgaccctggggcaggtttggtctttctcgctctgttctcacttctttcaagtctaatctaggaggctaaatttgggcctagcatgtattctcttatctatgttttaccagtagctcagcattgggaggtatgttgggctattaataaagtggtttcttgatccccatttagctactgatccttgtctgtagttactttaggcaaaaactctgcagattggccaggtataagtgagctgttccccaggtctcctagcttatactcctcttgtcaccccaacagcctctatagcagtgtctaatccaagctgatcatgcagccacgcttctgagacccatggtggctgggtcacccttgctgggagaggctcagtaatgaggccctgtgccctcagctctcttccctctcatcagatcatgtatagttctgttgggtctcagaacatgataccccgaagcattgcaccttgatttgctgagtattttgaactgaaggacattggaaggccttggaagcaagatctttctgtccatctttttctgcctttctcctgctcctttatctttcccctaagacagtccatagaaactaaactcctcttgcccgaagcaagcataaaatcctgaaatatcactctgaccaagacagccggccataaggaaattctctgagcaaccttgtctgatagtgggtcacaagactgtcgttcctgagggggtcttgccctatgcctgggaggaaggactgctacacagagagaccaagaagaatctcaacagcaggtcttgctaggcttcccatggagtctagaccattataccatacgcttttgttcaatttcatttccatacagctgtccattcttcatcaaacctaagccccaaaacacagttttccctgggtcttcactttcgatggttccaaagtcatgtaaaactttgattaaataaaattttaatgcttttctcttgttaatctgtcttttattataggagtattggcggtgaatgaccttcatgctaggtgaagaaagggatcacaccttttcacccctacagctcttccttgagtgaaatcaagacactccaaccatttaaactgaatagggaaagaagtcacaagtagataacatgcagcctggggaaggagggaggcttgggagcttttggttctcaatctacattgcacatgagaaaaaccaggggtgcctgaaaaatacagatgcccaggcattctgggaggggaggagccaggaagaatccattgggagattttaaagcattccagatgattctacaatgcaggtttggaagcactgctttaggaatcaatggttgggcctggcgtggtggctcacacctgtaatcccagcaatttgggaggcggaggtgggcagatcacttgaggtcaggagttcaagaccagcctggccaacatgatgaaaccccatctctactgaaaatataaaaattagctgggcatggtggcgggcacctgtaatcccagctactcgggaggctgaggtatgagaatcgcttgagcctgggaggcagaggttgcagtgatccgagatcacgcagttgcactccagcctgggtgacagagcaaggctccatctcaaaaaaagaaagaaaaaaagaaccaatggtctgcaggatgtgtgtatcaacctgttgcctccatgatttacagctccccaagagctgcaaccctcatccctacctcacaccctatcccaaaagcaagccagaccctaacgacagctgagcaaatgctttgggtgtgtagcaccttcgcatgcactgtacaaactcctgtgttttctacaagtgcaagtgaaaagaaagaaacctacacccttactattcaaaattgatcaatattatctgggagcttgttagatctgcagaatcctagattccatcccagacctgctgaatcagaacccgcatttcaacaagatctccgatgattcctgcatgcattgacatctgagaaacactagtcattgtctgcccctgtgcttctgacgggactgggaagctttggaatggtgtacaagcctgcaccttcactgggaggtgctgatttagaggcttgcttggttcctttgcactgagaaagcctcttgctctgaatcaaaagacttgtctgatttgaagaatgaatctcttcggtggtgctgacaggaaaggtgactgacacagaaaggcagacagtaggaaacaatcaagacatgagcgattatttctctgtgagttctgttgccattctgaatgaatcgtttctgtaatctattgcataataaatggggctgctttcaaaaggggctgcggttgcagtgagactcacagtgtccctgtatttcacgaagctgaacgtcacgttaacccaatccaacttcattctatccaagtttttctccagagagtattccttgctggcagctgcaccaatgggctccaatctaaagagagaacacagcaacagcaacatcaacaggaggcagagaagacacatcaaaggaggaacttcaggccaggcatggtggctcatgcctgtaatcccagcactttgggaggccgaggagggaagattgcttgaggtcgggagttcgagaccagcctgggcaatatagcaaaaccccatctccactaaaaacacaaaaattagccaggtgtggtgtatgcctgtagttctagctactcaggagactgaggtgggaggatcgcctgagcctgggaggtagaggctgcagtgagctgagatcgtgatttcaccactgcactccactctggaaaacagagtaaaccctgtctcaaaaaaaaaaaaaaaaaaaaaaaaaagggaggaatttcagctcagtcttaggagaatctccaaaagcccttaatttgaccaaaaggtttactatcctgctctaagatctgccagctaccgccagtgttttgcagggtttctcacccttggcaccgttgactttttgggctgtgttatgggttaaatattgtctcctcaaaaattcatatattgaaattctaacccctaatatcttggaatgtaactctatttggagaaaggatctttaaagaggtaattaaattaaaataagtcatgagggtgggccttaatccattataattggtgaccttataagaagagattaggacacagacacacagagggaagaccatgtcaattcataggggaagacagccatctgcaagccaaggagagaggcctcagaagcaaccaaccctgcctacaacttggccttggactttaagcctccagaattatgagacaataaatttctgttgtgtaagccactcagtctgtggtatgctgtaagagcagcctgttcaacaaaaattatgagaggtcattattccggactgagctcctgcactagaccccagcagaccagaccaaaccaaaatggagtcactcacgctaaatggcatgtaatcaaactgaatctttaaggaaggagatagatcccagaacaggacagtttttcctgaaaacaggagattccagtctacctgactcagagaataaggaagttccctctgcttgaaccctcataaaaaaataacctgacattaattaatccttttttttcatattgttctgtttccttataaaacttaccattgtgctactgcccagtgggaactctcattctattttggaaaacagaggctgccctgattcacgaatcttgattaaaagccaattagactataactcaatttgttgctttgtcttttgatgagacctagcaaactcacataggctgaaataattgtcatggggagctgtaccgtaccttctagggtgttgagcagcatccctggtctctacccactagacaccagcagcagactccccagccctgccccatcttttgccagtcatgacaaccaaaaatgtctccagatatttccaagtgtcccttaagggtgggaaatggcccccagttgagaaccactgttgtaaggtcactaaaataagacctcttctttccatctttgtttatgccttatttgcccatattctgatttcttttatttttttttcccccagatggagtctcactgcgatgcccagggtggagtgcagtggcatgatcttggctcactgcaacctctgcctcccggattcaagcgattctcctgcctcagcctcgcaagcagctgggattacaggtgccctccaccacacctggctaatttttgtatttttagtagagacggggtttcaccatattggccacgctggtcttgaactcctgaccacaagtgatccgcccgcctcggcctcccaaagtgctggaattacaggcgtgagccaccatgcccggccagtattctgatttcttattcagattttgaacctctgttaatttatgtgatggctcttgctctacttcccatcccttcccttttcaaaaacacctactattttcctgatactgggtccacccgtccatggcccctctattccacagaaaggggcatagagggagagagagaagaggcaaacaaattcctttcttcttgtttccacatggagatctgggtcctaaaaccgaggtgtggcaaagaattggaaagccaagttcttggaagtggaaagagggactgttctctctgcctcagccctgtctttcattgcatccttgagtgtagaagagaccatctgatatttactcataggtcaggaaaccaacgctcagaggaagcaagtgacatgtccaaaatcacagagccagggagtcctggaactgggtattgacaccaattcctcctaatctgactcctaccctggtgtttcttcttccacccttatgatatgccttctcccttctcttacttagaaagagcaatagaactaggccaggcacggtggctcactcctgtaatcccagcactttgggaggccaaggcaggtgaatcacctgaggtcaggagttcgagaccagcctgaccaacatggtgaaaccccgtctctactaaaaatacaaaattagccaggcatggtggcgcacgcctgtaatcccagctactcaggaggctgaggcaggaaaatcgcttgaacccgggaggtgaaggttgcattgagccaagatcatgtcattgcactccagtctgggcaacaagagtaaaattccgtctcaaaaaaaaaaaaaaaaaaaagagtaacaactaatagaactgttcatatgtgttcaatcaaataggaccaattaaatagagcggagaaccctcatttagcctctagaagggaggaagattaggagcagaaaattacaaacaaggactgatcaggacctcagcagcgtggtcactgacttaaatatggcctgtgagaggtgaccaaaatgagtgtgcatatagggaataattaataaaggcaggtgccagcccagattagtatgagacaaagagtcacaaggcccagcctccagtactcactggctgtgtggctgtggccaagtcacttgacaggcctcaggtccccatatgcccctatcacaggctttggggttcaattaaataagaccaaatgctggcaccaggcctcatgaattaccctagggtatgacttagaatgcaaatgattgaacagatgagggactaatcagtctgggaattcatgaaatatatcaggagttgacctcacccaaaatgtgctggagaagctcattaactatgggctgtgatgaagctgcattaactatggtgtgggtggaatacatgcaatatcacacctccctaaatggtggtggctgagtccccagacatggaatcagttcaggtgacatgccttttctcctaatcctaactctaatcacctagctactctcccatgttacaaatggaaccaaggcgcacagaaggaaacaacttagccaagatgcttccacttctgaattggtcacagttgaacatgtgtgcatggaaagtataagaatagctgtatgtttatttgctcattcactgtctctggagaggggtttactttttcagcagtgaagggtcatggttaaggcctgcctggtaatggaagcctgcttatgttcaaatcttgattctttcctaagtgaaatgttcattctttcggttactagtgtgatcaatggctaataatctgaagtttatttcctcatctgtaaaatgagaataatattaggacggtaggacctaggacactaggtttttgtgatggataaatgtgttaaggtcgggcatggtggctcacgcctgtaatcccagtactttgggaggccaaggcagatggatcacctgaggtcaggagttcgagaccagcctgaccaacatgatgaaaccccatctctacaaaaatacaaaaattagccaggcatgatggcaggtgcctgtaatcccagccactcgggaggctgaggcagaagaatcacttgaacccaggaggcggaggttgcagtgagctgagattgcaccgctgagattgcaccattgcactccagcctgggacacagagtgagactctgtctcaaaaaataaaaaataaataaataaataaaaagggttcaggtatataaaatgctgagtgcagcataagtgttcaatagctagtgtctcttggaaacatcttactgggggaaagtgaggccctttggccaaaaaacctaagggtttttatcctaaacctgataaaaaacatttgcgtctctaggcctgctcgttaatgaggaacatagtggtggtattggagaggcatcacagtattcaggtggcagaaagattcaggagctgggaagtgccttaaattagacctgctctggtgcagtatgagtggggaattctcagcctttcatgtatcagaatcgcctggagcagtgctgtccattagaaatatagagtgagccacatatgtaattttaaagtttctcgcctgtaatcccagcactttgggaggccgaggtgggcagatcacctgaggtcaggagttcaaggccagcctggccaatgtggtgaaaccccgtctctaccaaaaatacaaaaattagccaggcatggtggcgggcacctgtaaccccagctactcgggaagctgaggcaggagaatcacttgaacctgggaggaggaggttgcagtgagccgagattgtgccattgcactctggcctgggtgacaaagtgagactccgtctccaaaataaaataagataaaataaaataaagtttctagtagccacattttaaaaatattaaaagacacaggtgaaattagttccaataatgtatttgactcaatatatccaaaatattatcatttcaatactaatcagtattaaaaattgttaggtattttgcattcttttttcttgtagtatgtcttcgaaatccagcctgtattttatacttacagcacatctaattcagactagctgcactgtaggggctcaatggccacatgtggccagtggatgctgctttggacagtgctgacctgaaggatttgttaaaatgcagactgcagggcccatctgcagaatttgattatgtgggttgggtggggcctgaaaacgtgcattctagctagttcctagctgacgctgatgcagcagatctgggtgccacactcacctaacagggtctccagtccaggcaatgcaacatctccccacccatcgccctgaaggaagtgtgaaaaagcaagtagggtcctgagaagctctgttctagaggtagcatccaaatggtaaaattctcacacacaaactccaggggaatttggagaagggaagaaagcaagagaaaagacttctttttttttcttttttttaaattaagatggagtctcacactgtcacccaggctgtagtgcaatggcgctatcttggctcactgcaacctccacctcctgggttcgagcgatcctctggccttagcttcctgagtagctgggactacaggcatgtgccaccatgcctggctagcttttgtatttttagtagaaacgggggtttcactatgttggccaggctggtcttgaactcctgacctcaagtggtccgcctgcctcggccccccagagtgctgaaattacaggcatgagccactgtgcccaggcgagaagagacttcttattggaccaggtttcacacaatcttaaagctcagagacggttgttgctttgtttgtttaaagaagaggaaaccgaggcacagaaaggctgaatggttttgcccccaatcactgagagctgggcttgaagctcaggttcaaagaacattaaaaaaaaaaaaaaccctttgaaataaaatccatgactcaattttctagtcacaacccatcagcagctctgcagctaaaaaacagaagcttcaccaatacgagttggtagctgcaggtaattaaatagccttaagccaccctacgccacaaggaaaaaaaaacaaacagcccgatatggagccaatcagatcactgtgggaacttacagatcctttgaccaaaaccttatctgaaggaggggataagcccttacttttcaacgaatttgccgaatccaaattcgagcatatttgagaggcaggtcgtttcggtgggctttatctcatagccaacaatctcactgatctgcaaagaaaagaggaaagcaaatgtttgttgtccgaggcagtgctgtccagtagaaccttctgtgatgatggagatgttctttttatctgcactgctcagcataacagccacgagtggcaggtggctgttgagcaccagagatgtggctagtgtgactgaggaatttatttttaaattaaattaaaaaaattttttgagacagtctcactctgtctcccaggcaacacagtgccatcatagctcactgctgctttgacctcccaggcccaagcaatcctcccacatcagcctccccagtagctggggccacaggcacacaccaccttgcctggctaatttttaaatttattgtagagatagggtcttgctgtgttgctcaaagtggtctcaaactcctggcctcaagcgatcctcccaccatagcctcccaaagtagtcacattacaggagtgagccgccacacccagctaattttaattagacagggtcctgctttgttgcccaggctgaagtgcagtggtgtgatcatgactcactgcagccttgacctcccaggctcaagtggtcctcctccctcgacctcctgagcagctgggaccactggcatacaacaccatgcctggctaacctttttctttttaaaaatttttttgtagagatggggtctcgctatgttttccacgctggtcttgaactcctatactcaagcaatcctcgcaccttgatctcccaaaaatgctgggattacaggtgtgagccatcatgcccagtcccttttactttgtaaaatgtggctactagaaactttaaaattattggctgggtgcagtggcttactcctgtaatcccagcactttgggaggctgaggcgggcggatcacttgaggtcaggtgttcaagaccagcctgtcaaacaggtgaaaccctgtctctactaaaaatacaaaaattagctgggcacggtggcaggtgcctgcaatcccagctacttgggaggctgaggcaaaagaacagcttgaaccgggaggtggaggcaggaatcagccgagatcgcaccactgcactccagcctgggcaacagagtgagactccatctcaaaaaaaaaaaaaaattaacacaaatggctcacgttatatttgtactagtcacagagggccagttttggcatctatcagtgcagtttctccctaagatcaaatgttaccttgttccatcttgctttttttttaacagttaaatttttattattttttaaatttttattattttttaaatttttctttttccatacttttttttttttgagagagagtctcgctctgtcacccaggctggagtgccatggcgcaatctcggctcactgcaacctctgtctcctgggtccaatgattttcctgcctcagcctcccaagtagttgggattacaggcgcatggcaccacgcccggctaatttttgtatttttagtagaaatggggtttcgccatgttggccagactgctctcgaactcctgacctcaggtgatttgtctgcctcggcctcccaaagtgttgggattacaggcgtgagccactgcacctggccagaccaggagatttttttataatgactcagaaagcacaaaagcaaggaacccagaagtagttaccgttgaaataacggtcttggaagaccaagagtgttataggcacatgatgaaaaaataaccaaaataacactaattgcaaataggacatcagaaatgcaccttagtgtagtgatccaaaaagccttttagatttgtggcttccatttcgtttgaaaccacagtagcaacccctttgctgttatctataaagtctgtgccccaaacgtaaggctctaactttttctacctacgttctgtaaatgaccagaacccccagcacagccatggccttgcttcagaagatccagcttctagacttgagtgctacagatggctcatccttcagatccccctgccagagctagcatctgtggcagtggatctcctaagttaggcatcagggcagagaatgacatccccaggcctggggctgtccccagggcggcctgtggtgtgacctacatacactgcagggaggaatgggctctgcctaggggcagtccggagagtatctaggggcctttgtcctttctgaacttgcctcttaactgctcagcccactgggcttccatttaggggctcactccttgggagccactgtcctagggctgtgctccccggccctctctcactgtggtttactgccccctactgcccgctcccttcctctgaccggaccttttttgcctttttgacttttccaggctgagtcaaacagtgtagaaaaattccaatcccctttcccaccaccaactagccatctgacaattcatctctccaagtctcagttttccaatccgtgaaatggagataataataatctccacttcaaaggcctgttttaagggtgaaatgtgagaatccaaataaagtatacaacacagtacccagcaccatagctggtactcagtacattttcaatatcatcattattattatggttagaatttttttactttatttatttatttatttatttattgagacagggtctttctctgttgcccaggctagactgcagtggcgcaatcacagctcactgcagcctcaacctcccaggctcaagtgatgctcccaccttagcttccctagcagctgggactacaggcatgtgccaccacgcccggctaatttttttgtatttcttgatggggttttgcagtgttggcccgggctggttctcagactcctgggctcaagcgatccacttgcctcggcctctcaaagtcctgggattataggcgtgagccacggcacctgactgggattttttaaatttaaattaattaattttttaaatagatgggtcacactatgttgcccaggttggcctcaagctcctggcctcaagtgatcctcctgtctcggcctcctaaagtgctgagattagtggtgtgagctacctcgcttggcctggttgggattttctgagtgcccacatacaagaatagcatcatagaggaagcaccaggtggagcagatggctttcccggccccgcggcatgttctccaaatgccatcgacaaggacactcttgatagtgccatctcatagagaaacctggcactaccagaggccacctgtcccacctaagctccctaacccccccatccccccgatgcaggtcaaagtcctagttaggctgggtccgtagagagaggcaccccgtgagcaccagctgacagcaactcctcctctgcggatccctctgctggggcgtttcaaaaccagaagtcatggccaggcactgtggctcacgcctgtaatcccagcactttaggaggccaaggcaggaggatcacttgaggccaggaatttgagaccagcctgggcaacatagtaagaccccccccatctctattttaaaaatcaattaattaaaattacaattaaaaaatatcccagccaggcacggtggctcatgcctataatcccagaactttgggaggttgaggcgggtggatcacttgaggtcaggagttcaagaccagcctggccaacatggtgaaaccccatctctactaaaaatacaaaaattagcagggcatggtggcacgtgcctgcaatcccagctactcaggagactgaggcaggagaactgcttgaatgtagtgagccgagatcatgtcactgcactccagcctgggtgacacagtgagattccacctcaaaaaaaaaaaaaaaaaaaaagaaaaacagaggtctactcagacagcctatctcttgtctatacatcaccccatcctttggttaggtctccagttcaagactttttgggaaactgaaagtagcttctccctacaaaaagaccctgactctctcatgtattaagagagtcttcctctctcttcctagggagaacaaagtgctccttgtcactgtgttgtcattgggtcctttcagagagaatttcctcagtcttatacgtggcttttttgtccccccgttacccaggctggagtgcagtgacacgatcatggctcaatgcagccttgacatccttggcccaagcaatcctcccacctcagcctcccaagttactggaccacaaatgtgcaccactacacctagctaatattaattaattaattagggagagatgggggtctcactatgttgcccaggctgggctcaaactatcctcctgcctcagcttctcaaagtgttaggattatggtcttgagccaccgtgcctggtcttgaatgtggttctgagagggggaattacaggccaagtcagagaagaatcttcccaaagaaagccattttcacttctaattccatacagagcgactcctggtaaaggatgtttcaaggccattgctagcccttggaagtgacaattattttagaaacacagtgagttttcttttttctgcttagtgttcacaccacacttatcaccctcacacttggttccttataaaaatcccagctatttttaaggagaatatttatttttctaatttgtaggcccaaagggctgaaagaggagtgcaaagttatttctgaacctgtttgacaataaaatgccacaccaaagtcatcctaagtgggaatcatctggtattattagcaacccccagggagagatgtgactttcttttttgtgtatcctaggtcaaggagcaaatcaaggtcctctcactgtattgaacatccctgttgcaccttggaggctcttggcctccaaaagcccatctgcttaggaagcaggaaggagaccctttgtggtcattggctcgaacaacactcaacgaaccacgaccaatgggggttccaaggaaagggccaacctgtccagggggcagggagttcattctcttccttcagaagtcttgccactctcatttgctatccctttgcccttaaatagagtctcctttcggaaaggagaagcttgacctagtaatgtttcctgccttcccaaggacagtcagggccaggcctgggctgcgctgcttgggggcgggcagtgattgatagaaacctgctgccagtgtcggtctttcattcctgggttgcaggaaatactgaggatgggaatgtactgcttgaacttatcgatcttgatcttcacattctctgctaagcgcctgggtgcaggcacatcagacaaggtcttgatcagtttatacgttgtcctccacatattccctatctcctccgcaatttgctcagcattcagtaagaagaggggtcctgaaatagaagagtgagggaaaggtcagaccatcatgtggatgttagtcatgcgtacctttaattccctgaacttagagctgtgcctcctgtcgtttggagattggaacacatacaggctttgaggatctgaaacctgcacttagccagtggaaccttagatatgatacaggacttttctaagcctcaacagtaactcctgtgacacaggggtaataatggataccctggaaggtgattgtggaaattcagtgagataatatacagtggctaacataatgcctggcatataatggatgtacaattagcatatcaatagctttttgttttgttttgtttttgaccagttgcaatggcttacacttgtaatcccagcatttggggaggccaaggtgggaggactgcttgagcctagcagtttgagaccagcctgggcaacatagtgagaccccatctctacaaaaaatgagaagaaaaagaaaaaagaaaaaaattgttattattggttttagaatctgctatagtagtaattaaaagtgcttcacaaaagccatgaaatattaaccatcggggaaaggtgaatggagatatgagagggaggctgaggcaggcagattgtttgaggtcaggaattcaagaccagcttgtgcaacatggttaaacctcatttccactgaaaatgcaaaaaattagccaggcatggtggcatgctctgtagtcccagctatttgggaggctggggtgggaggatcacttgagcctaggaggtggaggttgcagtgagccaggatagtgccactgccctccagcctggacaacagagtgagactctgtcaaaaaatatatgtattttaaaagcaaaaagtaacacctcattgtttaaacttactccaaaacactaatttccttccccttcctttattttgctaagaacctttagcatttgggtttcacatccagccaagacctttccatgctgctgcccctgcttggatatttcaaattggtattaactcttgctatgtgatgttgctaacttactcaaaaacacttcttcaggagtgctgaaactaaatctaacttcattaatttcacatgcttcatcaacccaacatttttgttgcgtgattaaaaatttaaattaaaaaaaagtatccttcatgcaccaggaaatattgtaggtgctgggctagaatagaaaggcacctacgcaacaagtgagtagcctgtacttgggagggtttggctgaattatcacggtgactttcccagtaggatgaataaagtaggtaaggctaacacttcattgttcccactctatagttgtaagagtgaagcacaaacagagtgacttgcctgggttatttgcaatcactcaggcaaagaggagtagtagtagcatttctattagaagcaatttccctctggttatgattatctagagacagcctgaactgacaaatttatatctacaacaagagagaagaacataaaataatccagggattttagacactgctatttgaagagcagttatggatccctttatccacatgacgtggtagcttctcacctcatagcttatggaaaggctatattctgaaattctaactctgatcttaaaggatgagacagcaggtggaaatttttgtagccctgtggatacagtcaactcagtcaagattcaaatatggaggttgcaggaaatattaataaattctagggtcctgtccagtccagaaattccagagttctaagaaacattgctgaagtcattcttcaaggttaatgatcttcagccccatgaatgtaaacaaataacttctaggcaaagaagcaatgtgaggccatgcaattaaccacgtctgcctattctaactccccactaaatgatcaaaggcagataataaagggaaaaacatgtgtctctactggaaattaaagaaggtgccatcaaaatgtgagctatagggagaaatttctgtaggatattcacagtagttttccaagtttagcaggcatcagaactgccaggagggcttgttaaaacacagatttctgggccccattcccagagtttctgagtcaggtctggagcgagggctcaagattttgcatttttaacacattctcagttaatgagaatgctgctttgtcctggaaccataccttgaaagccactgcaggggaaaagtggaagcgacactcactaggaatcccattgcagaacttgctgcttatccatggagagggatatgtctagcacagtaacagccctgccaaagctgacttttaacaaaggcagcttgatcccttgataaaatattccactcaataacagcagagtacacattcttttttattgcaaatagaacacttaccaaggtgaatcttattctgagtcataaaacaaacctcaataaattgaaaagaagtaaaatcatgcaaagtgtcttttatggccataatggaattaaattagaaataacaataaaaacataacaagaaaatctccggtgactagaaaattaaacaacacacttataaataatccataggtcctagaggagtctcaaaggaaattagaaagcactttaaattgaacaaaatttgtgagggacaactataaaggataaatttgtagcattaaaaaaggagaaatttctaaaataaatcatccaagtttctaccttaagtaactagaaaaagaagagcaagataaatcaaagctagcagaaggaaggaaatgataaaaataagaacagaaatccattgaaaacaaaaataataagaaagattattgaaacaaaaagctgtttccttggaaaactaaaattgataggcctaaaaaaaagataaacttctagcaagacaggcaaagaaaaaagaaagaagatgcaaattaccaatatcaaaaataaaagatgggatatcactaccaacctctcagacattaacagggtaataagggaatgctataaacaactcaatgtacataaattagaccatttttttttaaaatgaagccattcttcaaaaactacaaacttccaaaaacttattcaagataaactagaaaacctgaatagttttataactattgaagaaattgaatttatagataaaaaatttccaaaatataaaaacttcagaatcagatggtttcactggaaaattctgccaaacattagaagaagaaaaaaataacagcaaaacctgtataatctcatctaaaaaatagaagaaaacatttcctaacttattttaacaggtcagtgatacgctgatacaaaaaccacacagatacattacaaaaaaaaaaaaaaccctacagaccagtatctctcacagacactaaaattctcaacaaaatattaggcatggaaactgaatccagcaacacatgaaaataataatacaccatgtccaagtagggtttatcattggagtgcaaggctggtttaatatttgaaaatcaaacaatataatatacagtattaacagcctcaaaattttctgtaatttgcaacaacatggatggaactggaggacattatgctaagtgaaataagccaggcacagaaagacaaatactgtatgatctcactatttgcagaatctaaaaatgtcaatttcatagaaacagagagtagaaaggcagttaccagaggcttggatgaggcaaagggatggggaaggaaaggaaagatgttgatgaagggtacaaagtttcagttatactggagaaataaattttagtaatctattgtagtgcatggtgactgcagttaataattattgtatatttcagctgggtgaggtggctcatgcctgtaatcctagcactttgggaatcagaggcgggtggattgcttgagctcaggcgttcaagaccggcctgggcaacatggcaaaatcctgtctctaccaaaaatacaaaaaattagctgggtgtggtggtgtgcatctgtagtcccagctactcaggaggttgaggtgggaggatcacttgaacctaggaggcagagattgcagtgagccgaggttacgtcactgtggtccaacctaggtggcagagcgagaccccatctcaaataataataataataatgtcttgtatatttaaaagttcttaaagaatagattataaatgttatcatcagaaaaaaaatgataaattggtgagggtgtggatatgttaattagcttgatttaatctttctatgatgtatacatagatcagaatatcacattgaaccccataaatatacataactacttgtcaactaaaaataaataagtaaaaattggaaaaaaaaaagaaatagaaagaaaatccaccagaatcaacaaaacaaactcctggaactaataagtgattgcagcaggatcacaggacacaatattaacattaaaaagtcaatcactttccaagatagcatcaatgaacagtggaatttgaaattaaaagcatagcccaggcacagtggctcatgcctgtaatcccagcactttgggaggccaaggcaggtggatcacgaggtcaggagttcgagaccagcctgaccaacatggtgaaaccctgtctctaccaaaaatacaaaaattagccgggtgtggtggcatgtgcctataatcccaactactcaggaggctaaggcaggagaatcacttgaacccaggaggtggaggttgtagtgagccaagatcacaccattacactccagcctgggtgacagaataagactctgtctcaaaaaagaaaaaaaaaagaaattaaaagcataatactatttacattggcaccctaaaaattaaatttgtacttgggcaaaaatctaccaaaatatttgcaagatctgtatgaggaaaactacaaaaaactctgatgaaagaaatcaaagaagatataaataatggagagatattccataatcatggataggaagactcaatattgttaagatgccagttcttcccaacttgatctatagattcaacacaatcccagtaaaaatcccagcaagttattttgtggatattgacaagccgattctaaaatttacacagagaagtaaaagatccagaatagccaacacaatattgaaggggaagaataaagtcagaggactgatactagccagcttcaagagttactataaaactattgtaatcaaaaaagcgtggtattggcaaaagaaagtcacatagatcagtggaacagaatacataacccatccaaaaatagaaccacacaaatatagtcaactggtctttgataaaagagcaaaggcaatataatagagaaaagatagccttttcaacaaataaagatgaaaaaattggacatctatatacacacacaaaaaaagaatctagacacggatcttacacccttcacaaaaattaactcaaaatggatcatagacttaaatctaaaatggaaaactataaaattcctagaagataacataggagaaaatatggatgaccttggatttgagaatggctttttagttacaacacagaaggcacaacacatgggaaaaaaatgataaactaggaatgaaaagattctcccctgtaaaagatgttgtcaagagaataaaaaaggcacagtctggaagaaaatatttgcaaaaaaaaaaaaaaaaaaaaaaaaaagatctgataaatgactattatctaaatatacaaagaatttttaaaaattcaacaataggaaaacaaaaacctgaaacttaaaaataggcaaaagctctgaacaaatacctaatctaagaagatatacaagaggtgaataagcatatgaaaagatgttcaatatcattgccattaaggaactacaaattaaaaaacaatgagtggctgggtatggtggctcatgcctgtaatcccaacactttgggaggccaaggtgggaggattgcttgagcccaggaatctgaggccacctggggcaaattagtgagaccctcatctcaatttaaaaacaataacaacaacaatagccaacaacagataccactacacacctattaaaatggtcaaaactcaaaacactgacaacactaaatgctggcaaggatgtggagcaacaggaaatgtcatttatattggtggaaatacaaaacggtacagcaactctgaaagacagtttggccgtttcttacaaaactaaacatattcttatcatataatccagcaattgtgcttcatagtacttacctcaaaaagtgaaattcaaaaacatacatcatttacaatagctccaaaaaaggaaatatttatgtataaatttaacaaaacatgcataggagctgtatgctgaaacctgcaaaacactgataaaaagaagtaaaaggagaactaaataattgaagagatgtaaagtgtccattgattgaaagactcaatgtaataaagatgtgaattctttccaaatttatctatagatttaaaacatttccaacaaaatcccagcagagttttttggtatgtatagacaaactgattctcaaatttatgtggaaaaataaagggactaaaatactcaaaataaaattttaaaaagaaaaatgaagttagaagaatcacactatgtgattttaagactttctataaaaatacagttgtcaagttgatgtggtatcagtgaaaggcttgacatatagattggcagaacagaatagagtcaagacatcaacccacgaagatatggacaactgatttttgacaaagatacaattaagtggataaaaatttttttttcccaattactggaaccattggacatttatatgtaagacaatgaacttgaactaagcctcgtattttaaaaaaattaactcaaaatggaccataggtctaaatgtaaaacataaaaccacaaaaaatctagaagaaaatataggagaatatcttcatgaccagggttaggctaagagtccttagagatgataccaagagcacaatccataaaagaaaaattgatacgttggacgtcatcaaagttaaaacctttttctctgtgaaagacactataaagagaataaaaaaacaagccatggacttggagaaaatatttgtaaatcacataatctcacaaaatttataaagacctcacaaaactcaacagtaagaaatcaaacaaccaattaaacaaatgggtaaaagacttgaacagacacttcaccaaagaggatatacaaatgacaggtatgcacataaagaaatgttcaagatcattaggcattggggaaatgcaaattaaaatcataatgagacatcacaactacttatgagaatggctaaaataaaaaaatacaggccaagcacagtggctcacacctgtaatcccagcactttgggaggccgaggcaggtggatcacctgaggtcaggagtttgagatcagcctggccaacatggtgaaaccccggctctacgaaaaatgcaaaaattagccaggtgtggtggcatgctcctgtaatcccagctaaatgggaggctgaggtgggagaattgcttgaacccaggaggcggaggctgcagtgagccgagatcacaccactgtacaaagtatgacaaagtgacactccatctcaaatatatatatatatatggacaataatacccagtggctggttgatatggtttggctgtgtccccattcaaatgtcatctagaattatagttcccataatccccacatgttgtgggagggatctggtgggaggtaactgaatcatggggtcgagttttcccatgctgttctcatgatagtgaataagtctcatgagaactgatggttttataaagctcagttcccctgcacatgctctcttgcctgccgccatgtaagaagtgcctttgctcctccttcaccttccaccatggttgtgaggcctccccatccaagtggaactgtgagttcattaaacttctttttctttacaaattacccagtctcaggtatttcttcatagcagtatgaaaatggactaatacactgatgaagaggtggaacaactggaattatcacacattggtgagggatgcacaacggcacagccactgtggaaaacaaaagtttggcattttcttataaacttgcaaatatactttaaatataattcagcaatccactgctgggcatttaccctagagaaataaaaacttacattgacacaaaaacgttgacataaatatttacagcatctctatttataatagtctgagagtgaaaacagtgggtaaatggttaagctggtgtatccatagaatgggatactactcgcaataaaaggaaatgacctattgctacatccaacaactcggatgaatcttaaaggcagtgtgctgagtgaaggaagcagtcttgaaagattgcatactgtatcattccatttgtaggaggagcctcaaaaggacaaaactataggaacaatgaagagatcaatagttgccaggggttacaactggggggaggatttgaccacaaggagacagtccaaagaaatttattgagttgatgaaattgctgttttctgattgtagtgatgtttatatgaaagtcaacaactgttaaaattcatagaaatgtatgccaaaaatgtccattttaatgtatataaatttaaaaataaaatgtaaaatgtttttaaaatacaatacctatttctaataaaaacacttggtaatttataaatactgttttttttgagacagggtctcgctctgtctcccaggttggagtgcagtagtgccatcacagctgattgcagcctcaacctcccaggttcaagcgatgctcctgcctcagcctcctgagtagctgggactataggtgcacaccaccatgcccagctaactttttcattttgtttttagtagaaataaggtctcgctaagttgctcaggctggtcttaaactcctgagctcaagtaatccttctaccttggcctcccaaagtgctgggattacaggtatgagccaccatgactggctttcttgtgtttataaatactgaagcactagaaacttgctaaaggctcaaacctaagggtctctgatttttttttttttttttgagacaaggttttgctctgatgcccaagttggggtgtagtaagcagatcatagcttactgcagccttgatctcctgggctcaagcgttcctcccatcttagcttctcgagtagctgagactacacgtgcaccatcacacttggctgattttttattttttgtagagacagggttctcactatgttactgaggctggtctcgaactcctgggctcatgcaatccccctgcatcagcctctcaaagtgctgggactacaggtgtgagccactgcacccagacaaggatctctgattttgtcctctgttcttcaacaccctccacaggtgttatcattcatggctttgattgtaatctacacatcaattattccccaacataaatcccacccgccaaatctctctcctaaaatccacactgatacactcaattgctatttaatattcccatttgattgtttccaggtgcctcaaactcaatgtattcaagttgatgggtttttttttatttgtttgttttgttttgtttttttcccaacaaatctgtcacttctctttttcagtgatggtaataccaaccaaattgcctgagccagtcatctggaagttggttctttgctgttattatcctcactcatccctgaagtaagagaactaagtcttggagaagctaagtaacttttcccaaaggtcagctagtaagttctttaagcattaaaattcttacctctgaggcaataaaattcttacctttgagaggatagtaacctcttcctccctgccccttaacccatatcggatcaatcattaagtcctgttgattccaactcctcaatacctttctggaccccagatcctagagtaaaaggtagtttacaaatgtctatggcaccctggcaccctggtctttcctgaagcagcaccatcgtgaaactgccatctgttctcctaccatctgcaaatctaagtcgtgactctgggtggctgcctattgtgttttaccctggaaatagatctggctctttctccaccttccatttttattatcacatcagataattttgactgtggctgccttaatctggagtgtcagaatctgattaaaagtccagccagattcttaagtgcaaaccatatttcagaagtgactgggtggatcctccacctcatccccatctgtcccagcagagtgagatcaccacataccattcatccattcctctgacttgatgctgaactcataggctgtcgaccacagctgctcataaggtactttgttcttcagcatggcctgcagaagagggtaagtactcttctccttttccaatagctcttcctccttattgatcaactgcagggcaaaaggagatgctgtttatgggatgggttgttctcctaagccctcgaagacaccagggcaaattcctcagtgccttgaaaaccaagtggagggaaatgcttattcatctggagagtaagagaggaaactaaagcatgaactcaagcaagaatgtccctctgccacctccaaggaccttggcagctgaggtctgtctggttgaaactgtaggataatcagctacttgccctatcatctctgtttccactctatgacagccatatctccgttttcataattttcatatgtactttagctacatatatgatgttacctccttgtactgacttgcctcagaagtaagaattttaatggttattaaagaacttactagctgatctttggggacagttacttagcttctccaagacttagttctcttacttcagggataagtgaggataataacagtacctaacccaaagatgtgttacaggcattaagtgaaatattgcatatgaagctcttgaccattgctaagcacataataaatgttcaataaatgtgaacaattaccttactataatttcttctttggatgctcagtaactaataaagggaaaagtctggtgtcatgaagggatatgggaaaaggtagttgaaagtaccagtgagccaggtgtggtggctcatgcctgtaatcccagcactttgggagatgaggcaggtggatcacttggggtcaggagttcaagaccagcctggccaacatggcaaaactctctattaaaaatacaaaaaatgagctgggcatggtggcacacgcctgtaatcccagctacttggaaggctgaggcaggagaatcacttgaacccaggaggtggaggttgcagtgagatgaggtcacattactgcactccagcctgcgcaacagagtgagaccttgtctcaaaaaaaaaaaaaaaaaaaagaaaagaaaaaagaaagtaccaatgaaagaactggccaatgagttaaccaatactatccacctagtagatgctattaggaaataggaaattcacaaccaaggatcagaaccaatagaccagtacagtgtcataagtccccatctcaagatcccaaacctcaaactctgcaaacgcccgatttaggttctttgaaagctcattaagcttttcaacattgtgcttcatttcttctgtagtcatcacttcgcgcttcctaaaactttccagttctctgtggtagccctcaagtctcaactcaaattctgagcatctgaaaataaagacagcctggttacctttggactttgcattttgtgcactttcaaaacatcagcactgcttgcccatatttaagcctgcagacaatttgatcagttacctgcagatttcctcccccaatactcccaactccatctttctctctctctctcaagataaatgaagatgaaaaaataagttaaactacctataagaccacctcccagaaatcgagctgttgtgagcctgttggtggttaaacatttccagatattttcctgtacaggtaaatacgtataagatatatgtacacgtatacatactgtttattcattcagccattagacatttattattgagtgcctaatatattctataactgccctaggcatcaggaatatatttgcgaagtatgctattaagttctctaccttcatggagcttctattttaactgagggagacctagacaatagacatggatggatggatggatggatggatggatggatggatggacagatggatggatggatgaatggatggatggttggatgaatggatgaataaatccatagacaggacaaacaataaaatatttctgttagtaataaatgctctgaagaaaataaaatagggcagaatgactagcagacggaagtggagggctactgtagctacagtgaccaggagagacctttccaaagatttatcaacttcatccatattatcaacaaagcaggtctcaatgagaactgctccctttttctaatgaggtagaataatatagtgtgaagtggacagggtcttgagacaaacaagctagcttcaaattcccaccttgccacttagtagctatgtagtcttgggaaagtcacttaaactctctgtgcctcgggtagataaaacaaggatagaaaaaatgccagcttaatagttaaagtcaataagaacaacaataacaaaaaaaagctcagaattgagcctggtatacaatagtcaatacataagtgtttgctcacattcactaaaatgtaaactctataaatagttgatttttacttatttattaatttttacccagccctgttcaaggaaataaatatgtttcttgtctccttaattccttttagtgtcttcagcagttagaccatctgatacatggcaaataatcaatactcttcaaacaaataagggaacttgtcattgagatcagctatagtgacatttcataaatttggttatcctaagaatgcttaattctgttatggcagttttaaagttgcttttttcttaaacatgatttagagaattaattttcaagtggtttgagtctctctctctctctttatctctttctttctggagtgcagtggcacaatctcggctcattgtaacctctgcctcccagttttaagtgattctccagccacagcctcccaagtagctgagattataggtgcccgccaccatgcccagctaatttttgtatttttcatagagatgtggtttcaccatgttggccaggctagtctcgaactcctgacctcaggtgattcgcccaccttggcctcccaaagtgctgggattacaagcatgagccacatattccggcctccattccttttctcagctttttatttttgttttgtaataagctgtaattttagactctggtcagtgttcattttcaagaatatccttagtgtaaaaacatttcattcattcactcattaaaatggtgaacatccactataagcaaggaaccgtgttctatctgaatccttaggctttggtgaaacacaatgtcgggtgctctccctaagatgtcttcccttcttcctccagggtgccaaagtgttttcctttgcccttttatggcagagagcagcagctcacatccctgagtcatccatcgtgtaaatatcacataacttccagaaccacggaacctaccactgagttggatgaaatgatgggggagagaggcaatgcttattattcttctgttgtacatgcaattaggtgctgctaagtgccttttcacatcattaaattctttttgaagctccaaatactatactcacatagaaatctctgatgaaagcagttttgaattcctcccagagggcaactgcatgtaagctcagtgattaccttaaaatattactattattattgtttctaatttcttataattgctaagtacattatagtttccaaagtactttcatgtccccacaacacacacacatacaaacaactgctccttgacttacaatggggttacatccctataaacctattgcaatttgaaaatactggaaattgaaaattcatttaatacacctaacctactgaacatcagagcttagcctagcctatcttaaatgcactcagaacactcacattagtccacagttatcatctaagacaaagcctgttttataataaagtgttgactatcccatgtaacttattgtataccgtactgaaagtgaaaaacataatggttgtatgggtactcaacatatcactttcacaccatcagaaagtcaaagaatcgtaagttgaaccatcgtaagtcagtgactagctgtgtgtatgtgtgtgtgtatatatgtaaattccatacatatttcatataaataaattcctatatatatatcccaatatattatattccatagaataatacaatcattagcaaatagtaggcactcatgaaattaggttgaataagagttgtatttgtgggaccatttagagtgtaaggggaggattctggcaggaaatagaattcactcccatgttcaaagaaagatactttaaggattacttgcaggggtgagatatggataggattaaaggaacaaatagcagacagtgaggcacccagagactagcatcagagggaagccattaggacccccaggctggggacaatggaaactggaaccatggaggaggaggcattgacatcagagggatgcagctactgcctctgagccccagggccaggcagggagggagaggaggaaaagcttgctagctactctcccacctcctgcagggctctgtggacagggcccagcccggatccaacagacaagagaatccaacactgcagattgggcatcaccttccaggtgcagagccggagggtggggtaggaacagcaaatggagaataatcggcatggaaccccaaaaccattaatgtggactgggaaaataaagccagatttcttgcagaggaagcaagattgttttctcatgagatggatggatgcatgaatatggcttaatccatctcacaggctgttctcaggattaatgcaacatgatggacataaggatttaaaggttcaccgaagagaggggtgagcccagggctgccctgctgagcctcttctagagccgccctctgctggcccctgctgttaagagctggggaaccagcggatgagatcaagctgagagtcacccctcagaaggagacaaggacactctactcctctcgtcataaatgacaattgttcccattcctcacagagccacccctcactcctcctaacttcaacagcatttactgtctctaattggtcttggagtaatattctaaaatcatgcatgcaaaattgatgccttggaagttgagaagcgtttttctccccacagaggtccctgttcaaagggagaaggaagctgatagttttgggattcctaccacgtgctgtttaccacctaagcacaatctcagatcatctcatttcatccttcagcaccatgagagagggtctgattctatcccgttctccagatgaggggcacagagtctcaaaaagatgagccttctgtttatttatctaacaaaaaaagtgattttgccacccaagttgtaagtttacttatataacaaacctgcacatgtactcctgaacctaaaataaaagttaaaatatattaaaaagcaaataaagaaattgctgggggaaaatgattttactttcctggttagacataaaaaagtggtagatatatagagtggatactactcagccataaaaagaatgaattaatggcatttgcagcatcctggatggattgaagactattattctttttttttttttttttgagacagaatctcgctctgtcaccaggctggtttcagcatgttggtcaggatggtctcaatctcttgacctcatgatctgcctgcctcggcctcccaaagtgctgagattacaggcatgagccactatgcccggccaggagactattattctaggtgaagtaactcaggaatggaaaaccaaacatcgtatattctcactcataagtgggagctaagctatgaggatgcaaaggcataagaatgatacaatggactttggggactccagggaaagggtaggaggggggtgagggatacaagactacaaattgggttcagtgtgtactgctcaggtgatgggtgcaccaaaatctcagaaatcaccactacttactcatgtaaccaaataccacctgttcccccaaaaacctatggaaaaaaaatcagttccatagaaaagggtgtagagggtgtgtgtgtgggggggggcagggtgggggagttgggaggtatatgggaattctttgtactttctgctcaattttgctgtgaatctgaaactgctctaaaacatagtctattaatttaaacacaaatcaattccttccatcaggctaagttctgggctccagggccagtatccatccaggtggaggcaggaaaatacacacacactcacaaacacacacacacaaatgttttgcactccctggggagcacacttaggccacattttccaggtagcaactacatgggttgacccttcagccaaaactctcccatttggtgtagaaatccctgcttttatctattcttgtcctttcttgtaagtatttgcaggaactatggcagctcaagttgggagtgggagtttcttatgtgaaggggacagggtaattgatatgaatctgcaggtcataatcaaaacgtgaacctggagtgggtgtgtgtgtgtgtaaaaccatgtccatggcactggcccacttcacttgacattattggatttgtcagtatgtctatattttctatgtcgctggattaaaatctttatttagcagccaaacacacatagatgtctagaacagagcatagcacatcatgaaaatccgcaataaataccaactgaattgacaaataatgaatgaataagtgattacagccacattagctctgaataagaccagctgcaaaataggcaatttctcagcccccctgccatgcctttattatcttgatatcttgatatcttacagatctgtggtctccaatgtaaggctgacaatttcactattattattggggaggccgttataacatgccactagttttgcgtttttctctctgcaccaccaaattccaattattcaaggcaggaagggaagacattagcagaggttattacagtgaagcagtcttaaagaaaacatccctcagtgggaaaccaaaggaaatgccttctccaccaattgttttcagacttcgcccacacgttgccatggagtgagctgggggatggcttagacagaaccaggaacctgcagcatgggtgaagaagtcaggtctcatttccaagacaatcccagactctcccggtaccttttaatcagatccatttctgcctgatccctcttgtgaaggagcaagttccggctgttgtcaaagatatcttcaatctggtctggccagaggaacagagtgctgttcaatttgatgtcctcatctgcaaaacacatactgcctgctccaggacactgtttagcataggtcgggtcagcatgtggcgaattaattagacagaacaagaggtcaacaggagtggtgtgggggtggcaatgaacacatggatgagtgacagtgacatttgttgagcacttactaagggccaggctagaaggtagatgatattatcatccttgtttgcacagatggcaaacacagccattgagcctagtggtcaaggttacactgctagaaggcatcagagaggaattcaaatccaggtctaattccaaagcctgtgttctaacctctctgcttgattgccttcctaggctaggtctgagtcaagtcagaaacccagattgatgctctcgttccacagttcaaactatttcacttcatctgcatgtcggtttccctttaggttaaatggcagtcatggtatcaaagccaaatgccctacccattttatgactctggtgaattaaaatgtccaccctgggtttcctttgtgaatttcgggaggcagagcccacagtgagagtccacggtgtatccaggggtcgagggcacagctcgtgaacatgcaggtggatggttagggaaccacttttcactcccagtccccatctctccctcccatcaacctccccctgacatccatacattgtgaacaccaagtaattcacaggtattttcagatagaaaatggcttgttgagaggttattaacttttccttcagaatctgcttctcactttaaaactctaacttgacccaacaaactttcaaggagccctgactatttttttccttttacaatacacaggagcatgaagaaaagtgtctcggcctcttcaaaagtgggattgatgaagattacagatgggcggccaggggctgtggctcacgcctataatcccagtacattgggaggtcgaggcaggcagatcacttgaggccaggagttcaagactagcctggccaacatggagaaactctgtctctactaaaaatacaaaaattagttgggcgtggtggcacgtgcctgtaattccagctactcaggaggctgaggcatgagaattgatggaccctgagaggcagaggttgcagtgagccgagggtggcactgcactacagcctggatgacagagcaagactctgtctcgacaaaaaaaataaataaataaaagattacaggtaagtaaaatctactcatttaaaaaaatgattctgcatttggaagtgacttttccaggaacaccagacacagatgccaagacagggatctaagaactggaggtcggccaggccccatggctcacgcctgtaatcccagcacttgggaggctgaggcgggcggatcatgaggtcaagagatagagaccatcctggccaacatggtaaaaccccgtctctactaaaaatacaaaaattagctgggcatggtggcacgtgcctgtagtcccagctacttgggaggctgaggcaggagaattgcttgaacccaggaggcggaagttacagtgagcctagattacaccacagcactccaacctgatgacagagcgagactccatctaaaaaaaaaaaaaaaaaaaaaagaactggaggtcaagtgtctatctatgtctcctttgtgtctaacaagattccttttgtgtgattcaaattactgtggatatgagtataaaattcgtgcctctaacatatgggggcacttgaaaggcagctcttttatatttagtggtagaattcatataactatccttttgctcaacactttacccctaaatatataaatacatatagactatttgaaatgttatatatacaaatataaaatatacatataggtatgcatttcgatggtcacacatggcattggacttacacggcaagtctgcatagtccatcaggaactccagccgttcacttgcatctctaagttgcctcctgagtttgaacacagtgacagcactggatttctttaggaattcaatgagggataccagctccttagtgttggcaggaacctcactgactttgtctgcgatgtggctgtactgattacaaatgctacagaaaagaaacagccattgttatcatcatcatcatcaccatcatcaccatctaaaatgactttcttgtaagactccatgttcaaaatacataattcctatttgaaaaaaaaagaaaatttttttttaattttttccctgcctgcaaatccttgatggataatattcacatgcacactaaactccaggaataatagcagttgtaatgataataatacctgttatgtattaagccattatgaagtagcacaccccattctaatcatttacatagattaactcatttaatcctcacaacaattctaagaggtagatactactattatctatactttataatggaagaaagtgaccctgagtaacattatcgaaagcaacatggtatgtgggtgtcagagccaagatctgaacctgggttaattgactccaaagctcatactcttaacaaatacaccatactacctctcatacacagaacctagatttagaccaaaacaccaccaccaccaccagcaattcatcacattttgtgttgaaatagagcactaaattaatttttaatctttttttttttttttttttttgagacagagtcttgctctgtcacccaggctggattacagtggtgtgatagctcactgcaacctctgcttcccgggctcaagcaattctcctgcctcagcctcccgagtagctgggattacaggtgcctgccaccatacccggctaatttttgtattttaagtagagatggggttttgccatgttggccaggctggtcttgaactcctgacctcaggtgatctgcctgccttggcctcctaaagtgctgggattacaggcatgagccaccgcacccagccttaatcattgcttttaacagaacaacagtaagtttatcctcatgggctacaggtaatccctcttggcagagaaaatgttccattactgggactaccaggtctaactggccacttttcaaacataagactgaaaaatgatgttattatacagataatttgaatatgctctaatttatgcaaaagcaaatgactgacggtcttggcatcttaactacaattagaagcaaatcatccgcaatacgtccactcctagcacagagtggccctcaacaaatgttagcaatgataccatagttttgttattattacttgatcgtgacatgtttttttttttcttttttgagatggagtcttgctctgtcacccaggctggtgcacagtggtgtgatctcagcttacggcaacctccgcctcctcccaggttcaagcaattctctgcctcagcctccctagtagctgggattacaggcaccgcccccacccaccaccacacccggctaatttttgtatttttagtagagatggggtttcaccatcttgaccaggctggtcttgaactcctgacctcatgatccacccgcctcggcctcccaaagtgctgggattacaggcgtaagccactgcgcccagccctgttgatgttatttttaaggcagacagaaacttcagaagtcagccaccaacctggagttcagctgccaacctggggtgtctgcattcttagatattcctgggttcagaatgaggctcttattttcacttatattaaaaagacctaaggacattatacatttatttggataaggatgaatgcactgatcaactaaggcaccatgttgctttgatttgacaggaacaaatggatgattgcttaagggaaaaaaatgcatggctcaaactttccaaagaaagtctccaagtaggccgggtgtggtggctcacgcctgtaatcccagcagtttgggaagctgaagtgggagtattgcttgagccagggagtttgagaccagcctgggcaaatggcaaaactccatcactacaaaaaatgcaaaaattagccaggtgtattggtgagcatctgtagacccagctacttcgggggctgaggcaggaggatgacatgagcccaggaggtcgaggctgcagtaagctttgatcatgccactgcactccagtctgggcaacagagtaagaccctgtctcaattttttaaaaagtgtccgagtagtgtgaaggctgaaaaccttttgctgtcctcgtcccaaacccatatcctataggcaaagaagctgaagatacaggctgggtgcggtggctcacccctgtaatcttagcactttgggaggccaaggcaggcagatcacctgagatcaggagtttgagactaggctgaccagcatggtgaaaccctgtctctactaaaaatacaaaacattagccgggtgtggtggcacacacctgtaatcccagctactcaggaggctgaggctggtgaatcacttgaatctgggaggcggaggttgcagtgagccaagatcatgccactgcactccagcctgaacaacagagcgagactctgtctcaaaaaaaaaaaaaaaagaaagaaagaaaagaaaaagaaaaagagaaactgaagatccaagagacaaggccagctattctggctccaaaaccaagaatctgacctcttcatcaatgaatgagaaagctgcttgcacatggactttgaggtcaaaatgggttaattcccagatatgccactgcctaacctgtcagagtctcagtgtcttcatcaacacgatggggaaaataatgaacaacctcttagggctgttgtgagttcctgattagatctattctgtgcagggtacttatatggtgcctagattataccatgtgctgggaagatggtcactagtattattattaatttgctgatgattttctgatatgtattttgtaaaacttatagtactataaaatgctaaaattacacatatatgaataatacagtatacaatataatattaatagcggtgattattactaaatcattttattttacatttatttattctgaggtagggtcttgctctgtggcccaggctggagtgcagcgcctcaatcataactcactgcagccttgacctcctgagctcaagtgatactcctgcctcaacttgcatacctctctcttttttttttttctttttttttgagacagagtcttattctgatgcacaggctggagtgcagtggtgtgaacatggttcattgcagcctcgacttctggggctcaagtgatcctctcgcctcagcctcttgagtagctgggaccacaggcacatgccactatgcctggctaatttcttaatttttatttttgtagagatggtatcttcccatgttgcccaggctggtcttgaactcctgggctcaagcaatcctcctgcctccacctcccaaagtaaacccaatctcatgttgggactatagacgtcagccatggcacctggccactaaatcattttagtctatagtttaaagtgctttgaggaagagagctaggataacatggaataaccattttctaaccttcaaatagagacacagtagaaggcagttgccatctcagccaagcatccattacctctttctgtaacaacacctatgtattatcggggacccccacccctttcagctcatgtggtttaggtggtgttgacacccatcccagagatgggaacacccagccagatctaagccatcctcttggccagtgtttgattcaatgttgtacaaacgacctaagtcaggccaacctcacatgggccaggacttttccaaggatgatagaaaaagaaattttttgcctcctctggataggaatccgggaggatgtaagcctggagctgcagaagcccataaactggagagaacctgttagagaatggagccaacgtggaggaaagccaagcagagagagaggaattgcatcctaattgcagcattgagggcctgaagctagaaaccctaaacttttcaacatgtgagccacaaattccctttttaacccaagctagtctgtttgagcttctatccattataaccaaaaacatcttgtctaacacgtagttgtcagtaaaataaaggcataatatagagtttaagattgaacaatggaaccaaacatggtggctcacacctgtagtcccaacagacttaggaggttgaggcagggggatcacttgagcctgggaggtcgaggctgccatgagctatgatcgcgccactactgcactccagcctaggggacagaacaagaccatgtgtctaaaaaagagaaagaaaaatgatatgcaaatagaggcaggaggattgcttgaatctaggaatttgaggctaccgtgcactgtgactgtacctgtgaataaccactacaatccagcttggacaacatagcaagaccctgtctctgaaaacaattagaaaattcgccagccatgatggtggatgcctatagtcctagctactcaggtggctgaggcaagaggattgcttgagcccaggagttcgaggctacaatgagctatgatcaggccactgcactccagatagagtgaaacctccttttgaaaaagaaaaagattgaacaacagaattcccggacctatacagcagaattctgcctaggagtgattctaaggaaaatgcgcctgtaagcactttgtgtttcaaaatatgtgctagatgaacagtgagaagggcctgtgacctcagacagacaagcccaggaagcagtttgcattctcctgaatttgcctgcaagaagacaaaagcttcaggatcagagacaaactgctaacaaatgccctccacccgcctactccaacccccatgtcgctttctcttgactgttcacctcctagcctgaacctgaattcctcactacccttacttaggggcagaaaaaacttgatctagaaaataatctgttcattgctggaaggtgcaagttctggtcactttttcgtctccagttggtgccaaataccattgctatttgtctgcacagaattacaatacctggtattggtgtctcggtttacatccacttggaattgaatcagatggtctttaagattttgagctcgctcacagagatcatgatttagggccgtagcatcaaggcagaacatggctaaaggcacggtgatgttcatggatgcaatttcatttctccgtttctttatggcattgatcttctgcagaaaggagcacattcagtagcttgatttgcccttgagcctctcccacttgcccccagcctaacccctggccaaccctagtccaatgctgagcatggtctatgcaccaaagagacactaactgctcattggattgtctgcagcacatgtcaccaaggtataaaatctcaagtggcatttcctaccgtcacaaaatcatcaatgtcatgattttctttcaggaacgcagcgatgttttgctctgccgtgttatccaataagtcaacatactttttgtagacatttaaatatcttccatattgaagggtgtgaaatcaaacacacaaatataagtcaaccaaatcagatgagtcagagtggcaaatgaagacatagtagcattttaaaaaatgtagcccaagccaggaaagagaactataatgtggcaaaagtttcattaaacagagaactcagaattttggctctgattttcagtttcaccacttcctagcagtgtaaacttagacaagatatttcagtttttcaaggatgggtgttgtattagtccattttcatactgctgatagagacatactcgagactgggaagaaaaagaggtttaattggacttacagttccacatggctggggaggcctcagatcatggtgggaggcaaaagacacgtcttacatggcagtggcaagagaaaatgaggaagaagcaaaagtggaaacccctgataaaccatcagatctcattagacttattcactatcatgagaatagcacaggacaaaacagcccccatggttcaatgacctccccctgcgtctttcccacaacacgtgggaattctaggagatacaattcaaattgagatttggtggggacacagccaaaccatatcattctctccctggcccctccaaatctcatgtcctcaaatttaaaaccaaccacacattcccatgctgcccaagaccatgggaacccacctcttgcatcaatataacctggatgtgagacctggagtcaaaggagatcattttggagctttaaagtttgactgtcccactggattttggacttgcatgggccctgtacccctttgttttagccaatttctcccatttggaatggctgtatttacccaatacctgtacccccattgtatctaggaagtaactaacttgcttttgattttacaggctcataggcagaagggacttgccttgtctcagatgagactttgcactgtggacttttgggttggtgctaaaatgagttgagattttgggggactaatgggaaggcatggtttgatttgaaatgtgaggacatgagatttggaggggccaggggcaaaatgatatggtttggctgtgtctccaccaaatctcaacttgaattgtatctcccagaattcccacttgttgtgggagggacccagggggaggtagttgaatcatagggctggttttttcccatgttattctcatggtagtgaataagtctggtgagatctgatgggtttaccaggggtttctgcttttgcttcttcctcattatctcttctggcaacacctacacaaacatacccaggattaatactttgtatccctcaatccaatcaagttgacactcagtattaaccatcacagttgtctttaattttattttattttattttttgagatagactctcactgtaacccaggctggagtgcagtgctgtgatctcagctcactgcaatctcctcctcccagcttcaagtgattctcttgcctcagcctctggagtagctgggattagaggcatgtgccaccacacccaactaattttggtatttttaatagagacagaattttgtcatgttggccaggctgctctcaaattcctggcctcaagtcatttgcccaccttggcctcccaaagtgctaggattacaggcatgcatcaccaggccgggcccaatgtctttaattttaagtggaaatgatcattaacacctcataggattattgtaatgcttaactgtaataaagcacacacaaatgaattaatgctgtgcctgacatacaatgaatgtgctacaaatattacgatagtccctccttacccttggggatatgttccaagacccccagtgaatgcctgaaaccgcagatagtactgaaccctttatatactgttttttcctatacacatatatgtatttatgataaagtttaatttataaattaggcacagcaaaagattaacaataactgaaaataaaatggaacatataacaatataatgtaaaaataaaagttatatgaatgtggtccctttctctgtttttctcaaaatagcttgatattttccaaccttagttgacctcgggtagctgtaactgcagaaagcaaaaccgcagacaaaggggacgcctgtgattcctatcccttcttcaagtcccaaaattctaagcctaaatcttaagatgaaaatctaggactaattaacctaaaatctattaaataaaatcaaaattttctctgcctgtaatcaaatgacacaaaaatggctggacagtttccccaaaattggaggatgtgtttgggatggtctggtttaaaataagtttgaattaaaataaagatgatagtgagtaagcagaattaactttgtgggactcagtggcatgcttccaagaggtgatcaacactttagagactctgaaactgagatgcaatgagaaatccgtggaactgtcaatccagaaagacaaacaaccccatcaaaaagtgggcgaaggatatgaacagacacttctcaaaagacatttatgcagccaaaagacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacacttttacactgttggtgggactgtaaactagttcaaccattgtggaagacagtgtggtgattcctcaaggatctagaactagaaataccatttaacccagttgatcccattactgggtatatacccaaaggattataaatcatgccgctataaagacacatgcacacgtatgtttattgtggcactattcacaatagcaaagacttggaacaaacccaaatgtccatcaatgatagactggattaagaaaatgtggcacatatacaccatggaatactatacagccataaaaaaggatgagttcatgtcctttgtagggacatggatgaagctggaaaccatcattctcagcaaactatcacaggcacaaaaaactgaacaccacatgttctcactcatagatgggaattgaacaatgagaacacttggacacaggaaggggaacatcacacaccggggcctgtcatggggttgggggatcggggagggatagcattaggagatatacctaatgtaaatgacgagttaatgggtgcagcacaccaacatgacacatgtatacatatgtaacaaacctgcacgttgtgcacatgtaacctagagcttaaagtgtaaaaaaaaaaaaaaaagtagaaagaaagacaaaacgtgccaggcaaggtggctcacacctgtaatcccagcactttgggaggccgaggtgagtggatcacctaaggtcaggagtttgaaaccagcctggccaacatggtgaaaccttgtgtctactaaaaatataaaaatcggctgggcgtggtggcacatgcctgtagtcccaactacttgggaggctgaggcaggagaattgcctgaacccaggagatggaggttgcagtgagctgagatcatgccactatactccagcctgggtgacagagcgagatgccatctcaaaaaataataaaataaataaaataaaataaaataaaataaaaataaaataaaataaataaaataaaataaaataaaataactgtgtgtctaagagtccatgaatagggaaaacagaggtttcaaatagaatctcccaaatcaaattcacgagggcagggcttccaaatatgaggccatgattttttgactaggttagcagttgttctcaactggtggggacttttggccacacctgaagacattcttggctgtcacaaccaggggattcctgccggcatgcataattcctacaaggattctgctaaacagcccaccacgcacaggacagcccccacaatataattttccagtcaaaaatgtcagtagagctgcagtccaaaaactctgggttagcgtgaccatatctcttggtttgcctgggacagtccaggtttatacctgttgtcccatggtaattgttaacaacactcttttcactcgtaaattgtctcactttggaagctatttacaggatcaccctaaactagtgtgatatggtttggctgtgtccccacccaaatttcatcttgaattgtggttcccataatccccacgtgttgtgggaaggactcggtgggaggtaatttaatcatgagagcggttaccctcatgctgttctcgtgacagtgagttctcacgagatctgatggtttataagaggcttttccctcccccttttgctcagcacttcctcttcctgctgccacgagaagaaggatgtgtttgcttccccttttgccacgaccgaccgaccataagtttcctgaggccaccccagacctgcagaattgtgagtcaattaagcctctttcttttgtaaattactcagtctcaagcatgtcttcattagcagcgtgagaacggactatacatagtgactgctcacgtgtgcagctgtgagatgttttacagtgtgatgattaaaggacatggcctgtgggttcagataactgattctcgatccccaaatccaaaaagttctgaaaacagacagttgcctcaaaattcacttggtagcaaaagttggcctgaacagatatgaggctattatgtgaatatttataggtttccctgcagaaatatcaacatgttgccccagacctcacagaaactgcaggataatatatgatatacgcattatgttacttttatataacccagaaattttgaagtgccaaaacccatctggcttcacaactatcagataatggaggtggatctgtaattgaatttgaatcctggctctactaactatttgctatgtaacactgggacagttagagtttcctcatttgtaaagtgggaataaatagtaatactcatgtaagtattggctattcttactatgtatgtgttcaggtgtttgggaacaggaataccttattggatgagagttaagaacaccaaatcaatcccaaaaagctacatagctaataaatttataactcaacttacttgcaggggccaacttgatttttctgaaataccttgaaagtttgaatcaaaaaatcagaaacaagtttttcttctgcgttaacagttccaaggagcagattatatcctttcagctctgggaacaggacagattccacctgaagagtaaacaccacttttgcatgttgcaagacttaagaagggagatggtacccaaatgcaaagccttctctaatgcactcatttccagggctgccagctgcatttttactctatttcctcttagatagtgctggaatcaccctgctgtttcctctacctctgttctctctcctttccttcttgcctggattactcatctttcaaatccctgacctttcaagggtcttgtcctttgagagtcccccttgtcctgctcaccgccccacaacgctccagtggatgttggtttccctgtttcaggctcaccttctgaacttttcctgcttagcactcatcacaattgcaattagatgaatgtgtaatgagatgttctaggtgtgtcatagaatacaaattccatgaaggtctggatcatatttgacttcttcactgttatatccccagggcctagcaaaagcttggcacttggtaagtgctcaaaaaatactgggtgagtcaatgaatactatcgtagtgctcccctcctcccctactacccagttttcctctctaatgaaaattctggagacgtggattctaattctgaatctgccactgagggacaatgtgaccttaggtaaactacttctctcgtgggtttttttttgttttgttttgtttttttgagacagtctcactctatggcccaggctggagtgcagtggcacgatctgggctcattgctacctctgcctcctgggctcaagcgattctcctgcctcagcctcccgagtagctgggattacaggcatgcaccaccatacccagctaatttttgtatttttagtagagacagagcttcaccatgttggccaggcttgtctcaaacctcaagcaatccacctgcctcagcctcacaaagtgctgggattacaggcatgaggcaccacatctggcctaaactacttctctgaatccccattttctcatctgtaaaaaagaagagatgtactagattctcctctaagcccagagaaaacaaacgatggctttatgatcatgaggcactgaaagtatcttctgagagaattcatactctctaacttctttttatttatttatttttttaaagagatggtctcactctgtcacccaggctggagtgcagtggcaccatcatagctcctatgctatgtgactcctcagctcaagcagtcttcctacctcagcctcctgagtagctggagctacaggtgcctgcgaccatgcctaattttcttatttttatttatatttttgtacagacaggggctctctctatgttgcccaggttggtcttgaactggtggtctggcttcacaactttcagaaaatggaggtggacctgtaattgtatatgaaccctggccctcggctcagcctccaaaagtattgagattgcaggcttgagtctccacgtctagtcactctaactccctcatggcacgtgtgtgtctctgagaatgttctcacttgcatggctcatgcaggctgcaaagttcctgcctgggacccattgtcttccattgtcctctctgctaagaaagattttagtggctggtctcagaaaaggtcttcagagtgtttcagtgagttacatgggttatatgcctttgatggaaatgcatcaatttagaaagggggaaaatcaagtgcaaatgatctgtgtcttgtttggccaatccagaggttttgaaaccagtggaggagcaacttctttgctgcagccatactacagacagctgccaaaggcaacgagatggagggactggcactggtcaatgcgtgaatgaaatggtttagggcagcacaattggtgcccccaggccatgtgacagatcacaagtgggcaggataatggatcgtctcatgggaagaagtcttcaaacttaagaggatgaaatacctcttgctgctctttcaatgtggtggattctcttatgccctgtagagcagtctgtgaaatggagtcaagaacaatcgcattcggccgggtgtggtggctcatacctataatccccacactttgggaggcagaggcaggcagatcgcttgagctcacgagttcaagaccagcctgggcaacgtggcggaaccctgtctctacaaaatacaaaaataagccgggcatggtggtgcacacctgttatcccagctacttgggaggctgagatgggaggatggcttgagcctgggaggtagaggttgcctcccgggctcaagcagaaaaaaaaaaattcttttttttttttgagatggagtttcactcttgttgcccaggctggagtgcaatggcgcaatctaggctcactgtaacctccgcctcctgggttcaagtgattctcctgcctcagcctcccgagtagctgggactacaggcacccgccaccacacccggctaattttttgtatttttagtagagacggggtttcaccatgttggctaggctggtattgaactcctgacctcagatgatccagccatctcggctaattttttgtatttttagtagagacggggtttcaccatgttggccaggctggtattgaacgcctgacctcaggtgatccagccatcttggcctaccaaagtgctgggattacaggtgtgagccactgtgcctagcccctttaataattatttctcacaaatatgctttcctgctttctttctgtgtcttgaataatgctatttactctattttctattttcaaaagtctcttgttagcttttccctaccaacttttttttttttttttttgacagagtctcactctgttgcccaggctggagtgcaatggtgcaatcatagctcactgcacccttgaacttctgggctcaagcgatcctcctgcctcagcctcctgagtagctaggactacagacgtgtgccaccaccccagctaatttaattttgtagagatgaggtcttgctatattgcccaggctgatattgaactcctggcctcaagcaatcttcctgcttctcgacctcccaaagctctaaaattataggtgtgagccaccatgattgaccttaactaacttttaaaattctttttaaaccatatatacggcagatcttgcagtgagtgaaggtaacacccaccagttgccattcttaaagatttttcttagtcaacctgcaggactatgtttttaagtcttcactaaccagttcagagataaaacagtctgaggggcttaaggaggaagctagggctgtgggtgtcactagatggggaactcagtctacgttgtttttccttattgtctcgtaaagtcattggtattcacataggccttgttttcaaacctggtacaaaccatgtcttcttggcattgtaattcatcaaatgtagtaccggccctggtacctgccattgcagtggcagccgcgtgcatgctgggctctcctggctcagctgctttcacacattgccgatcagcagcagcagcagtgaaggagaacttaagtggtatgtatttcagctgtccccatacatagtcatccaaattacagggtcttttcttccatttccttcctagggatactggttgtaggagagctgcccagtgtttcttctcctcccacacacccagttttaatggagtacttagaaccctgtaagtaccagattgcaaagagaagaatgcttgggcctccttgcactgcaaccttgaactcctgggcattcgtttcacatgagcaaggcccatgtgaagcatacataatgcatggagagagtgagaaggtggaagggtgagggagctagccagcaagaccccacagatcccttccctatatggaactggacaatggccctttggtcataccaaccaatcagagggagtgaggaaaagatggagctaaaaggagttacatccatgtgcatgatcctgtctagtaataaaagtttgttaataagtgtctggaatttaattagtaactctaccctggaaagcaaactggaaagggcgtgggccaggaaaggaatggttattctctctagaagcctacagtggctaaaacataacaaaccaacaaacaaataagcacacagaagagtgaaacttcaaactgaaattgaaaaaaagttcttggcaagttaatggcaattgattcatgatggattattaacccacagatatggcttgggacctatctgattcattgaggttgacatcatggaggacactatactctctcacaaagtaggtctttttttttttttcttttttctttttttttttttggagatggagtctcgctctgtcgcccaggcaggagtgcggtgacgccatctcagctcactgaaacctctgcctcccgggttcaagtgattctcctacaaagcagctcttcgtgctcttgttagaagcacaattctgggctgcgtgaatatttctttatggtctaaatcatttgtctggggtcaaggggttatattcaggatatatctccaaagtgaagctcccttaactgaatatcccagcgacctgacttgtacaacctctttcaatacattttattcactaagtgaaaaaatcatgcaaatgaatgattaagtgactactataccttggggatcccattagagttcttaataatttccaggaaagagtcacgtattaattcccagcagccatcaaaagatggattgaagacaataatgggttcactgacttcaagtttgatcatgattagctgaggtatgaaaaacttcatctcttggtagggctccttaaaatcattcccatccttcaggagacataaggtagggcaagcgttacaaaattgggccttccaaaatcaagggagtgaattttatacattcatagaactacatgaggaccagaaaaggcaatgaagggcatcatacactgtttatatttaaaatatgggctggggctgggcaccgtggctcacacctgtaatcccagcactttgggaggccgagacaggtggatcacctgaggtcaggagttcaagatcagcctggccaacatggtggaaccccgtctctactaaaaaacacaaaaaactagccaggcatggtgatgggtgcttgtaatcctagctacttgagaggctgaggcagtagaatcacttgaacccaggaggcagaggttgcagtgagatcacgccgttacactacagcctgggcaacaagagtgaaactccatctcaaaaaaataaaaaacaaataaaatatgtattgggtatagcttagcccaccctgactccatgcactctccctttcccaaagcctttattcccttttgtttatgcggcttggtaattcctgcacccaatatctagatccttcccatccttcaaaattcagctaaaacatttcttcctttgggaagcctccctgtttctcagctggatataatctcctcccacttctgaacttgtgtatttctacttcctctgttttttttttaatttattttatttgtgtccttagagatgaggtctcactatgttgcccaggctggtcttaaactcctgagctcaagtgatcctcctgcctcagcctcccaaagtgctgggattacaggtatgagacactaggcccagcctagtatttttttctttctctctggtaggaatttatatgcgtatctcaacttgtctattctaaagttgagggcaggatctatgtctgatcacctctctcctccaaaatacctgagacagcatatagtacctaacaggtgctcaataaaaatttattgattcagtccaaaagtattaatcataatccatataaccccaaatggagttgctaatgagcatagtttattttagacactcaaaatgtcaaccttgctacaacagaaatattgacatagagctatttccaattccctacaaaagctctaacccaggatgccctcataaactacagcgcctaatgaaattgtcagaaggcagctgtaaagtacttcttacatagagatttctagatccatttaaagatgactgatgatatttggtgaatacctactgtatatcaaatacctataaattcccccctattttccagacacaggaagattttacatttccctttgtgtggaattttagagtgagattggcttccacccctgggtttcttatgcttagcaaagtagacaatcacaatgacatttatagattggtcttctttagagagctaacattgcaattcagccccactggtttctatatttttgagcaaaagaccaattgttaatctttattacttcatttggaaaacttaaccttttataaccaggtaatttttaatttttgttactttgttaaggtaaaatgtgcacacggcataaaattcaaaagaatattcatcgatttttaggctatccaaattcagggaatgctatggtgctttgaaaactaggacttagtgttttcagttttctctctttttttttttagacagagtctcgctctgtcacccaggctggagccaggcagtggcgtgatctcggctcactgcaacctctgcctcctgggttcaagtgattctcctgcctcagtctcctgagtagctgggactacaggcacacaccaccacacccggctaatttttgtatttttagtagagatagggtttcaccagtcgaccaggctggtctcaaactcctgacctcaggtgatctgcctgcctcggtctcccaaagttctgggattacaggcgtgagccaccgtgcctggccagtgtttttagttttcattttgacttccctaaaacagtttcatgaaagaatttcttaattaggtcaacaaagccttttgtctttagaggtgccccttgccaagaccaaagaacaaaaacccatatctacaatgaaacctacagcactccctcaatatcaagccaaagattgaaaacaaaccttttccaaccccttcttgtaaaagagaggatgaaaaaaatgattccttctccccaaactgtaagacatatgtctttcattttatgcaatttttctttaaattttcttaacaacttctctacttctgtacatttttaccaacttaatactgagtgattatctcaagaaagtttgccatgtatttaaggaaattatttttaaaattattccaatccacagctggactggacttcttaagattttatttatggttttatacctctctttaaaaattaaaaaattgatactgattaattgtacatatttacaggatacatataatgtatagtggtcagatcatggtaattagcatatctatcatctcaaacatttacttttttttttttttcctttttgagacagagtttcactcttgtcgcccaggctggagtgcaatggcgcgatctggtctcactgcaacttccgccgcctgggttcaagcaattctcctgcctcagcctcccgagtagttgggactacaggcatccgccaccatgccaggaaaatttttgtatttttagtagagacagggtttcaccatgatggccaggctggtcttgaacttctgacgtcaggtgatctgcccgccttggcctcccaaagtgctgagattacagacgtggcctgtaatgcacccggccacatttaccatttgtgtgtgtgtgtgttgggaacattcaatatccttcttccagctaaaagaagacatttttataaactaacaactgcctgatgtgggtggaagtcaagcatttcactttgtgccctggctcacagctgaggacgtacatgacagagtcctggctctaaccaagtaaccaggttattcccctcaaaaggtccaaatgcaggtccctgacttactttgtgtatcatgaaaagggaaacgaggtcctcaagtgacttaatgaccagctccctaagctgcagcgacatgaatgatgccacagaagcaaaatattcctcaatgtttcgacttgagtcatagttgctcttgggagcaaaatgaatccagtgctccttccgtgaggtaaaaagctgggcgcaggtggggatccacctgtaaagacagaagggtgtccatgtgagaagctcttctgggctccgaggaacccacttgccgtgccccctgagctcagtgatgaggcagatgggctcaatgtcccaccaagcagccttgcaaatcagtactttcaatttccagccaccttacctgccatgcctctttcttgggaagaaagtaataagatttgaattaagaggttattcttccattgagaatacccaaatggaaaggggatattggtggcacatcctgctgaaagagtctacactttcttcattataatcagagattggggtaaaggggcataaggaactagaatgttctgtccaacttctctctctctagcagatgcctggtctctgattcaaacttcatagggggaaagagagaatgaggagcaaagaaagaaaacatgaaaggagaaactccagtgtggccctggctgctcagaagttgatggtagaaatcagaaaaccaaaagaagaaatagccaagtgtggtggctcatgcctgtaatcccagcactttgggaggccgaagcgggcagatcacttgaggccaggagttagagaccagcccggccaacatggcaaaactccatctctacaaaaacaaacaaacaaacaaaaattagctgggcatggtgcatggtgacacacacctgtagtcccagctacttgggaggctgaggcaggagaatcacttgaacctgggagatgggaggttgcagtgagctgagattgtgccactgcactccaacttgagtgacagagtgagtgaaactctgtctcaaacaaacaaacaacaacaaacaaacaaaaagaaatagatgcttcattgtttctttcctcccatgtcccccagtttctaattcccagtggaaaccactggccttttcatcctattgcatcttttctctgatcgctaaaaaggtactactctagcaaccagagaagcactactactggttgtagtcatagaggtatgagatttattgagcagctattatgtgccaatgatagcatctacattttctctgctaaagaaaacccatctgcaggtattattatcactgttttacacaagggaatttctctggctgtggaggtagtcttgcaggcatttgcaaaggaaaaaggaattgtgtaaatgtatgaaacccttttgccttgaaatcttgaggccgtttatctggactatctgaatataagtcattcaaatgcattcccctgtaacacagcaaggtctaaagcaggggtccccaacccctgggccatggactggttgtaggaaccaggctgcacagcaggaggtgagcagcaggtgggcgagccagcttcatctgtatttacagccgctccccatggctttttttaaccgcctgagctctgcctcctgtcagatcagcagcggcattagattctcacagaagcgtgaaccctactgtgaactgcacatgcgagggatccaggttgcacactccttaggagaatcaaatgcctgatgatctgtcactgtctcccatcaccttcagatgggaccatctagttgcaggaaaacaagctcagggctccctctgtttctacattatggtgagttgtagaattatttcattatatattacaatgtaatcataaaaataaggtgcacagtaaatgccgtgtgcttgaatcaccccgaaaccatcccactggcccagtctgtggaaaaactgtcttccacaaaaccagtccctgtggccaaaatgggtggggaccgctggtctaaaggattcgaggaggaggaaatgggggtgacagcctcccagggaatggtgataggggaatttcaagaaggcagagggagaccaggcatggggcagaaagcagctggacatgaaaaaaagaggacacgaggccaggcgcggtggctcatgcctgtaatcccagcactttgggaggccgaggcaggcagatcacaaggtcaggagattgagaccagcttggctaacacagtgaaaccctgtctctactaataatacaaaaaaaaaaaaaaaatagccgggcatggtggcatgcacctgtagtcccagctactgggggcgctgaggcaggataatcgcttgaacccgggaggcagaagttgcagtgagctgagatcacaccactgcactccagcctgagtgacagaaagagactctgtctcaaaaaaaaaaaagacacgaaaggatgccagtgggacaaaccccaggctgggtaccagcttcatttcagagggttttcagtctttaagataccatggtgcagccccacttggagggcagatactgacttgttgagaagagtctggtgtgcctccaggcagtgtttctggatcacatcccaaaattcctgaggctgcagaggcaattttcccgctagtatttctgctgttcgaacaaacctgaggtctctgaatctgccaaaagagagggagaaatttcctaagctaaagaacgcttaataacaaatcccgcaggacaggttccaagggtgtgtgttcacgtttctcaatgaaagttaagcagaatcaaatgaattacaggatatgggaaagatgctgaggaggatatgggaggctgaggagggaggagctaagtcctaaagaacgcttgcagggaggagacaaatgaggtgacccaagagtgctcctgagccttagagatatgcctcactctgcataacccatcaagaagtggggctgtggcaccagctggagactcagctggctgagaacttgggtatcaaatggacgaatcaatgttctttacaacagtgaagacccagaggccaggaccaagcagaacatcttcatcatcaaatgggattcacccaagcctctgggtgagctcttgaaggtaactttgaggactgctttgatttaaaacaaagagtttatggatcccagcactttggaggctaaggagagaggatggctttgagctcaggagttcaagaccagcctggcaatatagtgagacatcatctctccaaaaacaaaacaaaacaaaacaaaaaaggccgggcgcggtggctcacacctgtaatcccagcactttgggaggctgaggtgggtggatcacaaggtcaggagttcaagaccagcctggccaagatgctgaaaccccgtctctactaaaaatacaaaaaaattagccgggtgtggtggcgggcgcctgtaatcccaaccacccgggaggctgaggcagagaattgcttgaactcgggaggtggagcttgcagtgacaggagatcacgccactgcactccagcctgggggacagagcgagactcgtctaaaaaaaaaaaaaatagacgcgctgggtgtggtggtgcacacctgtaatcccagctacttaggaggctgaggcaggaagatcgcttgaacccaggaggtcaaggctacagtgagccctgattgcatcactgcactccagcctgggtgacagagcaacaccctgtctctacaaagaaaaaaaaaaaaaaaaaaagcttgtggagccaaaaaagcctctttaagccctctaactcctgtcactgtgagggtgaagaaaggccaaccagtgagaagaaatgagagttttctccactacgaggggtatccttttaacacctaagtcagattctatctgctccaaaccctccaatgacttcccatttcagagtaaaagcgtgcctagtgactggggcccactaggtgctctgcaccctatgccatctctcttgctcctgtcctgcctgtcacctccccccctccccatctcctctcctacccacctccgtgactcacagtgttccaggcacgctcacctcatactgtttccaggccgtgcccacctgctgctgcttgggtcctgtgcacaagctgttcccgctgcctccaatactcatcccctcgacttctatggagctgactcttcaccttccagccttggctcaaatgtcaccttcacagtaaaggctacccatggctgggtgtgtggttgtgcaggatctgccccttccaaagggccagaatgggtgagtgctctgcttgtcaagaaatgcaccctggggctgggtatggtggctcactcctgtaatcccggcactttgggaggccaaggtgggtggatcatttgaggtcaggagttaagagactagcctggccaacatggtgaaaccctatctctacaaaaaaaaaaaaaaaaaaaattagccgggcctggtggcgggtgtctgtaatcccagctactcaggaggctgaggcaggagaattgtttgaacctaggaggcagaggttgcagtgagtcgagaccgcaccactgcactccagcctgggcaacagagcaaggctctgtctcaaaaacaaaaacaaatgcaccctggtgttaggctgcatccatcccattagtggacaggggtagcggggaggtttgttagattcaaacaagtgttttatgggcaagcagccccaccccagccccacacaaaccacactccctatccccattactctggctaatttttcttttcatagtacccatcaccttctaacatattatataatttatttacctaatatatttattgtctgttttccccctagaaaaatgaactcacttctgttctctactacactaaaacaatgcttagcacataaccaggacctggcacctatttgttaaatgaatgaatgaatgaatgactaaataaatgaaaaaaaaaaaaaaaaaacaaatgaactcacagtttggaagccaagagacagaagagcctttggacctaatatatatttattttctatcttatgcttgagtgacacctcctagaactattgatgctagagttgtccagagtatatcggtaggatagagcggctggataaggaagagcggaaactaataaaaagctctcatcaagccctccacttttttttttttttttttcttgagacagggtctcactctgtcacccaggctggagtgcagtggcgatcttggctcactgcagcctcagcttctgaggttcaagcaattctcctgcctcagcctcccaagtagctgggactacaggcacacaccatcacgcctggctaatttttgtatttttagtagagacagggtttcaccatgttggtcaggctggtgtccaactcctgacctcaggtgatccacccacctcagcctcccaaggtgctgggattacaggcatgagccaccacgcccaggctctcattgctgatttttttggttcagttgataaaattcttctaaatgatttcagttcactttggtgctgctgttgctggcataatcttcctcagggaaccatgaaaagcaagtggtaaaaagcctttcttctcagtgaagctataggctcaacaatttgccgtctttgctacgagatcaatttaaactcaggtacatgtgattatctattatcttctgaacttctttatgaagtttctggctattcatccagctctaagactgacttcctcactagtttctatgttaatttatttttttagctcataaacacgcttgtacttaaagcaataccttaatttgttgagcaattactgtgtgccaagcagcagtctaagcactttctttagctaacaactccaggaggtaggtattgttatgatgattcccatttgcatgtagaacacagggtcagactaggcggtggctcatgcctgtaatcgcaacactttgggaggctgaggaaggaggaattcttaaagccaggagttcaagcccagcctaagcaacctagagagaccctgtttctacaaaaaatgtaaaaattagtcagacatggtggcatgcacctatagtcccagctacttgggaggctgaggagagagcccaggagtttgaggctgcagtgaactctaatcatgccactgcaccacaccctgggtgacagagcaaaagcttgtctaaaacaagaaagcaagcaagaaagcaagaaagaaacagggtcacagaggaaggaaggaaggaaggaaggaaggacaaacagggtcaaagagaaagaaagaagaaaagaaaggaagaaagaaagaaggaaagaaaggaaggaaggaaggaaggaagaaagaaaagaaagagagatgagagagaaggaaggaaggaaggaaggaaggaaagaaagaaaaagaaaggaaggaaggaaagaaagaaaggccggacgtggtggctcttgcctgtaatcccagcactttgggaggctgaggcaggtggatcacctgaggtcgggagttcgagaccagcctgaccaacatggagaaaccctgtctctactaaaaatacaaaaaaaaattagccaggcatggtggcacatgcctgtaatcccagctactagggaggctgaggcaggagaaatgtttgaacctgggaggcagaggttgcggtgagccaagatcgcgccattgcactccagcctgggcaacaagagtgaaactccatctcaaaaaaaaaaaaaaaaaaagggggagagaaagaaaggaagagagaaagaaagaaaagaaaacagtcacagagggattaatttctctcaaattatactattaattagtaacagaacaagaaccagaattcagatcccattctataagttattactttatatggttccacttagttagaaaattacttcttttttctcaatgtcctgactgctgactggtacttccaatgctttagaaaattgaattcagttcaaagaaaagaatacagctatttcttttcactgatgggctctgtcctacgttgacttcaccccctcaattcctttttaaaatacaagcaaaactaaggatttgaaaaacaagtaggttctccaagccacagggctcccttaagactgaacacgttcaaagctagagatcctcccaaagcaaaatacatgagctactaataagttcggccaatcaaagttaagtaagcatatctgcctctaatttttctaatacaaaactcagatgggggcagctcatcatttcattagcctggcctttcagtgaactccggtgtcttcatcctctcaccaggatgtgtaccttcttgaagggctcactaaaaaaaccagagtcttccacctccaggctcactgcaattgatgcatagataaaacaaatgtcggatagccatccaatggattagtatgccgccataaaaaggaagcactcactactgatacaagcttcagtgtggatgaagactgacaatattgttcattgaaagacaccagacacaaaagatcatatattgcatgattccatttctataaaatgtccagaatatgcaaatccatagagacagaaaatcacttagtggttgggaggaaatgggggaaggtgagaatgcggagtgactgctaatgggtttctttttggggtaatgataatactcttgaattagacagtggtaaggattaaacaaacttgtgaatatattaaaaacttgcattgtgtactttcaaagggtgaattttatggaatgtggatatctcacttttttttaaaatgaaagaatgaaaaaaggtggcttctgtctcatctggactcctacaatttttttttttttgagacggagtttcgcaaatttaattattgataaatatacctgagagatcactgcttgccagccctgtactggcactgagttacataaaggaataagaccgtccgggcgtggtggcttacacctgtaatcccagaactttggggtgccgatgtgggtggattgcttgagcttaggagtttgagaccagtctggacaacatggtgaaactccgtctctatcaaaaaatacaaaaaattagctgggtgtggtggtgtgggtctgtggtcccaactactcagctaacttgggagactgaggtgggaggattgcttcagcttgggaggaggaggttgcagtgaatcgagattatgccactgcactccagcctgggtgacagggtgagattcgtctcaaaaaaaaaaaaaaaaaaggaataaaacccaagcccgcacacacttcataggctaaagggagacaaataagtaaatgttctattataaccaagggtgagctgggtgcgatggcccatgtctctaatcccagcactttgggaggctgaggctggcagatcacctgagatcgagagttcgagaccagcctgaccaacatggagaaaccccatcttgactaaagatgcaaaattagccaggcatggtggcgcatgcctgtaatcccagctactcgggaggttgagacaggagaatcgcttgaacccgggaggcggaggctgcagtgagccaagatcgcgccattgcactccagcctgggtaacaagagccaaactctgtctcaaaaacaaaaactgagggtgatgttgtaatggaggtaatgccaaattaacaattactggtgcttaagttatattagatactgttctaagtgctttggatgtagtaagttatttattcctcttatcaatcctatgaagtggaaactcttattaacattatcgcaaatttagaggtaaaggaagcaaggcacagaaaagtgatgcgaccacatatatgcctgtaaagcagcagagctaggagttagacctgagcaggctggctccaagtctgtgcaattaagcaggatattccagtgcttagagacaggcacagggtgccctggggacacaaaggagggccacgtaagcctgcaaggaaaggtgtcacttataattcacatgcatatttggcctagatttttttttctttcatttctctatgctgtcagggctacccccactgtgcacagcagaataggcttgcttacacgtggatgtggtcaagaaagggaatgaaaaaaaaagggagggacttcttactctgcaaaccacagttctttcagcctgagcatcatggggttcaccgtgtgcagatgctcctcgttccacttcttggcgctcctgtagacactgtgccagggcacaggggcccggatcactctttgaggaaacaagcgggggatgctctcaataaagagccgttttctctccattgggtccatgaggatgtaatcaactacaaccggaaagggcgaacacctcattattaagctctaagggttgtgctcttagcttcaactcatttagttttgtttttaatatagagacggggtctcactaagttggccaggctggtctcaaactcctgggctcaagtgatcctcccacctcagcctgccaaagtgctgggattacaggcatgagttgctatgcctggccttagagtcaactctttttatttatttatttatttattttttgagatggagtctcgctctgtcgcccaggctcgattgcaatggttcaatctcagctcactgcaacctccacctccgcctcctaggttcaagccattctcctgcctcagcctcctgagtagctgggattacaggtggctgccaccacacctgcctaattttttgtattttcagtagatacagggttttgccatgttggccaggttggtcttgaaatcctgacctcaggtgatccacccgcctcggcctcccaaagtgctgcgattataggtgtgagctagcacacctggccttagcttcaactcttagaatataaatgagcctctgtccatttgcaaggtcatgggtaatcccctgggtataattcaactggtgaagcttcactcttggtgtttgttttctttctgagggtattttacagaaaggaggagtgtgacttcacggtgtggagcacttagaatctggggttgagccctggtaggatgtctagtatcaggcaggacaatgaaataggatttgctgataactcattagtcactgattgatttctcacaccaaaatagatgcacacaaaaaaacccaccatggatgataccatccattatatttacaaatagaagtttaaagaccaaatgttttccatactaagaaaggttggtagaaaagcttcatagaggatgtaacatttgtgctgggtcataaagaacaagtagcaggctgggtgcggtggctcacacctgtaatcccagcactttgagaggctgaggtgggtagatcacttgaggtcatgaattcgagaccagactggccaacatggcgaaaccttgtctctactaaaaatacaaaaattagctgggagtggtggtgcgtgcctgtagtcccagctactcaggaggctgaggcaggagaattgcgtgaacccaggggtccgcccaggtaggtcttgaaatcctgaccaacctctgcagttgcagtgagcagagatcacaccactgcacttcagcctgggcgacagagcaagactgtctcaaaaaagaaaaaaaaaagaagtgtagaatctcagccaggtgtgatggctcatgtctataatcccagcactttgggaggccgaggcaggaggatctcttgagtccaggatgttcaagacaagcctaggcaacatagggagaccttgtcgctaaaaaaaaaaaaaaaaaattgttttaaacttacaaatgtagaatctcaggccccaggttcagatctactgaatcgcaatctgcattttaagatctgcaggttacagggatgcacgtgaatatgtgaagtgctggtgtagacatcagtgatggtagggggatgcaggactttgaattagcggttaaatgatgttttgggtatttccagtggaatcagggtggcaaatgacaaagtgagaagaaagaagatgccttccaggccaggcatggtgcctcatgcctgtaatcctagcactttgggaggctaaggagggaggattgcttgagcccaggagttccagaccagcctgagcaacaaagcaagaccttgtctctacaaaaataaaaataaaaaagaaggtgccctctacatagaagctccccagccccctttatgcccaccagccttaccgatgcttttcatgaggctacagtaatagtcattctccttctcctgcacgaggaccaccatcaggggctccaggaagggactcgtcagcagcgtgttagaaatcagctttgaaatccgaaccatcacttcaccctcctcaggggcaatcatgtctttgcgaattccattggtcagatagtaatagtatctcttccataaacaaaccaccagcgagaaaatggtcatgattggatcatgggttcaactgtcctgcccatcagctgccaagggaccccattcatacagcattcgtctgcacccttcacttgccataaccatgcattctgggcctgtcgcttcacactcatggcaagaagatcactggcaaattttccccaggacttcagaggattcaaccaaagccagagagatgtcagtggggtataaggaaggatttgtcaaataccacccagataggaacagtggagtgagtacagagtccagggatggaggtggcatatctggtgacctttaagaagaggaataacaggccaggtgtggtggcttacacctgtaatctcagcattttgggaggcaaaggtgggagaattgcaaggtcaggggttcgagaccagcctggccaatatggtgaaaccccatctctactacaaaatacaaaaattagccgggcgtggtggcgcacacctgtagtcccatctgctcaggaggctgaggcaggaaaattgctggaacccaggaggtggaggttgcagtgagccaaggtcatgccactgcactccagcctgggtgaccaatcgagactctgtctcaaaaacaaacaaaaaaacattagattttcctgatccagagctagaatttaccccccggaagctttcactcactggtcctgattctgccttctaaggtagctcagacaaacagggttggatttctgtctaaaaaaaaaaaaaaaaaagtaaaggaatgacaagctcctaaaatggcctcgaatcacataccctcctgaacagcaatgatctcctacaaaacactttgatcccatggcttctagctgtcagtggggaaaaataaccccaaagtccaagatctattgttgttcttttttttttttttttgacacagaatttcacttttgtcgctcaggctggagtgcagtggcacaatctcagctcactgcaacctctgcctcccgggttcaagcaattctcctgcctcagcctcccaagtagctgggattacaggtgtgcaccaccacagccagctaatttttgtatttttagtggagacggggtttcaccatgttggccaggctggtctcaaactcctgacctcaggtgatccacccaccttggcctcccaaagtgctggaattataggcatgagccaccacacccagctgatagttcttcttacccaagcaagggcttttgagtttcaaaagcaacataaacacacaaatgaaacaaaaatggccagtggaacctagtgacttcaggaaattttgtatatttagggtttgcctctgagctgctggatggctgagtggctctgggaatgactaatgtcagatagaggagaagcacagagtgtgaggaaagggcttgaagtctgtttttaagtttcagatcagaagaggttgctggccaggcacggtggctcatgcctgtaatcccagcactttgggaggccaaggcgggtggatcacctgaagtcaggagtttgagaccagcctgaccaacatggtgaaaccctatctctactaaaaatacaaaaatcagccaggtggggtggtgcatacctgtaatcccagctactcaggaggctgagacagcagaattgcttgaacccaggaggtggagattgcagtggggcaagatcacgccacagcattcaaacctgggtgacagagcgagattctgtctcaaaaaaaaaaaagaaaagaaaaagaggttgctgctgccagcctctttgttactctcgcctctctccaacgttagtaaaagcagctgctaacaggggagtattgcaaagcttttctgattttaagaactgcctgggtgcagggtgggggtaaaaagtgcttgttaaaatgcagattcccaggcccctcctcaggcagttagggtgtttaccaaggaccccaggtgacccttatcttcaggcaagtttcagaaatgctgcacagctcttaagaacacagagactggctgggtgcggtggctcacgccataatcccagcactttaggaggctgaggtgggtggatcattcaaggtcaggagttcgagaccagcttgacctacatagtgaaaccccatctctactaaaatacaaaaattagctgggcatggtggcagttgcctgtaatcccagctacttgggaggctgaggcaggagaatcacttgaacccaggaggcagaggttgcagtgagccgagatcgtgccactgcactctagcctgggtaacagagcaagactccctctaataaaaaaaaaaaacaacacagagactttggtatcagccagaccggctttcagtcttagttttgtctcctaccctgtagccctaagcacattgcttaaacagtctatactccactttccgcaactggacaatagagataatcatagaacctgggtctcaagtggggtcaagtagctatagagggtttagcagggaattttgccaacagcacatagtcactgtgagtttttattaatcattttattatacaccctaaacccacaagacatttgctctaaagttttattgttcttttaagacgggttggaaactccaacatctatctagagccaggcaggtaatgttaataagtgaaagttgtctagacctaagaaaataataaggaatggtgggaactatgacaaactgaagagtgtatttctcatctaaaggaggtagctactgcttagcaccaaatattttagttttctcaagagaagttggaaaatgtagcttgagactttcctcatgcttttttttttttttttttttttttttttttgagatatggtcttgctctgttgcccaggctggagtgcagtggcatgatcatagctgggatgcctgaggtgtcagagaaggggaccaagggataggttgtcttgtcctagaaagggttgtgaatccctccccctaccctttttttgagacaaggtctcactctgctgcccagactggaatgtagtggcacaatcatagctcactgcagcctcagcttcccagggacaagtgatcctcccacctcagcctcccaagtagctgggaccacagatgcatggtaccatacccagctaatttttgtagagattgggtttctccatgttacccaggctggtcttgagatcctgggctcaagtgatcctccccattcctcctcctaaagtgctgggattacaggcatgagtcaccatgcccagccacctcattctttttttttttttttttttttgagatagagcctcgctctgttgcccatgccgaagtgcagtggctcaatcttggctcactgcaacctccacctcccaggttcaagtgattctcctgcctcagcctcccgagtagctgaaattacaggcgcctgccaccatgcctggctaattttgtttttgtatttttagtagagacggggtttcagcatgttgaccaggctggttttgaactcctgacctcaagtgatccacctgcctcggcctcccaaagtgctgggattacaggtgtgagccaccatgcccagccacctcattcttaaaacacatctacaggccaaattcagcctatgatagagatcccatataaaatatgggatgctttgggatatacttatactaaaaagttattcattacctaaaatttgaatttaactatgtgtcccattttttgtcttgcaaaatctggcacccccagcctatgggccactatttttgcaacttatattctaaaaggactcaaggtatcaatttccatcacttactagggcagagaacatgtacacacactctctctccttctctctcactcgcacaagcacacaaacatgcgccctcttcagtagcctgtcttgggtctagactttggtgtttttcaaacatttcccaggtgattctgctgttctccctgaatttagaatcactgagatgccgagagtaaccctcagcaaaccgagggaaagggggcaacaggaacgtacctccaggtccgattcagatggcttcttttctttactttccatttccatctcctgctgtaacatgacatcgagctgctgttctggactcattggtctgcttcctgggaacgtcaaagatgtctttacctccttcttcatgggtgagaagattgacgtcttgaaggccaacttgatcctgaaaagtagacacagctcagcccttggtgtttggttctccagagaggtgctgtggtgttgcctactttccctagcctgatgagtgtggttctgcaaatagaagcctctctcctctgtgtcatctaatggcatgtgtgtatacttccaagatgaccctaatgactgaacacctcataggtattttagcatggttttgttcagttggtttatttttgtctacaatctcaaaaagcctggccaacatggtgaaaccacgtctctactaaaaatacaaaaatcagccaggcctggtggcatgcacctgaaatcccagctactcaggaggctaaggaaggagagtcgcttgaacccgggaggcagatgttgcagcaagctgagatcatgccactgcactccagcccgggcaacagagcaagactccatctcaaaaaaaaaaattttttttttgattaaagtgattcgtggataagaatatgattatctgggaatgctttgaagccaagaagcagagtgtggctttagtgagaccacatccttctgttcagcccaccgtcctgccttctctggtgcccacagtgatatcttacctagtggaatcctctttgtttctggaggaaaacttcgtttttttcctcatgggctctgatgagcttctatttcctggaagaatggagaagaaagacatcagtgatgggcaatggccttgggccattctccgtccacaggggcatgactctcggaacagtccaggagcacactaaggggagcggacatggtacggtgtgacgtggcaggagatgtgggctcaggtctcatgtgcatcactgattacctgtgtgaccctgaagaactggcttcatcactccggacctcagcttcctcaactgtaaagtggggatgtgcgtatcttccattcgttcatacatttggcaagaattaataactgcttgtttcatgtactctccaatattgtatgctctattttctaaacacctgttatattactgtttaatatttctctttaagtagacctgggcatttaaacttagtacatttggccaggcacggtggctcatgcctgtaatcccagtactttgggaggctaaggcaggcagatcacctgaggtcaggagttcacgaccagcctggccaacatggcgaaaccccatctctactgaaaaatacaaaaattagccgggcattgcggcgagcgcctgtagacccagctacttgggaggctgaggcagggagaattgcttgaacccaggaggtggaggttgcagtgagccgagatcgtgccactgcactccatactgggcgacagagtgagactccgtctcaaaaataaataaataaaataaaaaataaaataggccggacacggtggctcatgcctgtaatcccagcactttgggaggccgagacaggcagatcacgaggtcaggagttggagaccagcctgaccaacatggtgaaatcccccatctctactaaaaatacaaaaattagccaggcatggtggcacacgcctgtaatcccagctactcaggaggctgaggcagaagaatcgcttgaaccctggggacggaggttgcagtgagccaagatagcaccattgcactccagcctgggcaatgagagcgaaactccgtctcaaaaaatatacatacatacatacatgcatacatacatacataaataaaataaacttagtacatttatttttaaaagaaattttatgattatcacaaataaaaaataagtacatatttattgcaagtagaaaaaccaatatcatttgcaataaatagaaggtagctacaattaattcaataagtgatataaaaactatattattcaactttaattagatattacttcctaaagtgtctatctttgaacttctcaaaatagtccacatataacaacaatacaaaaatcctttttttttttttttttgagacagggtctcactctgctgcctgtgctggagtgcagtggcatgatttcagctcactgcaacctcaaccacccaggctcaggtgatcctcccacctcagtctcctgagtagctaggagtacaggcgcatgccaccacacctggctaattttcctatcttttgtagagacggggttttgtcatgttacccaggctggtctccaactcctgggggcaagcaaccctctcaataaacacaacaatcaaggtacagattcacaaaatggaaataatacagcaataacaatattgctccaaaataaatttttaagatcctccaagtacaaatgtattttaatgaataataagcagaaatcatctcaagcaaggacatgaataacagacaccagtgccgctctgaagaaagcatcttagtactttatattcaaagactctggcttgcctgagaattttggggacaatgaaacctgggaagcaatagcactagttcttcacagatattaataattttggactaagaaaattattaaagactgctacagactgaaagctaatgtcttgtcaaaattagtatgttgaaccttaatccccagcatgatggtatttggaggtgggactcttgggaggtgactaggtcatgagggctccatcttatgaatgagattgtgcctttataaaaaaaacagcaaaaagatttctcaccccttctcccatgtgagcatgcagcaagaagatagagaagacagatgtctatgaatcaggaagaggaccttcatcatagactgaatctgttggtaccttgatctcggactttacagactccagaaccacaagatatgaatttctgtagtttataagccactcagtttatgattctttgttatagcagcccaaaaggaactaagatgatgaccatgaaattaccaattagagcagcaaacttaaggttctgtgtatcatgatcttgaacatttgggcattaattatttgctacatgtccttaaagcaggaacatgcaaaagcagcatcctagagactgtgggtgtgtatgtaatacacaaataacactggtaagaaccacttgggaaaaagaaatcctccaagtgatattgaaagggctatgacaataagaatggaatcaggagttggaaaagggaggtagaaaaccataagtaatcagaaaatttgaaatggaaagatagtcatttaaacaaaaaacactcattagacatgaaaaactcaagactgaacagagttgaagagaaaattagtaaattggaagatgtaattaagaaactcacccagacgtagcacagagaaaacaatgaaaaatataaaaatgagtttgagacagagagcagatcaagagtgccaacatacatccaacaaaaattactaaaggatatccttatgccaatatacctatgcttggtgggaattaaattaatacatacaaggtgctgtggtaagcagcttccaagacagcccccaatgatccccatctcctggtaacacccctttgtggtgtaatcctctccccttgagtatgggctagaactagtgactcctaacaaatagaatgtggcaaaagtgacaagatgtcacttccaagattaagttccaaaaaagcctatgggttctctcttgctggctctctctctttctctccccctccctcgctctaagggaagccagaagccatgttgtgagttgttctaagggagagacccgtgtggcaagaaactggtgtctatggccaacagccagcaaggacctgatgacatgagtgagcctggaagaggatccttccctagttgcctttagatgatggtggccttggtgtatgccttgattgtacgctagtgaggggccctgagccagcactacaaattcagccatgcccacgttcctgccccactgaaattgtaagataacaaatactggttcttttaagccacagaattttggaataacttatcatgcaaacaataacacaagtacatagaacagtgcctggtatatgtaaatggtctataaatgttagccgtttgcaatcatttcctccatagataaggaggagagtgaggctttgcaaagtctccaaagttagcttcagcaaaaggggagccaggatcagaatccaggagtaaaaatttcactccaggccaggcacagtggctcatgcctgtaatcccagcactttcggaggttgaggcaggtggatcacctgaggtcaggagtttgagaccagcctggccaacatagtgaaaccccatctctactaaaaatacaaaaaaaaatagccaggtgtggcctgtagtcccagctactcaggaggctgaggcaggagaatcacttgaatccgggaggcggaggttgcaatgagccacgatcgtgccatggcactccagcctgggcgacagagtgagactccatctaaaataaataaataaataaaaatttcctccaaagccccattctgcaagggtgtgacactgccacaagtacctgatgatggcagcccctgaccggtcctgtccctagggacactgatggtggccggttggtagaccttcagcagatctttcagcttcaggtcctgggccatcaaggagtagttgttggcgatggaatcactgggtccacggtggtgatgctgttctttgaagggtgcagccaaggtccatgacgtgcgttgcatcaagggcgggtaaaagctgtgtgacatgacagtctacgaggtaagaagtgcagagtgagacacaatgaggaacatctctcgatgagcctgagctctgctcacactgaggctcacaagagttccaagtgccttatgctatgtttctgccttctgcacattcagtggaaagattgtctgaacagacaccaactgtacttctctgaccattgtaagcatgaattctgatgtcagggataatagcttgcattcaccagtaattttgaggcaggtaattgacatctctggtctttattccttatggacatgactacaaggtacaagcaattaccctcattttacaatgaaacacgcagaagttcagagagtttaaataacacagcagatcagtggacggccagattctaattcacctttggacaatggcatagctctctctcccacacttctgcagcctcttctgggggcaaaagcgaccaaagctactaatcctacttgtcaggtctgtttgactctccaccctcattgagtacctgccaaatacggagagaagtgggggatgcacttcacctcctcaccctcaacagaagagctggcagccaggtgtgcatacctgatagagtccagacggttcctcattagcagaagcaggcagaggaggcagctctggctgcccctgggagtggctcatgtgatgtatggagtcacttttggcgatctgtgggacatgggaacaaagtcacccttcaaaaattagggaagatttgcaagcctctgagttggttaggactaaagaggtccccaggaaaagttttaggtccagagttctggacctaaaacaaaacactcctctcattcccatccattatgtatgtttcatttatttaaaaattaacagataagggctgggtgcggtagctcaccccggtaatcccaccagtttgagaggccagggagggtggatcacctgaggtcaggagttcgagaccagcctgaccaatatggtgaaaccctgtctctactaaaaatacaaaaattagccaggcatggtggcgtgtgcctgtagtctcagctacttgggaggctgagacaggagagttgcttgaacctgggacgcggaggttgcggtgagctgagattgcactctgagatgtattgaagtgtatatacattatagagtgactaaatctaattatcatatgcgttaccttgcatggttattatctttgcagtgagaacacatctactctcatagcgttgttcaagaatacaatatattgttaattagtcatcatgctgtacaacagatctcttgaacttattccatctaactgaaattttatatcctatgaccatctccccaacccttccactcctgtttcttttttctttctttctttttttttttgagatggagtcttgctctgtcacccaggctggagtgcagtggctctatctcagctcaatgcaacctctgcctccgggggtcaagtgattctcctccctcagcctcccaagtagctgggattacaggtgactgccaccatgcccagctaattttatatttttagtagagacggggtttcatcatgttggccaggctggtcttgaactcctggcctcaagtgatctgccctcctcggcctcccaaagttctgggattacaggcatgagccaccacgcccggcccctgcttcattttttaatcattcagtgtctcctcctcggattcccttctatgagcaaatttgaatatttttcccccgtggaagagcccaaattctgaggacatccccagtaccctaccctcaggtatgattaaaggaggtgactttaaaaacattgactcttgcatttttttttttttgagatagtctctcactctgtcacccaggctagagtgcaatggtacgatcttagctcactgcaactgctgcttcccaggttcaagcaatcctcctgcctcagcctcccaagaagctggatgggtgcccaccaccatgcctggctaattttcatatttttagtagagacggggtttcaccacattggtcaggctggtcttgaactcctgacctcaggtgatccacctgcttcgaccttccaaagtgctcggattacaggcataagccactccaccaggtggactcttgcattttcacatgtgcaaaattccaaagagaaattcactcaggcagtggcactgaattttctgtgtatttaacacacacataagcaactctttatgattcctgcgaaaagaaaaagtgttatttcaacaatgtgggtgttgagtactccattccaaccagtgagtgcatactgtggagtgagcctcaggtaagggtcaacttgtggctcccacaatcactctcagattccaagtgaccctccacctctcctgagcagagaagaaagtgactacattattgaatgaaatcacatgtgtttttgtcttaagacttagcccctatatgcaaaacaaccacttcacctgggactagtgatggagaaactgcaacttgttccaacactagaagaaaagctgttggcctggacttattgagaggtgctgccgttcagcactttaaaggtggtttgagggattttcaagggcaattttgactctctgtgattttcaccttaggcattgactttggacttaactcctatataagatgagccaacatcgtatcagtgtgatttatttgggtgtgcaaattatgacatgcaagatcactgatgagggtgggatggggcagggggcatatgactattagctgtccctctgcccccaaccccttaaagatgactcaaattaaccatcattatctctcccggagcacctacctcattaaataacaacagaaaaacaacaaccgcagcaatactatctaccattattccaaacgattatgtgccaggtactgtacaacctcatgagatttttttcatacccgcattctagctgaagaaaatgagggtgagaagataggtaacacatcctagccatgtaattggccggcttgacttctaagtcagtgacttatttattattattattattatttattttttttttttgagtccaagttttcgctctgtcgcccaggctggagtgcagtgacacaatcttggctcactacaactgcaacctccaccccctaggttcgagcgattctcctgcctcagcttccttactgcatcatgcaaactgacagggacgctgttctcgggataatgaagaaagcaaaccgtgagcattttgcagaacacaatggaaagagggagaacctctgtagaaacaaattaaactaggctatgtcataggcttggactaaaacaaatacacaaacagtcataagtacgctgatagcagaaagcatcccagtctgtcgatcaggaacacatggggcacacacaacatgagcagatctaggcatcaattgcagaatggggctaaaagagttttcctggcaataaatggctaagaatcctctgtggcaccttcaagagatcgagattctcataagaactagctggttgtgcaaaattgtttgttaaaaatatgaatgcttggccagccgtggtagctaatgtctataatcccagcactttgggaggccgaggcgggtggatcacttgaggccaggagttcgagaccagcctggccaacatggagaaatcccgtctctactaaaaatacaaaaattagccaggcggtggcgcacacctgtagttccagctactcaggagactgaggcaggagaatcgcttgaacccagaaagcagacgcttcagtgagtgaagatcacgccactgcactccagcctggataacagagacaaactgtctcaaaaaaaaaaaaagaaagaaagaaaaagaaagaaagaaattaatgcttaaatcttctctttggtaaatttcaaggagctttcacttcagagcatattggcttagttattatctacaaatccactttagttttacaaagtttctatttaaaatgctcctctgggcacttcgctgtatggcaacctggtgattcaacacagatacaacagaaattctggaacttagattgggtagaactgtcactttgggcagcttattgctgattacacatgttgtatgtatgttcttcatggaggccattcccaaatgctcgtctgaggacgtgctacaccagaatcactctggtcttagataaaaatatagattccagggccccactccaaatcttctggatcggaatctaggagtgggggaccaagactctatgtttttaagatgctccccagaatattctaatgttcagccacagtcaaaaactgatggttggaatatatggtctaatgggcttggaagggaaggaaagggaagaacgggtgtctattcccggatttttcacagcaaaacttgaagatttccaaaagtctaattcagcaaaaatgatatttcaaagcagacaacaaaaaaatgtgatgaatacacttgttcagtcaagggcatctaacatgccaattggccctcttcccacatattcccaacacattaaaaatacaggtaaatcggccagacacggtggctcacacctgtaatcccagcactttgggaggctgaggcaggcggatctcctgagatcgggagttcaagaccagcctgaccaacatggataaaccctgtctccactaaaaatacaaaattagccaggtgtggtggcacatgcctgtaatcccagctactcaggaggctgaggcaggagaatcacttgaacccaggaggcggaggttgcagtgagccgagatcacaccattgcactccagcctgggcaacaaagagcaaaactctgtctcaaaataaaaaataaaaaaaaaaaatacaggtaaaacaagaaacgtcttaaaattcacacctaccttctgagatgagcaatccatgtcacccatggtgtccactctaattgtagctatttttttaaaatgaataaagagctttcagcttctccagggatgtgcctctcctatccagttggtctgaaattcacacttccttatagcataatggggatgacaccaacaatggaactttccagatgttctgaaagctctgttcatgaggttgcctctctgaggtcatagactttggcccgctgaggagttccctggtaaaaaaggagagaaagggaagctagagataaggggacagcactgggtttctgctgcgcttttggctctggttcctagtcccccagcggtggccacgcttcctttcccttgagtgcttctctcttggaaattttccagaaacacactgagttcactgcagaggaaagactgaagcagagttacacattaatacagagaagagggagactcacccctccaaacaacatcctggcagcccgaactgttctccctcctcctccctggactcttaacactggcagtgcttgtatgcaggcgctgggcacagtaaccatgtctcagcgtctgttgctaagggaaggaggggcctctgcggtgcctacatacaagactgggcatgacctagctctgtgagctggtgtctccctttgctggaggcccaggtgggcagcaggaagtgttggtgacagaagggaacatgggaaggtgtttagcaatgttccaggaataacagaggcaacagcaataaaagacctttggagacgtcgaaaagcacagagtatggtggttaagttcttgggatctacaattggacaggtcatacttcagatcctactcttctcattaattagctgtgtggcttggcaagttgtttaatctctccaagtgtcctttccgtctgtaaaatggcaataatgtgagtccctacttcatagggttgctttgaagggttaacgggataacgtgtacagagcgatttgcatatagtagaaggataactgatattttcccagtttttccccgtttttttttttttttttgagacagagtcttgctctgttgcccaggctgcagtgcagtggcgtgatctcagctcactgcaagctctgcctcccgggttcacaccattctcctgcctcagcctcccaccagtgcgcccagctaattttttgtatttttagtagagacggggtttcaccgtgttagccaggatggtctcaatctcctgacctcgtgatccgcccacctcggcctcccaaagtgtgggattacaggtgtgagccactgcgcccagcccagtttttccccattttaacactaagtcctgcatcctgggagcaatctcagtcctgggcaaactgggatagtttgatcacccaacacagtcaatgctctataaatgttgtggctaacatcaatattacgataaacacagaaatacatgtgcacatactcaaaagtaacaatattagctgccgcccgaatattaaaagcacatgttccatggtcactgtgaagttctctcaaaaccaagttagacttaatgagttttttgggggtgccatgcttgcatatctttttttttcattcaatttccccccaaacaccacgatattcccattttaaggataaggaatcaaaactgagagatatgggccaggtatggtggttcatgcctgtaatcccagcactctgaaaggctgaggtggatggatcacttgaggtcaggagtttgagaccagcttggccaacatagtgaaaccccatctctactaaaaatacaaaattagccgggcatggtggtagtcgcctgtaatcccagctacttggggggctgaggcaggagaatcgcttgaacctgggagggaggttgcagtgagcacagatcatgccactgcaccccagcctgggcaacaagagcgaaactccatctcaaaaaaaaagaaaaacaaacaaaaaaactgagagatacataactttcctaagtcgacttgactcataagtagcactgatacaattggaacctgtcctgatgaccccgagtccactgctctttccataacctacctgtccagaacacaaacattcccgagttcctatgaaaagcattgcatagtgagaggtgacagcgtgctggcagtcctcacagccctcgctcgctctcggcgcctcctctgcctgggctcccactttggcggcacttgaggagcccttcagcccaccgctgcactgtgagagctcctttctgggctgggcaaggccgaagccggctccctcagcttgcaggcaggtgtggagggagaggcgcgagcgggaacccgggctgcgcacggcgcttgcgggccagctggagttccgggtgggcgtgggcttggcgggccccgcactgggagcagccagctggccctgccggccccgggcaatgaggggcttagcaccccggccagcggctgcggagggtgtactgggtcccccagcagtgctagcccaccggcgctgcgctccatttctcaccgggccttagctgccttcccgcggggcagggctcgggacttgcagcccgccatgcctgagcctcccaccccctccgtgggctcctgtgctgcccgagcctccccgacgagcgccaccccctgctccacggcgcccagtcccaccgaccacccaagggctgaggagtgcgggcccacggcgcgggactggcaggcagctccacctgcagccccggtgcaggagccactgggtgaagccagctgggctcctgagtctgatggggacgtggagaacctttatggctagctcagggattgtaaatacaccaatcagcaccctgagtctaactcagggtttgtgaatgcaccaatcgacactctgtatctagctgctctggtgggaccttggagaacctttatgtctagcttggggattgtaaatacaccaatcagcactctgtatctagctcaaggtttgtaaacacaccaatcagcaccctgtgtctagctcagggtctgtgaatgcaccaatccacactctgtatctagctattctggtggggccttggagaacctttgtgtggacactctgtgtctagctaatctggtggggacttggagaacctttgtgtctagctcagggattgtaaacgcaccaatcagcaccctgtcaaaacagaccactaggctctaccaatcagcaggatgtgggtggggccagataagagcataaaagcaggctgcccgggccagcagtggcaagccgcttgatccccttctacaacgtggaaggtttgttctttcactgtttgggttcatgccgccttaatagctgtaacactcacggtgaaggtctgcagcttcactcctgcgccagcgagaccagaaacccaccagaaggaagaaactccgaacacatccgagcatcagaaggaacaaactccagacgcgctaccttaagagctgtaacactcaccgcgagggcccacggcttcattcttgaagtcagtgagaccaagaacctacgaattccagacacaatagaaccaagtacttccattttccccctttttctactccttttcctcaaagttgggctttccatcctttcaaaataaccctgagcttttccatctcttatattatgctctttatcacaaagtatacatacggtttcaaatagcatttggaataattgagacagtgggagagctggagactctggtttagacggaaatgggaagattatcaggtctcctatactgggtgtgaaacctcatgtcccaccaaaaacagcaactgtaatccaatgaagtgaaaaattagaatggggccaggcgcggtggcccatgcctataatcccagcagctggggaggccaaggcgagtggatcgcctgaggtcaggggttcaagaccaacctggccaacatggtgaaaccccgtctctactaaaaatacaaaaaattagccgggcgtggtggcaggcaccagtaatcccagcttcttgggttgctgaggcaggagaattgcatgaacacaggaggtggaggttgcagtaagctgagatcacaccattgcactccagcctgtgtgacacagcgagactctgtctcaaaaaaaaaaaaattagaatggtcctgatgtggagctaatggaccctatggcctgtgtgtgagtaggaggtatgctaccatctgaaatttagtgtgttttaagtctactagtgtttaaaactatcaaaacaatactaatggctttcgcttattgagcatatactatgccctgggactgctgctaggcacttagtagacatcatgtctttgaatcttctcaacaacctagaatataaatatcagtattttcacaagttttatgattgaggaaactgatacattaaactaacctgcccatagtcacacagctaggtcatcaggaaagcttgaacttggttatgaaatctgttccatggcttcaaccgaaaacctacatgtaatctgaggaaaggtggaaaataaagtatctgccaaagagagtgaaagtgacttcccccaggccacctcacctgtaccagaattgtttgttgtctgacaactttgtgttggataattcttaagaaaggatataggcttcaagtttctcaatcttctttttctttctttcttttttttttttttttgagatggaatcttgctctgttgcccaggctggagtgcagtggtatgatctcggctcactgtaacctccacctcctgggttcaagtgattctcttgcctcagcctccccagtaactgggattacaggcgtgtgctaacacacctggcttatttttgtatttttagtagagatggggttttgccatgttggccagcctggtctcgaacccctgacctcaagtgatctgcccacctccgcctcccaaagtgctgggattcaggcatgagccaccatgcccggccttgtttctcaattgggctgccagacaaaacagaaggtgcccagttaaattagagtttcagtcaaacaatttttcaggtaaaagaatgttttagggccgggagcagtggctcatgcctgtaatcccaacactttggaaggccgaggcaggcggatcacaaagtcaggagtttgagaccagcctgaccaacatggtgaaaccctgtctctactaaaaatacaaaaattagctgggcgtggcggcacatgcctgtaatcccagctactccggaggctttggcaggagaatcatttgaacccaggaggtggaggttgcagtaagccgagatagcgccactgcactccagcctgggagacagagcaagactccgtctcaaaaaaaaaaaaaaaaaaaaaaagttttagtataagcatgtcccattcaatacatgggctgtacttgtacttgtactaaaaagttacccattatttacctgaaattcagatttaattgagtgtcgtgtgtttttatttgccaaatctgccaacatggggagcagaggtcagcaaggttccaagttgcccctgcctcttgttatcaagagtttagggtcttaatctgttgctaaaaaaatttcacacatttcttattcagaggctggtattcctggcagctcattcctgaggcctaaaatagttgtttaagcagagcaacagtttcaatccttggaggctactatagcaaagtaccaaagtctgggtggcttataaacaagagacatttatttctcactgctctgaaggctggaagttcacaatcagggtgccagggtggtctggttccagtgaaggcccccttccatgttgcaggctgccaacttctcattgtatcctcacatggtggaaagagggtaagagagctctctgggagttattcttattttattttattttattttattttattttattttatttattttattttattttattttattattttattttattttattttaatgagccagggtctcactttgttgcccaggctagagtgcagtggtgcaatctcagctcactgcagcctccactgcctgggctcaagagatcctcctgcctcagcctcccatgtagctgggactacaggcatgtgccactatgcccggctaacttttgtatttttagtagagaagaggtttcgccatgttgcccaggctggtctcgaactcctagactcaagcaatccacccaccttggcctcccaaagtggtgggattataggtgtgagccactgggatctcttttataagggcactaatcccatttaggagggcttcaccttcatgacctaatcacctcccaaaaaccccatgcctaatcccatcacattgggggttaggattttagaggaacagacattcagtccattgcagcaagtaattgggaaagcataggagaggctgcgcgtggatttttttaacccaaccactgcatgttccttgagggccaagtcctgatgctatggagagatgctaggatcccagccctggaggaacacatgatgtgatggaggaagcatctatcacacaaagacaagcaaaactctgctggcccagccaaaaatgccagaggtggaaggaatttgaagattcacagagacgcccctagatggcactcttaaacaaaaatcccagtggaaaccctaactcagctttccaaagcaacttccatttagggaatgatgattggaaggctgtaatctaaggaaacacacacacacacacacacacacacacaatcttttcctgggtggggaacccagcattttgcagctgaacaaagtgcatgacgccagacaagattggctaaaacttaagaatttagggattcttgtctgtcctatccccaccattagctcttctttctgctattgtggaattacagcaggattctgtggtttatcatatcattgtcgtgatcatcatcataaatcatcatcccaagcaaatatttttgagcccctactctgtgcctcaataggtgctaagttctcgacagccacagccacactattgcaccagtcctcactacaaccctgtgattgcttctttttttttttttttttttttgagacagggtctcactctgttgcccaggctggagtgcagtgtcttcactgcaacttctacttcccaggttcaagcgatacttctgcctcagcctcccgagtagctgggattacaggtgcgcaccaccatgcctggctagtttttatatttttagtagagatggggtttcaccatgttggccaggctggtctggaactcctggcctcaagtgatctgcccacctcagcctcccaaagtgctgggattataggtgtgagccaccgcaccctgccagctttttgttatctaaagacttattttccaggttgctatggccacaggcaaagaggagaggtcggtcaacacaggtccctgtctggaaagtggctgagaactgtgcaacagcagaccaatggttgggcttatccctctctctaatttatggttgaagccatggttcagagaggttacttagtcacacagtaagttgccatcatgctctatagcagtggttctcacctcgggacgatggggccttccaggggacatttggcaatattttgagacacaactggaggtgggggggggcggttcttgtaactggcatctaatgggtagaggctaggatattgctaaacattctacaatccacagctcagaaacagaattattccgccccaaatgtcaatagcatactattcagaaaccttactctatagggcagatttggggccaggggaaacaggggctcctgctccgacttggatccatgcaaaccgaggaatttggattgatttatcttgtctctctcagcctggactttttcatgtgtaaaatggacatccaatccatctgaaaggatctcactggcttatgacattcgcatttgagcagtcatggttaaaaacttccagccagggtgatacttcatcacgtgtgtgtcttgagcgccagagacgttccagagcagctggttttaggcatacaggaggggaaaccctgacacccttggaaaactcattctcggctgccagtctgcctgtcttgaaggtggtctgagctttctcactccaagccagtcgtgtgggaagggacactctctgagcctcagtttcctcagctgtcaacctctcagggcttgttctagtggctccgaaagccagtgggagcgagcgcgctttgcaaagccttgggcgccgggccttggcgcgcctttgccggatccttccggccacgggcggggcgagcccagaggagaagagccgaggggcggtgcccgggccagggggcggaggcaggcggctctggctccctctcgggacgctctttccttcttcctcttgttcctcctcctgcctctcttcgcttcgcctgcaaacgcggtgggggctgctcggcggtcaggagcaggtgagagctcggagcttgggggtgggggtccgggtgccccgggtggctagacccctctcgccgggcggggacagaggaggagcgcgggggcgacggcgtgagcgcgctatcggggtcccacgcccgtagctttctgccccggggttagtgtaaggggcgtctcctgcttatgagtcgccgggacggggctgggagcgcacgaggagacacgattcctccccacccctaaatgcacactcaccccgccaccccccaacacacacacacatacacacacacactaccactagattaggtaaaatggtagctagcaccaccacaccccgagactgtgcccctttctggggaacctggggaagacgtcgaggcaaacctccctaggattattgaaaacgggcgccttcctcaccacccagcccctcttctccaccgaggtccccttccccatcgctgcagagagatctgcaagtatcaaagggggcttctttacccccaaattaataactaagtactcgactcccctctgagttcccattattcagtctctgtgccttctgggacgcggaccccctctccacctgcatttcactcccttcctcctctccttgggtctccctggcttttgaacgctgaaaggctgggcccggatggggaggggcggccagtgtgagctcgaggcgccctgtagctcccatcccccaaccagagatgtgacccctcctcccagcttgaactttcgaggtagccgttttcccctggaggttcgggggtgggagggccaggagatttatttggagccttggaaggggaaagggttagctggtgttggcctggcccagtcccccaggcgtgaagaaggcggggcactccttggccgcgccgggttctcgctttcccttctcgggagacagctccgtgcctggggaggcccctccgaggagtgagtgaccagggggtctgggaattggtggccaggtagacgcatttgaaggctgtggccgatggcattcgccccacgcactctctcatcggactccccaaaccggtctgggtggcacttgaggctcccaggccaaaggagacctgtaaggggaactccgcttgtttctgcttgctgcagagatgagattatgggaactgagtgctgggaacatcccaagttcaagacctacgccagaggcagcttcaaagagagaatgtggggtggtgggattagtcccctcctcaactttcccctccaaagggtttcttgttttacaaaagggaagtagcagaggatgtctagctgggatgattaaaatgtgctttaatttgcatactagaccctgtacagcttagtagtagataaaattaccccctatatgataaataaatgtgaggatctctcaattaattttggccacgtggacacaatcttttaagcatttgtactgtaggtcaggtcagtttaaagggagaaatggaaaagatatctctgtgtccagccagttctgggaaatataaaataagaatgattttttttttatatttgaaaactcaacaagggttaaaaaatatatctaatttaaccaattgcctttattaaaaataagtaaaaattgtatgagattgggacacccctcaaaattccaggcagtttagttagagtataattactgtggtgaggtctgcccccgaggtgcagttctccttagcagggatagacttacccacaagtaagtagatgatgatgtatggaatgatggaattgggagccaacctgtacagtaataaagaagagaaacaggtcaaggctactgttgtacaaggaaagctttctagggagaataaaaggcaatgagatttgaaatagtgtgttcagctttcttgctttctgtatattttcagcattttgtcaagctaaaaaataaacataagctgtcagagataatactattaacattttatcatctttttttaaaagtatcatacacatcttttcacatcactaaacagtcacactatcattttaatgactgaatttatcattatttaaccaattttctcctaatggaaatacagttagctactttccaatgttttgctagtcattatatgttataaacagggatgcaatgcacagccttttagtacattttgagatacctgttggattatttccatcatgttcctggaatataaattcctggattgaagtgtgtgcaatctgaaattgttgtgaatattgccaggttaccctccgtctgcatgcccaccatcaaggtatgaggatggtagaagctctcgtcgaaccagatggatgaagaccactaacggcttttgtttcctctggtaacagcaagagacagagcgacatgagagattggaccgcgggctgcactggagaatttactggtaggataattcatccctaaagagattgaagtgagcttcagaatggcaaaagaggagccccagagtatctcaagggacttgcaggaactgcagaagaagctgtctctgctgatagactccttccagaataactcaaaggtcagtttccaatcactatgtataatggaaaatcccaatataacactagcataaacaagatagaaagttatttctttctccagtagaaggaatttggaggtaagtcaagaatctttctggcttaccgccctgccatgtctatgctgtgaccttcaaactccttgtctgagatgactgcaagagcatcagccattgtatccatctttcaggcaacaggatttgaggaggggggaagagagaagtgcaagccacctacaatttaaggagacttctgggagtcgcacacaatacttccaattacatcccttaagccaacattgagtcatttgccactaatggcaaatgcaattctttagctggataaagaagtctgtgcaacagatatcatcctttttttggttttgtttggttttgttgtgaattttgccctatctgttaccctgaaaatgagagacaaaagcctacttcaagatttgagttcattgttccactaggaatccaggtccgatagaaatatgatgtgagtcacgtatgtaatttagaatttttctagtagccacatgtaagaagtaaaaagaaataggtaaaattaattttggctgggcatagtggctcccgcctgtgatcctagcactttgggaggctgaggtgggtggatcacttgagatcagaagttcgagatcagcctggcgaacatggtaaaaccccatctctactaaaattaccaaaatgagcaggtgtggtggtaaggcctgtagtcccagctactcgggaggctgaggcaggagaatcacttgaacccaggaggcggaggttgcagtgagctgagattgtgccaccgcactccagcctgggcgacagagcgagattccgtctccaaaaaaaaaaaattatttttaataatgtttttattcaacctaagatatcaaaaatatttcaacatgtaatcatttatacaaaattattaatgaaaaaagattcttgaaacattgtaccttcttttttgaactccctcttcaaaaccccccgtgcgcatattttacacttctagcacatttcaattcgagttagccactttttaggtattcagtggccactcagtggcaatgagacttcagatagcgttatgttttcttgcatatttatccttattgctttcttctatatgtctttcagcattttgtcagggaaaagaaaacagctttcagagataatactgttaacattttgtatgtcattctagaccttttttctatgcaatatacctataaaaatacatatgtatatgtaacaaaatgaactattttgtggtgtatttttttttgtattggatagcacagcgggtctactcgaagagatgcttgtttgcaatctacaacaataaattctggacttgctccagaatttatttggcactctttgtggatttaccaagctatttttaaattggacaagcagctttctcgccagctggcggggactcttgttattaaaagttagctcagtaagaagggtcctcctgcctgttccacatttacagctgattctcattaaccatggtagttacgttctataaagttactgcagacactgaattagcacataccaaaccatcgctcctaggggaaatacaggattcagttgctgtgagcctcctgttcacaacatttttgtcagctgatcagtacataacctcgttttatgtgtatttctgtttaaagacatgttaatatatattgttgatcattaacgttgaactcagggccaacaacagtactatgactcatgtcttaaacaaagctaatcacacacatgtattttctgcataaggcacatcacagccttctcatggttaggaacgctagagaacacttcagcactacacttggggaccattttcaacagtaaaatcaccaaactaaagcataaacgtggcactaaatagaccacagtgacacttgtttaaaggatgaaacaggaaggctcggtgtcaccttgcttgacctcagctgggaatgtacgtggcaggtgactccactttttgctgttgtggacgtgtccactaatgacctcaaaagcactgcaggccaggcgtggtagctcacacctgtaatcctagtactttgggaggccgaggcgggtggatcccttgagccagaagttcaagaccagcctggccaacatgatgaaaccccttctctacgaaaaatacaaaaattagctgggtgtggtggtgtgcgcctgtaatcctagcctcttgggaggctgaggcacgagaatcgcttgaacccaggaggtgaaggttgaagggagccaagatcacaccactgtactccagcctgggtgacagagcaagactctatctcagacaaaacaaaacaaaacaaaaagcactgccagtattcattttgaggttacaaataaatttcagtgaggaggcaaatttacaaatatggaatcatgagtaataaggattgactgcatatttcttggcactgactgtatgccaagcactgcactaggcattcaccctggccctgtctgaacttagttaatagtcacgttcacctgccttttttgtttgtttgtttttgtatttttagtagagacggggtttctcaccattttggccacgctgatctccaactcctgacctcaggcaatccacccacttcggcctcccaaagtgctgggattataggcgtgagccaccgcacctggccaccagtggttgtaaatggtcctgacccttcgtctttctcctgttaggaagagataatgaatcattgattgttttttgcattctgataccagggaatttgcctggctcctgaatcatccaagtttcagtcttcatgttctcaaatactggccactttgtccctagtttagaagccaaccgcctttgtctgaccttgggcaagtcacttaggctcactgaatttccatctccttttttaaaattttttatttattttttattgagacagagtctcactctgtcttccaggctggagtatagtggtgtgatcatggcttactgtagcctcgaacttctggtctcaagcaacacctccagcctcagcctcctgagtagctgggactacaggtgcacaccagcatactcagctaatgttttattttattttttggagagacagcatctttcactgtgttgcccaggctggtctcaaactcttggcctcaagcagtcctcctgccttggcctcctgaagtgctgggattacagaagtgagccaccatgcccagctgccatctcctcttttctaaaatgagcaatgtcaggctcagaggtttgttatgaagattatctgagatgctgtttgaagctttagcacagagggtggcgcataatgttgtcagtctgtctcagcctggccttcctgggctctgcagtgctgcactgtgcttacagagcctagattgggtaacctgtgtctacctccaggctggtgatggaaaatcacagtgcatgttactgaataataacctctcccactttccatctttccattgcatccccctctgttgccatgagaatgaaatgttaattgctacgttctacccccctgagtttaaatagtgttaggtcgttcttttttacctacctcgtagcattgtaggaagaaataaatgaggaaataatacgagaggtgcttaaagcagtgcccagcacctgagtgtttaatgaatgttctctgttattattaggtgtggttgaatcgtgtcctcccctcctgggacagactggctggagctcagctgtacttcctgggagaagacaatttctgggtttaatcatctgaatcttggtctctttgcatatctaaatgactttctctttgattatagagcccagactcggaaaagactaagaatggcggggcatggtggctgatgcttataatcctagcacttcgggaggccgaggcgggcagatcacttgaggtcaggagttcgagactagcctggccaacatggtgaaaccccatctctactaaaaaatataaatattagctggaaatcgcctgaacctgggaagcggaagttgcagtgagccgagatcatgccattgcactctagcctgggcaatagagtgagattccatctcaaaaaaacaaaaggctaagaaaaaggtggattccttaaggactgaagtggaacagtcttgcctgtttccttttatatccctgtgccatacagtccctaagtcctgtgtattccttcttttgtcattccactttcatacccatctacccctcccccttctcttccctctctgccatcagcctggacttgaccacagtatatcttgcctgatttcctgcaaatctttctacctgcctcttgcacatgattgctaggttcatatttcttaaatcattcctttaatcatgtcatagttctgctcaaatgacagcagtttgttccctgttttttttttcccagatgaaatttaaatgagtgctgtctagcagaaatattatgtgagccacatatataattttaagttttttaataattacattaaaaacaaaaagaaacaaatgagattaattttatttatttatttatcttgagatggagtctcgctctgtcgcccaggctggagtacagtggcgtgatctcggctcactgcaacctctgactcccgggttcaagtgattctcccgcctcagcctcccaagtagctaggattacaggcacgcaccactctgcctgactaatttttttgtatttttactagagacggggtttcaccatgttgaccaggctggtcttaagctccagatcttaagtaatctgcccacctcagcctcccaaagtgctgggattacaggtgtgagccaccgtgcccagccagagattaattttaataatatattctcaatttaacacaatatatccaaaacactataatttcaacaggtaatataaaaaagtattaatgagatattttgcatttttttttcttacacttaaagcacatctcaattctgatgccaaattttcattggaaatatttaatctctattcagattttataaaacttacaattcagcgaaatagattcacatacccaacctattggaaacatacttaaaatttttccaacaactgaatcaagtctcagctttaaaatttaaattaaattaaattggaaatccaggccatcagtcacaggaggagcatttcaagtgctgaatggcgcaggtggcctgtgatggacagcccggggataagctagcaagcccagtgtcctggtgtcccagcctcacaagttccttccgctgcacagcccttccctcgctggcgcagcatactcacgggtgtactgctgcctccctttcctggagagcccatctgctctccccactgtggttctttggattgtaaagatcaggtgacacagggagcatcaaataaggatgcatgtggattcgaactggaaagaagtcaggacctgagacagcgcaagggaccagcccacattctgtgtggtgactcccacggctcctccgcctctctttctctttcagctgccccaacacagcaggatctcactggactctgatgatggagtgtccaggctgggcagtgctggctccaaggtgattcctgctacagtcatctctggctagagaagcggaatagcaagctctttggtggcttttgtcagaatggtggggtagcaggaggcagtgaggtcagcgggcattatgccgtcctgtggcctggcagggagtgaaattggccatgcctcgagagtaatccttaggagaccacgctgaagcccaagaccaatggctgtggcttcttggcatggcctcttttatttaagcagggtgcagcttgcactttagttccttcagcatgaaccacaaacccctcctgccttccaactcgccctgaaaatcccactgtttaaaccacttgggtaaactcttcttcctaggaggcacatgtgttttggggacctgaattatgtcttcttttcatctgttggcctgcaaggccgtagggatgaggctcaggaaggaccagttatgatggaaggaggttctggaataatggttcctttcaagtgaacaggatctagaataccagtactgaggagagagaaggcgtggagcctaaggaggagagggggaaacccatctttgcggatttgcctatggccagctctgcgttaaagcagtctccctccattgagtcagatcgaaaattcctttttgcccggtgaaggaaaataaactattaacacaacataaacttgcattagtcacaggctgtggccaactatggtaaccaggttgatgacataaaagcatttttacttgatgtggtggcagctgttgcaagcattggacattctgagtccaagaccttaggtttgtttttttttttttgaaaaggagacttgcggtggggcgcggtatcccacgcctgtaatctcagcactttgggaggccaaggcgggtggatcgcctgaggtcaggaattcgagaccagcctggacaatatagtgaaaccctgtctctactaaaaatacaaaacttagctgggcgtggtgggggcgcccgtaatcccagctactcgggaggctgaggcgggagaatggcttgaacccgggaggcggaggttgcagtgagccgagatcttgccattgcactccagcctgggcgacaagagcaaaactccatctcaaaaaaaaaaaaagaaagaaagaaaagaaaaggagacttgctctgtcatccaggctggagtgcaatggcgccatcttggctcactgcaacctccgccttccaggctcaaacgattctcgtgcctcagcctccctagtagctgggactaccagcacgcgccaccatgcctggctgatttttgtatgtttaaaagagacagggtttcaccatgttagccaggctgttcttgaactcctgacctcaggtgacccgcctgcctccacctcccaaagtgctgggattacaggtatgagccaccatgctggccaggccttagcttttaatgctgagattttgccacttggaggctgtgcgactctagacaagtgattagcttttaatgctgagcttagcttttaatagacaagtgaatagacaagtgattagcttttaatgcttactaatagacaagtgattagcttttaatgcttaataatgcttttaataataatgcttttaataattataattataataaataatatataaataatataatacatattataattatatacatatataaatataatatatttatataatatataataatgctatatgaatattgataactaatattagtataatatatctaatataattatacaatattataattatgatttttatattacattacaattatatttttatatataattatatatatatttttaatattatattatatttttattttatatattataattataaatatttttatatttatatttttataaatataattatatttttatataaaattaaatataatttaattttatataattataaatatttttatattttatatttataattataatttatattatatatttatatttatatatttatatttatttatatttatatatttaaatatttatatttatagtatatataatataatatattatattatatataattataaacatatataattattatattataattataattataatgcttttaatagtaataatacttttaataataatagacaagtgattagcttttaatgctaatcactttaataatgcttttaataataataatgcttttaatgcttaataatagacaagtgattagcttttaatgctgagattttgcaacttggaggctgtgcgactctagacaagtgacttagttcattgcttctcaaactttaatgtgtatgcacgacacctggggaatcttgtttaaaaggcagtctgattcatcagggcctgagattctgcatttcctttttttttcccctttttctggagacaagatctccctctgttgcccaggctggaatgcagtggtgcaatccatagttcactgcaacctcaaactcctgggctccagtgatcctcccacctcagcctcccaagtagctaggactgtgggtatgtgctgctatgccaagctagtttttaaattttttgtagagatggaatcttgctgtgttgtccaggctggtctcaaactcctggcctcaagcaatcttcctgcctcgacttcccataatgctgggattacagatgtgagccaccacgcccagccagattctgtatttctaacaaactcctagatgatccaagtagctaagcctatttgtgtctgagtggcttcaactatgagaacctcagctgtaaagtaggaggcagatggtatgtaccttacatcaatgcacctttatgccgaagaggtcttctcaagagtgtgtttggcaggagagccatgactgggtctttcctcctttcacaaggcttgaccttgggtggggacctcagacttgccacctctccacagctgcctaagatagctgcctgggtgactcatgtcttgggagaagtcttgttgtagtgactttttttttttttttgagacggagtttcgctcttgttattcttattatcatttttgagatggagtcttgctctgtctcccaggctggcgtgcaatggtgtgaccttggctcactgcaacctctgcctcccaggctggagtgcaatggtgcaaccttggctcactgcaacctctgtctcccaggttcaagcaattctcctgcctcagcctccccagtagctaggattacaggcacacaccaccgtgcctggctaattttgtatttttagtagagacgggggtttcatcatgttggtcaggctggtctcaagctcccaacctcaggtgatccgctcgccttggcctcccaaagtgttgggattacagacatgagccactgcacccggcctgtagtgacttgttaatgcataagccttctggctttacgacttctgccttgtaattcccacagcttgggcagattcattcaacctggggttccgatgtgttacttatccctggctctttgtcctttgcctacaggtggtggcctttatgaagtctccagtgggtcagtacttggacagccatccgtttctggccttcaccttgctggtgttcattgtcatgtcggccgttcctgttggattcttcctgctcatcgtggtgcttaccaccctggctgctctgctgggggtcataatattggaaggtagcctgttccgtcattcacccctttagaaaataattcaattgggagaaaaatacttttggggccatttaaaaatttttttaaggggcggggtcttgttatgttgcccaggctggtctcaaactcctgggctcaagtgatcctcccacgtcggcctgccaaagtgctgggattatggccatgggctaccatgcctggttgtctgccattcttgtcaaaatcacatcaagcaaggcaacttatcagagtaggtaaaacatagactctggagcctgcattcaaatcccacctccaccactgtgatttggggcaagtggtttacctctctgagccttaaattcttaatatgtaaaatgcagatataataatacaatctcaaaaggttgttgtgaagattgaaacttatggctccataaagtccttagcacaatacacaatacatgtcacagagtagcttctcaatgaatgctagctattattattaagcagagaggccattcattccacagtgagttattgggcacctactgcatgccagatgcctcgctaggtactggagaccaccttcatccttcctcctgaagttccactaccaacagtcaacttctccctgtattcctaagttaaaattactgggaaagcaaatctgatttgctcactttgacttttcaaatcagatcacacaccccaggcaagtggccaaagagatggtggccagtgggtcaggtgatcacttctggtccattccgtggcttcccagagctaagagcacccagggctgtttatttgccccagggacaaggcagtttacacttgaaggagaaagtaggcatggtcagtggatgagccaaatacagcctggcagagtggtttttgagtaaatgttgatagatagatgggtgaatgcatgaatgaatggatggaggaatgaatgagtaccataagaaaggaaatttatagagaaaggagagagccattacattttggtggtaccatgcaaagctttacagcagacaagactttaaggatgcataacaactttgcctcagggtgggcaaggaagggccttttggacaggggaacagcatgtgcaaagcctctagaatagtggttcttgaacctgagtgtatttaaatcttttttttttttctagatggaatcttactctgtcgcccagcctggaatacagtggcatgatctcaactcactgcaacctctgccacccaggttcaagaaattctcctgcctcagcctcccaagtagttgggattacaggcatgccccaccatgcccgactaatttttgtatttttggtagagatagggtttcgccatgttggccaggatggtcttgagctcccgacctcaagtgatctgcccacctcggcctcccaaagtgctgggattacaggtgtgagccactgcacccagctccaagtgtgtataaatcttactttctttatcaaaatacagactttggatcttttgagaccaggagttcaagaccactctgggcaacatagcgagattccctccatctctttaaaaaaaaaaaaaaagaggccggacacagtggctcatgcctgtaatcccaacactgggaggctgaggagggcagatcactggaggtcaggagttcgcgaccagcctggccaacatggtgaaaccccatctctactaaaaatacaaaaaattagccgggcatggtggtgggcacctgtatcccagctacttgggaggctgagacagtagaatcacttgagcctgggaggtggaggttgcagtgagccaagattgcaccattgcattccaccctgggtgataagagtgagactctgtctcaaaaaaaagaaaagaaaagaaaaaagaaagaaagaaagaaaaaagtggtgtgtgtctgtagtcccagctactcagaaggctgaggtgacgggatcgcttgagcccaggcagttgaggctgtagtgagctatgatcatgccactgcactccagcctgggcaacagagcaagactctgtctcttaaaaaaagaaaaaagagaaagaaaatgcagacttccaggcctcatccagagagtgttgttttagtaggtctggagtggggtttagaaatctgaatttttcacgagcttccttgatgcacctgattctgatgcaggtggttggcaccacactttgaaaaacgctgatctaaaattttgcgaatctttatgaacaggcagcacacctgttgatgttctcttccttccagccttttcagggtccctccctgaaaccatcactgtggctgtgggaggagcactgggctaactggccactcacaaagcaaagggaaggatgtcagccatacaatacttgccatgttacttgttcttcatgatcttttccttctaccttttattcttttcccccccacaggccccacattatgaaaaaatgtattttccttgcacgtattagatggtaattcattaatattcctattcagagtgggaatggtatattaaaatggcatataaaatgctccataaaaatgaccaatcagaccttaagattaaaatgtgatggtttacaggctggattttcaaggatgccatcaaaagctgcatttagattttgctttagcctgcatgacctttatacctatagcttgtaggtaagagtaaataatggcatttattatgcactttgagacattagagataatttacctcccccagtactgccttggctgactcctcgaggggatccctttggaagtccatctctgaccttgagggtaagggaatctcaaactccagcacttatgggcaagacaaaatgagcaggctggttgtggtggctcacgcctgtaatcgcagcaccttgggaggccaaggcaggtggatcacttgaggtcaggagttcaagaccagcctggccaacatagtgaaaccccatctcctctaaaaatataaaaattagctgggcgtagtggcaggcacctgtaatctcagctcgtcaggaggctgaagccgggaatcacttgaacctgggaggcggaggttgcagtgagctgagattgcgccactgcactccagcctgggaggcagagcaagactgtctcaaaaaagaaaaaaaaaaagacaaaatgagcaaagcagcccatgtgtgatgcagtttgggaattggggggactggaggcaacgggagggccagccagttgttgccatggtttgatgcccactcaggtacccatatcgcctcctttttttaagtgatgctagaaatctgggtttttgtgggaaatcttcttactttaataatctgagttagcggttgttattttaaacagactgacccagggtctgccagttttcaacctgtttgagatgaacccttctcctaaccacgttctcctcctaggattggtcatctctgtgggtggcttctcactgctctgcatcctctgtggtttgggcttcgtatcactcgccatgtcggggatgatgatagcatcttatgtagtggtctccagcctcatcagctgctggttttctcccaggtaaatacatgtccatgaaataatttatttttttaatctttctacttttttgtttttttgagacaaggcctcactctgtcactcaggctggagtgcagtggcatgaacatagctcgctacagcctcaacctccaaggctcaagcagttctcctgcttcagcctcccaagtagctggggctacaggtgcatgccatcatgcccggctaattttaatattttttattttttgtagagacagggtcttgctatgttgcccaggctgttctctaattcctgggctcaagcaatcctcctgcctccacctcccaaagtgcagggactacaggcatgagccaccacaccttgctgagtaatttaatctttgccacttgaggggattttcacaaataaaaccataatcctagttgatgtccagaaggaaacttgtaagacccaggtgtttctcatagttccccatgtatgccaggcatcaggtgggaatttaccatggaattttaaacaaagcaattgctgtcattttccatcacgtatacacatttcattgtcatagcaactctatcagtattattgattccttttaaaagatgtccatttaatttacaaatgtcaaattaggtggttttctttggcggggtggggcagagaggcacaggagaaaaatgacccacgagacatgtctgtcacccaaagcggtacagtatgggagccgtgaatcttctgtccccaaagtctgtcaatcccctctgctcttgagaatgtgagtttctcaccaactgagtgtgagcctcatgtttgaatatatagatttttgttcctacaatatggctcttcaatgccagctacttcatctggggccttgagtgaaagaacagcgatctacttaaatgctggagggaaaagccagctatgttggcattactgagagactctgtgtttgtctacaatgtgccacccacctaagggattttcaaaggagatttattttaatgctttatttttgtcctttgtgttgattttagaatctaagtcccaagttcatcatacttcatttaagctcctgctaaattgatgatagtgctactgagcacttgctctgtgccagggactctcttaaacactttccaggccttatgtcatgtaatccttaacaatttagcccctttctattataaggaaaattaagccaagtcccttaagctgagagtagcacagaagggacttaattccaggtgagttaattccaaagccctcttaatcaagatacaaagtgactctctaaaacaggagttggcaatttctggaaagggccagacaggaagtatttagtaagtaatatagtctctactggaatttctggaaagggccagatagtaagtatttagtaaataatatagtctctactgcagttagtcaactctgttgccgtagcatgaaggcagcacagaccaggaagtaaatgcatgggcatggctgtgttccagtaaaactttatttacaaagacaggcagcttgctggatttggccaaccattgctctataagaactgatatcctgagttttgtttttctacaaaacagcccttgaactccttaccaaaagtttatcctgttattattcctatgttgaaaaataaagggtgaagtgggtataatataaaattgctcaaggatggctcttataggattgcttaattgaatcaaccctggagtcataatcaccttttcaaaaatcgctttgatcactcttagtcttttgtttgttcatttgtattttacttataaaatggggtcttgctgtgttgcccaggccattctcaaactcctggcttcaagcaatcctcccccgttggcctctcaatgaactggaattataggcgtaaggcactaactcactcccagtcttaaaagatgtaaaaggagaaatattggcctattttgcatattgagggtgatgcttctgaaataaaattcctccctgcctctgaacgctgctgtaacagggtgagttcttaaagattataccacaggaagtagcagaatctgactccctacttatcaatgaagaaattgaaaaacaaatccaggatttgtacttgatctccttatcttcccctattgctgccaaccaattgtttccacgtgggcagaggttcttaagctttttgttctcaagtcccattttaccttcttaaaaattattgaggcatctgaagagatgttatttatgtggttaattgtattaatagcactttgggaggccaaggagggaagatcacttgaggccaggggtttaagaccaacctaggcaacatggcaagaccacatctctacaaaaaatacaaaaattagccaactgtggtggtgcgtgcctgtagtcccagctactcaggaggctgagatgggaggatcatttgggcccaggagttcaaggctgcagtgagctgtgatcacaccattgcactccagcctgggcaacagagcaagaccctgtctcaaaaaacaaatgaaatgagctgaaatataaaataaataactaacatgacataaaactatatacaataaaataaattaaaataaacataacataaattacattaaatcaaattaaatattagctggtgcatgcttgtggtcccagctactcaagaggctgaggagggaggatggcctgagcctgggaggttgggggtgcagtgagctatgattgtaccactgcactccagcctgggtgacagagctagactctgtctggaaaaaaaaaaaaaaagaatattaataattatttctttttaaaaaattttcttcctcattgtttcttgttctgaaataattattctatgagaaatcatagcataaattttaaaaatatctattcatttaaaaggaacaatattacctgttgatataaataacaaattttaatgaaaagtaactatattttccaaaacaaaatgaaatttgtgagtggtattattttacattttacagatctctttcatatctgccttaacagttgtcagccggcttctcgtttgtgtggctgcattcattctgttgtgctatgttgtcctgtttggagtatttgaagaagacctagcatcactaacatgcggttgggagagggaggcaaagcttttttaaacgattgtggatattctatgatagtccaccaaaactccgtaagtgatagtttcttaaaggttagctgaaatgtgaaatttttctactctattttattgaaatcttcaggtctgtgtcacactttaaattgatctttatcatgcatgattttctaactttacccattggtcaatgggagaatatcaattcattgagtcatgcagatcttccaaatatattttgaaaaattgcactgttcccttgtgagagaatgtgagtgaaaaaggcatataataggtcatgttattgtgaacatggttttcatctgagaacccttgcattagcgaattcttttttttttttttttttttgagacgagtctcactctcacccaggctggagtgcagtggcttgatcttggttcacacaacctctcccttctgggttcaagcagttcttctgtctcagcctcccgagtagctgggattataggtgtgcaccaccatgcatggctaatttttgtgtttttagtagaggtggggtttcaccatgttggccaggctggtcttgaactcctgagctcaagtgatccacccacctcagcctcccaagatgctgggattataggtgtaagccactgtacccagcctgcattagtgaattctttataactcaaaaaaagataactccctcattaaatgatcgaaagcatggaatggggggaagaggagctatataatttatttcatgatttaatggaattttggccctaaaacataaaagataatacagcttaaatttttaaaaaagaaaagaaaaaggaaacaaaactgtaagtttcccttacatatgaaacccaactaaacaatatttagatcaaatacactgacctgcctcctatgtagatcagctagcctctgaggggcaaaaccacactgcttggttatggagactgcaagaccttccagggcctgcagctcaggagaagtaggggccctgggcagctgtgtttatttgcagagccaccaaactcactaccccatatcataatcttccaaaccagcctgagcataactagcttccttacatctttactaagaaaaggaaaggcttctttcttagttttttgttatcagggaggaatggtttaggtggcaaataatgaaaaaaaccaaagtagatactagtttaaacacacagggaacttttttttattgcttaatgaaaaactggagacagcccagggctggtgcagccagtgtggtatcaacataccaggcaccttttgccttcctgtgttgctatccttagcccattggtttcctaccttatggccacaagatagctgctgcagctccagatctaccagctaccttcaaggcagcagaaaaggagaaaaaaatggagtctgacccttttaaaaatgtgaataaaatatttcccaggacctctcaccactatacttcaaaagacttcattgactagaactttgtcagatggccgctggttgctgttctcctgattgtaggtctcacgagatctgatggttttataaagggcatttcccctgcacatgctctcttgcctgccgccatgtaagaagtgcctctgatcttcctttgccttccaccatgattgtgaggcctccccagccatgtggaattgtgagtccatgaaacctctttttctttataaattacccagtctcaggtctttattagcaacataagaacggactaatacaatcctcccccgaactcctttccatggaaggtgtcaagaaactaattgaaatcagaagatatggtctgaatccccgccctgccatgttttcagctgtgtggtcttgaacgggctgcttgacttctctgatttcagtttttgtccattggtaaaatagacaaaatggctactcttaatctaccattctcactgggttgttgtgaggacacagataattaagaaaaacataataaatatccaaattagaaaatggaaaaggggccgtaaccctactcctaacctggtcattttaacctcctgtgccctcagtttcttcatctgtataatggacataggcctggtgtggttgcaagaagcagctaaaaatcaggaaaaagaacatcatgtattcagctatgcacacttccaacgttgctctttactgaggccctagagctaacgatctcttcttgttatccgacaggccactgacacagcaaaacaccagttgtgactttctgccagccatgaagtctgcagaattcgaggggctttaccaggaatgagtgactgctcagaggccgggcttcttttcaagtactgctggatcatactcaccccttgggattatggcttagaagaagggggctgggtaggcaagcactccttggctgtgtcctctcgctttttcacttacttgtaggatcccgcagcagccaatttagggattgtgttgttcttgtgttggttcccatgtaaagaagcagcagagaaatgcgatggttcaacagctcgccctgccccaagtatgcagacttgaccttggcggggtcctgggcttctagagtctagcccgttgaccccaaagcctcagggcttatgtccaacggtcccattgggagcaacagtgattgtttatagttttttgttttcagaaatgagggcagctgttaattttttcactcatgtgaaacaaaatgaaaaaaaaaatccaaaacagaacaagcccttctgtggtatttgctttttatcagaaagaacagcaacatttggcctctccaagttggaaaatagagtccaaatgtaactttgtggccaagagtattttcaaaaaagtctaaaggtgtagtttccactgtaactgttgagtactgttaagtactgttaatcttttacatatttgcacttggtactgttgtattgttctaaagagcttgtcctttaagtaatttctttcttttttttttttttttttttttgtgacggagtttccctcttgttgcccaggctggagtgcaatggtgcagtctcggctcactgcaacctccaactcccaggttcaagtgagtctcgtgcctcagcctcccaagtagctgggattacaggcacccgccaccgtgcccggctagtttttttttgtattttttttagtacagatggggtttcaccatgttggtcaggctagtctcaaactcctgacctcaggtgctccacctgccttggcctcccaaagtgctgggattacaggcgtgagccactgtgcccagcctaagccatttcttaaaataaaaatgctaaaggactagtaagtaaaaataaaacttcctatgggatttcccagtggaattactgagtggtttatttgcgtggcatttcattaaatatttatttgggtgggctttttttctttactctttttcccttctgctccatacatcagacctgcctattcctctgtcgatttcatgactggtgctgggtaatagggatttttttagttgctcgcaatagacacccaattccacattactttaaaaagaggggtggtagggagaaggattagtttcactcaaccaaaaagccaaggggtagatcttgaggtgctgctgattccaggggctcaggtggtgtcattaagcatctctcacccctcatctctcagtatagctttcctcagtgtgagctgcttttgcaggcaggcccgccacccctttcggaggtcccaggagctccatcctgggcaagaaaactgcttttttccaacagtatatacaaatattctgggtttggctctgattggatagacttgggtcatgtgagcgaccccagaccaatcatggtggctaggaggatgggatatgcagatgggacagggctgggatggtggccattcaagaaacaggggaggcgatagatcagcccactattaatataactattaatattaacagttactgtttattggatgtttccttcattcatacaactgtctgatattatctctctatgctatctacccagctgggttctgcagctttaataatgaagaatgcaatggtctcccttctgaagttttctttctaatgcaagagtgagtgagcaagcatatctgttgctatgtaacagtttaccagcaactattggcttaaaagaacaggcatttcttatctcacattcttcatgtgttaggggtccaggcatggcttggctagatcttttgtaagcctgtgatcacagtgtcatcagggctgtgttctcatttggggtctgactggggaaggaccacattccaagctcacatggttgttggcagcatccagctggcaacacgacttaagccctccattccttgctgcatattcccctccccatgacagttcagtgtggtcaatggcttcttcaaagccatcaagggagagcctctcagcaagatagacgttacattcttagggaacgtaatcatgcatgcacaatcatgaacactggatcactttatctgtgttctgctggttagaaacgagtcccagaaaccaccacccactctcatgaggaggggatcacccaagggcaggtaaaccacagaggggaccatgggctctgccttaagagtccttactagggtccttagtagtccaccttgctacaacaagtaaacaaaatattagaccaactccgctgaagataagtaaaagggtggtaagtaattgggagagcatgctttagccacagcaatcagagatttcttctatttgaaccaaaacatgagttgtcaccatgccaagcacacagggagggtgttcctagcagagggcacagtatcccaaaggcccagagatgggaagaagcttaatgtgtttaagggaaaaaaatgatgtcagcatggctgggcctcatcatgcaggacctcatggagtgagtttacaccaggggtccccaaccagtaccggtccttggcctgttaggaaccaggccatacagcaggaggtgagcagcaggtgagcaagcattgctgcctgagcttcacctcctgtcagatcagcagtggcattagattctcataggaacatgaaccctcatgtgaactgcacatgcaagggatctaggttgcatgatccttatgagaatctaatgcctgatgatctgtcactgtctcccgtcacccccagttgggattgtctagttgtaggaaaacaagctcagggctcccactgattctacattatggtaagttgtgtaattatttcattatgtattacaatgtaatcataatagaaataagctgcacgataaatggaatgcacttgaatcatcctgaaaccacccccctacccacgcctcatccatggaaaaattgtcttccacaaaacttgtccctggtgccaaaaaggttgaggaccactggtttatgccaaagagcaaaggaaagacaatgaagaatcttacatgggagagtgacgtgatcagacttgggtttttaaagatcactccatggccaatggatttaaagcaggaaggctagttgggaggtctatggaggcccaagagcagagaggataattgtgacttaaaacttacactaggctgagcacagtggctcatgcctgtaatcccagcactttgggcggccaaggatcacttggggtcaggagttcaagaccagcctggccaacatggtgaaaccccgtctctactaaaaatacaaaaattagctgggtgtgatggcgggcacctgtaattccagctactcaggaggctgaagcaggcaaatcacttgaacctgggaggtggagattgcagtgatctgagatcgcaccactgtactccagcctaggcgacagagcgagactctctctcaaaaaaaaaaaaaaaaaaaaaaaattagggcaaatgtaatggagaccttcctcattttgagggccagcagcacttggtgatgatggagaaggaaagggggacacaaggtggcacctaggtttttagcttgagccagtagtggatagtgacactattgtaggagtgaaggacaagcttcctctctaccctctgaaggatccctgaaatgaactggcaatagacagatgaacaggagaaaaggcatattcaaatttattaacatgcacatgaacacaggagttccaaaaatatgagactcaaagaaaggccaaatgattgaaacttacatagagggagatgggggaaatgtaggcaacttgaaggattgtaaatgatttttaggggaattgaatggacccaaagagcaaaccacaatgagataccatctgaaaccagtcagaatggctattactaaaaagtcaaaaaataacagatgctggcgagtttgtggagaaaagggaatgcttacacattgctggtgggaaagtaaattagttcagtcactgtggaaagcactatcacaatagcaaaaatggaatcaaaaaatgtccgtcaatggtggataaagaaaatgtggtgccatatacatcacagaatactacacagttataaaaacgaatgagattgtgtcctttgcagcaacatggatacagctagaagccattatcctaagtgaactaatgcaggaacagaaaaccaaacaccatatgttctcacatataagtgggagctaaacattgggtacatatggaaataaagatgggaccaacagacattggggcctacatggaggtggagggtgggaggagagtgaagataaaaaaaactattgggtactatgcttattacctgaatgataatctgtacaccaaacccctgtgacatgcaatttacccatgtaacaaacctccacatgtactcctggaactaaaatgaaagttaaaaaaaaaaagcagacaatagtttgtaaattattttctttagaaactgaatgggacaagttatgggaaggtgaggggcagaactgcactgcaaacaaaggtagtcttattatgcagattaagtcttttaggtaatctctcagaattactctcggcaaaatagatgaaaagcccgagcatggtgacaacttttagtctcttctgcagtggttaattttttctggttattttggatgctaatccaccacgttgacttctgattaaccccagtcccatgaatgcctcctgattcctacttcactgttcctagtgtaagaacatgttgaccttgatgtcatcacacaaattataggctatgatacattcagcattcttgcctgtcctgaagggttgcctttaattggcttgctggagcaagcataccctttccctatggtatatgcgtagccctggtgtggggagtaacagtgcagagagctacctgtcctgccaccacctaagaccacacttgtgtctgtaagttccttcaatgaatcacccaaagtcaacacaatggatctgtctgcctccttctttggttcctcggctccctcagcatttgggaatcactttgcatattcacagaaattaagacaattgcatttcttttggaagaaattttcctcggtcagataagggaacttccagagaaagcctgatatggttaggctgcgtccccacccaaatctcatcttgaattatagttcccataatcaccatgtgttgtgggtgggaccaggtggatataattgaatcatggggggtggtttctcgcatcctgttctcctgatagtgagtcagttctcatgagatttgatggttttacaagggacttcccccttcactgggcactcattctctcctgccgccctatgaagaggtgccttccgccttgattgtaagtttcctgaggcctccccagccatgtggaactgtgagtcagttaaacctcttcctttataaactacccagtgccagatatttcttcacagcagcctgagaacagactaatacagagcccctccctgcactcaagatggcagaaacaagagaaggttagaaaatccttggttctgaagcagtttctaaggcctttcattttcctttaactcagaagtgctctgcatgccaaagtaacagactttggggtatccttgtctgtgtctcaatgggggctgtgtgaaaattcaacccctgctttgctcatattaagtcagatatgcctcttggatactaagaggatgtgtcaagtagacagctggcttagagggtacgtttgggctggggagtatttttggtgctgagagctttacacagccttcatttgggatgctctcccagagagtagccaggagatcatttcatagcatagttctgatcacataaacaccttactccaacctctgccaagggcaaagtgctttcccacagcacttagaagtgctaactctttcccctcatggatcaatccatgatcaaagaccaatcccagctgggcacaatgatttacacctgtaatcatagcactttgggaggccgaggcaggtggatcacctgaggtcaggagtttgagacctggccaacacagtgaatccccgtctctgctaaaaatacaaaaattagctgggcatggtggcacatgcctataatcccagctacccggaaggctgaggcaggagaatcgctggaacctgggaggcgaaggctacactgagccaagatcacgccactgcactccagcctgggtgacagagggagactccctctcaaaaaaaaaaaaaaagatcaatccaagcttctgcttcctgctacttctttatatgccatcggcctctggatatgagagagaaaactaaagttcaaaggactcacccaattcagctaagaaatgtgacatctaaatcaaggctgtgcagtgaggttattcattcaggttctgttctttacatggtctgggcctaaccttcaccgatcaaatgaagtgaaataaggtgcagaaccctagcacagtggctgacaccaaacaagcccatcaagaataattgtcaaggacgaggctcagtggctcgtgcctgtcatctcagcactttgggaggccaaggcgagagaatcacttcagcccaggagttcaagagcagcctgggcaacataatgaaacctcgcctctacaaaaatgaaaaaattagctggggatagtgttacatgcctgtggtcccagctactgagggacttaggcaggaggatcacttgagcccaagaggtcaaggctgcagtgagctacgatggcaccactgcactccacactggggaacaatgagaccttgtctccaaaaaaaaaaacaaagaaaagttgtcaaaatgcatggctacatgagtcatttaaaactgagtgaaacaggaagatgtaaaagacctgttgttaaccaagctgtggaggaccgttaaggacttcgggctaaggtccttacaaagatatccttagccttttagacacacagctcaatgtgtggccgattggaaaggtaattaatccccagagcataaaaacgatgacttttttacagttataatgttaatttatcagtatgtccaggtttcttgtttgtttatttttgagcattcgccatgtgctggatgctattttttttttttttgagacagggtctcattctgtcacccaagctggagtgcagtgacatgatcatagctcactgcagcctcgacctcccaggctcagataatcctcccaccttagcctcccgagtagctgggaccactggtgcccaccatcatactcagctaatttttgtattttttgtagagacagggtttcaccatgttgcccaggttggttttgagctcctgagctcaagtgatcctcccgcctcagcctcctaaagtgctaggattacaggcgtgagccactgcgcctggctgcggggggctattttaagcccaatacacagcaatacatgtttccagtgcgtcctcactacctcccattttagagataaggaaaccgaaagattgacaagttaaattgcctaagggcccatagaattagaagtgggattctaactgcagtttgtctaactgcaaaagacatcctaggctgggtgcagtggctcatgcctgtaatcccagcactttgggagactgaggcgggtggatcacctgaggtcaggagttcaagaccagcctggccaacatagtgaaaccctgtctccactaaaaatacaaatattgttagctggacatgctggcgggcacccgtaatcccagctactcgggaggttgaggcaagagggttcgcttgaacccaggaggcaaaggttgcagtgagtcaagatcatgccattgcactccggcctggatgacaaagtgagaccccgtctcaaaaataaaactaactaactaaataaataaatctagatcagcagttctcagttgggagtgattgttccccgcccccgccccccgccccaaccctcaaccagcacccccaggggacatttggcaatgcctggaggcattttttttgtttgagacagggtcttgcttggtcgcccaaactggagtgcagtgtcaaccacagctctcttgacctcccaagctcaaatgatgctcctgtctcagcctcctgcatagcaggaactacagatgtgtggcgccatgcctagctttttttttttttttttttttttttcagtagagatggggtctcactgtgttgccagggctggtatcaaactcctgggctcaagtgattctcctgccttggcgtcccaaagtgctagaggcattttttgttatcacgatatgcgtgcctgtgttgggtgctgctggcatgtaatgagtaggggccaaggatgctgctcaacattttaccaagcccaggacaggcctccacaaccaagaattatctgggcccaaatgtcaacagtgccagtcttgacaaaccctaacctcaacaaataataagaattaagagaattaggccaagcaagagcacagctggtggagagggggtcaaaattgaccaggtctgccccagagtgaccagtggcaatcgtggcatcatggaaacacacaagttcacagttgtgaaatggttcaggttgtcaaagagttttcgtatcagttaccatccttacctttcataacagtccagagacgttattctgctctcattcccatcccctactcttcagctgatggaagaggaaagcagggttaatggatgagtcacctgtggaagttctcagagtcagcaaatgactaagccacagaacccggttatcggcctcctagcccacgtgcagatcctttcctcccccttctgctgccttttttgttaaagcagaagtgacaacgacgaaacgttcggaagatggactacagtgtcccatggcagttgggagtcagccatccagggggtccatacactgcagagggcatgctccgtgtatggacctccaggctggagaggacatgctccgtgtatgggcctccagcagcacacattgtttgttcatgtttccaaaactcaggaggagactcaagccccagccacatgctctaggagtctctatgcccctgttaggagctcccgtgctggagtttcaatccccagctggaaaccttagaaaaaccatcagaaggaaacgcaactgtttcctaatgaaagcgtttcatctctgagccagtagagggagcgcacatccaggccatccgaagctggctcagccgagacttcaatagcaccgagggctggaagaagcattcaacgcgcgatccttgaacttgaatgagcctatgcataggagcctgttaaaagccaaattcgcgggcggatcacgaggtcaggagatccagaccatcctggctaacacagtgaaaccccgtctctactaacaatacaaaaaaaaaaaattagccgggtgtggtggcgggcgcctgtagtaccagctacacgggaggctgaggcaggagaatggcgtgaacccgggaggcggagcttgtagtgagctgagatcgcgccactgcactccagcctgggcgacaggtgacagagcaagactccgtctcaaaagaaaaaaaaaaaaaaaaaaaaggccagattctggccgggtgcggtggctcacacttgtaatcccagctactcaggaggctgaggcaggagacttgcttgaaccggggaggcggaggttgcagtgagccaagattgcgccattgcactccagcctgggtgacgagagtgagactctgtcaataaataaataaataaggcagattctgagtctgtaggtctgcatcaggacctgagttcctgcattgcttatcagccaccagatgaagccttccaccggccacaccttgagtagcaaggtaatagataacttctcccaccctctcccatagatggtggacctgaggcccagggagtttagactgcttactagaggccaaacagaaagactgcagtgctggggctagaacccatgactcctacagctggtgctcacttcatagcatcttccctgcccctctgaccctgaaacaggattcagggaagaggatccctaagtgtgggtgaggagtaagagactatactatctgctttgaatcaagcttctttatactctatttttggtcaagttacttcccttgcagaagtaccaatagaaattcaaagatgaacacaagcagactccaattcttttgggcctgagggagccaaagtaaaatagatttgttagtgaagtccctcttatttttggttagtacaaatttggcaagtcatccaaagaaaagcttacatataacttggtatgtttttatgaatgcaaattatagccatagactttctcctaagaatgaagtttcttagcttgaatcagtttagatgaaaaatgcctcccttaaaaaataagagctcctaaactctcactaaacatgaaatgcagaggcaagtggttctagggttgatttggggaacacaatgaagttatcaaggatttaggctttccattttttcgctccatcgttctcagggtgtctttagggttatttcctcatagttacaacatggctgccatagctccgggaatcacatcacataatcatatccaaaagcaggtagaaaaggggttagctgcacatacctttttttaaataaggaaaaagaagccccctctcaacttccccttaaatctcattgaacagaactgtattacatgctcacctctaaacagaagggaaatgggacgttatcttggctatctcatgccaagcaggattgtcccccagggtgtgctgtgcaaacaaagtccaggttctcttagcaaggaagaaggggatgaggtgggaaggaaaaagaaagggcaagaaaatcccttttaattaagccctacactatctgccccagtacacttgtgttttcgctgtatttattcacaaagtaagggtcttcatgtgctgtgtgagcaaaggtcaggaccaaggaggatttagttaaatctggaatctcagtcaggggttcatactcttgagataaggaaaagtaaccaatgctgcctaacagcccagcacccacactgcagtccctagacttagcagatggaacttgctataatgaggaccatatgtattcatttgctaaggctgccatagaaagtaccacaaactgggtggcttacacaacagacatttattttctcacaatcctggaagctgggagtctaagatcaagatgccaagcaggcttggtttctccttggcctgtagagagctgtcttctccctgtgtcttctgcctgtgtctgaatttcctcttcttataaggatagcaatcctattggactagggctcatcctattaactcatgttaatgcaattacctctttttttttttttttttttttttaggcagagtctcactctgttgcccagactggggtgcagtggcgtgatcttggctcactgcaacctccatctcccaggttcaagtgattctcctgcctcagcctcctgagtagctgggactacaggcctgcaccaccatgcccggctagtttttttttttttttttttttttagtagagacagggtttcaccacgttggccaggctggtctcgaactcctgacctcaggtgatccactcacctcagcctcccaaagtgctgggattacaggcgtgagctgctgcacttagccacaattatctctttaaagacccttcctccagccatattttgagattctgatgttgggacttcaacatatcgatttgcgggtcacacaattcagtcctccaattcagcgagcatacttctatttcctctgcaagtctgatgtgcaccttgctttaaaagagatacgattatcatgcttctcatcctaattttcaaagggctttctatcatgtgtgaatctcaggttccagtgaatgccttcttcgtgtctgtggatgtcatcatatgagggtattttttgacctgtttctgtgacgtattcatagagttcctgtaatcgaacagtcatggatcagcattcagaatatataaagaaaccctaaaaatcaataggaaaaggacttttaaaatctagtataaattaaacaaaggctataaacagacaattcagaggaagggactgcttcctgctgtgcagatggtcatcttgcggtatcctcacatggccgagagcagagagaggaagctcactctcctttctcttcctttaagggcacttatcccctttatgagggcaccatcctcatgacttaattaattcccaaagccccacctccaaatatatcacactgggggtaaggacttcaaaaacatatacactgggggtaagaacttcatgtgaacttgttgtggggggacacaattgagcccacaacaccgagaataagcctgagcacacaccttgtgccacaggctgcatgttctacctttccgcaacccctgtgctgcccacgatgagacagcttcccactcaacacatcatcactttcaaaccagaagcaatgttgtgctgtggattttctggttattgacacagtggtgggcactatcagaggtaattcacatctttgcatccaatgggagagaaactaaattccctgttgacttaaaagggagaaactgaggcagaattaaaagtagagagttttttggggccaagtttgaggattgcaaccccggagcatggattcaagttgacatgagttatagactcctattagcagcatttacaagtggatttctaaaggcaaaaaaggggggacagggagtgagctgatgcacagttctttgtcaggaattctcattgtttttcagaaataacattgatgtgtgattggctatacattgttaagctatagggtgtggttatatgtctggtgcagcattattaggttaacttaaagctacttgtggcaatagtaagcagtttcaagagatggatacttagctcaagggaggagtaggatgtgatgactgtctcatcttttttcctttttttttttcttttgagatggagtctcactctgttgccaggctggagtgcagtgacatgatcttggctcactgcaacctctgcctcccaggttcaagcaattctcctgtctcagcctcctgagtagctgggactacaggtgtgcgccaccatgcccagctaatttttgtatttttagtagagacagggtttcaccatgttgtcaggatggtctcgatctcttgacctcgtgatctgcccaccttggcctcccgaagtgttgggattacaggtgtgacccacggcacccagctgactatctcatcttactgtctctggccctgatagtttagaaggacttatatttctcagatcaaagttcttttcttttctcacccctgtctcaggacctgtattctcagcaatgcctcttctttcaactacgatacatcactgtttggaaatggaactagttgcaacttaagtgccaagttcctgaagctataaactgctccccatgcttttagatcctatgtgcaagcaacagtgtgtgtttgtaatgtgttgtctgtgatgaagtgtggtaggctctgccttcactagcacagtgatttctatccagggatatgtgtcagagtcatctgaggagcatggattagttttctttcactgcttagacaaattattacaagtttagtgggttaaaacaacatagatttattctgctacaattctgaaggtcagaagtttgaaatcactttcactggactaaagccaaggtgtcggtggagctggttccttctggaggatctaggggaggatccatttccttgcattttccagcctctagtgttcccctgtatcccatggcttatagccctttctccatctcaaagtgcatcactccaacctctgcttccatcattgtactgctttctccccatagtcaaaactccctcttacaagcacacatgcagttatatgtatggcctacctggataatttagataatttccccatctcaccgttttaccttaattatgactgcaaagtcccttttgccatattagggaaaattcacaagtcccagaggttagcacgtgaatatctttggggccatgatttagcctcctatagagcctaaacatgcttagactccactccctaaagattctagtttagtagatggtgtctaagtttttgttttttgttttgttttgaaatggagtctacctctgtcgtccaggctggagtgcagtggcataatcttggctaactacaacttccacctcctgggttcgtgattctcctgcctcaacctcccaaatagctgggattacaggcacctgccaccatgcccacctaattttttgtatttttagtagaaacggtgtttcaccatgttgaccaggctggtctcaaactcctgacctcaggtgatccgcctgcctcagcctcccaaagtgctgggattacaggagtgagccaccatgcccagctgatagtgtctagttttgtaggtggtgtctccctaaagattttagtttggtagatggtgtctaggccagaggtctgtacaatcaggtgtacattctaccacatatgcacttgattacatatgccttggtatatagcacacagacttattcaagtcacagttattgtccataatgttatctgagtttttatttagagttagaacagtgctattttcttgatgttgagatactccaatgctgactgggcagtgcctacatcaatacaacggttatcttgttgaaccctcacacgcttccaaattaggttgtgttccctttttacagatgcggaagcaggctcagagattgttctatctgcccgaggccacacagccagggagacgtagatcccgaacccaaacccaactcttgctctagagcctgcgcatcccacagaacttcctaatgcagaacagggcaggggaaagtagtacattacattacaggtgccttcccagggcacacaagtctgttttcaactcctgcaacctccaccatcaatcagaactgctcaaactattagaaccccaaagctccatcattctactcttgacacctgtatgacaattacagcccatcactacgtgataaaggagattgcaagcacactaacgtggttgaagcagcagtctctcaggatttaagctcgactctcttcccacacagttcctgtctgaggaggctgcctcccccatatatagtaggatgcctactttcagaaggcaagaacacgactttagtcaactgctcccaggctaccatggcaacaagtgttcatcccggcagctgctccacaccagcttggctttccactctcaaagttctgctttagcatttttggcaaacacatcagaaccaagtcacgctgtgggctgccttgagacccaggggactttgattcccaatatgactctatacaagtggaccaacttgcagctgagaggctctagctctgaaatcaaggggctgtgacatcctggacaagcttctttagggctcaagttgctcatctgtaaaatgtgcacttttaagccatgtttttcaagttgtgggtagtgactcagtattttaatttcctattgttgctgtaacaagtttgtttcatgccgttaagctatctcacaattctggaggtcagaagtctaaagtggtacagcagagctgtactctttctagaggctctatgggaagatattttcttgttcccctactagaggcggcctgtgttttctgtgactctctatcattccaatttctgcttccattgatacatcctattctgaccttgtttttattttgagacagagtttcactcttcttgctcaggctggagtgcaatgtcgcaatctcggctcactgcaacctccaactcccgagttcaagcaattctcctgcctcagcctcccatgtatctgggattacaggcgcccgccaccatgcccggctaattttttgtatttttagtagagatggtgtttcaccatgttggccaggctggtctcgcactcctgacctcaggtgatccacatgcctcagcctcccaaagtgctgggatcaccggcatgagccaccgtgccctgctgaccttcttgttttatagggacacttgtgattgggcccaccgggatgatcttaccatgtcaagacccttagtcacatctgcagagtccatgttgccatgtaaaactaatattcacaggctctagggattaggatgtaattcctagacatgggtcgggggtaggtgtcattcagggtcaggaagtcatttaagtggccatttttaaaaatgccattaaaaagcatggtacgtgagatttagttatgatatacaatgcaacttgataaagtcacacagaattttgaatctaaaactatttagcagaatgccttggatccttaaaagaaggtccaaagaaggcttttgatgagacaatttgagcttttgaccctattactctagaaatgccagaccctctacataaggtaggtgtggttctttccctacatcagagtcttatctgtaagacctaaccaaaggatttagaaagctaccttttaagtctgtgtggcagaattctagaacaggtgccgggcacggtgtctcatgcctgtaatcccaacactttgggaggccgaggcaggcagatgacctgaggtcaggagtttgagacaagcctggccaacatggtgaaacaccatctctactaaaaatacaaaaattagctgggcttggtggcaggtgcctgcaatcccagctactgaggaggctgaggcaggagagtcacttgaacccaggaggcgaaggttgcaataagccgagattgcacctatagaaaaccacaagatgaccagatagacatcacgatattcaacctcaaggttagatttttgaaaaacccaagagtataatgactgagctgacatttaaatccagccactagaagctttcatcacttattcttcctgccatacgtagatttgaaatatttccttgcaaaaattttagactcaagttttctagaatacaagtgaatttccatatatcttgaaggtctctaagagctgcagtataaagcagacactagtcatgttgatgacataattacttagaataagactggctaccctcaggacgaaggcctcaggagacggtcaagatcgaatgcaggtaatggaaaactcactctaggctcagttgaatggtggagtctgattcttggaatgttataactgagccttaggactctggcactttagtattcctttccctaccaaagaaagattgcttgtctttagttataagtgggaaggtaactaagtccttttaagctcaggaaagttgtaagcttgagtgtaacttgagttaggaattaccttgaagtaagttcttatattactttcttaggaacatctggtttcccttcccttaaaagaaggggggttggatttatgccagtgatcatgggtagcttgctggcttcttatcctgtgtaagagcttgtagactcaagtgtacccccagagctgggctatagctaaagccctactgttgactgggagtgtcagaggactcatgtattggggttagaggatcagaaggggccaaatgacaggaaacaattataccatgaacttccctatttgtatctatatacaaatcctgcccagaggattgtggctaggtactgcctctacactgaggaacaaaagaaatgatcccttgtcatctaatcttaataagaatgtggaaggcaagaggcttattttgactgctttatttagaagcccatttagtgatttgacacagtccttttctcgtacaggtagtagatgaagcctagagttgccaccacacctgcaaaggcagccacagcagccacagctttggaaccaacatctccagcagtcttgtgccctttggtgtccatagcacctacaaaggaagcagacatttgagtcttaagtatttttaaataagggtaagtggaagccttacataaggctccccagagaagggggtaaaactaagccttcaacaggcttatttcagaagtttgcaacattgaataaacttacctcgtgagccaacctcctcccctgtttcactcctactcttctccccactgctcccacttgcttttagatcagatgagccgacacctgggaagaacctgagagtttagtacaacatcttcatgctagtcgatgtggttagctgtcccctgagggtgtgatcccacaggttgttcattaaggctatctcaggtaagggtatgtgttaacaggcacaaactaatacacacttaagtttggccatagcatgttaagatgcacatgctctgacctaatcttgctagaaacatatcttaaatctttgactactatacaagaaattcaagaggattttttttttttttttttgtggccgggtgtggtggctcacacctgtaatcccagcactttgggaggctgaggcaggcggatcacttgaggtcaggagtttgagaccagcctggccaacatggtaaaaccttttctctactaaaaataataaaattagctgggcacagtggcaggtgcctgtaatccctgatactcgggaggctgaggcaggagaatcacttgaacctgggaggcagaggttgcagtgagccaagatcacaccattgtactccagcctgggtgacaagaacaaaactttatctcaaaaagaaaaaaagaaggattctagtatggactgaggacaaaactagaaataaacctatagatatccatgaatgaggatcatgactaaggtagagccacgtggaatcctaagggttctttgtacagatataaggtagataagacagattagagaccaagttctagatcagtaggtagaagctatgatcctacttgtgttgaagtgatttctagaagggtacacaggagacttaatagaagcctacttctgggaagagacttagtcttttattcttctattgtttagactcaccacgggtacatagtatatgtaagcactgaccgcttggcataaaaagctaagaacttgaatccaggaagtactccaggctttaggtccatacctctgaatgaggagtcatctgacaacaggagaatgggtcctgggaggctgactgtcattttctctgcttcagtggcccctgtggctggagacagatgatcaagtttgtgtttggcctctggaatagtggttcgagaggtgtgtcaatggaatgcttagaagtagaagctctctggagtattttgttcatgtggtttgtcttgcctttgcaggcgaggttatgccctttactgtagaagtgggatggattcttggggttgggtgtggtggctcatgcctataatcccagcacttttgggaggccgaggtaggtggatcacctgaggtcaggagattgagaccagcctggcctggccaacatggtgaaaccctgtctctactaaagatataaaagttagctgggtatgttgggggggttcctataatcccagctacttgggaggctcaggcaggagaatcatttcccttgaaccctggaggtggaatgagccaagatcacaccatcttactccagcctgggcaacaagagcaaaactgtctcaaaaaaaaaaaaaaaaaaaaaaaaaaggatagattcttaaagaactcatcgtctatagaactagacaagaaactgttcatcttagacctgtcacatgagtaaggtagactggaccaagttttgactgggccaacaagagctctgggcagtaaataaagtatgagttataccagtccttaagatcttctattctaaaaagttgatacttgctttgaattagactcacagaaacaggaatttgaagtttttacctcgcctgtgcctagaggacacagggcaggtcacagaacacagtggggagtcaggggagagtcgattacagattaaggcactgcagtggaagtagacctggagacagaagagagttacatggaatcgatgcactaacatttaacctgtccctggtgacttctgaatcacttaccaggctagagagcacgtgggcttctgatacaaaggcaaaagccttcatgtcaaacctctgatagtgatcaggatgggtcacagaggagccgactggatggaaggtggtctggtagttgtccaggtcatatgcacagctaggaggtatgcaccagggagggatgtcagtcatatgcatcttggagtcaaattcaatgtctgcccagatttagtcatacgtaatatcttcagaactattgccatatttaccttctaccagcacctttgttttactcagcatttcttacctgacctataatacctatgaaatcataagttgtatagactagttatattttaactattttagcagtacctgtttgccaactacatgagaagtacaaattatatcatttcagaagacactggtttcttggccaggtgcagtagctcacacctgtaatcccagaactgtgggaggctgaggtgggcagatcacctgaggtcaggagtctaagaccagcctggccaacatggtgaaaccccgtttctactaaagatataaaaattagctgggcatggtggcaggcacctgtagtcccagctacttgggaggctaaggcaggtgaatcgcttgaatctgggaggcggaggttgcagtgagctgagattgtgccattgcactccagcctgggggacaagagtgagacctcgtctcaaaaacaaaacagaaggcttagtaactgagctaccacagcttcaagaaagcaaaggtgcagttttagccaagtacacactattccataagaatgggtgagatccagttgtaggacaggacacggcaggagagctgtaaggttgaacacctatgtgtacaagtgtgtggctgcaacctcagagcatcagtgctcagattctagagtcagatggatattctaatacaagctccattgtttaagtattgttttgggctggttatttaggcagcaagctggggtttcttcatgaaagacgaagactagtacaactagtggatgtggaatacatagcactgtgcctggcatatggtaggtgttcagatggatagaggctagagaccagtctttccagatgatcaacaccatagtagagtcagactttctggggctttggaactcattccttaagattcaagaggtgattggaaggcagcatgtggccaagtgtggtggttcacacctgtaatcccagtactttgggaggccaaggtaggtggatcacctgaagtcaggagttcgagaccagcctggccaacatggcaaaaccctgtctctactaagatagcaaaaattagctgggcttggtggtgtgcccctgtaatctcagctacccaggaggctgaggtaggagaattgcttgaacccaggaggcaggggctacagtgagctaagatcatgccgcagcaccccaacctgggtgacagaatgagaccccatctcaaaacaaaaaaaaaaaaaacagaaggcagaagagtcccaattagaaaacaaggactaaatctggatctcacatgactgaatgctgctctaaagcccaagagggtttattcccattactggcaagttttgatggattagctgggtaacctgatagtacagggagtacctacccatccacgacaacgttccactgggggaaagagtctggatccatggtggacgtcgcccagcagtcatctaagaccagcttgatgttggggtcatccctgtttaggactctcacttccatgtaaattggttggcggaggaatctcactagagggtactcgttttccccataaggttgttggtaggaattatctgaaattgaatggtattcaagtagttaatggctgcaacacagattcataggtcatcactgctccattagtctggcagtatcaggatgttcattttagggagaagtttgagatcatttaagcaatttcacagactgcaatctcttacctgggtagctttgcaggatcaaggtaaatggacccaacttcactgaggccactggaggagtaaggctttcaacgttgatgtttagtagcatgtcattcctgctataagaacacttcactgtcattctgtaagagtttggagggaaggtaggtacagaaaatttcaggttaaaaaattgcttgagtttaaactagagcttaagagtcaaatagcaattttatctcacctgaactcactgtctctagatattttgcttggaggaaaatccgtccagagagcatgtatttcgttttcatagacgactttatcatcttcgaacttaaatgtcagagaaagtgggttagcagccagttatgtcaaagatgagacttaacctcgtgccatctgccagtactaaccttatatctcgttccacatccattcaggggtatgtggaaccgtaccagcccctgagactgagcctcaaagacaggctggcaggatgagtttcccaccctcagagtacccaggtcaagagctggttgtgtttggtagctgtagacctcgacgtccataaacccatcctgggtgcacagctcccctgtaactagacagcggtgaaagtttagagaaaataagtttgtctgccctgtgatactgtcatctcccaacctgatatgctacgagggagaaattctaatttagcaggaggcatcagaatctgtcttgaagtctttatgagggaaccttgatcagcagcttgaattacaaagggagctgaagttagttgattgttctatgtgagagtaggacttttcatccaaaggagggaccagtagatgtaggaagaagtgctatatggtataagaccagtgagaatcctgatgaagggcaggagttgactcaaggttaaacttaatgtggctttaagtacagcgcctatgttattgtatcctttctttgtatactcacaaatcctgagtagtttggggagaaactgaggcaggagctggttttcctatttgatctgacctgtgcagatcacattaaacagaagcacatggtggaggcaatgctaaacaagagatattcactctatttaagaatttgtaggaattttggggtgggggggtacttaaacttaattctaattagaagtttgaatattcttacctagatgtcaggttcaggctcctaagccaaaatatctagattgtttaaccatggagcagttgccataaaacctacctatgtagggatcttaaaaatatcatacttaggaccccatcgtagcagctacactgtttctaatctgactagtctttagtttcttcagtctataagcaatagatcagaatctgaccttctatacatttgcccacatgtacaagagccaagggagaaaaaaggtagaacatgattttaataaaaggtctttacctatagaaacgggtgactcacagagacactcaggatagatcaccatggatactgtctctggccgaaggagaaaggtcagcttgagtgaagctaagtagaactgatggagtaggcatttttcagataactgaaatgagaaaatgtcaattagcagccacagtccgttggggcccggaaccgtcacagggaggcaggaagcaagtccactaaatacttgcaggacacactccagacttatctgggctccctttaaaccaaaacaagagagaccctatcacttcctcagatctggatgtatccccaggcagatttattgctttaaactcatgccctggagtacccagcactgtactctttgtacgaggcactaaagcttgaattagcagatcaaattccaaagaatagtggaatcctctgccaagccaggtctgagtcaaaaggactctacagatgttataaaatggtattgcataatatgtacccccaacctaagattattctctggtatccctggcagttctagtgaagactaacctcaacagcaacagtacgggacccttttgtttagatcaaggtgtcctgttcgttgaccaggacagattcatcattaggtatttgacaagtagttgctactactcagttggggccttagacagttttaagacttagaaagacttagacgatttttcatgacagaagttaaagaggttttgtgttagagaatgaactttagttacttgatatttcacttatacaagatgatcaaatgaggccttttggagtttgaatctgttatgttggcaattagagctcacgggcaagttatcagccgtatgaggactacccacaagagtatacttcaagtcaggacccggtggagttcagtggttgacaattgaacatactttcgttttgagcagagttttgctgaaatgcaatttcatgccatttgttgcttctagatcaattccattgtcatgcagctggctcacatcaatgttctggttttcaaagctcacagacttaagcttcccaggaaactctggtatggtgagagtcatgtgtgtggcattgcaggtcacaggatctagaaggaatgacaacagaatgcccattaccagccttgattaagcttctaggacaatgtctcccacactgaggttgcagctatctgggaccttacctggtgcacaaatagcttgtgaagagaagatcaccttctgtccaggagatataaatgtaagcttcagagacaccatgtagagatgactgttaccttgctagggggagaaataacagtgatcttcaaaaacattggttacttgaatctctaaccagtaagaatcatcttggcaagtatatatccaagtaatgggcactactttgacacaagtaggatttaagcatttgtctaatgactaatttgtctaatctggaggtatattagttttaaccttgttctaacatctggaagaatgttgtctagatcacctgtagccaatgacttctaggcagataagatctgtccttaccccatatgactattttaaagtatcagcagccagacaatgttttcaagcctcaatccatttgtgttcttactgggagataggactgttcttgaagtggttggcatttgagcacttacatctcaggacctgtcctaagtactttaggagattaattcatttagtgcagtgttcagactattggcctggaaagcaccaatacttgctataaaacaatataggacaatgacaacccaaacagaaccccttaacccataaagctttcaggaatatgcttgttctgtgttgtactatagatttaagactatgggaaagagactagattgaggtaaggattatgtatttttgagaaatggtctcgctctgtcgcccaggctggagtgcagtggtacaatctcggctcactgcaacttctacctcctgggttcaagcgattctcccacctcagcctcctgagtagttgggattataggcatgtaccatctcacccagttaagtttttgtgtttttagtagagacagggtttcactaaacagacagggttggccgggctggtcttgaactcctgacctcaagcgatctgcccgcttcagccttccaaagtgctgggattacaggtgtgaatacccagcgaagtgtttggcacttaataggcattaaaatgggttgtattataaattaatgtgaagacatggttgagatcatgcttcaatttaggaatactggcctgtgctttggtggtacaaagccagacttccacacctaccacatagtgagtcactccagtggcattgaatggcacatggaaggtcatcctgtggttgtcaatcaagaggctgaagccttccttcatggcctctggcagggtcagagttttggctcttgcaccatcaccaacctcaatgctccatcccatctgaactttggtcccctgaagtcaaaaagctttgtttagagggctggtgctcccttaaccaagtctctggtagtctaacaatttatcaggttaaaggtaatatcacctttaacatagaattaaaggttattaaggtctgatttttaaaatttgcttcataccttactgtcgtcagccaagccagagaagacccgtggcaaggaaaactggaagaaaagaattgtgatgtaagactttgatttggaggtagatgtttccgaattcatgccagaaattgctgtgtggttgtcataccaaaaggcctgctgtgggatgcagtggaagaagcacatgaaccctgactgtgcccttagatgtcattatacttctttgaacttctgatcccaagaggcagctggaagatctaagctcctttccagttgtaagttgggacacatttctccccccaagatagagtttcgctcatcgcccaggctggagtgcaatggtgcaatctcggctccctgcaacctccgtctcctgggttcaagcgattctcctgccccagcctcccaagtagctgggattacaggaatgtactaccatacccggctagttttttgtatttagtagagatgggttttcaccatgttggtcaggctggtctcaaactcctgacctcaggtgatccacctacctcagcctcccaaattgctgggattacaggcatgagccaccatgcctgaccaggacaatgttcttaaacgtttgccctttcaccaatgtccatagaaatcaggtactatgtaaaagccatgcagttctatcattgttattgagttgcttttatgtcagtgttatttttagttgtccattgttgacattagccatgttagactctaaacccatgaagatgtgactgggtcgttttgttcacttattgtatcttagcatctagggtagggcctggaacatggcatgtattccatttgtcagatgattagtgtgagtgcaactaccaataaaaccctattgccatgcatgatgtgccaagtaccatgtatataccctcagtaaattcttagagccaccctgaggtaagcattattgtcccatcactttggacttggaaacaaagcctcagggtaaagttaaacctcatcacacagaaaattagcaagtacaggattaaatcatggtctgatttctaagccccgccctggttagatcatcatcatattccccctgcagtagccatataccccgagcagtcagcccgtttcactcacagacatgaaatccttctggcagattgtagatgctgaaagcccctgggtctcttctacttgcatagctggacagaagaactgatacatgacagctccgtgtcttaaggcagcactgttgttcatgactctgatggtcatctggtgtccaccatgctgtgtacagatagcacagtgggaacagagtaagtactgtacccccatgggattctagaataccatctgacccatctgagtgggaaaacccttaaagttactaataccacaagtgctggaaggtacctcattcccgtaccaggagactagctagcccattgtaatctgttagtgaagactcatgctgataggccagttttagcatcaggaaatggagttcagtttctatttctcttatgtgtaccctatgtctcagtaccatggtcctggctgaatggggttggtatggggcttctacccaggttatctgaatacttgttaagcacctaagtagctgccattgtgctgggtagagctacccttgctattacccctgaccttaggaaactcagtctaaaagcaggggtcagccaacctttttccattatgcattagcaactgttttagactcatgtgagccacatgaaatccatagcatatttccttaaaagaactttaaaaagataaaagccagctgggcatggtggctcattgcctgtaactccagcactttgggaggctgaggcagactgactgcttgagctcaggagttcaagaccagcctgtgcaacatggtgagagactccatctctatatatatattaaacacacacacacacacacacacacacacacacacacacacacacaccacaaaagttagctgggtgtggtggtatatgcctgtggtctcagctactgggcaggctgaggtggtactgagacatagggtaggggattgcttgagtccgggaggtagaggttgcagtgagccgagattatgccactgcatgccagcctggacaacagcaagaccctgtctcaagaagattaagaagataaaacccattcttagtttgaaaaccaaaccaaaacaaaaacaaacaaaaacacaaaaaaaacccatgaactaggcacagtggttcatgcctataatcccagtgctttggaaggctgaggtgggaggatcccttgaggccagaagtttgaggccagcctggacaacatggtgaaatccccattttgacaagacaaagattagacaggcatagtgttgcatgcctgtagccccaactagttgggaggctgagacgggagaatcccttgagcccagcagttctaggctgcagtgagccatgattgcagccactactttccagcctgggctacagagcaagcctgcctcagaaagagaccatggactgcgtttggccatccacaggttatggcttgcagacccttagtctaagggaatgcgactccaagacctctaatgttgagaaggtctgttttagaaggaaattatcaggtttttcatgaaggacctatgattacttcattgattgatcacagagggctttaggggaccagatgacttacagttcaagcctgtttacagagtagggtctaagactgtatctgtacaaagcttagactgctgaccacctgcatcgtaatcagatggtatagactgttagatatgcagattcccagaactcaccccaggcctatgtccaactagtcaaacccaaactttccaaattacaacttgctagcttctgcttagacaggttgcttttattgctcctaatattcctgattgggcaatactgttgcttggcaatagaaaaacccttactgcttagctgctgtttgccttttaacacctgtttctataggtcagatttctatttgctagcaccaaaatagccttccatctcatgttggggttcacagatcaaaatagctcgtgtttcatcacttgttgtatccaggttctgcaccaggtcttaatctgtagaacatcattagtcttcattacccccatggagcaggcaccattactctcatcttctaatgggcaaacaggcttgaaagggctcacttggtggaaattacacctgattagtggtagagccagggctcaagggctcaagtacttgaatgccagggtttctcatcctcaacactgacatctcagtcctggtaattctgtgttatggggaggagacttgggtaatgttggttgtctgccagcatctttggcttgtatccattagatgccagtagtagctcttctaccttcagttgtgataaccaaagatgtttctagatgttgtcaaatgtcccctggacagattccccccaccctcctccagacagttttgctcttgttgcccaggctggagggcaatggagcaatctcagctcactgcaaacctctgtcccctgggtttaagcgattctcctgcctcagcctcacaagtagctgggattacaggtgtgtgctaccacacccagctagttttttgtatttttagtagggatggggtttcaccatgttggccaggctggtctcaaacttctgacctcaggtgatccacccgtctcagcctcctaaagtgcagagattataggcgtgagccatcacacctggcctagacagattataatagaaaagaagagccacacacgagacaccacccccttggttgagagccactgctttactccaaagagaaagttcttagccaagtttactgccagtaactcttaggttactacgtacttccccaagaactgctcaaagcaatgacttaccactctcctggtacagttatcataggtagccctcagggtgagcttttctgggtccaggatgtaagtgcagttcggcatgtcgagaccaagaggatctgccaaggccagagcaggttagacaggatggctgagtacatttcagtgacagtccaaagctatagagtcaagaccaccagtccatttctaaggtacttcagtcccttcacttccgccccaactcagtgatagaacttgagctttgagatggtatgacttgcagccagaggcttcccagagatgctggcataagacacactttcgaagacagacaggtcttccatgctgggtggcttcatgcaaatcaggtatccccatggcatcatgggagttggatgccgttgctgcaggagtttgggtactctgctccccaaacaggattgacctaagccaaaggctgtctgctaatcaggactatgaggagataacacacgttacctacccaccacagatgcatgccatttcttggtgccaggactgcttgggaactccactgttatttccctttcatcgcaagtgacagtgcctaaggagcaaaggaagcatttgggggctttgagtcatgagtgatgcaactcctacaaaagtgtatagactcctctcagatgggagggattccagatgagggaggcaagaatcgtcccctaccctgggagagctcacaaacaagtgaccaagacaacaatacaatatgccaagaactgtaaggaaaatatcaggtacccagggcttttgaagtgttccagtaagaagcccaggttagggttgacaagcaggtctgtaggagccaggtcaacaccttgacagtggagcagatggaggcaggcccgaaaaactgacaaaagctttgtcaacaggttttgcaaattgatgttaaacaaagtcctgggtaagtcccaggacttttatttatttatttatttattttgagacggagtctctctgtcacccaggctggagtgcagtggcacgatctcaacccacctcaacctccgcctcccaggttcaagcgattctcctgcctcagcctcccaagtagctgggattacatgtgcccaccaccacacccagctagtttttgtatttttggtagagatggggtttcaccacattggccaggctggtctcaaactcctgagctcaggtgatctgcccgccttggcttcccaaagttctgggattacaggcgtgagccccggcgcctggctgcatttttttttttttttttaaagatcaagttttgcccatcatctgctactctgcagcctctggctcaggtgaacgtcaagtgagcagctccagttttgcttgttatgtcgatgttttccttaagcatgagtttgtgtttgaagattgctgctcctaaagatgagggcttagtgtggtggtttgctgttctgtggataccataaagcttgaggcagtgagggattggaaggcagtgcaagtgtttgagttttcatttagcaggtatagtgagtctacaggttagcagaagaaagatccagtaacctgaccaaggtaataaagggggtgaatggaggttgtctgagccaggcctgtgtttcttggccagctaggccttccagctgcaacctgttttctctgctaagaagacttctgtcacccaagagacatacctggaaaggcaggatttaccaactgagaaacatctatggagttccctgaagtcacaagggcgaagaagagagaaatcgacctgtaggtgctggaaagagacagggagatagtcaaggaagaatggactttaacaaacaaagctaccataccccctccctccacttccagaattactcacctccagcctgcattgaaccagcctgagggactccaagagcctcctctctgcctgcacgccatagcagaagacactaccagatcaaccaggtagagggtaggctgctctgtgtttttatagcaggaagccagccgcatccacaccctctccccattgggggcacctgaatcttgtcccattctcccagctgaaacggaaggattggggaaggaagtggcctctgattcctgacagcttgcgccgggtattctgccagctgccctgtgggccaggcatgaaatcagagtttgctgaaatcagctccaggtgagtgaattggtgttttccctataactatgggggaaattaggatcttttgggcaaattatttacaactgcaatgtagagccaaagagaatcatgggctttattgagaaaaaaacaagtcttgttcacaccactacattttttttttttttttgagattcagtttcactctgtcacccaggctggagtgcactggtgcaatctcggctcactgcaacctctgcctcctgggttcaagcaattctcctgcctcagcctcctgagtagctgggattacaggtgcacgccaccacacctggctaatttttgtattttgagtaaagattgggtttcaccgtgttggtcagggtggtctcgaactcctgacctaggtgatccacgtgcctcggcctcccaaagtgctgggattacaggcgtgagccattgcacctaccctaaaaccttttaagtaacatctagtcttctggctactgcagaagttaccctgataatgcacaggaagtgtctttaaaaaaatgaatgaagccttgttgacccccaagtgtaaaagcttaagcttaccgcaaagatacaatttcagaaggatacagagaaaaggcaaaagtcactcataatagtgccactgctaatatttaggtgagtaactttagacatgtttctacaaacaccacacacaatttttttaaaacactgggaggaaagtttaaatactgttttgtaatctgctactgtcactttataactattaaacataaagctctctgttaccattttagggtggcataatattcaatttgagataaatctgtgtttatataatttccttaattatgagcataaggtggcttgtaatttttcatcattataagcagtaacatgatgagcattctgatacatatccttgggtaaccctcaagataaattcctcaaagtaaaacttctgggtaaaagggagtagtgatctaataagaatgttatattgttgtaaagcacttggaagtttcccagtggggaaactgaggcaaggcaacttgccccaacaatgtcagggaccaggtggagaactcagatttcctgaggcctgatggttgtgttttttcaacatctctcacactctttgagataactagatgtctgcagcccatgttccaaaataggtggatataaggcttagactccattcaagtggtgggtgacacttgcaattattaggctggtgcaaaagtgattgcagtttttgccgctacttttatgtatgtatgtatgtatttgagatggagtcttgctctgttgcccaggtgggagtgcagtggcgcaatcttggctcactgcaacctctgcctcctggattcaagcgattctcctgcctcagcctcccgggtagctgggattacaggcgcccaccaccaagcccagctaatttttgtatttttggtagagacagggtttcaccatgttggccaggctggtctcgaactcctggcctcaagtgatccaaccgtgtcagcctcccaaagtgctgggattacaggcgtgagccactgtgcccggccctttgccactaattttaatggcaaaaactgcaattatttttgcatcatcctaaactgtattgattcatgtgttgcctttgaggtgtaacctgaggcatctgaaataacattggagattaactgtttccctgacttccttgatcaaaaggatcacatggagctctcattaatatcacagattccagggtcccacccaaaagctgctgaattagactctccagaagatgtgcctgggaaatatttacttaacgagcaccacaggtgattcttataatcaggaaaacctggaaaatacttggagggagcgaggcgagaaaatctgtggtggccagtggttaacctccttacgggaattgagtagattacatcccagcggaattgggaagaaggagcaaaatacagataagtttttggggatagagatggtaaaaggatttcattttatagccaaagcatgatagcaatagtttctccttctatgcatatttttctgaaaagtggcaccttttctacaaatataatttattgccacaatggttaagactatgataagacattagaggaaaaaggagcatagacgtgagactcagagccctattgagaaggtggtcagagaagtgatgggttaatgtgcttattcagcctccctcagaccccacctcccttcccaccgcgctactcactcccctcgagatggtgtctttctccagagcgggaagtttttgccttggaaagggcagctttggtcagagcccccaaatttggggtttctaaaaggttaaggggcagcacagagaccccaagcaggagatgtggtgagaaagcccgctgtgggctggtgaagctggtatgtgcaccagagattaattttgtttgtctcacctaacccagacctgtggtgtgctggggacagccaccgaacaaatggctctgggcccaggagcatccatgtctaggattctgctccggaaaagcaggaagctaccatctgttcagcaactgactttgaacacaggaagaaatagctgctccgtaaaacagtgtctcctatcaggaggtaggaaaaactaaagttattacaaaaatgattcttaacattctgttctcacttataagtgggagctgaacaatgagaacacatggacacagggaggggaacatcacacactgggtcctggtgacaggggttggggggtgggggcagggagagcatcaagataaatagctaatgcatgcggggctcaatacctaggtgatgggttgataggtgcagcaaaccaccatggcacacgtttacctatgtaacaaagctgcatgtcctgtacatgtatcctggaaattaaaattaaatttaaaaaaatattgcgctaaataggcccggtgcagtggctcacgcctgtaatcccagcactttgggaggctgaggcgggtggatcaccagaggtcaggagtttgagaccagcctagccaacatggtgaaaccctgtctctaccaaaaatattagctgggcatggcggcacacacctgtaaatcctgctactcgggaggctgaggcaggagaatcgcttgaacccaggaggcagaggttgcagtgagccaagattgtgccactgcactccagcctgggcaacaagagtgaaactctgtctcaaaaaaaaaaaaaaaaaaaaggcagtaaacaaacagcagacctcgttcaaatatatgtgttccacactcttttcaatgaacctcttaaagtttgctgatttattattacaaggtgttccttctcctcttctctgccctgggttctatgtatcatgaaaccatttctctcttgctaatcacaaggcatttcttgacggggttctcatacataaaagaaagactatagttttgttgttgcctcatttgggcagatgtcttcctttctgaagtgtggttcttataaatgacagtttataattcttaaattctgaatctgctgcccttgttttccacaacaattataaaagtatttataaaagacaacctaaatatcaccatctagagatggttggataaactatggaatactcttcagctactgcaaatgattctatgagttcgttcagatctgtgagtactgacatgaaagatgtctgcaataaaactggaatttcagggctatatatctactatgctttcatgttttgctttaataggaaaatgaaaaacctgtcgacctaaaggaaggagaagagaatatagttttaaagagtttacttgaggcaaagtgtggacagctgcccaggaaacacttccaagttgccttggtgagttctccacttttgtcacaagtgggtgttttttttgttttgttttttgttttttttagacagagtcttgctctgtcgcccagactggagtgcagtcgcacgatctcagctcactgcaagctccgcctcccaggttcacgctattctcctgcctcagcctcccgagtagctgggactacaggcgcccaccaccacgcccagctaattttttgtatttttagtagagatggggtttcaccgtgttagccaggatggtcttgatctcctgaactcatgatccacctgcctcagcctcccaaagtgctgggattacaggcgcccaccaccattcctggctaattttttgtatttttagtagagacggggtttcaccatgttagccagaatggtctcctaacctcgtgatccgcccaccttggcctcccaaagtgctgggattagtggctgatacagtgtttcttgactcattgatttacagaaataacactgattagctgggtacagtggctcacacctgtagtcacagtgactcaggaggctgaggtgggaggatagcttgagcccaggacttttaaggcagtctgggcagcatagcaagatcccatctcaaaaaaaaaaaaaaaacactgattagtgattggctatacattgttgaactatagggtatgattaatggcgtccagcatatggtatgagttatgatgtccagtgtatggcatagttaggttaattttatggctacttggtgtcagtctagagcccacatatcaagtagctccaagagataattactgagcccgagggagtgaggtgtgactgctgtcacgtttcaatgcctctctgggcctgataatttaaagggacttgcattcttcagataaaaagtttcttttctttctcaaacttatgtgtatatttatactttatgtgtctgcatgtgggtctatacatatgtatttggattacaagtcaagaaagttgtcccagagaatcgacagcatcatccaggaaaggagagggttgccagggtccggggagtccacgtggctgtgctgggcatttgcgaccattgtctattctgacttgttcgtgcttttgctgtatgggttttaaatacattgaatatcatcaccgggaataggattaaggagatgggagggttggagcacagaaaacaattccccaaatgtgcctgggcatgccaagtgctttggaaaattaaaaggcttcagaaataagcctcagaatcaaggtctctctatccttgccttgttccctttccacccccaaagtacaggaaggaactctctctggggaaaaaaaaaagaaagctccttcttttttttttttttttttttggcagggctttggtcttgttgcgcaggctggagtgcaatggcatgatctgggctcactgcaacctccacctcccaggttcaagtgattctcctgcctcagcctctcaagtagctgggattacaggtgcacgccagcaaccatggctaattattttttttttcttgtatttttagtagagacagggtttcaccatgacggtcaggctggtctcaaactcctgacctcaaatgatccacctgccttggcctcccaaagtgctgagattacaggcatgagccactgggcccagccaaggcagcttcttaacagaagaaacactattgccttctatcccctccctgaaatctcattatctatagcaggaaaggagactaaggaatgtaaccacacatggacagacttttccacaagataatgtcagcctctgaagctcagtcaaattccaaagataattatgtacaagttaatttctctctccctggtctgttcattctccctgataatcattattgcccctcaagagaattgtctacagtccccatctcctccctcccctatgaaaaactgtatatacagccaggcacggtggctcacacctgtaatcccagcactttgggaagccgaggcaggtggatcacctgaggtcaggagtttgagaccagcctggccaacatggcgaaaccctgtctctactaaaaatataaaaaattagccaggcatggtggtgtgtgcctgtaatcccagctacgcaggagtctgaggcaggagaatcgcttgaacccggcgggcagaggctgtagtgagccgagattgcaccactacactccagcctgggcaacagagcaagactccatctcaaaaaaaaaaaaaaaagaaaacccaccgtatatatgcatctgtgccccactgagggtttaggggcaattactctgtgattcccaccttcccctgcacattaataattttgtatgaatttttctcttattcatctgcctttggtcagtttattttcagtgaactttcagagtgcaaaggtgggagttttcttccttcagcccttaaagaataagtaactcctgcctttctgactttgagggagaagaaaaggaaaaatcatttgggataaacaggctgcacctgcacacagataagcaactttgtctaattagcgagctcctaggaaaaagtttcctccccttttcagacatatccatggtgggaacttacacagggaggaggggggcttacctaaaacaaacccgcagttatcaaaacaagagacgcaggctttgtgcttgcctagatacatgcccacagttgcgtaagataccgggagttgcacagacagctttactgatgagaagttactcaaactgctagagatgagagaggagtttcttaaaaaagcttttgaattcagctgtaacctggcaatccacttggactcccctctctgctgcagagaatttttttctttcacttattactattcttttttgagacggagtttcgctcttgttgcccaggctggagtgcaatggtgtgatctcgggtcactgcaaactctgcctcctggattcaagagattctcctgcctcagcctcccaagtaactgggattacaggcatgccccaccacactcggctaattttgtatttttagtagagatggggtttcatcatattggccagactggtctcaaattcctgacctcaggtgatccacccacctcggcctctcaaactggtgggattagaggtgtgagccaccacacctggcctctttccctcattaaactttcactccaacccacctttgtgtccatgttccttaattttctaggaggtaggacaaagaacccagggtactagttcagacaatgagaaagtctacattaaggtgcattggtgaggttccaacaactttattccctctgttttggttgaattgttttagtgataaaataaccaattaaataattatagactgggcatggtggctcacgcctataa

SEQ ID NO: 53 - DNA, 164910 bp, Homo sapiens
gcttgtggagccaaaaaagcctctttaagccctctaactcctgtcactgtgagggtgaagaaaggccaaccagtgagaagaaatgagagttttctccactacgaggggtatccttttaacacctaagtcagattctatctgctccaaaccctccaatgacttcccatttcagagtaaaagcgtgcctagtgactggggcccactaggtgctctgcaccctatgccatctctcttgctcctgtcctgcctgtcacctccccccctccccatctcctctcctacccacctccgtgactcacagtgttccaggcacgctcacctcatactgtttccaggccgtgcccacctgctgctgcttgggtcctgtgcacaagctgttcccgctgcctccaatactcatcccctcgacttctatggagctgactcttcaccttccagccttggctcaaatgtcaccttcacagtaaaggctacccatggctgggtgtgtggttgtgcaggatctgccccttccaaagggccagaatgggtgagtgctctgcttgtcaagaaatgcaccctggggctgggtatggtggctcactcctgtaatcccggcactttgggaggccaaggtgggtggatcatttgaggtcaggagttaagagactagcctggccaacatggtgaaaccctatctctacaaaaaaaaaaaaaaaaaaaattagccgggcctggtggcgggtgtctgtaatcccagctactcaggaggctgaggcaggagaattgtttgaacctaggaggcagaggttgcagtgagtcgagaccgcaccactgcactccagcctgggcaacagagcaaggctctgtctcaaaaacaaaaacaaatgcaccctggtgttaggctgcatccatcccattagtggacaggggtagcggggaggtttgttagattcaaacaagtgttttatgggcaagcagccccaccccagccccacacaaaccacactccctatccccattactctggctaatttttcttttcatagtacccatcaccttctaacatattatataatttatttacctaatatatttattgtctgttttccccctagaaaaatgaactcacttctgttctctactacactaaaacaatgcttagcacataaccaggacctggcacctatttgttaaatgaatgaatgaatgaatgactaaataaatgaaaaaaaaaaaaaaaaaacaaatgaactcacagtttggaagccaagagacagaagagcctttggacctaatatatatttattttctatcttatgcttgagtgacacctcctagaactattgatgctagagttgtccagagtatatcggtaggatagagcggctggataaggaagagcggaaactaataaaaagctctcatcaagccctccacttttttttttttttttttcttgagacagggtctcactctgtcacccaggctggagtgcagtggcgatcttggctcactgcagcctcagcttctgaggttcaagcaattctcctgcctcagcctcccaagtagctgggactacaggcacacaccatcacgcctggctaatttttgtatttttagtagagacagggtttcaccatgttggtcaggctggtgtccaactcctgacctcaggtgatccacccacctcagcctcccaaggtgctgggattacaggcatgagccaccacgcccaggctctcattgctgatttttttggttcagttgataaaattcttctaaatgatttcagttcactttggtgctgctgttgctggcataatcttcctcagggaaccatgaaaagcaagtggtaaaaagcctttcttctcagtgaagctataggctcaacaatttgccgtctttgctacgagatcaatttaaactcaggtacatgtgattatctattatcttctgaacttctttatgaagtttctggctattcatccagctctaagactgacttcctcactagtttctatgttaatttatttttttagctcataaacacgcttgtacttaaagcaataccttaatttgttgagcaattactgtgtgccaagcagcagtctaagcactttctttagctaacaactccaggaggtaggtattgttatgatgattcccatttgcatgtagaacacagggtcagactaggcggtggctcatgcctgtaatcgcaacactttgggaggctgaggaaggaggaattcttaaagccaggagttcaagcccagcctaagcaacctagagagaccctgtttctacaaaaaatgtaaaaattagtcagacatggtggcatgcacctatagtcccagctacttgggaggctgaggagagagcccaggagtttgaggctgcagtgaactctaatcatgccactgcaccacaccctgggtgacagagcaaaagcttgtctaaaacaagaaagcaagcaagaaagcaagaaagaaacagggtcacagaggaaggaaggaaggaaggaaggaaggacaaacagggtcaaagagaaagaaagaagaaaagaaaggaagaaagaaagaaggaaagaaaggaaggaaggaaggaaggaagaaagaaaagaaagagagatgagagagaaggaaggaaggaaggaaggaaggaaagaaagaaaaagaaaggaaggaaggaaagaaagaaaggccggacgtggtggctcttgcctgtaatcccagcactttgggaggctgaggcaggtggatcacctgaggtcgggagttcgagaccagcctgaccaacatggagaaaccctgtctctactaaaaatacaaaaaaaaattagccaggcatggtggcacatgcctgtaatcccagctactagggaggctgaggcaggagaaatgtttgaacctgggaggcagaggttgcggtgagccaagatcgcgccattgcactccagcctgggcaacaagagtgaaactccatctcaaaaaaaaaaaaaaaaaaagggggagagaaagaaaggaagagagaaagaaagaaaagaaaacagtcacagagggattaatttctctcaaattatactattaattagtaacagaacaagaaccagaattcagatcccattctataagttattactttatatggttccacttagttagaaaattacttcttttttctcaatgtcctgactgctgactggtacttccaatgctttagaaaattgaattcagttcaaagaaaagaatacagctatttcttttcactgatgggctctgtcctacgttgacttcaccccctcaattcctttttaaaatacaagcaaaactaaggatttgaaaaacaagtaggttctccaagccacagggctcccttaagactgaacacgttcaaagctagagatcctcccaaagcaaaatacatgagctactaataagttcggccaatcaaagttaagtaagcatatctgcctctaatttttctaatacaaaactcagatgggggcagctcatcatttcattagcctggcctttcagtgaactccggtgtcttcatcctctcaccaggatgtgtaccttcttgaagggctcactaaaaaaaccagagtcttccacctccaggctcactgcaattgatgcatagataaaacaaatgtcggatagccatccaatggattagtatgccgccataaaaaggaagcactcactactgatacaagcttcagtgtggatgaagactgacaatattgttcattgaaagacaccagacacaaaagatcatatattgcatgattccatttctataaaatgtccagaatatgcaaatccatagagacagaaaatcacttagtggttgggaggaaatgggggaaggtgagaatgcggagtgactgctaatgggtttctttttggggtaatgataatactcttgaattagacagtggtaaggattaaacaaacttgtgaatatattaaaaacttgcattgtgtactttcaaagggtgaattttatggaatgtggatatctcacttttttttaaaatgaaagaatgaaaaaaggtggcttctgtctcatctggactcctacaatttttttttttttgagacggagtttcgcaaatttaattattgataaatatacctgagagatcactgcttgccagccctgtactggcactgagttacataaaggaataagaccgtccgggcgtggtggcttacacctgtaatcccagaactttggggtgccgatgtgggtggattgcttgagcttaggagtttgagaccagtctggacaacatggtgaaactccgtctctatcaaaaaatacaaaaaattagctgggtgtggtggtgtgggtctgtggtcccaactactcagctaacttgggagactgaggtgggaggattgcttcagcttgggaggaggaggttgcagtgaatcgagattatgccactgcactccagcctgggtgacagggtgagattcgtctcaaaaaaaaaaaaaaaaaaggaataaaacccaagcccgcacacacttcataggctaaagggagacaaataagtaaatgttctattataaccaagggtgagctgggtgcgatggcccatgtctctaatcccagcactttgggaggctgaggctggcagatcacctgagatcgagagttcgagaccagcctgaccaacatggagaaaccccatcttgactaaagatgcaaaattagccaggcatggtggcgcatgcctgtaatcccagctactcgggaggttgagacaggagaatcgcttgaacccgggaggcggaggctgcagtgagccaagatcgcgccattgcactccagcctgggtaacaagagccaaactctgtctcaaaaacaaaaactgagggtgatgttgtaatggaggtaatgccaaattaacaattactggtgcttaagttatattagatactgttctaagtgctttggatgtagtaagttatttattcctcttatcaatcctatgaagtggaaactcttattaacattatcgcaaatttagaggtaaaggaagcaaggcacagaaaagtgatgcgaccacatatatgcctgtaaagcagcagagctaggagttagacctgagcaggctggctccaagtctgtgcaattaagcaggatattccagtgcttagagacaggcacagggtgccctggggacacaaaggagggccacgtaagcctgcaaggaaaggtgtcacttataattcacatgcatatttggcctagatttttttttctttcatttctctatgctgtcagggctacccccactgtgcacagcagaataggcttgcttacacgtggatgtggtcaagaaagggaatgaaaaaaaaagggagggacttcttactctgcaaaccacagttctttcagcctgagcatcatggggttcaccgtgtgcagatgctcctcgttccacttcttggcgctcctgtagacactgtgccagggcacaggggcccggatcactctttgaggaaacaagcgggggatgctctcaataaagagccgttttctctccattgggtccatgaggatgtaatcaactacaaccggaaagggcgaacacctcattattaagctctaagggttgtgctcttagcttcaactcatttagttttgtttttaatatagagacggggtctcactaagttggccaggctggtctcaaactcctgggctcaagtgatcctcccacctcagcctgccaaagtgctgggattacaggcatgagttgctatgcctggccttagagtcaactctttttatttatttatttatttattttttgagatggagtctcgctctgtcgcccaggctcgattgcaatggttcaatctcagctcactgcaacctccacctccgcctcctaggttcaagccattctcctgcctcagcctcctgagtagctgggattacaggtggctgccaccacacctgcctaattttttgtattttcagtagatacagggttttgccatgttggccaggttggtcttgaaatcctgacctcaggtgatccacccgcctcggcctcccaaagtgctgcgattataggtgtgagctagcacacctggccttagcttcaactcttagaatataaatgagcctctgtccatttgcaaggtcatgggtaatcccctgggtataattcaactggtgaagcttcactcttggtgtttgttttctttctgagggtattttacagaaaggaggagtgtgacttcacggtgtggagcacttagaatctggggttgagccctggtaggatgtctagtatcaggcaggacaatgaaataggatttgctgataactcattagtcactgattgatttctcacaccaaaatagatgcacacaaaaaaacccaccatggatgataccatccattatatttacaaatagaagtttaaagaccaaatgttttccatactaagaaaggttggtagaaaagcttcatagaggatgtaacatttgtgctgggtcataaagaacaagtagcaggctgggtgcggtggctcacacctgtaatcccagcactttgagaggctgaggtgggtagatcacttgaggtcatgaattcgagaccagactggccaacatggcgaaaccttgtctctactaaaaatacaaaaattagctgggagtggtggtgcgtgcctgtagtcccagctactcaggaggctgaggcaggagaattgcgtgaacccaggggtccgcccaggtaggtcttgaaatcctgaccaacctctgcagttgcagtgagcagagatcacaccactgcacttcagcctgggcgacagagcaagactgtctcaaaaaagaaaaaaaaaagaagtgtagaatctcagccaggtgtgatggctcatgtctataatcccagcactttgggaggccgaggcaggaggatctcttgagtccaggatgttcaagacaagcctaggcaacatagggagaccttgtcgctaaaaaaaaaaaaaaaaaattgttttaaacttacaaatgtagaatctcaggccccaggttcagatctactgaatcgcaatctgcattttaagatctgcaggttacagggatgcacgtgaatatgtgaagtgctggtgtagacatcagtgatggtagggggatgcaggactttgaattagcggttaaatgatgttttgggtatttccagtggaatcagggtggcaaatgacaaagtgagaagaaagaagatgccttccaggccaggcatggtgcctcatgcctgtaatcctagcactttgggaggctaaggagggaggattgcttgagcccaggagttccagaccagcctgagcaacaaagcaagaccttgtctctacaaaaataaaaataaaaaagaaggtgccctctacatagaagctccccagccccctttatgcccaccagccttaccgatgcttttcatgaggctacagtaatagtcattctccttctcctgcacgaggaccaccatcaggggctccaggaagggactcgtcagcagcgtgttagaaatcagctttgaaatccgaaccatcacttcaccctcctcaggggcaatcatgtctttgcgaattccattggtcagatagtaatagtatctcttccataaacaaaccaccagcgagaaaatggtcatgattggatcatgggttcaactgtcctgcccatcagctgccaagggaccccattcatacagcattcgtctgcacccttcacttgccataaccatgcattctgggcctgtcgcttcacactcatggcaagaagatcactggcaaattttccccaggacttcagaggattcaaccaaagccagagagatgtcagtggggtataaggaaggatttgtcaaataccacccagataggaacagtggagtgagtacagagtccagggatggaggtggcatatctggtgacctttaagaagaggaataacaggccaggtgtggtggcttacacctgtaatctcagcattttgggaggcaaaggtgggagaattgcaaggtcaggggttcgagaccagcctggccaatatggtgaaaccccatctctactacaaaatacaaaaattagccgggcgtggtggcgcacacctgtagtcccatctgctcaggaggctgaggcaggaaaattgctggaacccaggaggtggaggttgcagtgagccaaggtcatgccactgcactccagcctgggtgaccaatcgagactctgtctcaaaaacaaacaaaaaaacattagattttcctgatccagagctagaatttaccccccggaagctttcactcactggtcctgattctgccttctaaggtagctcagacaaacagggttggatttctgtctaaaaaaaaaaaaaaaaaagtaaaggaatgacaagctcctaaaatggcctcgaatcacataccctcctgaacagcaatgatctcctacaaaacactttgatcccatggcttctagctgtcagtggggaaaaataaccccaaagtccaagatctattgttgttcttttttttttttttttgacacagaatttcacttttgtcgctcaggctggagtgcagtggcacaatctcagctcactgcaacctctgcctcccgggttcaagcaattctcctgcctcagcctcccaagtagctgggattacaggtgtgcaccaccacagccagctaatttttgtatttttagtggagacggggtttcaccatgttggccaggctggtctcaaactcctgacctcaggtgatccacccaccttggcctcccaaagtgctggaattataggcatgagccaccacacccagctgatagttcttcttacccaagcaagggcttttgagtttcaaaagcaacataaacacacaaatgaaacaaaaatggccagtggaacctagtgacttcaggaaattttgtatatttagggtttgcctctgagctgctggatggctgagtggctctgggaatgactaatgtcagatagaggagaagcacagagtgtgaggaaagggcttgaagtctgtttttaagtttcagatcagaagaggttgctggccaggcacggtggctcatgcctgtaatcccagcactttgggaggccaaggcgggtggatcacctgaagtcaggagtttgagaccagcctgaccaacatggtgaaaccctatctctactaaaaatacaaaaatcagccaggtggggtggtgcatacctgtaatcccagctactcaggaggctgagacagcagaattgcttgaacccaggaggtggagattgcagtggggcaagatcacgccacagcattcaaacctgggtgacagagcgagattctgtctcaaaaaaaaaaaagaaaagaaaaagaggttgctgctgccagcctctttgttactctcgcctctctccaacgttagtaaaagcagctgctaacaggggagtattgcaaagcttttctgattttaagaactgcctgggtgcagggtgggggtaaaaagtgcttgttaaaatgcagattcccaggcccctcctcaggcagttagggtgtttaccaaggaccccaggtgacccttatcttcaggcaagtttcagaaatgctgcacagctcttaagaacacagagactggctgggtgcggtggctcacgccataatcccagcactttaggaggctgaggtgggtggatcattcaaggtcaggagttcgagaccagcttgacctacatagtgaaaccccatctctactaaaatacaaaaattagctgggcatggtggcagttgcctgtaatcccagctacttgggaggctgaggcaggagaatcacttgaacccaggaggcagaggttgcagtgagccgagatcgtgccactgcactctagcctgggtaacagagcaagactccctctaataaaaaaaaaaaacaacacagagactttggtatcagccagaccggctttcagtcttagttttgtctcctaccctgtagccctaagcacattgcttaaacagtctatactccactttccgcaactggacaatagagataatcatagaacctgggtctcaagtggggtcaagtagctatagagggtttagcagggaattttgccaacagcacatagtcactgtgagtttttattaatcattttattatacaccctaaacccacaagacatttgctctaaagttttattgttcttttaagacgggttggaaactccaacatctatctagagccaggcaggtaatgttaataagtgaaagttgtctagacctaagaaaataataaggaatggtgggaactatgacaaactgaagagtgtatttctcatctaaaggaggtagctactgcttagcaccaaatattttagttttctcaagagaagttggaaaatgtagcttgagactttcctcatgcttttttttttttttttttttttttttttttgagatatggtcttgctctgttgcccaggctggagtgcagtggcatgatcatagctgggatgcctgaggtgtcagagaaggggaccaagggataggttgtcttgtcctagaaagggttgtgaatccctccccctaccctttttttgagacaaggtctcactctgctgcccagactggaatgtagtggcacaatcatagctcactgcagcctcagcttcccagggacaagtgatcctcccacctcagcctcccaagtagctgggaccacagatgcatggtaccatacccagctaatttttgtagagattgggtttctccatgttacccaggctggtcttgagatcctgggctcaagtgatcctccccattcctcctcctaaagtgctgggattacaggcatgagtcaccatgcccagccacctcattctttttttttttttttttttttgagatagagcctcgctctgttgcccatgccgaagtgcagtggctcaatcttggctcactgcaacctccacctcccaggttcaagtgattctcctgcctcagcctcccgagtagctgaaattacaggcgcctgccaccatgcctggctaattttgtttttgtatttttagtagagacggggtttcagcatgttgaccaggctggttttgaactcctgacctcaagtgatccacctgcctcggcctcccaaagtgctgggattacaggtgtgagccaccatgcccagccacctcattcttaaaacacatctacaggccaaattcagcctatgatagagatcccatataaaatatgggatgctttgggatatacttatactaaaaagttattcattacctaaaatttgaatttaactatgtgtcccattttttgtcttgcaaaatctggcacccccagcctatgggccactatttttgcaacttatattctaaaaggactcaaggtatcaatttccatcacttactagggcagagaacatgtacacacactctctctccttctctctcactcgcacaagcacacaaacatgcgccctcttcagtagcctgtcttgggtctagactttggtgtttttcaaacatttcccaggtgattctgctgttctccctgaatttagaatcactgagatgccgagagtaaccctcagcaaaccgagggaaagggggcaacaggaacgtacctccaggtccgattcagatggcttcttttctttactttccatttccatctcctgctgtaacatgacatcgagctgctgttctggactcattggtctgcttcctgggaacgtcaaagatgtctttacctccttcttcatgggtgagaagattgacgtcttgaaggccaacttgatcctgaaaagtagacacagctcagcccttggtgtttggttctccagagaggtgctgtggtgttgcctactttccctagcctgatgagtgtggttctgcaaatagaagcctctctcctctgtgtcatctaatggcatgtgtgtatacttccaagatgaccctaatgactgaacacctcataggtattttagcatggttttgttcagttggtttatttttgtctacaatctcaaaaagcctggccaacatggtgaaaccacgtctctactaaaaatacaaaaatcagccaggcctggtggcatgcacctgaaatcccagctactcaggaggctaaggaaggagagtcgcttgaacccgggaggcagatgttgcagcaagctgagatcatgccactgcactccagcccgggcaacagagcaagactccatctcaaaaaaaaaaattttttttttgattaaagtgattcgtggataagaatatgattatctgggaatgctttgaagccaagaagcagagtgtggctttagtgagaccacatccttctgttcagcccaccgtcctgccttctctggtgcccacagtgatatcttacctagtggaatcctctttgtttctggaggaaaacttcgtttttttcctcatgggctctgatgagcttctatttcctggaagaatggagaagaaagacatcagtgatgggcaatggccttgggccattctccgtccacaggggcatgactctcggaacagtccaggagcacactaaggggagcggacatggtacggtgtgacgtggcaggagatgtgggctcaggtctcatgtgcatcactgattacctgtgtgaccctgaagaactggcttcatcactccggacctcagcttcctcaactgtaaagtggggatgtgcgtatcttccattcgttcatacatttggcaagaattaataactgcttgtttcatgtactctccaatattgtatgctctattttctaaacacctgttatattactgtttaatatttctctttaagtagacctgggcatttaaacttagtacatttggccaggcacggtggctcatgcctgtaatcccagtactttgggaggctaaggcaggcagatcacctgaggtcaggagttcacgaccagcctggccaacatggcgaaaccccatctctactgaaaaatacaaaaattagccgggcattgcggcgagcgcctgtagacccagctacttgggaggctgaggcagggagaattgcttgaacccaggaggtggaggttgcagtgagccgagatcgtgccactgcactccatactgggcgacagagtgagactccgtctcaaaaataaataaataaaataaaaaataaaataggccggacacggtggctcatgcctgtaatcccagcactttgggaggccgagacaggcagatcacgaggtcaggagttggagaccagcctgaccaacatggtgaaatcccccatctctactaaaaatacaaaaattagccaggcatggtggcacacgcctgtaatcccagctactcaggaggctgaggcagaagaatcgcttgaaccctggggacggaggttgcagtgagccaagatagcaccattgcactccagcctgggcaatgagagcgaaactccgtctcaaaaaatatacatacatacatacatgcatacatacatacataaataaaataaacttagtacatttatttttaaaagaaattttatgattatcacaaataaaaaataagtacatatttattgcaagtagaaaaaccaatatcatttgcaataaatagaaggtagctacaattaattcaataagtgatataaaaactatattattcaactttaattagatattacttcctaaagtgtctatctttgaacttctcaaaatagtccacatataacaacaatacaaaaatcctttttttttttttttttgagacagggtctcactctgctgcctgtgctggagtgcagtggcatgatttcagctcactgcaacctcaaccacccaggctcaggtgatcctcccacctcagtctcctgagtagctaggagtacaggcgcatgccaccacacctggctaattttcctatcttttgtagagacggggttttgtcatgttacccaggctggtctccaactcctgggggcaagcaaccctctcaataaacacaacaatcaaggtacagattcacaaaatggaaataatacagcaataacaatattgctccaaaataaatttttaagatcctccaagtacaaatgtattttaatgaataataagcagaaatcatctcaagcaaggacatgaataacagacaccagtgccgctctgaagaaagcatcttagtactttatattcaaagactctggcttgcctgagaattttggggacaatgaaacctgggaagcaatagcactagttcttcacagatattaataattttggactaagaaaattattaaagactgctacagactgaaagctaatgtcttgtcaaaattagtatgttgaaccttaatccccagcatgatggtatttggaggtgggactcttgggaggtgactaggtcatgagggctccatcttatgaatgagattgtgcctttataaaaaaaacagcaaaaagatttctcaccccttctcccatgtgagcatgcagcaagaagatagagaagacagatgtctatgaatcaggaagaggaccttcatcatagactgaatctgttggtaccttgatctcggactttacagactccagaaccacaagatatgaatttctgtagtttataagccactcagtttatgattctttgttatagcagcccaaaaggaactaagatgatgaccatgaaattaccaattagagcagcaaacttaaggttctgtgtatcatgatcttgaacatttgggcattaattatttgctacatgtccttaaagcaggaacatgcaaaagcagcatcctagagactgtgggtgtgtatgtaatacacaaataacactggtaagaaccacttgggaaaaagaaatcctccaagtgatattgaaagggctatgacaataagaatggaatcaggagttggaaaagggaggtagaaaaccataagtaatcagaaaatttgaaatggaaagatagtcatttaaacaaaaaacactcattagacatgaaaaactcaagactgaacagagttgaagagaaaattagtaaattggaagatgtaattaagaaactcacccagacgtagcacagagaaaacaatgaaaaatataaaaatgagtttgagacagagagcagatcaagagtgccaacatacatccaacaaaaattactaaaggatatccttatgccaatatacctatgcttggtgggaattaaattaatacatacaaggtgctgtggtaagcagcttccaagacagcccccaatgatccccatctcctggtaacacccctttgtggtgtaatcctctccccttgagtatgggctagaactagtgactcctaacaaatagaatgtggcaaaagtgacaagatgtcacttccaagattaagttccaaaaaagcctatgggttctctcttgctggctctctctctttctctccccctccctcgctctaagggaagccagaagccatgttgtgagttgttctaagggagagacccgtgtggcaagaaactggtgtctatggccaacagccagcaaggacctgatgacatgagtgagcctggaagaggatccttccctagttgcctttagatgatggtggccttggtgtatgccttgattgtacgctagtgaggggccctgagccagcactacaaattcagccatgcccacgttcctgccccactgaaattgtaagataacaaatactggttcttttaagccacagaattttggaataacttatcatgcaaacaataacacaagtacatagaacagtgcctggtatatgtaaatggtctataaatgttagccgtttgcaatcatttcctccatagataaggaggagagtgaggctttgcaaagtctccaaagttagcttcagcaaaaggggagccaggatcagaatccaggagtaaaaatttcactccaggccaggcacagtggctcatgcctgtaatcccagcactttcggaggttgaggcaggtggatcacctgaggtcaggagtttgagaccagcctggccaacatagtgaaaccccatctctactaaaaatacaaaaaaaaatagccaggtgtggcctgtagtcccagctactcaggaggctgaggcaggagaatcacttgaatccgggaggcggaggttgcaatgagccacgatcgtgccatggcactccagcctgggcgacagagtgagactccatctaaaataaataaataaataaaaatttcctccaaagccccattctgcaagggtgtgacactgccacaagtacctgatgatggcagcccctgaccggtcctgtccctagggacactgatggtggccggttggtagaccttcagcagatctttcagcttcaggtcctgggccatcaaggagtagttgttggcgatggaatcactgggtccacggtggtgatgctgttctttgaagggtgcagccaaggtccatgacgtgcgttgcatcaagggcgggtaaaagctgtgtgacatgacagtctacgaggtaagaagtgcagagtgagacacaatgaggaacatctctcgatgagcctgagctctgctcacactgaggctcacaagagttccaagtgccttatgctatgtttctgccttctgcacattcagtggaaagattgtctgaacagacaccaactgtacttctctgaccattgtaagcatgaattctgatgtcagggataatagcttgcattcaccagtaattttgaggcaggtaattgacatctctggtctttattccttatggacatgactacaaggtacaagcaattaccctcattttacaatgaaacacgcagaagttcagagagtttaaataacacagcagatcagtggacggccagattctaattcacctttggacaatggcatagctctctctcccacacttctgcagcctcttctgggggcaaaagcgaccaaagctactaatcctacttgtcaggtctgtttgactctccaccctcattgagtacctgccaaatacggagagaagtgggggatgcacttcacctcctcaccctcaacagaagagctggcagccaggtgtgcatacctgatagagtccagacggttcctcattagcagaagcaggcagaggaggcagctctggctgcccctgggagtggctcatgtgatgtatggagtcacttttggcgatctgtgggacatgggaacaaagtcacccttcaaaaattagggaagatttgcaagcctctgagttggttaggactaaagaggtccccaggaaaagttttaggtccagagttctggacctaaaacaaaacactcctctcattcccatccattatgtatgtttcatttatttaaaaattaacagataagggctgggtgcggtagctcaccccggtaatcccaccagtttgagaggccagggagggtggatcacctgaggtcaggagttcgagaccagcctgaccaatatggtgaaaccctgtctctactaaaaatacaaaaattagccaggcatggtggcgtgtgcctgtagtctcagctacttgggaggctgagacaggagagttgcttgaacctgggacgcggaggttgcggtgagctgagattgcactctgagatgtattgaagtgtatatacattatagagtgactaaatctaattatcatatgcgttaccttgcatggttattatctttgcagtgagaacacatctactctcatagcgttgttcaagaatacaatatattgttaattagtcatcatgctgtacaacagatctcttgaacttattccatctaactgaaattttatatcctatgaccatctccccaacccttccactcctgtttcttttttctttctttctttttttttttgagatggagtcttgctctgtcacccaggctggagtgcagtggctctatctcagctcaatgcaacctctgcctccgggggtcaagtgattctcctccctcagcctcccaagtagctgggattacaggtgactgccaccatgcccagctaattttatatttttagtagagacggggtttcatcatgttggccaggctggtcttgaactcctggcctcaagtgatctgccctcctcggcctcccaaagttctgggattacaggcatgagccaccacgcccggcccctgcttcattttttaatcattcagtgtctcctcctcggattcccttctatgagcaaatttgaatatttttcccccgtggaagagcccaaattctgaggacatccccagtaccctaccctcaggtatgattaaaggaggtgactttaaaaacattgactcttgcatttttttttttttgagatagtctctcactctgtcacccaggctagagtgcaatggtacgatcttagctcactgcaactgctgcttcccaggttcaagcaatcctcctgcctcagcctcccaagaagctggatgggtgcccaccaccatgcctggctaattttcatatttttagtagagacggggtttcaccacattggtcaggctggtcttgaactcctgacctcaggtgatccacctgcttcgaccttccaaagtgctcggattacaggcataagccactccaccaggtggactcttgcattttcacatgtgcaaaattccaaagagaaattcactcaggcagtggcactgaattttctgtgtatttaacacacacataagcaactctttatgattcctgcgaaaagaaaaagtgttatttcaacaatgtgggtgttgagtactccattccaaccagtgagtgcatactgtggagtgagcctcaggtaagggtcaacttgtggctcccacaatcactctcagattccaagtgaccctccacctctcctgagcagagaagaaagtgactacattattgaatgaaatcacatgtgtttttgtcttaagacttagcccctatatgcaaaacaaccacttcacctgggactagtgatggagaaactgcaacttgttccaacactagaagaaaagctgttggcctggacttattgagaggtgctgccgttcagcactttaaaggtggtttgagggattttcaagggcaattttgactctctgtgattttcaccttaggcattgactttggacttaactcctatataagatgagccaacatcgtatcagtgtgatttatttgggtgtgcaaattatgacatgcaagatcactgatgagggtgggatggggcagggggcatatgactattagctgtccctctgcccccaaccccttaaagatgactcaaattaaccatcattatctctcccggagcacctacctcattaaataacaacagaaaaacaacaaccgcagcaatactatctaccattattccaaacgattatgtgccaggtactgtacaacctcatgagatttttttcatacccgcattctagctgaagaaaatgagggtgagaagataggtaacacatcctagccatgtaattggccggcttgacttctaagtcagtgacttatttattattattattattatttattttttttttttgagtccaagttttcgctctgtcgcccaggctggagtgcagtgacacaatcttggctcactacaactgcaacctccaccccctaggttcgagcgattctcctgcctcagcttccttactgcatcatgcaaactgacagggacgctgttctcgggataatgaagaaagcaaaccgtgagcattttgcagaacacaatggaaagagggagaacctctgtagaaacaaattaaactaggctatgtcataggcttggactaaaacaaatacacaaacagtcataagtacgctgatagcagaaagcatcccagtctgtcgatcaggaacacatggggcacacacaacatgagcagatctaggcatcaattgcagaatggggctaaaagagttttcctggcaataaatggctaagaatcctctgtggcaccttcaagagatcgagattctcataagaactagctggttgtgcaaaattgtttgttaaaaatatgaatgcttggccagccgtggtagctaatgtctataatcccagcactttgggaggccgaggcgggtggatcacttgaggccaggagttcgagaccagcctggccaacatggagaaatcccgtctctactaaaaatacaaaaattagccaggcggtggcgcacacctgtagttccagctactcaggagactgaggcaggagaatcgcttgaacccagaaagcagacgcttcagtgagtgaagatcacgccactgcactccagcctggataacagagacaaactgtctcaaaaaaaaaaaaagaaagaaagaaaaagaaagaaagaaattaatgcttaaatcttctctttggtaaatttcaaggagctttcacttcagagcatattggcttagttattatctacaaatccactttagttttacaaagtttctatttaaaatgctcctctgggcacttcgctgtatggcaacctggtgattcaacacagatacaacagaaattctggaacttagattgggtagaactgtcactttgggcagcttattgctgattacacatgttgtatgtatgttcttcatggaggccattcccaaatgctcgtctgaggacgtgctacaccagaatcactctggtcttagataaaaatatagattccagggccccactccaaatcttctggatcggaatctaggagtgggggaccaagactctatgtttttaagatgctccccagaatattctaatgttcagccacagtcaaaaactgatggttggaatatatggtctaatgggcttggaagggaaggaaagggaagaacgggtgtctattcccggatttttcacagcaaaacttgaagatttccaaaagtctaattcagcaaaaatgatatttcaaagcagacaacaaaaaaatgtgatgaatacacttgttcagtcaagggcatctaacatgccaattggccctcttcccacatattcccaacacattaaaaatacaggtaaatcggccagacacggtggctcacacctgtaatcccagcactttgggaggctgaggcaggcggatctcctgagatcgggagttcaagaccagcctgaccaacatggataaaccctgtctccactaaaaatacaaaattagccaggtgtggtggcacatgcctgtaatcccagctactcaggaggctgaggcaggagaatcacttgaacccaggaggcggaggttgcagtgagccgagatcacaccattgcactccagcctgggcaacaaagagcaaaactctgtctcaaaataaaaaataaaaaaaaaaaatacaggtaaaacaagaaacgtcttaaaattcacacctaccttctgagatgagcaatccatgtcacccatggtgtccactctaattgtagctatttttttaaaatgaataaagagctttcagcttctccagggatgtgcctctcctatccagttggtctgaaattcacacttccttatagcataatggggatgacaccaacaatggaactttccagatgttctgaaagctctgttcatgaggttgcctctctgaggtcatagactttggcccgctgaggagttccctggtaaaaaaggagagaaagggaagctagagataaggggacagcactgggtttctgctgcgcttttggctctggttcctagtcccccagcggtggccacgcttcctttcccttgagtgcttctctcttggaaattttccagaaacacactgagttcactgcagaggaaagactgaagcagagttacacattaatacagagaagagggagactcacccctccaaacaacatcctggcagcccgaactgttctccctcctcctccctggactcttaacactggcagtgcttgtatgcaggcgctgggcacagtaaccatgtctcagcgtctgttgctaagggaaggaggggcctctgcggtgcctacatacaagactgggcatgacctagctctgtgagctggtgtctccctttgctggaggcccaggtgggcagcaggaagtgttggtgacagaagggaacatgggaaggtgtttagcaatgttccaggaataacagaggcaacagcaataaaagacctttggagacgtcgaaaagcacagagtatggtggttaagttcttgggatctacaattggacaggtcatacttcagatcctactcttctcattaattagctgtgtggcttggcaagttgtttaatctctccaagtgtcctttccgtctgtaaaatggcaataatgtgagtccctacttcatagggttgctttgaagggttaacgggataacgtgtacagagcgatttgcatatagtagaaggataactgatattttcccagtttttccccgtttttttttttttttttgagacagagtcttgctctgttgcccaggctgcagtgcagtggcgtgatctcagctcactgcaagctctgcctcccgggttcacaccattctcctgcctcagcctcccaccagtgcgcccagctaattttttgtatttttagtagagacggggtttcaccgtgttagccaggatggtctcaatctcctgacctcgtgatccgcccacctcggcctcccaaagtgtgggattacaggtgtgagccactgcgcccagcccagtttttccccattttaacactaagtcctgcatcctgggagcaatctcagtcctgggcaaactgggatagtttgatcacccaacacagtcaatgctctataaatgttgtggctaacatcaatattacgataaacacagaaatacatgtgcacatactcaaaagtaacaatattagctgccgcccgaatattaaaagcacatgttccatggtcactgtgaagttctctcaaaaccaagttagacttaatgagttttttgggggtgccatgcttgcatatctttttttttcattcaatttccccccaaacaccacgatattcccattttaaggataaggaatcaaaactgagagatatgggccaggtatggtggttcatgcctgtaatcccagcactctgaaaggctgaggtggatggatcacttgaggtcaggagtttgagaccagcttggccaacatagtgaaaccccatctctactaaaaatacaaaattagccgggcatggtggtagtcgcctgtaatcccagctacttggggggctgaggcaggagaatcgcttgaacctgggagggaggttgcagtgagcacagatcatgccactgcaccccagcctgggcaacaagagcgaaactccatctcaaaaaaaaagaaaaacaaacaaaaaaactgagagatacataactttcctaagtcgacttgactcataagtagcactgatacaattggaacctgtcctgatgaccccgagtccactgctctttccataacctacctgtccagaacacaaacattcccgagttcctatgaaaagcattgcatagtgagaggtgacagcgtgctggcagtcctcacagccctcgctcgctctcggcgcctcctctgcctgggctcccactttggcggcacttgaggagcccttcagcccaccgctgcactgtgagagctcctttctgggctgggcaaggccgaagccggctccctcagcttgcaggcaggtgtggagggagaggcgcgagcgggaacccgggctgcgcacggcgcttgcgggccagctggagttccgggtgggcgtgggcttggcgggccccgcactgggagcagccagctggccctgccggccccgggcaatgaggggcttagcaccccggccagcggctgcggagggtgtactgggtcccccagcagtgctagcccaccggcgctgcgctccatttctcaccgggccttagctgccttcccgcggggcagggctcgggacttgcagcccgccatgcctgagcctcccaccccctccgtgggctcctgtgctgcccgagcctccccgacgagcgccaccccctgctccacggcgcccagtcccaccgaccacccaagggctgaggagtgcgggcccacggcgcgggactggcaggcagctccacctgcagccccggtgcaggagccactgggtgaagccagctgggctcctgagtctgatggggacgtggagaacctttatggctagctcagggattgtaaatacaccaatcagcaccctgagtctaactcagggtttgtgaatgcaccaatcgacactctgtatctagctgctctggtgggaccttggagaacctttatgtctagcttggggattgtaaatacaccaatcagcactctgtatctagctcaaggtttgtaaacacaccaatcagcaccctgtgtctagctcagggtctgtgaatgcaccaatccacactctgtatctagctattctggtggggccttggagaacctttgtgtggacactctgtgtctagctaatctggtggggacttggagaacctttgtgtctagctcagggattgtaaacgcaccaatcagcaccctgtcaaaacagaccactaggctctaccaatcagcaggatgtgggtggggccagataagagcataaaagcaggctgcccgggccagcagtggcaagccgcttgatccccttctacaacgtggaaggtttgttctttcactgtttgggttcatgccgccttaatagctgtaacactcacggtgaaggtctgcagcttcactcctgcgccagcgagaccagaaacccaccagaaggaagaaactccgaacacatccgagcatcagaaggaacaaactccagacgcgctaccttaagagctgtaacactcaccgcgagggcccacggcttcattcttgaagtcagtgagaccaagaacctacgaattccagacacaatagaaccaagtacttccattttccccctttttctactccttttcctcaaagttgggctttccatcctttcaaaataaccctgagcttttccatctcttatattatgctctttatcacaaagtatacatacggtttcaaatagcatttggaataattgagacagtgggagagctggagactctggtttagacggaaatgggaagattatcaggtctcctatactgggtgtgaaacctcatgtcccaccaaaaacagcaactgtaatccaatgaagtgaaaaattagaatggggccaggcgcggtggcccatgcctataatcccagcagctggggaggccaaggcgagtggatcgcctgaggtcaggggttcaagaccaacctggccaacatggtgaaaccccgtctctactaaaaatacaaaaaattagccgggcgtggtggcaggcaccagtaatcccagcttcttgggttgctgaggcaggagaattgcatgaacacaggaggtggaggttgcagtaagctgagatcacaccattgcactccagcctgtgtgacacagcgagactctgtctcaaaaaaaaaaaaattagaatggtcctgatgtggagctaatggaccctatggcctgtgtgtgagtaggaggtatgctaccatctgaaatttagtgtgttttaagtctactagtgtttaaaactatcaaaacaatactaatggctttcgcttattgagcatatactatgccctgggactgctgctaggcacttagtagacatcatgtctttgaatcttctcaacaacctagaatataaatatcagtattttcacaagttttatgattgaggaaactgatacattaaactaacctgcccatagtcacacagctaggtcatcaggaaagcttgaacttggttatgaaatctgttccatggcttcaaccgaaaacctacatgtaatctgaggaaaggtggaaaataaagtatctgccaaagagagtgaaagtgacttcccccaggccacctcacctgtaccagaattgtttgttgtctgacaactttgtgttggataattcttaagaaaggatataggcttcaagtttctcaatcttctttttctttctttcttttttttttttttttgagatggaatcttgctctgttgcccaggctggagtgcagtggtatgatctcggctcactgtaacctccacctcctgggttcaagtgattctcttgcctcagcctccccagtaactgggattacaggcgtgtgctaacacacctggcttatttttgtatttttagtagagatggggttttgccatgttggccagcctggtctcgaacccctgacctcaagtgatctgcccacctccgcctcccaaagtgctgggattcaggcatgagccaccatgcccggccttgtttctcaattgggctgccagacaaaacagaaggtgcccagttaaattagagtttcagtcaaacaatttttcaggtaaaagaatgttttagggccgggagcagtggctcatgcctgtaatcccaacactttggaaggccgaggcaggcggatcacaaagtcaggagtttgagaccagcctgaccaacatggtgaaaccctgtctctactaaaaatacaaaaattagctgggcgtggcggcacatgcctgtaatcccagctactccggaggctttggcaggagaatcatttgaacccaggaggtggaggttgcagtaagccgagatagcgccactgcactccagcctgggagacagagcaagactccgtctcaaaaaaaaaaaaaaaaaaaaaaagttttagtataagcatgtcccattcaatacatgggctgtacttgtacttgtactaaaaagttacccattatttacctgaaattcagatttaattgagtgtcgtgtgtttttatttgccaaatctgccaacatggggagcagaggtcagcaaggttccaagttgcccctgcctcttgttatcaagagtttagggtcttaatctgttgctaaaaaaatttcacacatttcttattcagaggctggtattcctggcagctcattcctgaggcctaaaatagttgtttaagcagagcaacagtttcaatccttggaggctactatagcaaagtaccaaagtctgggtggcttataaacaagagacatttatttctcactgctctgaaggctggaagttcacaatcagggtgccagggtggtctggttccagtgaaggcccccttccatgttgcaggctgccaacttctcattgtatcctcacatggtggaaagagggtaagagagctctctgggagttattcttattttattttattttattttattttattttattttatttattttattttattttattttattattttattttattttattttaatgagccagggtctcactttgttgcccaggctagagtgcagtggtgcaatctcagctcactgcagcctccactgcctgggctcaagagatcctcctgcctcagcctcccatgtagctgggactacaggcatgtgccactatgcccggctaacttttgtatttttagtagagaagaggtttcgccatgttgcccaggctggtctcgaactcctagactcaagcaatccacccaccttggcctcccaaagtggtgggattataggtgtgagccactgggatctcttttataagggcactaatcccatttaggagggcttcaccttcatgacctaatcacctcccaaaaaccccatgcctaatcccatcacattgggggttaggattttagaggaacagacattcagtccattgcagcaagtaattgggaaagcataggagaggctgcgcgtggatttttttaacccaaccactgcatgttccttgagggccaagtcctgatgctatggagagatgctaggatcccagccctggaggaacacatgatgtgatggaggaagcatctatcacacaaagacaagcaaaactctgctggcccagccaaaaatgccagaggtggaaggaatttgaagattcacagagacgcccctagatggcactcttaaacaaaaatcccagtggaaaccctaactcagctttccaaagcaacttccatttagggaatgatgattggaaggctgtaatctaaggaaacacacacacacacacacacacacacacaatcttttcctgggtggggaacccagcattttgcagctgaacaaagtgcatgacgccagacaagattggctaaaacttaagaatttagggattcttgtctgtcctatccccaccattagctcttctttctgctattgtggaattacagcaggattctgtggtttatcatatcattgtcgtgatcatcatcataaatcatcatcccaagcaaatatttttgagcccctactctgtgcctcaataggtgctaagttctcgacagccacagccacactattgcaccagtcctcactacaaccctgtgattgcttctttttttttttttttttttttgagacagggtctcactctgttgcccaggctggagtgcagtgtcttcactgcaacttctacttcccaggttcaagcgatacttctgcctcagcctcccgagtagctgggattacaggtgcgcaccaccatgcctggctagtttttatatttttagtagagatggggtttcaccatgttggccaggctggtctggaactcctggcctcaagtgatctgcccacctcagcctcccaaagtgctgggattataggtgtgagccaccgcaccctgccagctttttgttatctaaagacttattttccaggttgctatggccacaggcaaagaggagaggtcggtcaacacaggtccctgtctggaaagtggctgagaactgtgcaacagcagaccaatggttgggcttatccctctctctaatttatggttgaagccatggttcagagaggttacttagtcacacagtaagttgccatcatgctctatagcagtggttctcacctcgggacgatggggccttccaggggacatttggcaatattttgagacacaactggaggtgggggggggcggttcttgtaactggcatctaatgggtagaggctaggatattgctaaacattctacaatccacagctcagaaacagaattattccgccccaaatgtcaatagcatactattcagaaaccttactctatagggcagatttggggccaggggaaacaggggctcctgctccgacttggatccatgcaaaccgaggaatttggattgatttatcttgtctctctcagcctggactttttcatgtgtaaaatggacatccaatccatctgaaaggatctcactggcttatgacattcgcatttgagcagtcatggttaaaaacttccagccagggtgatacttcatcacgtgtgtgtcttgagcgccagagacgttccagagcagctggttttaggcatacaggaggggaaaccctgacacccttggaaaactcattctcggctgccagtctgcctgtcttgaaggtggtctgagctttctcactccaagccagtcgtgtgggaagggacactctctgagcctcagtttcctcagctgtcaacctctcagggcttgttctagtggctccgaaagccagtgggagcgagcgcgctttgcaaagccttgggcgccgggccttggcgcgcctttgccggatccttccggccacgggcggggcgagcccagaggagaagagccgaggggcggtgcccgggccagggggcggaggcaggcggctctggctccctctcgggacgctctttccttcttcctcttgttcctcctcctgcctctcttcgcttcgcctgcaaacgcggtgggggctgctcggcggtcaggagcaggtgagagctcggagcttgggggtgggggtccgggtgccccgggtggctagacccctctcgccgggcggggacagaggaggagcgcgggggcgacggcgtgagcgcgctatcggggtcccacgcccgtagctttctgccccggggttagtgtaaggggcgtctcctgcttatgagtcgccgggacggggctgggagcgcacgaggagacacgattcctccccacccctaaatgcacactcaccccgccaccccccaacacacacacacatacacacacacactaccactagattaggtaaaatggtagctagcaccaccacaccccgagactgtgcccctttctggggaacctggggaagacgtcgaggcaaacctccctaggattattgaaaacgggcgccttcctcaccacccagcccctcttctccaccgaggtccccttccccatcgctgcagagagatctgcaagtatcaaagggggcttctttacccccaaattaataactaagtactcgactcccctctgagttcccattattcagtctctgtgccttctgggacgcggaccccctctccacctgcatttcactcccttcctcctctccttgggtctccctggcttttgaacgctgaaaggctgggcccggatggggaggggcggccagtgtgagctcgaggcgccctgtagctcccatcccccaaccagagatgtgacccctcctcccagcttgaactttcgaggtagccgttttcccctggaggttcgggggtgggagggccaggagatttatttggagccttggaaggggaaagggttagctggtgttggcctggcccagtcccccaggcgtgaagaaggcggggcactccttggccgcgccgggttctcgctttcccttctcgggagacagctccgtgcctggggaggcccctccgaggagtgagtgaccagggggtctgggaattggtggccaggtagacgcatttgaaggctgtggccgatggcattcgccccacgcactctctcatcggactccccaaaccggtctgggtggcacttgaggctcccaggccaaaggagacctgtaaggggaactccgcttgtttctgcttgctgcagagatgagattatgggaactgagtgctgggaacatcccaagttcaagacctacgccagaggcagcttcaaagagagaatgtggggtggtgggattagtcccctcctcaactttcccctccaaagggtttcttgttttacaaaagggaagtagcagaggatgtctagctgggatgattaaaatgtgctttaatttgcatactagaccctgtacagcttagtagtagataaaattaccccctatatgataaataaatgtgaggatctctcaattaattttggccacgtggacacaatcttttaagcatttgtactgtaggtcaggtcagtttaaagggagaaatggaaaagatatctctgtgtccagccagttctgggaaatataaaataagaatgattttttttttatatttgaaaactcaacaagggttaaaaaatatatctaatttaaccaattgcctttattaaaaataagtaaaaattgtatgagattgggacacccctcaaaattccaggcagtttagttagagtataattactgtggtgaggtctgcccccgaggtgcagttctccttagcagggatagacttacccacaagtaagtagatgatgatgtatggaatgatggaattgggagccaacctgtacagtaataaagaagagaaacaggtcaaggctactgttgtacaaggaaagctttctagggagaataaaaggcaatgagatttgaaatagtgtgttcagctttcttgctttctgtatattttcagcattttgtcaagctaaaaaataaacataagctgtcagagataatactattaacattttatcatctttttttaaaagtatcatacacatcttttcacatcactaaacagtcacactatcattttaatgactgaatttatcattatttaaccaattttctcctaatggaaatacagttagctactttccaatgttttgctagtcattatatgttataaacagggatgcaatgcacagccttttagtacattttgagatacctgttggattatttccatcatgttcctggaatataaattcctggattgaagtgtgtgcaatctgaaattgttgtgaatattgccaggttaccctccgtctgcatgcccaccatcaaggtatgaggatggtagaagctctcgtcgaaccagatggatgaagaccactaacggcttttgtttcctctggtaacagcaagagacagagcgacatgagagattggaccgcgggctgcactggagaatttactggtaggataattcatccctaaagagattgaagtgagcttcagaatggcaaaagaggagccccagagtatctcaagggacttgcaggaactgcagaagaagctgtctctgctgatagactccttccagaataactcaaaggtcagtttccaatcactatgtataatggaaaatcccaatataacactagcataaacaagatagaaagttatttctttctccagtagaaggaatttggaggtaagtcaagaatctttctggcttaccgccctgccatgtctatgctgtgaccttcaaactccttgtctgagatgactgcaagagcatcagccattgtatccatctttcaggcaacaggatttgaggaggggggaagagagaagtgcaagccacctacaatttaaggagacttctgggagtcgcacacaatacttccaattacatcccttaagccaacattgagtcatttgccactaatggcaaatgcaattctttagctggataaagaagtctgtgcaacagatatcatcctttttttggttttgtttggttttgttgtgaattttgccctatctgttaccctgaaaatgagagacaaaagcctacttcaagatttgagttcattgttccactaggaatccaggtccgatagaaatatgatgtgagtcacgtatgtaatttagaatttttctagtagccacatgtaagaagtaaaaagaaataggtaaaattaattttggctgggcatagtggctcccgcctgtgatcctagcactttgggaggctgaggtgggtggatcacttgagatcagaagttcgagatcagcctggcgaacatggtaaaaccccatctctactaaaattaccaaaatgagcaggtgtggtggtaaggcctgtagtcccagctactcgggaggctgaggcaggagaatcacttgaacccaggaggcggaggttgcagtgagctgagattgtgccaccgcactccagcctgggcgacagagcgagattccgtctccaaaaaaaaaaaattatttttaataatgtttttattcaacctaagatatcaaaaatatttcaacatgtaatcatttatacaaaattattaatgaaaaaagattcttgaaacattgtaccttcttttttgaactccctcttcaaaaccccccgtgcgcatattttacacttctagcacatttcaattcgagttagccactttttaggtattcagtggccactcagtggcaatgagacttcagatagcgttatgttttcttgcatatttatccttattgctttcttctatatgtctttcagcattttgtcagggaaaagaaaacagctttcagagataatactgttaacattttgtatgtcattctagaccttttttctatgcaatatacctataaaaatacatatgtatatgtaacaaaatgaactattttgtggtgtatttttttttgtattggatagcacagcgggtctactcgaagagatgcttgtttgcaatctacaacaataaattctggacttgctccagaatttatttggcactctttgtggatttaccaagctatttttaaattggacaagcagctttctcgccagctggcggggactcttgttattaaaagttagctcagtaagaagggtcctcctgcctgttccacatttacagctgattctcattaaccatggtagttacgttctataaagttactgcagacactgaattagcacataccaaaccatcgctcctaggggaaatacaggattcagttgctgtgagcctcctgttcacaacatttttgtcagctgatcagtacataacctcgttttatgtgtatttctgtttaaagacatgttaatatatattgttgatcattaacgttgaactcagggccaacaacagtactatgactcatgtcttaaacaaagctaatcacacacatgtattttctgcataaggcacatcacagccttctcatggttaggaacgctagagaacacttcagcactacacttggggaccattttcaacagtaaaatcaccaaactaaagcataaacgtggcactaaatagaccacagtgacacttgtttaaaggatgaaacaggaaggctcggtgtcaccttgcttgacctcagctgggaatgtacgtggcaggtgactccactttttgctgttgtggacgtgtccactaatgacctcaaaagcactgcaggccaggcgtggtagctcacacctgtaatcctagtactttgggaggccgaggcgggtggatcccttgagccagaagttcaagaccagcctggccaacatgatgaaaccccttctctacgaaaaatacaaaaattagctgggtgtggtggtgtgcgcctgtaatcctagcctcttgggaggctgaggcacgagaatcgcttgaacccaggaggtgaaggttgaagggagccaagatcacaccactgtactccagcctgggtgacagagcaagactctatctcagacaaaacaaaacaaaacaaaaagcactgccagtattcattttgaggttacaaataaatttcagtgaggaggcaaatttacaaatatggaatcatgagtaataaggattgactgcatatttcttggcactgactgtatgccaagcactgcactaggcattcaccctggccctgtctgaacttagttaatagtcacgttcacctgccttttttgtttgtttgtttttgtatttttagtagagacggggtttctcaccattttggccacgctgatctccaactcctgacctcaggcaatccacccacttcggcctcccaaagtgctgggattataggcgtgagccaccgcacctggccaccagtggttgtaaatggtcctgacccttcgtctttctcctgttaggaagagataatgaatcattgattgttttttgcattctgataccagggaatttgcctggctcctgaatcatccaagtttcagtcttcatgttctcaaatactggccactttgtccctagtttagaagccaaccgcctttgtctgaccttgggcaagtcacttaggctcactgaatttccatctccttttttaaaattttttatttattttttattgagacagagtctcactctgtcttccaggctggagtatagtggtgtgatcatggcttactgtagcctcgaacttctggtctcaagcaacacctccagcctcagcctcctgagtagctgggactacaggtgcacaccagcatactcagctaatgttttattttattttttggagagacagcatctttcactgtgttgcccaggctggtctcaaactcttggcctcaagcagtcctcctgccttggcctcctgaagtgctgggattacagaagtgagccaccatgcccagctgccatctcctcttttctaaaatgagcaatgtcaggctcagaggtttgttatgaagattatctgagatgctgtttgaagctttagcacagagggtggcgcataatgttgtcagtctgtctcagcctggccttcctgggctctgcagtgctgcactgtgcttacagagcctagattgggtaacctgtgtctacctccaggctggtgatggaaaatcacagtgcatgttactgaataataacctctcccactttccatctttccattgcatccccctctgttgccatgagaatgaaatgttaattgctacgttctacccccctgagtttaaatagtgttaggtcgttcttttttacctacctcgtagcattgtaggaagaaataaatgaggaaataatacgagaggtgcttaaagcagtgcccagcacctgagtgtttaatgaatgttctctgttattattaggtgtggttgaatcgtgtcctcccctcctgggacagactggctggagctcagctgtacttcctgggagaagacaatttctgggtttaatcatctgaatcttggtctctttgcatatctaaatgactttctctttgattatagagcccagactcggaaaagactaagaatggcggggcatggtggctgatgcttataatcctagcacttcgggaggccgaggcgggcagatcacttgaggtcaggagttcgagactagcctggccaacatggtgaaaccccatctctactaaaaaatataaatattagctggaaatcgcctgaacctgggaagcggaagttgcagtgagccgagatcatgccattgcactctagcctgggcaatagagtgagattccatctcaaaaaaacaaaaggctaagaaaaaggtggattccttaaggactgaagtggaacagtcttgcctgtttccttttatatccctgtgccatacagtccctaagtcctgtgtattccttcttttgtcattccactttcatacccatctacccctcccccttctcttccctctctgccatcagcctggacttgaccacagtatatcttgcctgatttcctgcaaatctttctacctgcctcttgcacatgattgctaggttcatatttcttaaatcattcctttaatcatgtcatagttctgctcaaatgacagcagtttgttccctgttttttttttcccagatgaaatttaaatgagtgctgtctagcagaaatattatgtgagccacatatataattttaagttttttaataattacattaaaaacaaaaagaaacaaatgagattaattttatttatttatttatcttgagatggagtctcgctctgtcgcccaggctggagtacagtggcgtgatctcggctcactgcaacctctgactcccgggttcaagtgattctcccgcctcagcctcccaagtagctaggattacaggcacgcaccactctgcctgactaatttttttgtatttttactagagacggggtttcaccatgttgaccaggctggtcttaagctccagatcttaagtaatctgcccacctcagcctcccaaagtgctgggattacaggtgtgagccaccgtgcccagccagagattaattttaataatatattctcaatttaacacaatatatccaaaacactataatttcaacaggtaatataaaaaagtattaatgagatattttgcatttttttttcttacacttaaagcacatctcaattctgatgccaaattttcattggaaatatttaatctctattcagattttataaaacttacaattcagcgaaatagattcacatacccaacctattggaaacatacttaaaatttttccaacaactgaatcaagtctcagctttaaaatttaaattaaattaaattggaaatccaggccatcagtcacaggaggagcatttcaagtgctgaatggcgcaggtggcctgtgatggacagcccggggataagctagcaagcccagtgtcctggtgtcccagcctcacaagttccttccgctgcacagcccttccctcgctggcgcagcatactcacgggtgtactgctgcctccctttcctggagagcccatctgctctccccactgtggttctttggattgtaaagatcaggtgacacagggagcatcaaataaggatgcatgtggattcgaactggaaagaagtcaggacctgagacagcgcaagggaccagcccacattctgtgtggtgactcccacggctcctccgcctctctttctctttcagctgccccaacacagcaggatctcactggactctgatgatggagtgtccaggctgggcagtgctggctccaaggtgattcctgctacagtcatctctggctagagaagcggaatagcaagctctttggtggcttttgtcagaatggtggggtagcaggaggcagtgaggtcagcgggcattatgccgtcctgtggcctggcagggagtgaaattggccatgcctcgagagtaatccttaggagaccacgctgaagcccaagaccaatggctgtggcttcttggcatggcctcttttatttaagcagggtgcagcttgcactttagttccttcagcatgaaccacaaacccctcctgccttccaactcgccctgaaaatcccactgtttaaaccacttgggtaaactcttcttcctaggaggcacatgtgttttggggacctgaattatgtcttcttttcatctgttggcctgcaaggccgtagggatgaggctcaggaaggaccagttatgatggaaggaggttctggaataatggttcctttcaagtgaacaggatctagaataccagtactgaggagagagaaggcgtggagcctaaggaggagagggggaaacccatctttgcggatttgcctatggccagctctgcgttaaagcagtctccctccattgagtcagatcgaaaattcctttttgcccggtgaaggaaaataaactattaacacaacataaacttgcattagtcacaggctgtggccaactatggtaaccaggttgatgacataaaagcatttttacttgatgtggtggcagctgttgcaagcattggacattctgagtccaagaccttaggtttgtttttttttttttgaaaaggagacttgcggtggggcgcggtatcccacgcctgtaatctcagcactttgggaggccaaggcgggtggatcgcctgaggtcaggaattcgagaccagcctggacaatatagtgaaaccctgtctctactaaaaatacaaaacttagctgggcgtggtgggggcgcccgtaatcccagctactcgggaggctgaggcgggagaatggcttgaacccgggaggcggaggttgcagtgagccgagatcttgccattgcactccagcctgggcgacaagagcaaaactccatctcaaaaaaaaaaaaagaaagaaagaaaagaaaaggagacttgctctgtcatccaggctggagtgcaatggcgccatcttggctcactgcaacctccgccttccaggctcaaacgattctcgtgcctcagcctccctagtagctgggactaccagcacgcgccaccatgcctggctgatttttgtatgtttaaaagagacagggtttcaccatgttagccaggctgttcttgaactcctgacctcaggtgacccgcctgcctccacctcccaaagtgctgggattacaggtatgagccaccatgctggccaggccttagcttttaatgctgagattttgccacttggaggctgtgcgactctagacaagtgattagcttttaatgctgagcttagcttttaatagacaagtgaatagacaagtgattagcttttaatgcttactaatagacaagtgattagcttttaatgcttaataatgcttttaataataatgcttttaataattataattataataaataatatataaataatataatacatattataattatatacatatataaatataatatatttatataatatataataatgctatatgaatattgataactaatattagtataatatatctaatataattatacaatattataattatgatttttatattacattacaattatatttttatatataattatatatatatttttaatattatattatatttttattttatatattataattataaatatttttatatttatatttttataaatataattatatttttatataaaattaaatataatttaattttatataattataaatatttttatattttatatttataattataatttatattatatatttatatttatatatttatatttatttatatttatatatttaaatatttatatttatagtatatataatataatatattatattatatataattataaacatatataattattatattataattataattataatgcttttaatagtaataatacttttaataataatagacaagtgattagcttttaatgctaatcactttaataatgcttttaataataataatgcttttaatgcttaataatagacaagtgattagcttttaatgctgagattttgcaacttggaggctgtgcgactctagacaagtgacttagttcattgcttctcaaactttaatgtgtatgcacgacacctggggaatcttgtttaaaaggcagtctgattcatcagggcctgagattctgcatttcctttttttttcccctttttctggagacaagatctccctctgttgcccaggctggaatgcagtggtgcaatccatagttcactgcaacctcaaactcctgggctccagtgatcctcccacctcagcctcccaagtagctaggactgtgggtatgtgctgctatgccaagctagtttttaaattttttgtagagatggaatcttgctgtgttgtccaggctggtctcaaactcctggcctcaagcaatcttcctgcctcgacttcccataatgctgggattacagatgtgagccaccacgcccagccagattctgtatttctaacaaactcctagatgatccaagtagctaagcctatttgtgtctgagtggcttcaactatgagaacctcagctgtaaagtaggaggcagatggtatgtaccttacatcaatgcacctttatgccgaagaggtcttctcaagagtgtgtttggcaggagagccatgactgggtctttcctcctttcacaaggcttgaccttgggtggggacctcagacttgccacctctccacagctgcctaagatagctgcctgggtgactcatgtcttgggagaagtcttgttgtagtgactttttttttttttttgagacggagtttcgctcttgttattcttattatcatttttgagatggagtcttgctctgtctcccaggctggcgtgcaatggtgtgaccttggctcactgcaacctctgcctcccaggctggagtgcaatggtgcaaccttggctcactgcaacctctgtctcccaggttcaagcaattctcctgcctcagcctccccagtagctaggattacaggcacacaccaccgtgcctggctaattttgtatttttagtagagacgggggtttcatcatgttggtcaggctggtctcaagctcccaacctcaggtgatccgctcgccttggcctcccaaagtgttgggattacagacatgagccactgcacccggcctgtagtgacttgttaatgcataagccttctggctttacgacttctgccttgtaattcccacagcttgggcagattcattcaacctggggttccgatgtgttacttatccctggctctttgtcctttgcctacaggtggtggcctttatgaagtctccagtgggtcagtacttggacagccatccgtttctggccttcaccttgctggtgttcattgtcatgtcggccgttcctgttggattcttcctgctcatcgtggtgcttaccaccctggctgctctgctgggggtcataatattggaaggtagcctgttccgtcattcacccctttagaaaataattcaattgggagaaaaatacttttggggccatttaaaaatttttttaaggggcggggtcttgttatgttgcccaggctggtctcaaactcctgggctcaagtgatcctcccacgtcggcctgccaaagtgctgggattatggccatgggctaccatgcctggttgtctgccattcttgtcaaaatcacatcaagcaaggcaacttatcagagtaggtaaaacatagactctggagcctgcattcaaatcccacctccaccactgtgatttggggcaagtggtttacctctctgagccttaaattcttaatatgtaaaatgcagatataataatacaatctcaaaaggttgttgtgaagattgaaacttatggctccataaagtccttagcacaatacacaatacatgtcacagagtagcttctcaatgaatgctagctattattattaagcagagaggccattcattccacagtgagttattgggcacctactgcatgccagatgcctcgctaggtactggagaccaccttcatccttcctcctgaagttccactaccaacagtcaacttctccctgtattcctaagttaaaattactgggaaagcaaatctgatttgctcactttgacttttcaaatcagatcacacaccccaggcaagtggccaaagagatggtggccagtgggtcaggtgatcacttctggtccattccgtggcttcccagagctaagagcacccagggctgtttatttgccccagggacaaggcagtttacacttgaaggagaaagtaggcatggtcagtggatgagccaaatacagcctggcagagtggtttttgagtaaatgttgatagatagatgggtgaatgcatgaatgaatggatggaggaatgaatgagtaccataagaaaggaaatttatagagaaaggagagagccattacattttggtggtaccatgcaaagctttacagcagacaagactttaaggatgcataacaactttgcctcagggtgggcaaggaagggccttttggacaggggaacagcatgtgcaaagcctctagaatagtggttcttgaacctgagtgtatttaaatcttttttttttttctagatggaatcttactctgtcgcccagcctggaatacagtggcatgatctcaactcactgcaacctctgccacccaggttcaagaaattctcctgcctcagcctcccaagtagttgggattacaggcatgccccaccatgcccgactaatttttgtatttttggtagagatagggtttcgccatgttggccaggatggtcttgagctcccgacctcaagtgatctgcccacctcggcctcccaaagtgctgggattacaggtgtgagccactgcacccagctccaagtgtgtataaatcttactttctttatcaaaatacagactttggatcttttgagaccaggagttcaagaccactctgggcaacatagcgagattccctccatctctttaaaaaaaaaaaaaaagaggccggacacagtggctcatgcctgtaatcccaacactgggaggctgaggagggcagatcactggaggtcaggagttcgcgaccagcctggccaacatggtgaaaccccatctctactaaaaatacaaaaaattagccgggcatggtggtgggcacctgtatcccagctacttgggaggctgagacagtagaatcacttgagcctgggaggtggaggttgcagtgagccaagattgcaccattgcattccaccctgggtgataagagtgagactctgtctcaaaaaaaagaaaagaaaagaaaaaagaaagaaagaaagaaaaaagtggtgtgtgtctgtagtcccagctactcagaaggctgaggtgacgggatcgcttgagcccaggcagttgaggctgtagtgagctatgatcatgccactgcactccagcctgggcaacagagcaagactctgtctcttaaaaaaagaaaaaagagaaagaaaatgcagacttccaggcctcatccagagagtgttgttttagtaggtctggagtggggtttagaaatctgaatttttcacgagcttccttgatgcacctgattctgatgcaggtggttggcaccacactttgaaaaacgctgatctaaaattttgcgaatctttatgaacaggcagcacacctgttgatgttctcttccttccagccttttcagggtccctccctgaaaccatcactgtggctgtgggaggagcactgggctaactggccactcacaaagcaaagggaaggatgtcagccatacaatacttgccatgttacttgttcttcatgatcttttccttctaccttttattcttttcccccccacaggccccacattatgaaaaaatgtattttccttgcacgtattagatggtaattcattaatattcctattcagagtgggaatggtatattaaaatggcatataaaatgctccataaaaatgaccaatcagaccttaagattaaaatgtgatggtttacaggctggattttcaaggatgccatcaaaagctgcatttagattttgctttagcctgcatgacctttatacctatagcttgtaggtaagagtaaataatggcatttattatgcactttgagacattagagataatttacctcccccagtactgccttggctgactcctcgaggggatccctttggaagtccatctctgaccttgagggtaagggaatctcaaactccagcacttatgggcaagacaaaatgagcaggctggttgtggtggctcacgcctgtaatcgcagcaccttgggaggccaaggcaggtggatcacttgaggtcaggagttcaagaccagcctggccaacatagtgaaaccccatctcctctaaaaatataaaaattagctgggcgtagtggcaggcacctgtaatctcagctcgtcaggaggctgaagccgggaatcacttgaacctgggaggcggaggttgcagtgagctgagattgcgccactgcactccagcctgggaggcagagcaagactgtctcaaaaaagaaaaaaaaaaagacaaaatgagcaaagcagcccatgtgtgatgcagtttgggaattggggggactggaggcaacgggagggccagccagttgttgccatggtttgatgcccactcaggtacccatatcgcctcctttttttaagtgatgctagaaatctgggtttttgtgggaaatcttcttactttaataatctgagttagcggttgttattttaaacagactgacccagggtctgccagttttcaacctgtttgagatgaacccttctcctaaccacgttctcctcctaggattggtcatctctgtgggtggcttctcactgctctgcatcctctgtggtttgggcttcgtatcactcgccatgtcggggatgatgatagcatcttatgtagtggtctccagcctcatcagctgctggttttctcccaggtaaatacatgtccatgaaataatttatttttttaatctttctacttttttgtttttttgagacaaggcctcactctgtcactcaggctggagtgcagtggcatgaacatagctcgctacagcctcaacctccaaggctcaagcagttctcctgcttcagcctcccaagtagctggggctacaggtgcatgccatcatgcccggctaattttaatattttttattttttgtagagacagggtcttgctatgttgcccaggctgttctctaattcctgggctcaagcaatcctcctgcctccacctcccaaagtgcagggactacaggcatgagccaccacaccttgctgagtaatttaatctttgccacttgaggggattttcacaaataaaaccataatcctagttgatgtccagaaggaaacttgtaagacccaggtgtttctcatagttccccatgtatgccaggcatcaggtgggaatttaccatggaattttaaacaaagcaattgctgtcattttccatcacgtatacacatttcattgtcatagcaactctatcagtattattgattccttttaaaagatgtccatttaatttacaaatgtcaaattaggtggttttctttggcggggtggggcagagaggcacaggagaaaaatgacccacgagacatgtctgtcacccaaagcggtacagtatgggagccgtgaatcttctgtccccaaagtctgtcaatcccctctgctcttgagaatgtgagtttctcaccaactgagtgtgagcctcatgtttgaatatatagatttttgttcctacaatatggctcttcaatgccagctacttcatctggggccttgagtgaaagaacagcgatctacttaaatgctggagggaaaagccagctatgttggcattactgagagactctgtgtttgtctacaatgtgccacccacctaagggattttcaaaggagatttattttaatgctttatttttgtcctttgtgttgattttagaatctaagtcccaagttcatcatacttcatttaagctcctgctaaattgatgatagtgctactgagcacttgctctgtgccagggactctcttaaacactttccaggccttatgtcatgtaatccttaacaatttagcccctttctattataaggaaaattaagccaagtcccttaagctgagagtagcacagaagggacttaattccaggtgagttaattccaaagccctcttaatcaagatacaaagtgactctctaaaacaggagttggcaatttctggaaagggccagacaggaagtatttagtaagtaatatagtctctactggaatttctggaaagggccagatagtaagtatttagtaaataatatagtctctactgcagttagtcaactctgttgccgtagcatgaaggcagcacagaccaggaagtaaatgcatgggcatggctgtgttccagtaaaactttatttacaaagacaggcagcttgctggatttggccaaccattgctctataagaactgatatcctgagttttgtttttctacaaaacagcccttgaactccttaccaaaagtttatcctgttattattcctatgttgaaaaataaagggtgaagtgggtataatataaaattgctcaaggatggctcttataggattgcttaattgaatcaaccctggagtcataatcaccttttcaaaaatcgctttgatcactcttagtcttttgtttgttcatttgtattttacttataaaatggggtcttgctgtgttgcccaggccattctcaaactcctggcttcaagcaatcctcccccgttggcctctcaatgaactggaattataggcgtaaggcactaactcactcccagtcttaaaagatgtaaaaggagaaatattggcctattttgcatattgagggtgatgcttctgaaataaaattcctccctgcctctgaacgctgctgtaacagggtgagttcttaaagattataccacaggaagtagcagaatctgactccctacttatcaatgaagaaattgaaaaacaaatccaggatttgtacttgatctccttatcttcccctattgctgccaaccaattgtttccacgtgggcagaggttcttaagctttttgttctcaagtcccattttaccttcttaaaaattattgaggcatctgaagagatgttatttatgtggttaattgtattaatagcactttgggaggccaaggagggaagatcacttgaggccaggggtttaagaccaacctaggcaacatggcaagaccacatctctacaaaaaatacaaaaattagccaactgtggtggtgcgtgcctgtagtcccagctactcaggaggctgagatgggaggatcatttgggcccaggagttcaaggctgcagtgagctgtgatcacaccattgcactccagcctgggcaacagagcaagaccctgtctcaaaaaacaaatgaaatgagctgaaatataaaataaataactaacatgacataaaactatatacaataaaataaattaaaataaacataacataaattacattaaatcaaattaaatattagctggtgcatgcttgtggtcccagctactcaagaggctgaggagggaggatggcctgagcctgggaggttgggggtgcagtgagctatgattgtaccactgcactccagcctgggtgacagagctagactctgtctggaaaaaaaaaaaaaaagaatattaataattatttctttttaaaaaattttcttcctcattgtttcttgttctgaaataattattctatgagaaatcatagcataaattttaaaaatatctattcatttaaaaggaacaatattacctgttgatataaataacaaattttaatgaaaagtaactatattttccaaaacaaaatgaaatttgtgagtggtattattttacattttacagatctctttcatatctgccttaacagttgtcagccggcttctcgtttgtgtggctgcattcattctgttgtgctatgttgtcctgtttggagtatttgaagaagacctagcatcactaacatgcggttgggagagggaggcaaagcttttttaaacgattgtggatattctatgatagtccaccaaaactccgtaagtgatagtttcttaaaggttagctgaaatgtgaaatttttctactctattttattgaaatcttcaggtctgtgtcacactttaaattgatctttatcatgcatgattttctaactttacccattggtcaatgggagaatatcaattcattgagtcatgcagatcttccaaatatattttgaaaaattgcactgttcccttgtgagagaatgtgagtgaaaaaggcatataataggtcatgttattgtgaacatggttttcatctgagaacccttgcattagcgaattcttttttttttttttttttttgagacgagtctcactctcacccaggctggagtgcagtggcttgatcttggttcacacaacctctcccttctgggttcaagcagttcttctgtctcagcctcccgagtagctgggattataggtgtgcaccaccatgcatggctaatttttgtgtttttagtagaggtggggtttcaccatgttggccaggctggtcttgaactcctgagctcaagtgatccacccacctcagcctcccaagatgctgggattataggtgtaagccactgtacccagcctgcattagtgaattctttataactcaaaaaaagataactccctcattaaatgatcgaaagcatggaatggggggaagaggagctatataatttatttcatgatttaatggaattttggccctaaaacataaaagataatacagcttaaatttttaaaaaagaaaagaaaaaggaaacaaaactgtaagtttcccttacatatgaaacccaactaaacaatatttagatcaaatacactgacctgcctcctatgtagatcagctagcctctgaggggcaaaaccacactgcttggttatggagactgcaagaccttccagggcctgcagctcaggagaagtaggggccctgggcagctgtgtttatttgcagagccaccaaactcactaccccatatcataatcttccaaaccagcctgagcataactagcttccttacatctttactaagaaaaggaaaggcttctttcttagttttttgttatcagggaggaatggtttaggtggcaaataatgaaaaaaaccaaagtagatactagtttaaacacacagggaacttttttttattgcttaatgaaaaactggagacagcccagggctggtgcagccagtgtggtatcaacataccaggcaccttttgccttcctgtgttgctatccttagcccattggtttcctaccttatggccacaagatagctgctgcagctccagatctaccagctaccttcaaggcagcagaaaaggagaaaaaaatggagtctgacccttttaaaaatgtgaataaaatatttcccaggacctctcaccactatacttcaaaagacttcattgactagaactttgtcagatggccgctggttgctgttctcctgattgtaggtctcacgagatctgatggttttataaagggcatttcccctgcacatgctctcttgcctgccgccatgtaagaagtgcctctgatcttcctttgccttccaccatgattgtgaggcctccccagccatgtggaattgtgagtccatgaaacctctttttctttataaattacccagtctcaggtctttattagcaacataagaacggactaatacaatcctcccccgaactcctttccatggaaggtgtcaagaaactaattgaaatcagaagatatggtctgaatccccgccctgccatgttttcagctgtgtggtcttgaacgggctgcttgacttctctgatttcagtttttgtccattggtaaaatagacaaaatggctactcttaatctaccattctcactgggttgttgtgaggacacagataattaagaaaaacataataaatatccaaattagaaaatggaaaaggggccgtaaccctactcctaacctggtcattttaacctcctgtgccctcagtttcttcatctgtataatggacataggcctggtgtggttgcaagaagcagctaaaaatcaggaaaaagaacatcatgtattcagctatgcacacttccaacgttgctctttactgaggccctagagctaacgatctcttcttgttatccgacaggccactgacacagcaaaacaccagttgtgactttctgccagccatgaagtctgcagaattcgaggggctttaccaggaatgagtgactgctcagaggccgggcttcttttcaagtactgctggatcatactcaccccttgggattatggcttagaagaagggggctgggtaggcaagcactccttggctgtgtcctctcgctttttcacttacttgtaggatcccgcagcagccaatttagggattgtgttgttcttgtgttggttcccatgtaaagaagcagcagagaaatgcgatggttcaacagctcgccctgccccaagtatgcagacttgaccttggcggggtcctgggcttctagagtctagcccgttgaccccaaagcctcagggcttatgtccaacggtcccattgggagcaacagtgattgtttatagttttttgttttcagaaatgagggcagctgttaattttttcactcatgtgaaacaaaatgaaaaaaaaaatccaaaacagaacaagcccttctgtggtatttgctttttatcagaaagaacagcaacatttggcctctccaagttggaaaatagagtccaaatgtaactttgtggccaagagtattttcaaaaaagtctaaaggtgtagtttccactgtaactgttgagtactgttaagtactgttaatcttttacatatttgcacttggtactgttgtattgttctaaagagcttgtcctttaagtaatttctttcttttttttttttttttttttttgtgacggagtttccctcttgttgcccaggctggagtgcaatggtgcagtctcggctcactgcaacctccaactcccaggttcaagtgagtctcgtgcctcagcctcccaagtagctgggattacaggcacccgccaccgtgcccggctagtttttttttgtattttttttagtacagatggggtttcaccatgttggtcaggctagtctcaaactcctgacctcaggtgctccacctgccttggcctcccaaagtgctgggattacaggcgtgagccactgtgcccagcctaagccatttcttaaaataaaaatgctaaaggactagtaagtaaaaataaaacttcctatgggatttcccagtggaattactgagtggtttatttgcgtggcatttcattaaatatttatttgggtgggctttttttctttactctttttcccttctgctccatacatcagacctgcctattcctctgtcgatttcatgactggtgctgggtaatagggatttttttagttgctcgcaatagacacccaattccacattactttaaaaagaggggtggtagggagaaggattagtttcactcaaccaaaaagccaaggggtagatcttgaggtgctgctgattccaggggctcaggtggtgtcattaagcatctctcacccctcatctctcagtatagctttcctcagtgtgagctgcttttgcaggcaggcccgccacccctttcggaggtcccaggagctccatcctgggcaagaaaactgcttttttccaacagtatatacaaatattctgggtttggctctgattggatagacttgggtcatgtgagcgaccccagaccaatcatggtggctaggaggatgggatatgcagatgggacagggctgggatggtggccattcaagaaacaggggaggcgatagatcagcccactattaatataactattaatattaacagttactgtttattggatgtttccttcattcatacaactgtctgatattatctctctatgctatctacccagctgggttctgcagctttaataatgaagaatgcaatggtctcccttctgaagttttctttctaatgcaagagtgagtgagcaagcatatctgttgctatgtaacagtttaccagcaactattggcttaaaagaacaggcatttcttatctcacattcttcatgtgttaggggtccaggcatggcttggctagatcttttgtaagcctgtgatcacagtgtcatcagggctgtgttctcatttggggtctgactggggaaggaccacattccaagctcacatggttgttggcagcatccagctggcaacacgacttaagccctccattccttgctgcatattcccctccccatgacagttcagtgtggtcaatggcttcttcaaagccatcaagggagagcctctcagcaagatagacgttacattcttagggaacgtaatcatgcatgcacaatcatgaacactggatcactttatctgtgttctgctggttagaaacgagtcccagaaaccaccacccactctcatgaggaggggatcacccaagggcaggtaaaccacagaggggaccatgggctctgccttaagagtccttactagggtccttagtagtccaccttgctacaacaagtaaacaaaatattagaccaactccgctgaagataagtaaaagggtggtaagtaattgggagagcatgctttagccacagcaatcagagatttcttctatttgaaccaaaacatgagttgtcaccatgccaagcacacagggagggtgttcctagcagagggcacagtatcccaaaggcccagagatgggaagaagcttaatgtgtttaagggaaaaaaatgatgtcagcatggctgggcctcatcatgcaggacctcatggagtgagtttacaccaggggtccccaaccagtaccggtccttggcctgttaggaaccaggccatacagcaggaggtgagcagcaggtgagcaagcattgctgcctgagcttcacctcctgtcagatcagcagtggcattagattctcataggaacatgaaccctcatgtgaactgcacatgcaagggatctaggttgcatgatccttatgagaatctaatgcctgatgatctgtcactgtctcccgtcacccccagttgggattgtctagttgtaggaaaacaagctcagggctcccactgattctacattatggtaagttgtgtaattatttcattatgtattacaatgtaatcataatagaaataagctgcacgataaatggaatgcacttgaatcatcctgaaaccacccccctacccacgcctcatccatggaaaaattgtcttccacaaaacttgtccctggtgccaaaaaggttgaggaccactggtttatgccaaagagcaaaggaaagacaatgaagaatcttacatgggagagtgacgtgatcagacttgggtttttaaagatcactccatggccaatggatttaaagcaggaaggctagttgggaggtctatggaggcccaagagcagagaggataattgtgacttaaaacttacactaggctgagcacagtggctcatgcctgtaatcccagcactttgggcggccaaggatcacttggggtcaggagttcaagaccagcctggccaacatggtgaaaccccgtctctactaaaaatacaaaaattagctgggtgtgatggcgggcacctgtaattccagctactcaggaggctgaagcaggcaaatcacttgaacctgggaggtggagattgcagtgatctgagatcgcaccactgtactccagcctaggcgacagagcgagactctctctcaaaaaaaaaaaaaaaaaaaaaaaattagggcaaatgtaatggagaccttcctcattttgagggccagcagcacttggtgatgatggagaaggaaagggggacacaaggtggcacctaggtttttagcttgagccagtagtggatagtgacactattgtaggagtgaaggacaagcttcctctctaccctctgaaggatccctgaaatgaactggcaatagacagatgaacaggagaaaaggcatattcaaatttattaacatgcacatgaacacaggagttccaaaaatatgagactcaaagaaaggccaaatgattgaaacttacatagagggagatgggggaaatgtaggcaacttgaaggattgtaaatgatttttaggggaattgaatggacccaaagagcaaaccacaatgagataccatctgaaaccagtcagaatggctattactaaaaagtcaaaaaataacagatgctggcgagtttgtggagaaaagggaatgcttacacattgctggtgggaaagtaaattagttcagtcactgtggaaagcactatcacaatagcaaaaatggaatcaaaaaatgtccgtcaatggtggataaagaaaatgtggtgccatatacatcacagaatactacacagttataaaaacgaatgagattgtgtcctttgcagcaacatggatacagctagaagccattatcctaagtgaactaatgcaggaacagaaaaccaaacaccatatgttctcacatataagtgggagctaaacattgggtacatatggaaataaagatgggaccaacagacattggggcctacatggaggtggagggtgggaggagagtgaagataaaaaaaactattgggtactatgcttattacctgaatgataatctgtacaccaaacccctgtgacatgcaatttacccatgtaacaaacctccacatgtactcctggaactaaaatgaaagttaaaaaaaaaaagcagacaatagtttgtaaattattttctttagaaactgaatgggacaagttatgggaaggtgaggggcagaactgcactgcaaacaaaggtagtcttattatgcagattaagtcttttaggtaatctctcagaattactctcggcaaaatagatgaaaagcccgagcatggtgacaacttttagtctcttctgcagtggttaattttttctggttattttggatgctaatccaccacgttgacttctgattaaccccagtcccatgaatgcctcctgattcctacttcactgttcctagtgtaagaacatgttgaccttgatgtcatcacacaaattataggctatgatacattcagcattcttgcctgtcctgaagggttgcctttaattggcttgctggagcaagcataccctttccctatggtatatgcgtagccctggtgtggggagtaacagtgcagagagctacctgtcctgccaccacctaagaccacacttgtgtctgtaagttccttcaatgaatcacccaaagtcaacacaatggatctgtctgcctccttctttggttcctcggctccctcagcatttgggaatcactttgcatattcacagaaattaagacaattgcatttcttttggaagaaattttcctcggtcagataagggaacttccagagaaagcctgatatggttaggctgcgtccccacccaaatctcatcttgaattatagttcccataatcaccatgtgttgtgggtgggaccaggtggatataattgaatcatggggggtggtttctcgcatcctgttctcctgatagtgagtcagttctcatgagatttgatggttttacaagggacttcccccttcactgggcactcattctctcctgccgccctatgaagaggtgccttccgccttgattgtaagtttcctgaggcctccccagccatgtggaactgtgagtcagttaaacctcttcctttataaactacccagtgccagatatttcttcacagcagcctgagaacagactaatacagagcccctccctgcactcaagatggcagaaacaagagaaggttagaaaatccttggttctgaagcagtttctaaggcctttcattttcctttaactcagaagtgctctgcatgccaaagtaacagactttggggtatccttgtctgtgtctcaatgggggctgtgtgaaaattcaacccctgctttgctcatattaagtcagatatgcctcttggatactaagaggatgtgtcaagtagacagctggcttagagggtacgtttgggctggggagtatttttggtgctgagagctttacacagccttcatttgggatgctctcccagagagtagccaggagatcatttcatagcatagttctgatcacataaacaccttactccaacctctgccaagggcaaagtgctttcccacagcacttagaagtgctaactctttcccctcatggatcaatccatgatcaaagaccaatcccagctgggcacaatgatttacacctgtaatcatagcactttgggaggccgaggcaggtggatcacctgaggtcaggagtttgagacctggccaacacagtgaatccccgtctctgctaaaaatacaaaaattagctgggcatggtggcacatgcctataatcccagctacccggaaggctgaggcaggagaatcgctggaacctgggaggcgaaggctacactgagccaagatcacgccactgcactccagcctgggtgacagagggagactccctctcaaaaaaaaaaaaaaagatcaatccaagcttctgcttcctgctacttctttatatgccatcggcctctggatatgagagagaaaactaaagttcaaaggactcacccaattcagctaagaaatgtgacatctaaatcaaggctgtgcagtgaggttattcattcaggttctgttctttacatggtctgggcctaaccttcaccgatcaaatgaagtgaaataaggtgcagaaccctagcacagtggctgacaccaaacaagcccatcaagaataattgtcaaggacgaggctcagtggctcgtgcctgtcatctcagcactttgggaggccaaggcgagagaatcacttcagcccaggagttcaagagcagcctgggcaacataatgaaacctcgcctctacaaaaatgaaaaaattagctggggatagtgttacatgcctgtggtcccagctactgagggacttaggcaggaggatcacttgagcccaagaggtcaaggctgcagtgagctacgatggcaccactgcactccacactggggaacaatgagaccttgtctccaaaaaaaaaaacaaagaaaagttgtcaaaatgcatggctacatgagtcatttaaaactgagtgaaacaggaagatgtaaaagacctgttgttaaccaagctgtggaggaccgttaaggacttcgggctaaggtccttacaaagatatccttagccttttagacacacagctcaatgtgtggccgattggaaaggtaattaatccccagagcataaaaacgatgacttttttacagttataatgttaatttatcagtatgtccaggtttcttgtttgtttatttttgagcattcgccatgtgctggatgctattttttttttttttgagacagggtctcattctgtcacccaagctggagtgcagtgacatgatcatagctcactgcagcctcgacctcccaggctcagataatcctcccaccttagcctcccgagtagctgggaccactggtgcccaccatcatactcagctaatttttgtattttttgtagagacagggtttcaccatgttgcccaggttggttttgagctcctgagctcaagtgatcctcccgcctcagcctcctaaagtgctaggattacaggcgtgagccactgcgcctggctgcggggggctattttaagcccaatacacagcaatacatgtttccagtgcgtcctcactacctcccattttagagataaggaaaccgaaagattgacaagttaaattgcctaagggcccatagaattagaagtgggattctaactgcagtttgtctaactgcaaaagacatcctaggctgggtgcagtggctcatgcctgtaatcccagcactttgggagactgaggcgggtggatcacctgaggtcaggagttcaagaccagcctggccaacatagtgaaaccctgtctccactaaaaatacaaatattgttagctggacatgctggcgggcacccgtaatcccagctactcgggaggttgaggcaagagggttcgcttgaacccaggaggcaaaggttgcagtgagtcaagatcatgccattgcactccggcctggatgacaaagtgagaccccgtctcaaaaataaaactaactaactaaataaataaatctagatcagcagttctcagttgggagtgattgttccccgcccccgccccccgccccaaccctcaaccagcacccccaggggacatttggcaatgcctggaggcattttttttgtttgagacagggtcttgcttggtcgcccaaactggagtgcagtgtcaaccacagctctcttgacctcccaagctcaaatgatgctcctgtctcagcctcctgcatagcaggaactacagatgtgtggcgccatgcctagctttttttttttttttttttttttttcagtagagatggggtctcactgtgttgccagggctggtatcaaactcctgggctcaagtgattctcctgccttggcgtcccaaagtgctagaggcattttttgttatcacgatatgcgtgcctgtgttgggtgctgctggcatgtaatgagtaggggccaaggatgctgctcaacattttaccaagcccaggacaggcctccacaaccaagaattatctgggcccaaatgtcaacagtgccagtcttgacaaaccctaacctcaacaaataataagaattaagagaattaggccaagcaagagcacagctggtggagagggggtcaaaattgaccaggtctgccccagagtgaccagtggcaatcgtggcatcatggaaacacacaagttcacagttgtgaaatggttcaggttgtcaaagagttttcgtatcagttaccatccttacctttcataacagtccagagacgttattctgctctcattcccatcccctactcttcagctgatggaagaggaaagcagggttaatggatgagtcacctgtggaagttctcagagtcagcaaatgactaagccacagaacccggttatcggcctcctagcccacgtgcagatcctttcctcccccttctgctgccttttttgttaaagcagaagtgacaacgacgaaacgttcggaagatggactacagtgtcccatggcagttgggagtcagccatccagggggtccatacactgcagagggcatgctccgtgtatggacctccaggctggagaggacatgctccgtgtatgggcctccagcagcacacattgtttgttcatgtttccaaaactcaggaggagactcaagccccagccacatgctctaggagtctctatgcccctgttaggagctcccgtgctggagtttcaatccccagctggaaaccttagaaaaaccatcagaaggaaacgcaactgtttcctaatgaaagcgtttcatctctgagccagtagagggagcgcacatccaggccatccgaagctggctcagccgagacttcaatagcaccgagggctggaagaagcattcaacgcgcgatccttgaacttgaatgagcctatgcataggagcctgttaaaagccaaattcgcgggcggatcacgaggtcaggagatccagaccatcctggctaacacagtgaaaccccgtctctactaacaatacaaaaaaaaaaaattagccgggtgtggtggcgggcgcctgtagtaccagctacacgggaggctgaggcaggagaatggcgtgaacccgggaggcggagcttgtagtgagctgagatcgcgccactgcactccagcctgggcgacaggtgacagagcaagactccgtctcaaaagaaaaaaaaaaaaaaaaaaaaggccagattctggccgggtgcggtggctcacacttgtaatcccagctactcaggaggctgaggcaggagacttgcttgaaccggggaggcggaggttgcagtgagccaagattgcgccattgcactccagcctgggtgacgagagtgagactctgtcaataaataaataaataaggcagattctgagtctgtaggtctgcatcaggacctgagttcctgcattgcttatcagccaccagatgaagccttccaccggccacaccttgagtagcaaggtaatagataacttctcccaccctctcccatagatggtggacctgaggcccagggagtttagactgcttactagaggccaaacagaaagactgcagtgctggggctagaacccatgactcctacagctggtgctcacttcatagcatcttccctgcccctctgaccctgaaacaggattcagggaagaggatccctaagtgtgggtgaggagtaagagactatactatctgctttgaatcaagcttctttatactctatttttggtcaagttacttcccttgcagaagtaccaatagaaattcaaagatgaacacaagcagactccaattcttttgggcctgagggagccaaagtaaaatagatttgttagtgaagtccctcttatttttggttagtacaaatttggcaagtcatccaaagaaaagcttacatataacttggtatgtttttatgaatgcaaattatagccatagactttctcctaagaatgaagtttcttagcttgaatcagtttagatgaaaaatgcctcccttaaaaaataagagctcctaaactctcactaaacatgaaatgcagaggcaagtggttctagggttgatttggggaacacaatgaagttatcaaggatttaggctttccattttttcgctccatcgttctcagggtgtctttagggttatttcctcatagttacaacatggctgccatagctccgggaatcacatcacataatcatatccaaaagcaggtagaaaaggggttagctgcacatacctttttttaaataaggaaaaagaagccccctctcaacttccccttaaatctcattgaacagaactgtattacatgctcacctctaaacagaagggaaatgggacgttatcttggctatctcatgccaagcaggattgtcccccagggtgtgctgtgcaaacaaagtccaggttctcttagcaaggaagaaggggatgaggtgggaaggaaaaagaaagggcaagaaaatcccttttaattaagccctacactatctgccccagtacacttgtgttttcgctgtatttattcacaaagtaagggtcttcatgtgctgtgtgagcaaaggtcaggaccaaggaggatttagttaaatctggaatctcagtcaggggttcatactcttgagataaggaaaagtaaccaatgctgcctaacagcccagcacccacactgcagtccctagacttagcagatggaacttgctataatgaggaccatatgtattcatttgctaaggctgccatagaaagtaccacaaactgggtggcttacacaacagacatttattttctcacaatcctggaagctgggagtctaagatcaagatgccaagcaggcttggtttctccttggcctgtagagagctgtcttctccctgtgtcttctgcctgtgtctgaatttcctcttcttataaggatagcaatcctattggactagggctcatcctattaactcatgttaatgcaattacctctttttttttttttttttttttttaggcagagtctcactctgttgcccagactggggtgcagtggcgtgatcttggctcactgcaacctccatctcccaggttcaagtgattctcctgcctcagcctcctgagtagctgggactacaggcctgcaccaccatgcccggctagtttttttttttttttttttttttagtagagacagggtttcaccacgttggccaggctggtctcgaactcctgacctcaggtgatccactcacctcagcctcccaaagtgctgggattacaggcgtgagctgctgcacttagccacaattatctctttaaagacccttcctccagccatattttgagattctgatgttgggacttcaacatatcgatttgcgggtcacacaattcagtcctccaattcagcgagcatacttctatttcctctgcaagtctgatgtgcaccttgctttaaaagagatacgattatcatgcttctcatcctaattttcaaagggctttctatcatgtgtgaatctcaggttccagtgaatgccttcttcgtgtctgtggatgtcatcatatgagggtattttttgacctgtttctgtgacgtattcatagagttcctgtaatcgaacagtcatggatcagcattcagaatatataaagaaaccctaaaaatcaataggaaaaggacttttaaaatctagtataaattaaacaaaggctataaacagacaattcagaggaagggactgcttcctgctgtgcagatggtcatcttgcggtatcctcacatggccgagagcagagagaggaagctcactctcctttctcttcctttaagggcacttatcccctttatgagggcaccatcctcatgacttaattaattcccaaagccccacctccaaatatatcacactgggggtaaggacttcaaaaacatatacactgggggtaagaacttcatgtgaacttgttgtggggggacacaattgagcccacaacaccgagaataagcctgagcacacaccttgtgccacaggctgcatgttctacctttccgcaacccctgtgctgcccacgatgagacagcttcccactcaacacatcatcactttcaaaccagaagcaatgttgtgctgtggattttctggttattgacacagtggtgggcactatcagaggtaattcacatctttgcatccaatgggagagaaactaaattccctgttgacttaaaagggagaaactgaggcagaattaaaagtagagagttttttggggccaagtttgaggattgcaaccccggagcatggattcaagttgacatgagttatagactcctattagcagcatttacaagtggatttctaaaggcaaaaaaggggggacagggagtgagctgatgcacagttctttgtcaggaattctcattgtttttcagaaataacattgatgtgtgattggctatacattgttaagctatagggtgtggttatatgtctggtgcagcattattaggttaacttaaagctacttgtggcaatagtaagcagtttcaagagatggatacttagctcaagggaggagtaggatgtgatgactgtctcatcttttttcctttttttttttcttttgagatggagtctcactctgttgccaggctggagtgcagtgacatgatcttggctcactgcaacctctgcctcccaggttcaagcaattctcctgtctcagcctcctgagtagctgggactacaggtgtgcgccaccatgcccagctaatttttgtatttttagtagagacagggtttcaccatgttgtcaggatggtctcgatctcttgacctcgtgatctgcccaccttggcctcccgaagtgttgggattacaggtgtgacccacggcacccagctgactatctcatcttactgtctctggccctgatagtttagaaggacttatatttctcagatcaaagttcttttcttttctcacccctgtctcaggacctgtattctcagcaatgcctcttctttcaactacgatacatcactgtttggaaatggaactagttgcaacttaagtgccaagttcctgaagctataaactgctccccatgcttttagatcctatgtgcaagcaacagtgtgtgtttgtaatgtgttgtctgtgatgaagtgtggtaggctctgccttcactagcacagtgatttctatccagggatatgtgtcagagtcatctgaggagcatggattagttttctttcactgcttagacaaattattacaagtttagtgggttaaaacaacatagatttattctgctacaattctgaaggtcagaagtttgaaatcactttcactggactaaagccaaggtgtcggtggagctggttccttctggaggatctaggggaggatccatttccttgcattttccagcctctagtgttcccctgtatcccatggcttatagccctttctccatctcaaagtgcatcactccaacctctgcttccatcattgtactgctttctccccatagtcaaaactccctcttacaagcacacatgcagttatatgtatggcctacctggataatttagataatttccccatctcaccgttttaccttaattatgactgcaaagtcccttttgccatattagggaaaattcacaagtcccagaggttagcacgtgaatatctttggggccatgatttagcctcctatagagcctaaacatgcttagactccactccctaaagattctagtttagtagatggtgtctaagtttttgttttttgttttgttttgaaatggagtctacctctgtcgtccaggctggagtgcagtggcataatcttggctaactacaacttccacctcctgggttcgtgattctcctgcctcaacctcccaaatagctgggattacaggcacctgccaccatgcccacctaattttttgtatttttagtagaaacggtgtttcaccatgttgaccaggctggtctcaaactcctgacctcaggtgatccgcctgcctcagcctcccaaagtgctgggattacaggagtgagccaccatgcccagctgatagtgtctagttttgtaggtggtgtctccctaaagattttagtttggtagatggtgtctaggccagaggtctgtacaatcaggtgtacattctaccacatatgcacttgattacatatgccttggtatatagcacacagacttattcaagtcacagttattgtccataatgttatctgagtttttatttagagttagaacagtgctattttcttgatgttgagatactccaatgctgactgggcagtgcctacatcaatacaacggttatcttgttgaaccctcacacgcttccaaattaggttgtgttccctttttacagatgcggaagcaggctcagagattgttctatctgcccgaggccacacagccagggagacgtagatcccgaacccaaacccaactcttgctctagagcctgcgcatcccacagaacttcctaatgcagaacagggcaggggaaagtagtacattacattacaggtgccttcccagggcacacaagtctgttttcaactcctgcaacctccaccatcaatcagaactgctcaaactattagaaccccaaagctccatcattctactcttgacacctgtatgacaattacagcccatcactacgtgataaaggagattgcaagcacactaacgtggttgaagcagcagtctctcaggatttaagctcgactctcttcccacacagttcctgtctgaggaggctgcctcccccatatatagtaggatgcctactttcagaaggcaagaacacgactttagtcaactgctcccaggctaccatggcaacaagtgttcatcccggcagctgctccacaccagcttggctttccactctcaaagttctgctttagcatttttggcaaacacatcagaaccaagtcacgctgtgggctgccttgagacccaggggactttgattcccaatatgactctatacaagtggaccaacttgcagctgagaggctctagctctgaaatcaaggggctgtgacatcctggacaagcttctttagggctcaagttgctcatctgtaaaatgtgcacttttaagccatgtttttcaagttgtgggtagtgactcagtattttaatttcctattgttgctgtaacaagtttgtttcatgccgttaagctatctcacaattctggaggtcagaagtctaaagtggtacagcagagctgtactctttctagaggctctatgggaagatattttcttgttcccctactagaggcggcctgtgttttctgtgactctctatcattccaatttctgcttccattgatacatcctattctgaccttgtttttattttgagacagagtttcactcttcttgctcaggctggagtgcaatgtcgcaatctcggctcactgcaacctccaactcccgagttcaagcaattctcctgcctcagcctcccatgtatctgggattacaggcgcccgccaccatgcccggctaattttttgtatttttagtagagatggtgtttcaccatgttggccaggctggtctcgcactcctgacctcaggtgatccacatgcctcagcctcccaaagtgctgggatcaccggcatgagccaccgtgccctgctgaccttcttgttttatagggacacttgtgattgggcccaccgggatgatcttaccatgtcaagacccttagtcacatctgcagagtccatgttgccatgtaaaactaatattcacaggctctagggattaggatgtaattcctagacatgggtcgggggtaggtgtcattcagggtcaggaagtcatttaagtggccatttttaaaaatgccattaaaaagcatggtacgtgagatttagttatgatatacaatgcaacttgataaagtcacacagaattttgaatctaaaactatttagcagaatgccttggatccttaaaagaaggtccaaagaaggcttttgatgagacaatttgagcttttgaccctattactctagaaatgccagaccctctacataaggtaggtgtggttctttccctacatcagagtcttatctgtaagacctaaccaaaggatttagaaagctaccttttaagtctgtgtggcagaattctagaacaggtgccgggcacggtgtctcatgcctgtaatcccaacactttgggaggccgaggcaggcagatgacctgaggtcaggagtttgagacaagcctggccaacatggtgaaacaccatctctactaaaaatacaaaaattagctgggcttggtggcaggtgcctgcaatcccagctactgaggaggctgaggcaggagagtcacttgaacccaggaggcgaaggttgcaataagccgagattgcacctatagaaaaccacaagatgaccagatagacatcacgatattcaacctcaaggttagatttttgaaaaacccaagagtataatgactgagctgacatttaaatccagccactagaagctttcatcacttattcttcctgccatacgtagatttgaaatatttccttgcaaaaattttagactcaagttttctagaatacaagtgaatttccatatatcttgaaggtctctaagagctgcagtataaagcagacactagtcatgttgatgacataattacttagaataagactggctaccctcaggacgaaggcctcaggagacggtcaagatcgaatgcaggtaatggaaaactcactctaggctcagttgaatggtggagtctgattcttggaatgttataactgagccttaggactctggcactttagtattcctttccctaccaaagaaagattgcttgtctttagttataagtgggaaggtaactaagtccttttaagctcaggaaagttgtaagcttgagtgtaacttgagttaggaattaccttgaagtaagttcttatattactttcttaggaacatctggtttcccttcccttaaaagaaggggggttggatttatgccagtgatcatgggtagcttgctggcttcttatcctgtgtaagagcttgtagactcaagtgtacccccagagctgggctatagctaaagccctactgttgactgggagtgtcagaggactcatgtattggggttagaggatcagaaggggccaaatgacaggaaacaattataccatgaacttccctatttgtatctatatacaaatcctgcccagaggattgtggctaggtactgcctctacactgaggaacaaaagaaatgatcccttgtcatctaatcttaataagaatgtggaaggcaagaggcttattttgactgctttatttagaagcccatttagtgatttgacacagtccttttctcgtacaggtagtagatgaagcctagagttgccaccacacctgcaaaggcagccacagcagccacagctttggaaccaacatctccagcagtcttgtgccctttggtgtccatagcacctacaaaggaagcagacatttgagtcttaagtatttttaaataagggtaagtggaagccttacataaggctccccagagaagggggtaaaactaagccttcaacaggcttatttcagaagtttgcaacattgaataaacttacctcgtgagccaacctcctcccctgtttcactcctactcttctccccactgctcccacttgcttttagatcagatgagccgacacctgggaagaacctgagagtttagtacaacatcttcatgctagtcgatgtggttagctgtcccctgagggtgtgatcccacaggttgttcattaaggctatctcaggtaagggtatgtgttaacaggcacaaactaatacacacttaagtttggccatagcatgttaagatgcacatgctctgacctaatcttgctagaaacatatcttaaatctttgactactatacaagaaattcaagaggattttttttttttttttttgtggccgggtgtggtggctcacacctgtaatcccagcactttgggaggctgaggcaggcggatcacttgaggtcaggagtttgagaccagcctggccaacatggtaaaaccttttctctactaaaaataataaaattagctgggcacagtggcaggtgcctgtaatccctgatactcgggaggctgaggcaggagaatcacttgaacctgggaggcagaggttgcagtgagccaagatcacaccattgtactccagcctgggtgacaagaacaaaactttatctcaaaaagaaaaaaagaaggattctagtatggactgaggacaaaactagaaataaacctatagatatccatgaatgaggatcatgactaaggtagagccacgtggaatcctaagggttctttgtacagatataaggtagataagacagattagagaccaagttctagatcagtaggtagaagctatgatcctacttgtgttgaagtgatttctagaagggtacacaggagacttaatagaagcctacttctgggaagagacttagtcttttattcttctattgtttagactcaccacgggtacatagtatatgtaagcactgaccgcttggcataaaaagctaagaacttgaatccaggaagtactccaggctttaggtccatacctctgaatgaggagtcatctgacaacaggagaatgggtcctgggaggctgactgtcattttctctgcttcagtggcccctgtggctggagacagatgatcaagtttgtgtttggcctctggaatagtggttcgagaggtgtgtcaatggaatgcttagaagtagaagctctctggagtattttgttcatgtggtttgtcttgcctttgcaggcgaggttatgccctttactgtagaagtgggatggattcttggggttgggtgtggtggctcatgcctataatcccagcacttttgggaggccgaggtaggtggatcacctgaggtcaggagattgagaccagcctggcctggccaacatggtgaaaccctgtctctactaaagatataaaagttagctgggtatgttgggggggttcctataatcccagctacttgggaggctcaggcaggagaatcatttcccttgaaccctggaggtggaatgagccaagatcacaccatcttactccagcctgggcaacaagagcaaaactgtctcaaaaaaaaaaaaaaaaaaaaaaaaaaggatagattcttaaagaactcatcgtctatagaactagacaagaaactgttcatcttagacctgtcacatgagtaaggtagactggaccaagttttgactgggccaacaagagctctgggcagtaaataaagtatgagttataccagtccttaagatcttctattctaaaaagttgatacttgctttgaattagactcacagaaacaggaatttgaagtttttacctcgcctgtgcctagaggacacagggcaggtcacagaacacagtggggagtcaggggagagtcgattacagattaaggcactgcagtggaagtagacctggagacagaagagagttacatggaatcgatgcactaacatttaacctgtccctggtgacttctgaatcacttaccaggctagagagcacgtgggcttctgatacaaaggcaaaagccttcatgtcaaacctctgatagtgatcaggatgggtcacagaggagccgactggatggaaggtggtctggtagttgtccaggtcatatgcacagctaggaggtatgcaccagggagggatgtcagtcatatgcatcttggagtcaaattcaatgtctgcccagatttagtcatacgtaatatcttcagaactattgccatatttaccttctaccagcacctttgttttactcagcatttcttacctgacctataatacctatgaaatcataagttgtatagactagttatattttaactattttagcagtacctgtttgccaactacatgagaagtacaaattatatcatttcagaagacactggtttcttggccaggtgcagtagctcacacctgtaatcccagaactgtgggaggctgaggtgggcagatcacctgaggtcaggagtctaagaccagcctggccaacatggtgaaaccccgtttctactaaagatataaaaattagctgggcatggtggcaggcacctgtagtcccagctacttgggaggctaaggcaggtgaatcgcttgaatctgggaggcggaggttgcagtgagctgagattgtgccattgcactccagcctgggggacaagagtgagacctcgtctcaaaaacaaaacagaaggcttagtaactgagctaccacagcttcaagaaagcaaaggtgcagttttagccaagtacacactattccataagaatgggtgagatccagttgtaggacaggacacggcaggagagctgtaaggttgaacacctatgtgtacaagtgtgtggctgcaacctcagagcatcagtgctcagattctagagtcagatggatattctaatacaagctccattgtttaagtattgttttgggctggttatttaggcagcaagctggggtttcttcatgaaagacgaagactagtacaactagtggatgtggaatacatagcactgtgcctggcatatggtaggtgttcagatggatagaggctagagaccagtctttccagatgatcaacaccatagtagagtcagactttctggggctttggaactcattccttaagattcaagaggtgattggaaggcagcatgtggccaagtgtggtggttcacacctgtaatcccagtactttgggaggccaaggtaggtggatcacctgaagtcaggagttcgagaccagcctggccaacatggcaaaaccctgtctctactaagatagcaaaaattagctgggcttggtggtgtgcccctgtaatctcagctacccaggaggctgaggtaggagaattgcttgaacccaggaggcaggggctacagtgagctaagatcatgccgcagcaccccaacctgggtgacagaatgagaccccatctcaaaacaaaaaaaaaaaaaacagaaggcagaagagtcccaattagaaaacaaggactaaatctggatctcacatgactgaatgctgctctaaagcccaagagggtttattcccattactggcaagttttgatggattagctgggtaacctgatagtacagggagtacctacccatccacgacaacgttccactgggggaaagagtctggatccatggtggacgtcgcccagcagtcatctaagaccagcttgatgttggggtcatccctgtttaggactctcacttccatgtaaattggttggcggaggaatctcactagagggtactcgttttccccataaggttgttggtaggaattatctgaaattgaatggtattcaagtagttaatggctgcaacacagattcataggtcatcactgctccattagtctggcagtatcaggatgttcattttagggagaagtttgagatcatttaagcaatttcacagactgcaatctcttacctgggtagctttgcaggatcaaggtaaatggacccaacttcactgaggccactggaggagtaaggctttcaacgttgatgtttagtagcatgtcattcctgctataagaacacttcactgtcattctgtaagagtttggagggaaggtaggtacagaaaatttcaggttaaaaaattgcttgagtttaaactagagcttaagagtcaaatagcaattttatctcacctgaactcactgtctctagatattttgcttggaggaaaatccgtccagagagcatgtatttcgttttcatagacgactttatcatcttcgaacttaaatgtcagagaaagtgggttagcagccagttatgtcaaagatgagacttaacctcgtgccatctgccagtactaaccttatatctcgttccacatccattcaggggtatgtggaaccgtaccagcccctgagactgagcctcaaagacaggctggcaggatgagtttcccaccctcagagtacccaggtcaagagctggttgtgtttggtagctgtagacctcgacgtccataaacccatcctgggtgcacagctcccctgtaactagacagcggtgaaagtttagagaaaataagtttgtctgccctgtgatactgtcatctcccaacctgatatgctacgagggagaaattctaatttagcaggaggcatcagaatctgtcttgaagtctttatgagggaaccttgatcagcagcttgaattacaaagggagctgaagttagttgattgttctatgtgagagtaggacttttcatccaaaggagggaccagtagatgtaggaagaagtgctatatggtataagaccagtgagaatcctgatgaagggcaggagttgactcaaggttaaacttaatgtggctttaagtacagcgcctatgttattgtatcctttctttgtatactcacaaatcctgagtagtttggggagaaactgaggcaggagctggttttcctatttgatctgacctgtgcagatcacattaaacagaagcacatggtggaggcaatgctaaacaagagatattcactctatttaagaatttgtaggaattttggggtgggggggtacttaaacttaattctaattagaagtttgaatattcttacctagatgtcaggttcaggctcctaagccaaaatatctagattgtttaaccatggagcagttgccataaaacctacctatgtagggatcttaaaaatatcatacttaggaccccatcgtagcagctacactgtttctaatctgactagtctttagtttcttcagtctataagcaatagatcagaatctgaccttctatacatttgcccacatgtacaagagccaagggagaaaaaaggtagaacatgattttaataaaaggtctttacctatagaaacgggtgactcacagagacactcaggatagatcaccatggatactgtctctggccgaaggagaaaggtcagcttgagtgaagctaagtagaactgatggagtaggcatttttcagataactgaaatgagaaaatgtcaattagcagccacagtccgttggggcccggaaccgtcacagggaggcaggaagcaagtccactaaatacttgcaggacacactccagacttatctgggctccctttaaaccaaaacaagagagaccctatcacttcctcagatctggatgtatccccaggcagatttattgctttaaactcatgccctggagtacccagcactgtactctttgtacgaggcactaaagcttgaattagcagatcaaattccaaagaatagtggaatcctctgccaagccaggtctgagtcaaaaggactctacagatgttataaaatggtattgcataatatgtacccccaacctaagattattctctggtatccctggcagttctagtgaagactaacctcaacagcaacagtacgggacccttttgtttagatcaaggtgtcctgttcgttgaccaggacagattcatcattaggtatttgacaagtagttgctactactcagttggggccttagacagttttaagacttagaaagacttagacgatttttcatgacagaagttaaagaggttttgtgttagagaatgaactttagttacttgatatttcacttatacaagatgatcaaatgaggccttttggagtttgaatctgttatgttggcaattagagctcacgggcaagttatcagccgtatgaggactacccacaagagtatacttcaagtcaggacccggtggagttcagtggttgacaattgaacatactttcgttttgagcagagttttgctgaaatgcaatttcatgccatttgttgcttctagatcaattccattgtcatgcagctggctcacatcaatgttctggttttcaaagctcacagacttaagcttcccaggaaactctggtatggtgagagtcatgtgtgtggcattgcaggtcacaggatctagaaggaatgacaacagaatgcccattaccagccttgattaagcttctaggacaatgtctcccacactgaggttgcagctatctgggaccttacctggtgcacaaatagcttgtgaagagaagatcaccttctgtccaggagatataaatgtaagcttcagagacaccatgtagagatgactgttaccttgctagggggagaaataacagtgatcttcaaaaacattggttacttgaatctctaaccagtaagaatcatcttggcaagtatatatccaagtaatgggcactactttgacacaagtaggatttaagcatttgtctaatgactaatttgtctaatctggaggtatattagttttaaccttgttctaacatctggaagaatgttgtctagatcacctgtagccaatgacttctaggcagataagatctgtccttaccccatatgactattttaaagtatcagcagccagacaatgttttcaagcctcaatccatttgtgttcttactgggagataggactgttcttgaagtggttggcatttgagcacttacatctcaggacctgtcctaagtactttaggagattaattcatttagtgcagtgttcagactattggcctggaaagcaccaatacttgctataaaacaatataggacaatgacaacccaaacagaaccccttaacccataaagctttcaggaatatgcttgttctgtgttgtactatagatttaagactatgggaaagagactagattgaggtaaggattatgtatttttgagaaatggtctcgctctgtcgcccaggctggagtgcagtggtacaatctcggctcactgcaacttctacctcctgggttcaagcgattctcccacctcagcctcctgagtagttgggattataggcatgtaccatctcacccagttaagtttttgtgtttttagtagagacagggtttcactaaacagacagggttggccgggctggtcttgaactcctgacctcaagcgatctgcccgcttcagccttccaaagtgctgggattacaggtgtgaatacccagcgaagtgtttggcacttaataggcattaaaatgggttgtattataaattaatgtgaagacatggttgagatcatgcttcaatttaggaatactggcctgtgctttggtggtacaaagccagacttccacacctaccacatagtgagtcactccagtggcattgaatggcacatggaaggtcatcctgtggttgtcaatcaagaggctgaagccttccttcatggcctctggcagggtcagagttttggctcttgcaccatcaccaacctcaatgctccatcccatctgaactttggtcccctgaagtcaaaaagctttgtttagagggctggtgctcccttaaccaagtctctggtagtctaacaatttatcaggttaaaggtaatatcacctttaacatagaattaaaggttattaaggtctgatttttaaaatttgcttcataccttactgtcgtcagccaagccagagaagacccgtggcaaggaaaactggaagaaaagaattgtgatgtaagactttgatttggaggtagatgtttccgaattcatgccagaaattgctgtgtggttgtcataccaaaaggcctgctgtgggatgcagtggaagaagcacatgaaccctgactgtgcccttagatgtcattatacttctttgaacttctgatcccaagaggcagctggaagatctaagctcctttccagttgtaagttgggacacatttctccccccaagatagagtttcgctcatcgcccaggctggagtgcaatggtgcaatctcggctccctgcaacctccgtctcctgggttcaagcgattctcctgccccagcctcccaagtagctgggattacaggaatgtactaccatacccggctagttttttgtatttagtagagatgggttttcaccatgttggtcaggctggtctcaaactcctgacctcaggtgatccacctacctcagcctcccaaattgctgggattacaggcatgagccaccatgcctgaccaggacaatgttcttaaacgtttgccctttcaccaatgtccatagaaatcaggtactatgtaaaagccatgcagttctatcattgttattgagttgcttttatgtcagtgttatttttagttgtccattgttgacattagccatgttagactctaaacccatgaagatgtgactgggtcgttttgttcacttattgtatcttagcatctagggtagggcctggaacatggcatgtattccatttgtcagatgattagtgtgagtgcaactaccaataaaaccctattgccatgcatgatgtgccaagtaccatgtatataccctcagtaaattcttagagccaccctgaggtaagcattattgtcccatcactttggacttggaaacaaagcctcagggtaaagttaaacctcatcacacagaaaattagcaagtacaggattaaatcatggtctgatttctaagccccgccctggttagatcatcatcatattccccctgcagtagccatataccccgagcagtcagcccgtttcactcacagacatgaaatccttctggcagattgtagatgctgaaagcccctgggtctcttctacttgcatagctggacagaagaactgatacatgacagctccgtgtcttaaggcagcactgttgttcatgactctgatggtcatctggtgtccaccatgctgtgtacagatagcacagtgggaacagagtaagtactgtacccccatgggattctagaataccatctgacccatctgagtgggaaaacccttaaagttactaataccacaagtgctggaaggtacctcattcccgtaccaggagactagctagcccattgtaatctgttagtgaagactcatgctgataggccagttttagcatcaggaaatggagttcagtttctatttctcttatgtgtaccctatgtctcagtaccatggtcctggctgaatggggttggtatggggcttctacccaggttatctgaatacttgttaagcacctaagtagctgccattgtgctgggtagagctacccttgctattacccctgaccttaggaaactcagtctaaaagcaggggtcagccaacctttttccattatgcattagcaactgttttagactcatgtgagccacatgaaatccatagcatatttccttaaaagaactttaaaaagataaaagccagctgggcatggtggctcattgcctgtaactccagcactttgggaggctgaggcagactgactgcttgagctcaggagttcaagaccagcctgtgcaacatggtgagagactccatctctatatatatattaaacacacacacacacacacacacacacacacacacacacacacacaccacaaaagttagctgggtgtggtggtatatgcctgtggtctcagctactgggcaggctgaggtggtactgagacatagggtaggggattgcttgagtccgggaggtagaggttgcagtgagccgagattatgccactgcatgccagcctggacaacagcaagaccctgtctcaagaagattaagaagataaaacccattcttagtttgaaaaccaaaccaaaacaaaaacaaacaaaaacacaaaaaaaacccatgaactaggcacagtggttcatgcctataatcccagtgctttggaaggctgaggtgggaggatcccttgaggccagaagtttgaggccagcctggacaacatggtgaaatccccattttgacaagacaaagattagacaggcatagtgttgcatgcctgtagccccaactagttgggaggctgagacgggagaatcccttgagcccagcagttctaggctgcagtgagccatgattgcagccactactttccagcctgggctacagagcaagcctgcctcagaaagagaccatggactgcgtttggccatccacaggttatggcttgcagacccttagtctaagggaatgcgactccaagacctctaatgttgagaaggtctgttttagaaggaaattatcaggtttttcatgaaggacctatgattacttcattgattgatcacagagggctttaggggaccagatgacttacagttcaagcctgtttacagagtagggtctaagactgtatctgtacaaagcttagactgctgaccacctgcatcgtaatcagatggtatagactgttagatatgcagattcccagaactcaccccaggcctatgtccaactagtcaaacccaaactttccaaattacaacttgctagcttctgcttagacaggttgcttttattgctcctaatattcctgattgggcaatactgttgcttggcaatagaaaaacccttactgcttagctgctgtttgccttttaacacctgtttctataggtcagatttctatttgctagcaccaaaatagccttccatctcatgttggggttcacagatcaaaatagctcgtgtttcatcacttgttgtatccaggttctgcaccaggtcttaatctgtagaacatcattagtcttcattacccccatggagcaggcaccattactctcatcttctaatgggcaaacaggcttgaaagggctcacttggtggaaattacacctgattagtggtagagccagggctcaagggctcaagtacttgaatgccagggtttctcatcctcaacactgacatctcagtcctggtaattctgtgttatggggaggagacttgggtaatgttggttgtctgccagcatctttggcttgtatccattagatgccagtagtagctcttctaccttcagttgtgataaccaaagatgtttctagatgttgtcaaatgtcccctggacagattccccccaccctcctccagacagttttgctcttgttgcccaggctggagggcaatggagcaatctcagctcactgcaaacctctgtcccctgggtttaagcgattctcctgcctcagcctcacaagtagctgggattacaggtgtgtgctaccacacccagctagttttttgtatttttagtagggatggggtttcaccatgttggccaggctggtctcaaacttctgacctcaggtgatccacccgtctcagcctcctaaagtgcagagattataggcgtgagccatcacacctggcctagacagattataatagaaaagaagagccacacacgagacaccacccccttggttgagagccactgctttactccaaagagaaagttcttagccaagtttactgccagtaactcttaggttactacgtacttccccaagaactgctcaaagcaatgacttaccactctcctggtacagttatcataggtagccctcagggtgagcttttctgggtccaggatgtaagtgcagttcggcatgtcgagaccaagaggatctgccaaggccagagcaggttagacaggatggctgagtacatttcagtgacagtccaaagctatagagtcaagaccaccagtccatttctaaggtacttcagtcccttcacttccgccccaactcagtgatagaacttgagctttgagatggtatgacttgcagccagaggcttcccagagatgctggcataagacacactttcgaagacagacaggtcttccatgctgggtggcttcatgcaaatcaggtatccccatggcatcatgggagttggatgccgttgctgcaggagtttgggtactctgctccccaaacaggattgacctaagccaaaggctgtctgctaatcaggactatgaggagataacacacgttacctacccaccacagatgcatgccatttcttggtgccaggactgcttgggaactccactgttatttccctttcatcgcaagtgacagtgcctaaggagcaaaggaagcatttgggggctttgagtcatgagtgatgcaactcctacaaaagtgtatagactcctctcagatgggagggattccagatgagggaggcaagaatcgtcccctaccctgggagagctcacaaacaagtgaccaagacaacaatacaatatgccaagaactgtaaggaaaatatcaggtacccagggcttttgaagtgttccagtaagaagcccaggttagggttgacaagcaggtctgtaggagccaggtcaacaccttgacagtggagcagatggaggcaggcccgaaaaactgacaaaagctttgtcaacaggttttgcaaattgatgttaaacaaagtcctgggtaagtcccaggacttttatttatttatttatttattttgagacggagtctctctgtcacccaggctggagtgcagtggcacgatctcaacccacctcaacctccgcctcccaggttcaagcgattctcctgcctcagcctcccaagtagctgggattacatgtgcccaccaccacacccagctagtttttgtatttttggtagagatggggtttcaccacattggccaggctggtctcaaactcctgagctcaggtgatctgcccgccttggcttcccaaagttctgggattacaggcgtgagccccggcgcctggctgcatttttttttttttttttaaagatcaagttttgcccatcatctgctactctgcagcctctggctcaggtgaacgtcaagtgagcagctccagttttgcttgttatgtcgatgttttccttaagcatgagtttgtgtttgaagattgctgctcctaaagatgagggcttagtgtggtggtttgctgttctgtggataccataaagcttgaggcagtgagggattggaaggcagtgcaagtgtttgagttttcatttagcaggtatagtgagtctacaggttagcagaagaaagatccagtaacctgaccaaggtaataaagggggtgaatggaggttgtctgagccaggcctgtgtttcttggccagctaggccttccagctgcaacctgttttctctgctaagaagacttctgtcacccaagagacatacctggaaaggcaggatttaccaactgagaaacatctatggagttccctgaagtcacaagggcgaagaagagagaaatcgacctgtaggtgctggaaagagacagggagatagtcaaggaagaatggactttaacaaacaaagctaccataccccctccctccacttccagaattactcacctccagcctgcattgaaccagcctgagggactccaagagcctcctctctgcctgcacgccatagcagaagacactaccagatcaaccaggtagagggtaggctgctctgtgtttttatagcaggaagccagccgcatccacaccctctccccattgggggcacctgaatcttgtcccattctcccagctgaaacggaaggattggggaaggaagtggcctctgattcctgacagcttgcgccgggtattctgccagctgccctgtgggccaggcatgaaatcagagtttgctgaaatcagctccaggtgagtgaattggtgttttccctataactatgggggaaattaggatcttttgggcaaattatttacaactgcaatgtagagccaaagagaatcatgggctttattgagaaaaaaacaagtcttgttcacaccactacattttttttttttttttgagattcagtttcactctgtcacccaggctggagtgcactggtgcaatctcggctcactgcaacctctgcctcctgggttcaagcaattctcctgcctcagcctcctgagtagctgggattacaggtgcacgccaccacacctggctaatttttgtattttgagtaaagattgggtttcaccgtgttggtcagggtggtctcgaactcctgacctaggtgatccacgtgcctcggcctcccaaagtgctgggattacaggcgtgagccattgcacctaccctaaaaccttttaagtaacatctagtcttctggctactgcagaagttaccctgataatgcacaggaagtgtctttaaaaaaatgaatgaagccttgttgacccccaagtgtaaaagcttaagcttaccgcaaagatacaatttcagaaggatacagagaaaaggcaaaagtcactcataatagtgccactgctaatatttaggtgagtaactttagacatgtttctacaaacaccacacacaatttttttaaaacactgggaggaaagtttaaatactgttttgtaatctgctactgtcactttataactattaaacataaagctctctgttaccattttagggtggcataatattcaatttgagataaatctgtgtttatataatttccttaattatgagcataaggtggcttgtaatttttcatcattataagcagtaacatgatgagcattctgatacatatccttgggtaaccctcaagataaattcctcaaagtaaaacttctgggtaaaagggagtagtgatctaataagaatgttatattgttgtaaagcacttggaagtttcccagtggggaaactgaggcaaggcaacttgccccaacaatgtcagggaccaggtggagaactcagatttcctgaggcctgatggttgtgttttttcaacatctctcacactctttgagataactagatgtctgcagcccatgttccaaaataggtggatataaggcttagactccattcaagtggtgggtgacacttgcaattattaggctggtgcaaaagtgattgcagtttttgccgctacttttatgtatgtatgtatgtatttgagatggagtcttgctctgttgcccaggtgggagtgcagtggcgcaatcttggctcactgcaacctctgcctcctggattcaagcgattctcctgcctcagcctcccgggtagctgggattacaggcgcccaccaccaagcccagctaatttttgtatttttggtagagacagggtttcaccatgttggccaggctggtctcgaactcctggcctcaagtgatccaaccgtgtcagcctcccaaagtgctgggattacaggcgtgagccactgtgcccggccctttgccactaattttaatggcaaaaactgcaattatttttgcatcatcctaaactgtattgattcatgtgttgcctttgaggtgtaacctgaggcatctgaaataacattggagattaactgtttccctgacttccttgatcaaaaggatcacatggagctctcattaatatcacagattccagggtcccacccaaaagctgctgaattagactctccagaagatgtgcctgggaaatatttacttaacgagcaccacaggtgattcttataatcaggaaaacctggaaaatacttggagggagcgaggcgagaaaatctgtggtggccagtggttaacctccttacgggaattgagtagattacatcccagcggaattgggaagaaggagcaaaatacagataagtttttggggatagagatggtaaaaggatttcattttatagccaaagcatgatagcaatagtttctccttctatgcatatttttctgaaaagtggcaccttttctacaaatataatttattgccacaatggttaagactatgataagacattagaggaaaaaggagcatagacgtgagactcagagccctattgagaaggtggtcagagaagtgatgggttaatgtgcttattcagcctccctcagaccccacctcccttcccaccgcgctactcactcccctcgagatggtgtctttctccagagcgggaagtttttgccttggaaagggcagctttggtcagagcccccaaatttggggtttctaaaaggttaaggggcagcacagagaccccaagcaggagatgtggtgagaaagcccgctgtgggctggtgaagctggtatgtgcaccagagattaattttgtttgtctcacctaacccagacctgtggtgtgctggggacagccaccgaacaaatggctctgggcccaggagcatccatgtctaggattctgctccggaaaagcaggaagctaccatctgttcagcaactgactttgaacacaggaagaaatagctgctccgtaaaacagtgtctcctatcaggaggtaggaaaaactaaagttattacaaaaatgattcttaacattctgttctcacttataagtgggagctgaacaatgagaacacatggacacagggaggggaacatcacacactgggtcctggtgacaggggttggggggtgggggcagggagagcatcaagataaatagctaatgcatgcggggctcaatacctaggtgatgggttgataggtgcagcaaaccaccatggcacacgtttacctatgtaacaaagctgcatgtcctgtacatgtatcctggaaattaaaattaaatttaaaaaaatattgcgctaaataggcccggtgcagtggctcacgcctgtaatcccagcactttgggaggctgaggcgggtggatcaccagaggtcaggagtttgagaccagcctagccaacatggtgaaaccctgtctctaccaaaaatattagctgggcatggcggcacacacctgtaaatcctgctactcgggaggctgaggcaggagaatcgcttgaacccaggaggcagaggttgcagtgagccaagattgtgccactgcactccagcctgggcaacaagagtgaaactctgtctcaaaaaaaaaaaaaaaaaaaaggcagtaaacaaacagcagacctcgttcaaatatatgtgttccacactcttttcaatgaacctcttaaagtttgctgatttattattacaaggtgttccttctcctcttctctgccctgggttctatgtatcatgaaaccatttctctcttgctaatcacaaggcatttcttgacggggttctcatacataaaagaaagactatagttttgttgttgcctcatttgggcagatgtcttcctttctgaagtgtggttcttataaatgacagtttataattcttaaattctgaatctgctgcccttgttttccacaacaattataaaagtatttataaaagacaacctaaatatcaccatctagagatggttggataaactatggaatactcttcagctactgcaaatgattctatgagttcgttcagatctgtgagtactgacatgaaagatgtctgcaataaaactggaatttcagggctatatatctactatgctttcatgttttgctttaataggaaaatgaaaaacctgtcgacctaaaggaaggagaagagaatatagttttaaagagtttacttgaggcaaagtgtggacagctgcccaggaaacacttccaagttgccttggtgagttctccacttttgtcacaagtgggtgttttttttgttttgttttttgttttttttagacagagtcttgctctgtcgcccagactggagtgcagtcgcacgatctcagctcactgcaagctccgcctcccaggttcacgctattctcctgcctcagcctcccgagtagctgggactacaggcgcccaccaccacgcccagctaattttttgtatttttagtagagatggggtttcaccgtgttagccaggatggtcttgatctcctgaactcatgatccacctgcctcagcctcccaaagtgctgggattacaggcgcccaccaccattcctggctaattttttgtatttttagtagagacggggtttcaccatgttagccagaatggtctcctaacctcgtgatccgcccaccttggcctcccaaagtgctgggattagtggctgatacagtgtttcttgactcattgatttacagaaataacactgattagctgggtacagtggctcacacctgtagtcacagtgactcaggaggctgaggtgggaggatagcttgagcccaggacttttaaggcagtctgggcagcatagcaagatcccatctcaaaaaaaaaaaaaaaacactgattagtgattggctatacattgttgaactatagggtatgattaatggcgtccagcatatggtatgagttatgatgtccagtgtatggcatagttaggttaattttatggctacttggtgtcagtctagagcccacatatcaagtagctccaagagataattactgagcccgagggagtgaggtgtgactgctgtcacgtttcaatgcctctctgggcctgataatttaaagggacttgcattcttcagataaaaagtttcttttctttctcaaacttatgtgtatatttatactttatgtgtctgcatgtgggtctatacatatgtatttggattacaagtcaagaaagttgtcccagagaatcgacagcatcatccaggaaaggagagggttgccagggtccggggagtccacgtggctgtgctgggcatttgcgaccattgtctattctgacttgttcgtgcttttgctgtatgggttttaaatacattgaatatcatcaccgggaataggattaaggagatgggagggttggagcacagaaaacaattccccaaatgtgcctgggcatgccaagtgctttggaaaattaaaaggcttcagaaataagcctcagaatcaaggtctctctatccttgccttgttccctttccacccccaaagtacaggaaggaactctctctggggaaaaaaaaaagaaagctccttcttttttttttttttttttttggcagggctttggtcttgttgcgcaggctggagtgcaatggcatgatctgggctcactgcaacctccacctcccaggttcaagtgattctcctgcctcagcctctcaagtagctgggattacaggtgcacgccagcaaccatggctaattattttttttttcttgtatttttagtagagacagggtttcaccatgacggtcaggctggtctcaaactcctgacctcaaatgatccacctgccttggcctcccaaagtgctgagattacaggcatgagccactgggcccagccaaggcagcttcttaacagaagaaacactattgccttctatcccctccctgaaatctcattatctatagcaggaaaggagactaaggaatgtaaccacacatggacagacttttccacaagataatgtcagcctctgaagctcagtcaaattccaaagataattatgtacaagttaatttctctctccctggtctgttcattctccctgataatcattattgcccctcaagagaattgtctacagtccccatctcctccctcccctatgaaaaactgtatatacagccaggcacggtggctcacacctgtaatcccagcactttgggaagccgaggcaggtggatcacctgaggtcaggagtttgagaccagcctggccaacatggcgaaaccctgtctctactaaaaatataaaaaattagccaggcatggtggtgtgtgcctgtaatcccagctacgcaggagtctgaggcaggagaatcgcttgaacccggcgggcagaggctgtagtgagccgagattgcaccactacactccagcctgggcaacagagcaagactccatctcaaaaaaaaaaaaaaaagaaaacccaccgtatatatgcatctgtgccccactgagggtttaggggcaattactctgtgattcccaccttcccctgcacattaataattttgtatgaatttttctcttattcatctgcctttggtcagtttattttcagtgaactttcagagtgcaaaggtgggagttttcttccttcagcccttaaagaataagtaactcctgcctttctgactttgagggagaagaaaaggaaaaatcatttgggataaacaggctgcacctgcacacagataagcaactttgtctaattagcgagctcctaggaaaaagtttcctccccttttcagacatatccatggtgggaacttacacagggaggaggggggcttacctaaaacaaacccgcagttatcaaaacaagagacgcaggctttgtgcttgcctagatacatgcccacagttgcgtaagataccgggagttgcacagacagctttactgatgagaagttactcaaactgctagagatgagagaggagtttcttaaaaaagcttttgaattcagctgtaacctggcaatccacttggactcccctctctgctgcagagaatttttttctttcacttattactattcttttttgagacggagtttcgctcttgttgcccaggctggagtgcaatggtgtgatctcgggtcactgcaaactctgcctcctggattcaagagattctcctgcctcagcctcccaagtaactgggattacaggcatgccccaccacactcggctaattttgtatttttagtagagatggggtttcatcatattggccagactggtctcaaattcctgacctcaggtgatccacccacctcggcctctcaaactggtgggattagaggtgtgagccaccacacctggcctctttccctcattaaactttcactccaacccacctttgtgtccatgttccttaattttctaggaggtaggacaaagaacccagggtactagttcagacaatgagaaagtctacattaaggtgcattggtgaggttccaacaactttattccctctgttttggttgaattgttttagtgataaaataaccaattaaataattatagactgggcatggtggctcacgcctataatcccagcactttgggaggctgaggctagaagataacttgaggccaggaattcaaaaccaccttcgacagcatggcaggaccctgtctcttaaaaatttatttagttagttagttttagttttttgagacagagtctcactctgtcacccatgctggagtccagtggtaccatctgtgctccctgcaacctctgcctcccaggttcaagctattcttatgactcagcctccccagcagctgggactacaggcgtgtgccaccacacctggctactttttgtatttttagtagagatggggtttcatcatgttggccaggctggtcctgaactcttgacctcaggtgatccatccgccttggcctcccaaagtgctgggattacaagtgtgagccaccgtgcctggacaaaaaaaaattttttttaataataattttgactgatttctgagtgagctacctaagttacagagtctaaggctcaaggatgaaaactcagtagtataaaggtaaaaaggcgaaatgaatggatccggaacttgaggctttgaaacaaagtccaactccctatggtaaaatgaagatattaagaggtttaatatctaaagaggtttagtgacttgctccaggtcatttaccaagttagtagcagatagagctccagtgagaaaccaggtctcctgatgcctctccctgccctttctaattcatttcaattttctctctctcgctgtgtgtgtgtgtctgtgcatgcgggggtgttttaaaactctgtgcttctcttgcagttcacttgtcttttaaaagtacaagatgacattaattagaattttagcagtataagataaataatataaaaacttctcccagttatgctaatgcagctcaaaatagctttcaaatatcaaatatgaatttaacttggaaaaataagatagactatgtcaatgagaatgttctcgaacatcatatggtagttcctttaccaatctaatatacaatgttaatgttgttttccccttgggtcctttagacagatccaagttgaatgagccttctgacagtaataaattcagaaagaactaggatgaaagctttatcgatctataaatataaaggtagggcggcatcaatatatggaagacagaaggcccagaagtcttttttttttttgagatggagtcttgctctgtcgcccaggctggagtgcaatggcgtgatctcggctcatggcaacctccgtcttccaggttcaagagattctccggtctcagcctcctgagtatctgggattataggcatgtgccaccacgcccagctaatttttgtacttttagtagagatggggtttcaccatgttggccaggctggtctcgaactcctgacctcaagtgatctgccccctccagcctcccaaagtgctgggattataggcatgagccaccacaccttgcctttttgtcttttttaactgttgttgctttaacgtctgttttgactgatacaagaatagctattcctgctcacttttgatgtccgtttgcatggaatgtcctttttcacccctttactttaagtttatgtgagtccttacatgttagatgagtctcttgaagacagcagatacttggttgctgaattcttattcattctgccattctatatcttttaagtagagcatttagtccatttacattcagtgttagtattgagaagtgaagtactattctattcgttgtgttagtttttgcctgaataccttgtgttttttttttcattgtgtttttgttttataagtcctgtgagacaatgccttaaggaggttctattttggtatattttgaagatttgtttcaagattttgagctacttttagcagttcttgtagtgctggcttggtagtggcaaattctctcagcatttgtttgaaaaaaaactgtgtttttccttcatttatgaagcatagtttcactggataccaaattcttggctgataattattttgtttaagaaggctaaagacaggaccccaatcccttctagcctgtagggtttctgctgagaaatctgctgttaatctgatagtttttcctttataggttacctgatgcttttgcctcacagctcttaagattctttccttcatcttgaatttgatcattatgtgcctacatgataatctttttacggtgaatttcctgggtgttctttgagcttcttgtatttggatgtctagatctttaacaaggccaaggaagttttcctcaattattccctcaaatatctttttcaaacttttagatttctcttcttcctcaggaatgccaattattcttaggtttggtcatttaacatactcccaaacttcttggagactttgttcatttttaaaatccgtttttctttgtctttgttggattgggttaactcaaaagccttgtcttcgagctctgcagttttcttctacttgtttgattcttgttggagaatacctggatactcatttggttgtctttatcctagatgggtatgtgggtttgcctatgctgaggttgtttcaagaaccaagagaagtcaatattgtaagagattagtggtatgtgtatgtgtatgtttatgcatgcatatagatacatatatatgtttttctagagtagcttgcatataaaggggcagtgatatagcaagaaataagctgctgtttttaactatggcaggactctgcttgttcagagagtgtgtaagatgcccacacagcaatgacactatgggatgaaggggtgccctgcccctccaaacctgtgggtgttttcttgtcgggtgggatgagagactaagaaaagaaagagacacagagacaaagtatagagaaagaaaagtgggcccaggggatcgtcgctcagcatacggaggaccatgccggcaccagtctctgagttcccttagtatttattgatcattatctctaccatctcggaaagggggatgtggcaggacaatagggtaatagtggggagaggttcagcaggaaaacatgtgaacaaatgtctctgtgtcataaacaaagttagaaaaggtgctgtgccttgatgtgcacatacagaaacatatctggtgcattaaagagcagtattaccgccagcatgtctcacctccagccttaaggcagttttctcctatctcagtagatggaacatacaatccggttttacactgagacattctattgcccagggacgagcaggagacaggtgcctttctcttatctcaactgcaaagaggccttcctcttttactaatccttctcagcacagaccctttacgggtgttgggctgggggacagtcaggtctttcccttcccgcgaggccatatttcagactatcacatggggagaaaacttggacaatacctggctttcctaggcagaggtccctgcggccttccgcagtgttttgtgtccctgggtacttgagattagggagtggtgatgacttttaacaagcatactgccttcaagcatttgtttaacaaagcacatcctgcatagccctaaatccattaaaccttgagtcaacacagcatgtttctgggagcacagggttgggggtagggttacagattaacagcatctcaaggcagaagaatttttcttagtacagaacaaaatggagtctcttatgtctacttctttctacatagacacagtaacagtctgatctctcttttctccacaatgggaccaggataaagtgttactaaaacacatagcagctaattttgctctgcgtggccacttctgtatccttggctaacctgggaaattatcctgcaagtgtgtgtgtgttctttctactgatcagtaattcaactgcaattgggcaatatgcaagtttgcttaagtcttataaccctgtgagtgcaggtgtaaatatccccatatccccaagagaacagcctttttaatgcttgagaattggccagacatgctggaaatggggactagaagagctttcacacaggcgcataatatgtatttggtgactgattggcacagaaggaaatgagggagggttaggatgtaactgatgtgagaggaaatgataggacattgtcacactcaaaaggccattcgacatggttactggagcaaggcaaatactgtacatgagtgaagtcggttgggtgcaaggaaatggctttagtgtgatgagaatggcaagtgactaactattgccctcagggtcaggattacagctctgggcagctgggggtgatgtggactgttgagtccaggctgcatctaaagaaataactgctttggctgggcacagcggctcacacctgtaatcccagcactttgggaggccaaggtgggtggatcccctgaggttgggagttcgagactaacctgaccaacccggagaaacctcctgtctactaaaaatacaaaaaaattagccgggcatggtggcgcatgcctgtaatcccaggtactctggaggctgaggcaggagaatcacttgaacccaggaggcggaggttgcagtgagctgagatcgcgccattgcactccagcctgggcaacaagagcaaaactgcatcttaaaaaaaaagaaaaaagaaaaaaaagaactgcttcccagctcaggcagaggtaattgtcatgatcttcagtttctcatctggaagctgaaaatccagattccattcaatttcctcaattttaatgttgatatttaatgttaaagatattttcaaaatcctgtgcctgccaaacaagacatatctctggccatatttattcccatccaccagcagcctgtaacttccaaaaccatggagagaccatgcatatagtggctgagctgctgctcaccctgtgggcgtggggcaggaggcgaacctgcagctcctcccactccgtccagatctcccccttcagcttctctgaatcctaggccaggtgcgtttgcagctttgtctatggtgaaaggtggcagcttatcctgtagacacctgtgtcgtcgaggttgggggtggtgagagacaggcgtgggtttcgttttattctctggggttccaatttgtctctgcagattctaatttgttctttttctttacttcctctccatctttacttcccaattgctggccctacggactttgggtctaacatctggtgcagaagaaatagccttactagacagcttacctggcttccaggtataagcttaatctctgcaataaaccctttattctatatcactcagaatggttctgcttctctgatgaaacctgactgatacagaatttggttgctacctccttatatgagaggcaaggaacctggattgcagatagggacaataactctaggtcctacagttacttagtgacagtcctgggaattgaatccagggttcccctcatctctgctttttactttttcccctgtgtttaaagaagttgattctcacctttgtataatctttttttatttttttgcgacagagtttcactcttgttgcccaggctggagtacagtggcacaaccttggctcactgcaacctctgtctcctgggttcaagtgattctcctgcctcagcctccaagtagctaggactgcaggtgcgtgccaccacacccagctaatttttgtatgtttagtagagatggggtttcaccatgttggccaggctggtcttgaccccctgacctcaggtgatacatccacctcggcctctcaaagagctgggattacaggtgtgagccaccatgcctggccacctttgtataatctttaaagcatcttttccataaaatgtcccccaccattcaaataacagctgagtcctgctaagtctcctttgatcatagctctgtaagccactccttcctcatttggtcctctgcaggttttgtaagccacatgtacatcgttcacgtttcatccagagttctgggaaagagtaggtggttcccagaaacaatgtgagttcatgagtctttctaagaagaagggaagaaagtttttgtcaaggccacaatgtatagaccttgtgctaagcactgatttataaataatccagataggagtaagaaaatgaaatgaagtctccttgaggtgaattttcctccagttgatagtagtagaaagctattatgggctgaaaatatatctcccccaccattcatgttgaggtcctaattcccagcacctcagaatgttactgtatttggagatagcctttgatacggtttggctctgtgtccccatccaaatctcatctcaaattgtaattctcacgtgctgagggagggaggtgattgaatcatggaggtgatttcccccatgctgttctagtgatagtgagtttgttcctatgagatttgatggttttataagtgtttggaagttcctccttcattctctctcctaccactgtgtgtggaagatgcttgcttcccctttgcctttgccaggattgggtttcctgaagcctccccagccatgttggaactgtgagtcaattaaacctctttccttgataaattacccagtctcgggtatttcattatagccgtgtgaaaacagactaatacagcttttacagaggtgatgatgttaaatgaagttattagggtgtgctctaatcaatatgaccatcttataaggaccaagtgtccttataagaagagaaaatttggacacagacatgtgaagaggaagatgacatgaagacacaaggagaaaatggccatttgcaagtctttttccaggagagaggcctggaacaggtcctttcctcacagccctcaaaaggaaccaaccacgctcacaccttgatttcagatttctggctttcagaactgtaagaaaataaatttgtttaagccactcagtctgtggtactttgttatggaagtcctagtaaactattacaaaaccccagattgaaattcaattctgtgtgactgtaaaatatatattatttttattataccatgataaggggtaggacaaaaaaaaaaaaacaaaactaggtctcggctgttgttattgagaaggaaaatgcagagaaaagagaagttttaagaaaatgctgcatttatatagattgacttaaagaaaggagaaactttctttctcctagtgctagtactactattaatttactttaattaagtgctgactacacaccataaactgtacttagtattttacaaatattcagtaattacttgcaacaaccctgtgaatgattctcttttaaagagaaaagtactgtctttattttactgatgaagaaactaaagcttagggagaagtaatttgcccaacttaatgggaagatccaatctggggcttaatatctgtcagtctctgacttcagaccccatgttctcaatcattattctactctggctttatttcaacacaatgcttggagtttacatttgcttgtctttccaatccaaccatcagctttgtaagagttgaacggttttgatggtatttgatgatctgctaatggatgctataacacacctcccttgtggtaaattctaccatctttgaaacaaaatggcacctaacataggtttttccaatgattgtcgttcctgcagtttttctagaacttgagttatagaggggacctgttggtagaagaattacatggattgaaattttcaagtcacagaaccaataattaggaagaaggaaagacataagaaaaaagggaaatttgttcagctaacaaagccagtttaatcaagtgtagaatttaaattcctagcccctgcttagactatccagtattcaaatttgaaagaatttgtttttggaagcctttataaaactcttcactgttacaatgtatgccatctgggatttagcatttataaaatgtgcagttaagagatgccaagagattcctcatgcaaaccagatggtacaataacagctctgtctttagttttctgccagaaaaataggcctttgaatggcttgaaacttatatgaataaattaagctcaaccaatacttcagggacattacaatttcaataggcaacttatccacttaaatatttttataaatgttttcatttagaaaagaagaaacaaaaaggcagacaatgattctttttgattgttaaagaatacaaacatgatacaatgcttttaaggaaaacatcaatgactttcaatgtgggaaagaaagtttctccttattttgacagtgttatatgtgtttgtttatttattttttgagacggagttttgctcttgtcgcccaggctggagtgcaatggcacaatctcggcttgctgcaacctctgcctcccaggttcaagtgattcttctgcctcagcctcccaagtagctgggactacaggcatatgccaccacgcccagctaatttttgtatttttagtagacacggggtttcaccatgttggccaggctagtcgatgaatgtgtttaagttagaagtgaagttgttgaaatttcttccgaataggagaaatccatatcaaataggttgaacagttgtatcattgtgctaaagagaaaagaatacacatgtaagtgacattttctggataatatatttgagcacatctttaccttaacagatagtctctcataaacccaagggcagtgcatacagcagtgtgttactgatggcttcttttgtccttgcctggttcctgcaagttttctatggaacaacaggacttttgtattactctctaatttcccttactttgttactgtttttattttcattaaaattcataataagatcctcattagatgaagtaatcttgttaaaagcagtgttctactctgatctttttccttcttatgtaaaaaaaaaaaatgtgcttccctaccatacaagtgaatttcttctctaattagacatgaatagctttagagatcaaacacaggctgcttttgaaaaccagatctcttaggacacaggggcaatctcattactgaaaatatgtgtttctgggttgcacaagccattgaatttctttcccaattagcagcaaatggtttttcagaacaatgaggaagaagtttggtttgtactttgcaagtgttgtttttttcttggagttagactggaagtatcaactaccatcatctctgtcccttcttttcctctccctgagcaaaggaacacacatgactctgttttatagatagtcagagttccaggtaaattcttcatccaaatgctacttcctctgggccaggattggactccatggtagaaggaacacctatttaagactacctagttgtcagctactgtcagctgttatgatgttaggggagactgcaaaatcataaacacagcaatgagaagctgacaatgtccttgctctggggggaggaggggaaccattcatgagagaatctctccaagtgctgcccctagaagcagattaaccatgttttctctgggtctttggcaaaaaagaagtggtgtctgtggagaagggcttcttatcattaaataaccaactgcttggggttccagataataggttgaggttctagagttttaggacagtgcaggaggaaataagacctgcctgtctaaacctaagtgtcagtcagagtcaagggaacacagaggtcatggacaggatgtttctctaagttgagacatactagtagtgcaggagtatggggagatatgaggagcatggcgaggctccaacaggaaggttgatgagagctttgacttggggtcactgccactcaggtccgagcctcaaagtctctccagtgtgtgtctggcaaatattcttctctggccttccaagagtccagctgtatgctgatggaacacgctcaaatactaatttccacaagatcagtacagtcaagaaaatccacaactgcccccacaattaccatgactcctcacaaggaattaatgtctacattatatgcaaattcgtgttagctctttttattaatttctgcccttaccatctcccaccaattttgtttcctttgggctttgaggaattcaaaaatgattactgggctaaaacttcctctgtctgttccctaagccacaatcacactacttctagtttgtaaaaacatgctttatgggttgcaagaaattttatttcttcatctttactaaagttagttgatgctgatgataatgatgatatgatcactagcaacatcccccagttttatccacaaggatatggagactcaaatagatggagtaacttttcctggattatatgaacgctaggtcttcaaccctccttcccaacctcaccttgaagggataggataaggaggatcttcaagttcagaaaaatgttttaaatccttatctctgcccccacttccccaccccccgctgcccctgccaccccattcttctcccaaggaggaaattttcccaagggcgtgccagaggatgccaggatatttaccatttaagaaagtttggttatttcgccatttcacaggagactttaagttctagtcctaaggactgctggaactgagaaattctttctctttcttgtcttctatctccaatccttcttccccatctctataattattctgtcctctttaccctttgcctccatcctgtgaaacttaatcacgcaaattgcatcattcttgttatacccaactaaatcagggttgagaggctgggtggtggagttgggggagaaagcactccgagtacaaaaaataaataaataaataaaaattgctccaagaacgtaattctcagcaagactgactgctggaactgcctgctgtaacccgggagcagttttatttacagctgctgagataacttgctgcaactctaggacaaattttgcccactaatcagagcttgccagctccccaaacccttactagtgccaatgaactttcttgaagagcaatatgtaacatttctcttgttaataaaacctctaaacttctcttttcttcttcagacatactgaagaccacctggtctatgtgtgtatcccaaattgcaagtctttttccaaataaaacattaaatttagagattcagctctaaatttttattttgactttgacaatcctcatcctaatttggcttatgaccatcctagtggccactattcttctctttctcttcctcttcctcatccttatcttctgaaagcagaccctttggctggagtcttaggattctactacaaataatacatctttgagaagttctctatcggttatatgtatttttattttttattttttttgcactctgtcacccaggctggagtgcagtggtgtgatcttggctcactgcaacctcagcctcccaggctcaatcaattctcctgcctcagcctcatgagtagctgggcttacaggtgtgcaccaccatgcccagataatttttgtattttagtagagatggggttttgccatgttggccaagtgggtcttcaactcccgacctcaagtgattcacccacctttgcctcccaaagtgctaggattataggcgtgagccacctcgcctgacctgtttttaaatttcaaagtgcattaatgaatgcagttgtatctaaattaaagtggctcatgcaaaacttgatgaagaaccttaccattttctcacagtattcataatcatgtttggatatgtcactctctctgggctaaaaacaatgtttaaaaaaagctaaataatgctgccctccaggctgcttctactgctcttcacctagaagccagaaaaaggaacaaacagtgacctttggagctcattattattgtgaagaaactgtagatgaaagctttgtactttttctgagtgggtaaataatttatcttggaataaaaacttagacaaaaagagataagaggaatatacagttacaggcttcaaaaatagatatttctcacatcagtttagtggacaattatctaaatatattaaagattgtgtaacaatatggggatatatttatgatggattaaggagtggaaaagatgtaatgtaaaattatatgtatttgatgaaaacaatgtaaaaaatacaccacaggagaacatatgcatagttgatgagttatgtaaggatggcggtttctaatttagttgcagtgtcttcagagaacacggtttgcatgaaccctgttatttgttatttgtcgagaactgcactgcttctattcagtggtcaggttttataaatattctgtgtgcttagaaaaaacatgcatttactattgggcacagggtcctttctccatgtgactgttagatcaagcttgttaattgtgttcaaatctgtttttcttctttttttttttttttgagatggagtctcactctgtcaccaggctggagtgcaatggtgcgatctcagctcactgcaacctccgcctcccgggtttaggcgactctcctgcctcagcctcccgagtagctgggactacaggcacatgccaccatgcccagctaatttttgtatttttagtagagacgtggtttcaccatattggccaggatggtctcaatctcttgacctcgtgatctgcaccccctcagcctctcaaagtgctaggattacaggtgtgagccactgtgcccggcccaaatattttatagctataccaatctttagtctgatatagaacattatgatgatgtctgaaatcttcccttatgattgtggttttgtttttttttttctgtttaatttttgctttcccttttttgcagctgtgttatttaatttatacaagtttaaaacgatcatagtttcttgattaattgttcctttcattatcatgtattatctctctttatgcctagtaaatttttttggcttaagctatatttttccttgctaccaatacgggtgctcttcaacttacaatgcaaaaccaccataagttgatataataactcagttgtgagctgagaagcatactaaatacctgtcatttttgtgccatcataaagttgaaaaattaggtcaaactctcataagttgcagaccatctatgtgggtacaccaatgttttgttagtatttgcttgctataacttttccattttttgctttcaatctttctgcaattttatattttagatatgtctattataaacaagacatggctgagtcttccacatcataaatttagtccattttcttttgtttttattacagatctggaaattttttggtcttatattgtactccttatagtcatttttctatactttttctccttcccttgagttattgataatatgtttaagttattgatttgagatcttttttctttctcatatatgcataaaaaactacaaattttgccctaagcttttctttaactgcatcctataaatcttgatatgtggtattttcattttcattctgttccaaatatgtctgatataggacttgtatccagagtatataaataattcttataatttattaataagacaaccacttaaaaattgggcaaaaagatttgaatagaagatgtaagaatggctaatgggcacatgaaaagatgctcaatatcttagtcattaggaaattgaaaattaaagccataataagaccacttcatatccactaggatgaccataaacaaaaagataggcaataataaggctggcaaggttgtggagaaattgaaaccctcatacgttattggtggaaatgtgaagtagtacagccactttggaaaacagtctggcaacttctgaaatttaaatgtaaattgccatgcaacccagcagtttcactccttgatatatacgcaagacacatgaaaatatgtgtccacacagagacttgtacatcagtgctcatagcagcattattcatcattactgaaaaatggaaacaacccaaatattcatcatattcatgaaacattgaatggatgaagaacatgtggtatgttagcacagtggaatattattcagcagtgaaaagaaagaaaccattacatgctacacatgacaaacctcaaaaaagtatgtgaattgaaacaagctatacactaaagactatatattgtaggattccatttgtctgaaatgcccgtaaaaaacaaatctatagagacagaaagcagactgtggtttcctgaggttgggagtggaaatgggattgacagcaaatggcatgagggatctttaagggctgatggaaactggattatgataatgggcatgcaactctataaatgtcctaaaaatcattgaattgtatgcatgaaatgggtaaatttaatgatgttatacctcaataaagctgttctttttggaaaaaacagctagtgaactagagtagctctgcattttattaagaaattatttcttacatcctgtgcctagatggccaatattacactcaagaaactaatggacatagaaaaattgaatgtacctccaaacactcaagatgaatacagcagtcttcaatagtcaacgtcatggccattccagagagaaaaggtccaagttcagtgcctcgaaccttgttgccttccgtgaaaggaagcagttgaaatgagctttgcccctggtgacactcttccttgtcactaattaaccagctctataggaaggttgctccgccaacaccttgctctgcctggagagacatctggccaagttctggtgagcaggaaaaatgtctactcgttaccaccaagctgctagtgatagttacctggaacttctaaaagaggctaccaagcgagatctaaatctttcggatgaagacggcatgactcctactctcttggcagcctaccatgggaacttggaagccctagagataatctgcagtagagggtaagttcaacccgatggtttctgttggaaacagtgttcatggtaggtttttgcagacagcagcaagaggcagggacgtcaatacaaatactttatcctctttctagattgtctaaatgattggatttttagagaaagagagaaaactatgcctagagatgctctcttttctcactgaggactggcactataggagtggctcatcccttagccacaatcagaggagagaccctgaactacggcattatctgcatggggaagagggaagatattttaattctatgcctttaaaaatgcttttcatgaaatttaaatagttttctcttttcaaagaggccattgttttacttggttttaagttgccaaccttggttggaacaaatgacatggttttagttttttttttatctatgccatcaaaatctcacagtcttttattaactttcaatcccagtgcaagctcatgatttttttattttttatttttgacacagggtcttgctcttttgaatggagttgctggctctacaaggactctttagcctatcttaactctatcacttctttggctagtggatagatacacacacacacacacacacacacacacacacacacaccccatctctttgcccagattttaatggaggagtaagctagttcctctgcttgttctgcctgttatcagagggctaggttgtgttggcaaccgtaacccaagaggggtaaagaaagagaaaaggacaaggtaaataaaggagccaagtgaatccaattgaatacccatttattcagtatttgttatgtgccagccacttatctcttaagataagagatattttgctagccactgggcacactgtgatcaacaagacagccacagtccctgtcatagtgagcagatttgagaggggaagacaagacatctatgatatttgtgtgtgtgtgtgtgtgcatgtttgctctgagacagggtctcactctgtcactcaggctggagtgcagtgtcaagatcatagctgactgcagccttgagccccaggctcaagtggtcctcccatctgagcctcccgagtagctgggacaagaggtgtgcaccaccatgcccagcaatttttgtactttttgtagtgatggggttttgccatgttgcccaggatggtcttcaacttatgagctcaagcgatctgacagcctcggtctcccaaagtgctgggattacagctgtgagccactgtgcctggctcatctatgatatttgttacaaaaagggaaatagagggcactaaataggcatctacctcaatctcaggggtgagggaaggcttccctaaggggaaagcatttaagctgggattaggaaaatgagaacaagttggctagacgaaagagtgttttccctaagatggaaaactgctctagttctgagaactagagaagctgagtatggctggatgtggttcaagtaggagtggggtcaggacaagtataagagataagaccagatcacaaagagccttgtcaactctggtaaggactttatcctaagggcccaggaagccatgtcttgggtagggaagctgccagagtagatttatgtttacaaaactcactcaggtagatggataacagtcggagagaatgtttggggactgttttagtggtcgagatgagttggactagggtagtgacattgggaatgggaagatatggttggatttgagtggcagtttggatgtagaatcaataatgattgactggatgtgggcagataaaggaaaaggagggttaaggtcccaggttttggatgttgacaccctttattaaaataggggacatttaggaagtgtcagaagaacccaggattgggagagttcctgagttgaagattgaatgagaaagtgagtgaagcagatcttccccatctctcttgtctgaataagactttcttttctcagacacatcgatccccatcagccagccttctccagtcatctcatctcttctcctactcagcctagggttccccagctttctccatctactgaaagtctacctcattccacaaactgcaagatgtcagttactttaaaatcaaagtattagcctattcttgcattgctataaggaaatgcctgggcctaggtaatttataaagaaaagaggtttcactggctcatagttctacgggctgtacaggaagtatagtagcttctgcttttggggagccttcaggaagcttccaatcatggcagaaggaaaaggcatctcacatggcagaagcaagagcaagagagcaaggggggaggtgctagaaaccagatctaatgagagctcactatcatgaggacagtaccaaggggaatggtgctaaaccattcatgagaaattcgcccccacgatccagtcacctcccaccagtccctacctccaacattgcggattacaatttgatttgaggtttgttccccaccaaatctcacagatccaaactgtatcaaccagtgagtttgtcctcctagaagagggtttgggggttctggggttcttctcagcagagagctcttgttccatttgaggacattttgaatagtaatgcttaggtgttctctctctttctctcctttgaaagcctgaaatattctcttacaataactcttctgctggtctttatttattttttatttttactagagacagggcctcgctttgttgcccaggctggtctcgaactcctgagctcaaataatcctcctgcctcagcctcccaaagtgttgagattacaggtgtgagccacagcactcagcctggttctgctagtctttaattacaaaagtaacatgagctgaacccagaaaattaaaccatacagacgcacacaaaacatgaagaaaaaatgtcctataatgccatgctactaagatgtatatagttctctctatatatactatagtgcatacaaatacattttaatattcttctataaatttcagggactttgtaggactctagtcaacaaatacatttcttagccaacccctcttttggacacatagtttgttttccctagtttgaatagggctatgatgactatccttgtacataaatctttgctgacattgtcttttgtgtttttttgagatggagtctctctgtcactcaggctggagtgcagtagcgtgatcttggctcactgcaacctccacctctcgggtttgagcaattttcctgcctcagcctcctaagtagctgggtctacaggcgtgcactaccacgccgggctaatttttgtatttttagtagggacagggtttcaccatgttggccaggctggtctcgaactcctgacctcaggtgatttgcccacctcggcctcccaaagtgttgggattacaggtgtgagccaccgggcctggccacattttcttgagaataaattctccaaagtgaaatttctggatcaatttgcatttgtgttagtccatttgtactgctataacaaaataccttagattaggtaatttataaaaaccagaaatttatttcttacagctctggcagcagagacatccaagatcaaggcaccagcaggactggtgtctgatgacagccctgtctccgcttccaagatggtgccttgttgttgcatcctatggctgtgtcctcacatggaggaagggaaggaaggggcaaaaaaaaaaaaaaggcaaattccctgtgtcaagtccttttataagggtgctaaccccattcatgagggtagagtcttcatgactcaatcgtctcctaaaggccacactgcttaacgctgttacattgacgattaagtttcaacatgaattctggaggagacacattcaaaccatagcagcatatgtgcaatttaaatagttttgtgtgtgtgtaaatggacatgctgtccttcagaaagtgagtacccattttggccaacatgataggtccaaaatgatatattaggctgggcgtggtggctcactcctgtaatcccagcactttgggaagccaaggcgggcagatcacttgaggccaggagttcgaggccagcctggccaacatggtgaaaccccatctctactaaaaatacaaaattagcatggtgtggtggtgcacgcctataatcccagctactcaggaggctgaggcacaaattgctcctgaatcccttgaatccgggtggtggaggttgcagtgagccgagatcaggcaactgcactccagcctgggcaacagagtgagactctgtctcaaaaaacaaaacaaaacaaaacaaaatgatacaccagtgtggctttaatgttcttttctttggttgccgatgaggttgaaaattctttttatgcttaaaaagaattggccattggattgccacttttgtgaactgtgtatttataactttattccccatttatattggggttttcaaccatttctccttgattgataaaaacacttttgaaagttaacaatatcaactctttgtcatataggttacaactgttttacaatacacaatttatatttttgacaacagatttttaaatataaatgtaaacataaatatatatatatatatacgtataagtctatcaatctttgttgtgtgattctaactttgaggtcatgcctcaatactgactgatcctttagtgctatttttagtttcatttgttattttaaatactttatataatttaagatctgaattatgatctaactctgcattctccaagtggctactcatttattccaacacaattagttgttatagtctatctctttctccactaagttgacatggtaacatcatttctttcaatgtaatataaatatccagtccccccaatttgcttatattaatatttattaaacactggctatgggtgcaaatattcttctaaccttgtttttcctagtccttccttctcaactcctttcttctcacgggatctagtacatctcagatttgtttcattgccctcaaaagcatctgggatctgctgtgttgagcaggcctgatgtaggctaaaaaaaagaacagaagtcttgtgaggtgcctttttgaccatagctaatcctgggaaccagtgtgaggtcaaatttccaattagatttaaggaagctgaaaagggaagaaaattaccatctcacatcagtcagaatggctattataacatcaaaaaataacagatgctggtgaggttgaggagaaaagcgaacacttatacactgttggtgggagtgtaaattagttcaaccattgtggaaagcagtgtgacaattgctccaagagctaaaagcagaactaccattcgagccagcaatctcattactgggtatatacccaaaggaatatgaatccttccacaataaagatacatgcctggatcatgcctgtaatcctagcactttgggaggccgaggcgggtgggtcatttgaggtcaggagttcaagaccagcctgatcaacatggtgaaacctcatctctactaaaagaaaaacacaaaaaattaactgggcgtggtggcacacacctgtaattccagctcctcaggaggctgagacacaaaaattgcttgaacccgcaaggagaaggttgcagtgagccaagatcacgccactgcactccagcctggggaacagcaagactccatctcaaaaaacaaacaaacaaacaaacacatgcatgtgagtgttcattgcagcactgtcacaatagcaaagacatggaatcagcctaaatgtccatcaatgacagattggataaaggaaatgtggtacatatacagcatggaatagtatgcagtcgaaaaagaatgagatcacatattttgtgggaacatgggtggagatggaggccattattcttagcgagctaacgcaggaacagaaaaccaaacaccacatattcttactgataagtgggagctaaatgatgagaacatgttggcttagtgcctgggtgacaaaattatctacaacaaacactcgtgatatgagtttacctatataacaaacctgcacatgtactcctgaacctaaaattaaaaaaaattgaaaattgaatttagaagctaatcaactattgaaatactgaagtccatttcagtctgatgatttaagagtttatctgtcattacctgatagacaacgaatcctatagcaaccatttatattaaaactctggctttgttagaaaactattttcctttgtttttaaaatttgaagatggaaaacaatcattacatgtattttcctgcactaggaagcataatggcccaattacaaaaaaaaattcattttacctttaaagtgtatgaaatttcttggttttattttttaaaatggaaactagactttttcccccagattcttttttttttgtgatggagtctcgcttctgtcgcccatcctggagtgcaatgatgggatcttggctcactgcaacctccgccacctaggttcgagtgattctcctgcctcagcctctggaatagctgagactacaggtgcctgccaccacaccccgctaatttttgtatttttagtagagacaaggtttcaccatgttggccaggctggtctgattcttaaagaaatacatacttattgtaatatttcacatcatattgaatagaattgataaagtaaaaattataccaattcctacagttatcaacatttgggtacatatccttccagactttttcctttgagtacatgcaaacacatgtacattctctccctttaaaagacaatcatataaactatactgaaaccttctaattatttaacaatatatcatggaccatttgcacttaaaagttgagatccacgccactattttattttttttttaataatttcaacttttttttttttgtgagagacagagtcttgttctgtcacctaggctggagtgcagtggcacaatcttggctcactgcatcctccacctcccaggtttgagtgattctcctgcctcagcttcccaagcagctggaactacaggtatgcgccaccatgcccagctaattttggtattttttagtagagacagggtttcactatatgttggccaggccggtctcgaactcctgacttcaggcgatccacctgccttggcctcccaaattgttgggattacaggtgtgagtcactgcaccacgccagtttcaacttttagatttagagggtacgtgtgcaggtttgctgcatgggtacactgcatggtgctggtgtttggggtatgactgatcccatcacccaggtagtgagcatggtaccaaatagtttttcaaccgttgccctcctctcatagtcccccgtgtctgttgttgctatctttacgtctgtgagtacccaatgtttagctctcactcataagtaagaatatgcggtagtgggttttccattcctgtgttaatttgctagggatgggataatgcatgccactatctttaatgacttcatggtattctgttttatggtgtttgtttgtttgtttttgagatggactctcgctctgtcatccaggctggagtgcagtggtgcgatctcagttcactgcaccctcagcctcccaggttcaagcaattctcctgcctgtctccagagtagctggggttacaggcacatgctaccacccccacttaatttttgtagttttagtagagatgaggtttcaccatgttggccgggctggtctcaaactcctggcctcaagtgatcaacccaccttggcctcccaaagtgctaggattataggcgtgagctactgtgcctggccagtttcattatttttattaattaacaaaaattatatatatttatggtgtacaacgtgatttttaaaaatatgtatacattgtggaattaagtcaagctaattgactatgtgttatcttctatactttttgtgatgagaacattaaaatctacttggtaggcaattttcaaatatacagtgtattgttattaactatagccattgagctgagcatgatggctcatgcctgtaatcccagctctttgggaggttgaggcaggaggattgcttgaggccaggagttcgagactagcctgggcaacatagcaagaccccatctctataaaaaataaataactaatttttaaaaaaactatagtcatcatgtgttacaatagatgtcttgtacttattcctcctgtctcactgaaattttgtatcctttgaccaactccccagtctgcctctgcctagttaccaccattctactttctgcttctaggagacttttcttttagacggagtctcactctgtcaccaggctggagtgaagtggcacgatcttggctcactgcaacctccgcctcccggattcaagcaattctcctgcctcagccctcccaagtagctgggactacaggcacgtgccaccacacccagctaatttttgtattttcagtagagatggggtttcaccatggtggccaggatggtttcaatctcttgacctcgtgatctgcccacctcagcctcccgaagtgctgggattacaggcatgagccactgcgcccagcctctaggagacttttttagattccacatttaagtgagatcatgtggtattcgtctttctgtgcctgtcttatttcacttaacatactgtcctccaggctcatccatgttgtcgaaaatgacaggatccgtttgtttcttaagactggatagtattccattgtgtggagccaccatgttttctttatccattcttccactgatggacacagattaatgccataatatatgtaatcagttgactattcatgttgcttaatttgaacccactctttttcctgttataagtaagtttgggaggaacattcctgctcattcatctttgcacaaagatcttatatttccttaggacaaattcctaaatgtagaattgtagattcaaaagagtgcctcattttaaaggctttttgtgtgtattgtgccaggaaatttgaaccactttctgcttcttccagcagtatttctttccccatactcctgccaaaaccaagtattactattctttttaatcgttgcctatctgattggcaaaaggcagagtattgtttcaatttgcatttctttgactattagtgagtccaaatatttctttttatgcagaaaaacgtttttgaaagaatagttgagaacttcacaaaaaatcaacttcaggaggaaaaattggaatgtaacagatgctcagggtaatttaagcaaattgcctacttagtgacagtagtgctaagccagctttaaaaactattgcccaaatgcactgatctaccaaaaatcaagggaaaaatgggttattttaaaatctcttcagtgagtttctcttttggggaaaagggaaatagaaaaaaacaacactagactgagcttagcccacgaaaaccgtagagcatcaatgttgaactcagattatcaaacgacaggactagttttccacccaggcagttgtatgcaatggttctatcaagaaatgtgaacaatgacaagtatggaatttaaaaggactccatgcaacttgtctgtagaaaatatttccatttaaattgtacatcaatttggaaatgtgtctgtaagtagaagttttgcaagttttttgttttgttttgttttgtttttgagacggagtcttgctctgttgcctgggctggagtgcagtggtgtgatctcagctcactgcaagctccgcctcctgggttcacgccattctcctgcctcagcctcccgagtagctgggactacaggtacacaccaccatgcctggctaattttttttgtatttttagtagagacggggtttcaccatgttagccaggatggtcttgatcttctgacctcgtgatccacccaccttggcctcccaaagtgctgggattacagacataagccactgtgcccagccaaagttttgcaagttttaatagcttaaagccactaggaaaacccatgaattgtcttactgacagtttcatctgtaaatctggaattttgcatttgaaattttctcaaaagaaggcccacctttggggtcatctcaggtgtactgttcttccttctgtcttgaaagcatcatttaagattcagtgaaatgggtgcagctgtaaaaaaaaaaaaaaaaaaaaatgagatcatgtcctttgcagggacatggatgaagctggaagccatcattctcagcaaactaacacaggaacagaaaaccaaacactgcatgttctcactcataaatgggagttgaacaatgagaagacatggacacagggaggggaacatcacacaccggggcctgttggggggtcgggggcaagaggagggagagcattaggacaaatacctactgcatgaagggcttaaaacctagatgacaggttgacaggtgcagcaaaccaccatggcacatgtatacctaggtaacagacctgtatgttctgcacatgtatcccagaacttaaagcaaaataaaaattcagtgaaatgagaaaattccaccagtctatagtcttaagcatatacatttaacccggacaccttagtgcccttctgcatcccccctgcagctcactcctcccaataattttgttttcaacttatccaatccaaggataacttcaggcaaatttaatcagtatgtttctctttctgttgatagtaacgtcttgggtgttttacaatccctctttgatgtctaggatacttaaggagtcttttgcatctagtgtttatttaaaataaaaagtgaaaccacatgtttaggggggagacacagcggtcccttaagatgcgggtctgtgccaaggttgaagggtctcctttcatcccaaacaattaagtcaggctgactgaccagagccttctggaaagtggcttcccagcaaaactgtgttacttaatatttgctttccttagatttgatttcattttctttccttttccactctttccccttacccccaactccacacactctggtcacgctgatctatactcctggttccccaaataggccttgtaatatcagccatctgtgcctctgctcacactgttctctctgctcagaaggaggttaccagttgccagcttatgggctggagctggtccacaaatgtgttttatttggactttactatatttttcttttaaatttgagccaacacttaaaaatcacagaatttcgcttgaaattctggatttgtggcttcgtttgaaaaatgggagctctggcaatattgtttccgctttgattcaaggtagctgagctgtggtcctttctaggtggagtatgcatttaactgtgactttgttgaaagagcaaacttggccccattcagtcacttacatgacttgctggacttctttgagttgggttggagacttctgccgggacatgtggctgacacaaaggagaaagagacacaggctttgccctctggggcatattatccaattaaggagacaaggcataaatatttgtcagattaaaactggaagtgattgattgattgattttttttttatttttttgagacagagtctcactttgtcacccaggctggagtgcggcggcgcaatctcggctcactgcaatctccacctcccaggttctcctgcctcagtctcctgagtagctgggactacaggcgcgcaccaccatgcctggctaatttttgtacttttagtagagatggggtttcaccatgttgaataggctggtctcaaactcctggcctccagtgatccaccagcctcggcctcccaaagtgctgggattataggcatgagccacctcacctggcctataagtgatttttaaaaacccacaagcattattgtgctgtaggaatttactagttgaatacaaggaaaaataaatacatgaaattaaggattatgagtttgggggcaagggcaaggataataagtaatgtttattcaatatttactatgtgccaagcagttttccaatgctttatgtagattaatttatttaattcacataactctatgaataggtaatagtattatcttcaatttacagatgagtgttagaaatgtttgtcttttggtgttgcaaagaaatagtatttgaacataaatttaatttttttagtaaggctatttttatttttcgtagaaagggtatatttgttagtagttttgttatgagagtatattgaacaaaggagacagggttatttataacttgatgtgtttaatgttgtgtttggtttttattggctggaatgggactttacattttgtatttgtcttgattggttagtaacttagaactttttaaaagaggcaaaggcagaggagaacaaaggaaggagaaagtaatttgtggaatgttgagaaaggtaaaaacacttttaaataaggaagaggaacaggctatgacttaatgtttgtttggactactataagtatgttagggtaaatatttaagctaaattgtgggagttaagagtataaagtatattgatttttttattatggctagtagatatttaagaatgttagtacaggtttttgaataaattttgtttttaagagaagttattatttatttttaattagatggggaggaaagtttttgaagaggaaactttattttactttttacatgaagaaaccaagtcctagaaaaattaaacttgaggccatgtagctggtaaaatggaaaagcccagttgtgttaatctaggatgtattgtattggagatgatttgactgggagaccagcctgatccaaatcatgctgcctgttacccttgggcaaatcaattaagctctctgagtcttattttattcctgcagtaatgattcttgcctgccttctctaagagggagattgtgatggttgaaggcaaagaatgtgaaagtgcttctttgtaactaacacacaccaaagagccagggattcccgtggagtaactgcaaatctgatttatcaaattataggaccctggtcggatcacactaaccagtgaagttcttttcaatctgtagtgagcctacgaatcacctgcggatcttgctaaagtgtagattctgattcaataggtctgggtgagagtcttctgtactttttttggtttgcttttttttttttttggagagagtctcactctgtcacccaggctggagtgcagtggtgtgatctcggctcactgcaacctccgcctccggggtttaagcaattctctgcctcagcctcctgagaaactgggattacagacatgtgccaccacgcccggctaatttttgtatttttagtagagacagggtttcacaatgttgaccaggctgatcttgaactcctgaccttgtgatccacccacctcgacctcccaaagtgctgggattacaggcatgagagtcttctgaacttctaacaaactcacaggtgatgcatctgcttctggtctggagacccaacgttgagcagccaggaactagtagaatggtcgtggcgcactaacaggtcatttgcaagggtgcagatcttctcttctgcttctgtctgccctctacttctcgggaatgttaagaggacttctcagactcactgtcctctttccatggggccaggctggccagagtttagtgagatcctgattttggagtctagcctagggcaaaggaaggaccccttagtatctgtattatcagagttctcagcattggcgcatggctctggccatcattaaaaatagttactcgactttttatctgttcctgtttgtaactcaagtccttgtaggagaggagggtttgctgccttgggcaggattccagtaggttttcattcattccacaaatactggagcacctactatgtccctgttctgtgccaggcattaggtttatggccttaataccatctaatagtatccccaattccaccttaaactcttgtagaatgacacacttatatgaacctgcagtcatggaagtaagttgaggaataaatagagatgtaatgcccttttaatgaataatgtttgtaacagacactgtttgctacctctccaacatccttttctttcttctttcctgctgatggggactgagtttggttcagttatttatttccccacatgtggctcaattcgggagggtagcagtagcatgctggaaccagcttgtcagagttatttccaaattttagaaagtttgacagctaaatatagccattctttcttactttttatttttattttaaaaaaaaatttaatggaggcaggtcttgttatgtttcccaggctggtcttgaatgcctggcctcaagcaaatctcccacctcagcctcccagtgctgggattacaggcacgagccactgagcctagccttttttttttttttttttaaggcagggtcttgctgtgttgcccaggctgtagacagtggtgcaatcataggttactgtaagcctgagcttctgagaacatagccattcttaaaaataaaattacaggctgggcgtggtggctcacaactgtaatcccagcactttgggaggctgaggcgggtggatcacctgaggtcaggagtttgagaccagcctgaccaacacggtgaaactccatctctactaaaaatacaaaaattagctgggtgcagtggtgggtgcctgcagtcccagctactcgggaggctgaggcaggagaatcgcttgaacctgggaggtggaggttgcagtcaagccgagattgcaccactgcactccagcctggacgacagagcaagacttcatctcaaaaaaaattatataaacttataatttaacaaattatattaaaaagataacacgaaagtctcactttctacttattttaatacatttcactcttacctgtctcttaagatgattcatgtccattatatctacatgggggaaatagttgataatggtacgctactgtgtatctcttccaaactctgtccagtgatgttacattggtagcttgaaatttgccatggtggatgtatttacaccacagaaattggcacatgctacaaattaggattttgatgttattattttcttgataagccattgaacaatcctatccctagtttcagggcaaaatctaattgatctaagttaaacacaatagtatgtttcccatctcttaggcgtgtaacctagtgctggccaatgagacaagaaagttgtttggctggagaatttcttagtaagtttttctcacttctaaaaaggagacacagccaggcacggtggcttacacctgtaatcccaacaatttgggacgccaaggcaagcagatggcttgaggccaggagtttgcgaccagcctgggcaacatggtgaaaccctgtctctacaaaaaattagctaggtgtcatggtgcatgcctgtagtctcagctactcaggaggctgagcagggagaatcacctgagcctgggaggtcaaggctgccaatgagctgtgatcacaccattccactccagcctgggagatagagtgagaacctgtctcaaaacaaaacaaaggaaacaaacaaaaaggagacacacggtagagatgggctctgtttctggccatgtggttttaagatgggatggttctaagacagttggacttgcagccagtatcttataacaatgtcaagtcaggatgaacatgtttgtattaacgtgccttttgttctttatttttgttttgatttttttgggcctgcgttcagagaaaaaaagtccaacatgtattttttttctctctctctcttctagaggggaccctgataggtgtgacatctggggaaacactcctctacattttgcagcctccaatggccatgcccactgcgtctcattcctggtcaactttggtgccaacatctttgccctggataatgacttacagactccactggatgctgctgccagcagggagcagaatgaatgtgttgctctcctggacaaggctgccactgcacagaacatcatgaaccccaagaaggtcaccaggctgaaggagcaggctcagaagaatgccaggaggcagatcaaagagtgtgagaggctccaggagaagcaccaaaataagatggcccacacctacagcaaggaggaatccgggactctctcttcttccaagggtaccttctccagatcatccccttcaaatgcttctgctcctggcacattcgggtcactatctaagggcattaaagacactttcaagatcaagttcaagaagaacaaagatacagcagaacaggtggggaaggaaggcagaagtgggcagaggaacgtgatggaagtgttcagagaggaagaggaagactcgttctcaggggacttcaaagagaagctccagttgtcagcagaggaggacggcagtgtgcaccatgaatccattctcaatcgtccaggtctaggaagtattgtttttagaaggaacaggatatcgagtcctgaagacatctcagatagcaagagagagtttggttttaaactgcccagtgaattgcttcaaagacaaggagcatcagaggctgatgagggtgcagctgatgaagagggagaggaaaacggcctcaaagatgatctgccgtgggatgacgatgaagtggagtgggaggaagatgtggtcgatgccacgcccctggaagtgttcttgctgtctcagcacctggaagaattcctgcctatcttcaagagagagcagattgatctagaagctctgctgctctgctctgatgaggaccttcagagcatacaaatgcagctgggtcccaggaagaaagttctgaatgctatcaacaggaggaagcaggtgcttcaacagcctgggcagctggtcgacaccagcctgtgatggagagttttggcctggagcattggggtgatgctgtggcccgctggcagcactccaggcggcaccccctctttacccaatgccagaccactgggaatggattctagggcatcggaaatgcctacctgagagagagacccaaactttactctgggaggtaggctatgcccatccaaataaatctccatgagaaacttgaggagacttcataacaagaatctggcatttctcttcagttatcttatatgtacatataattgtttttgtggttgttttgttttgttttgttttgttttttggagatgaaggtctcagtctcttacccaggctagggtgcagtggtatgatcatagttcactgtattctcaacctcctgggctcaaatgatctcctcccacctcagcctcccaagtagctgagactacaggttcacaccccccacacctggcttattttgtatgttttagtagaggtggggtcttgccacattgcccaggctggtctcaaactcctggcctcaagcaatcctcccacctcagcctcctaaagcactgggattacaggtgtgaaccaccgtacccagcctatctttttgatacttttgaataaagaaagggtcatatgcatgacaggaaaatgaaagaaacttcctttacttttctatctctggatttaaaattataatctcatcacattatcctgctgcttgctttccgatctgtgtaacctgggaattccaattctttttctctcctgagatctatgactttgcctagtggtagagactagagttctttcctggcctgcggcttgatgcccaacttaaatgcatctaaccctttaacaaatgtgtacatgtttacaagtaatggaaatgcgtctataatactcctgcctgagaatagagacagagtggtggtggggagagtgaagaaagagatagaatacaggtggtacctgttgtggactgaattgcgtcaaattcatatgttggagctctaacccctaatgtgactgtaattggaaataagacctttaaagaagtgattaaggttaaatgaagtcataagaatgcaaccctaatcctgtaggactggtgtcctttttttccctttttttttttttttttgagatggagccttgctctgtcactcatgctggagtgcagtggcgtgatctcagctcactgcaacccccgcctcccaggttcgagcacttttcatgcctcagcctcctgagtagctgggattacaggcgtgcaccacaacgcctggctaagtttttgtatttttagtagaggcggggtttcaccatgttggccaggctggtctcaaactcctgacctcaggtgatccacctgcctcggcctcccagagtgctgggattacaggcatgagccactgcacctggcctaggactggtgtcctaagaagaggaagagacacttaggtggaaggcacacagagaggccacgtgaggacacagtgagaaggtggccgtctgcaagccgaggagggggcctcaggagaaaccaaccctgcaatcaccttgatcttgggctttcagcccccaaaggtgtgagaaaataaacttcggttgataaactgctgttgttgaagccatccagtctgtggcattttgttatggcagtcctagcagaataatactgtcctaagtaagagggttggggaggagaccaagaaaaatacagaaaaaaagtctgtccaactgcaattgatgagttttgtaagggtaaacacctagtgaaacttaaggggaaaaaaaactaagttctttggagggaagatttgattgtcaaaggaaatttcacattttcatgcttattatgtacacatggtttatttactgttgtctgtcaccattgccgcatatctgaatatgtgtaggttccacgatagaaactgacaacacttggctcatgcctgtaatcccagcactttgggaggcccaggcaggcagatcacctgaggtcaggagttcaagaccagcctggccaacatggcggaaacccgtctctactaaaaatacaaaaattagccaggtgtggtggcgtgtgcctgtaatcccagctacttgggaggctgaggcaagagaattgcttgaacccaaaaggtggaggttgcagtgagttgagattgcaccactgcactctagcccaggcggtaagagagactccatctcaaaaaaaaaaaaaaaaaaaaagaaaaaagaaactgacaacactgctgctgacattttttcaatggcaatcccaaattcaaactgaaaccccactgaagagctaagcttcattagatctctacaggctgacttacatcaagtggaatttactgttgattctgggtataatacagaaacagctgtttatcttcagcttgctttctgatgcacatctgtttgggttacttcaagaggcatcatggaggattcaagtttagggaggatacagatgctcaaatctgatgaacaattggcttattcttcctcaatgaatatattcagaaagcttgttagccattgaataaacacgttgcattaggggatgattgtttacaaataccttatcttgtggaataaactgaagttgtgctttccttcattaacgtgcacagaagcagttggcaaatagaaagtgctcaaaaaagtttgtagtctgtgcctgccactattatatttcatcatcatagatgccagaatcccctcttcacctattgcccggaatctgcctaatgagatatttgctccaccccctgctgtaactacatcatagcaagagagccatcactcaggttggtagaaatgaacttgaacattgactctcatccctttttaggagatatttgccactaggggtctcatcaggtacctctatgctcttcttaggggttcttttcttttatgattgacagaattaataggtgagcgttctccaaagttctcagcatcaaggatatagtctcttcgtcacagagtattgttatataataaaaaaaggtttataccatgttataagatgttatcaatgttctaagaattccagatctttcgaactaaataccaactacaggggctaagagaagatgccagagcaatacaaaggccttgataagagacaaagacaagaggattatgagccaggatgagcttcaagtactcactgatctcagacctccatctcttaaactagatgcttagagtagctcaatccaatatctggtcacccctaccacctcctggcccctcttttccccctctatgtagcttgacataaaagtcaacaagagggaaaagcagctgggagcatttcaccgaagaggagagtttgagaagttatagtgtggtaaatgtgtattgtgcttatatttcaggccattgtgtagtacaggtcagttatatgctcagaattcctaagtccaagttaccagcccagaccattgctttgggcaccaaatacttaagcccaaatctaatctgacatctcctctcacatgtctcacaagtaccccatactcagtgtgtccaggactgaacccattttcttccaggttgtcagttctcaacttggatgattttgccctctgtctcctagaggacatgtggcaatatctagagacattttttgattgccatgataggggaacagtggtgcaactgacatccagtgggtagaaacaatgggtgctaaacatcctagaatgtacaggacagcccaccaccacaatgaattatcgagacccaaatagtgatcgtgctcagtttcagctgcattaaaacatgcagctctaaatcttcatttttcataaatggaaaatttaacccaatacttcttttcatcacccaattggtcaccaggccctttcaacttttcaatatgtctcagagctaaatcctctttgatgtttgcaagatgacctattggttcctgcccccaaccatcactcactggattgctgtaagtatccttatctgtctttaattcattctccacaaggctggttgagtcacgtaatctttttaatatgtaagtctcttgtcactttctactttactgttgctttttttttttttttttttttaagacgcagttttgctcttgttgcccaggctggagtgcaatagcacgatctcagctcaccgcaacctcagcctcctgggttcaagtgattctcctgcctcagcctcccaagtagctggaattacaggcatgtgccaccaagcctggctaatgttgtatttttagtagagacagggtttctccatgttggtcaggctggtctcgaactcccgacctcaggtgatccacctgcctcagcctcccaaagtgctgggattacaggcgtgagccactgggctcagccaccattgcttttcaaactctcaccaccacacagaaggcctgcatgattaaagagccctattctctcctccaaacctctggtcccatctctgaccactcctctccctgtcccctaatttcagctatactagatttcttgtggcttcctgaatacatgtctctcatatgcctgtgccttagcataccatcacccttctgcctggaaaagtcttcctccatatagccatcctcactgggagacataccctctctctttgcccctagtctgggttgagtagcttcctatctgtgcaagctctctttgtttgcctctccagaacttctctctactattttccaacctactttgtgtcccaggtggttgggctctggactgcatcaaagggctcccttgcccttgggatcctggttgggtctggccaatgggagttactaacaagataccagaaggtgggagaaagaaagattgaggcatttattctacctgtttcttcttttcagggcagcagctgccttcatctaagctcacctctcccatctggcagccctctgctatagctctagttgtttctgggtttcactaactgctctttcaagcttagcagtggtagtgatttcctactattgctaaccctggggtgcttcttcctaaacagtctctttattctcttcaatcacaccttttgagtgtggcatctacagacagttccccacttacaatcgttcaacttaagattttttgactttacgatggtgtgaaaatgatacgcattcagtagaaactggtaagatattctctcaggatgctgggcagaggcagcgagccacagcttccaatcagccatgtgatcaccaggataatcaattgacagtgaacagtgtaccgtgttaccagatgattttgcccaaatgtaggcaaatgtaagtgttctgagcacatttaaggtaggcaaggctaagctatcatgtttggtaggtgttttctatgcatttttgacacatttccaactttttttgagacagggtcttgctctgtcaaccaggctggagtgcactggcacaatctcggctcactgcagcctctgcctcctgggttcaagtgattctcctgcctcagcctcctgagtagctgggactacaggtgtgcaccaccacacccagctaagttttgtatttttagtatagacggggtttcaccatattgcccaggctggtctcggactcctgacctcaggtgatccgcctgccttggcctcccaaagtgctgggattacaggcatgacccaccatgttcggccacatatttccaacttttgatgaatttattgggacacgactgcatcataagtcaaggaacatctgcatttcctgcagggaccctgaaccatgttcctgtaacaccaaattattgtaattttttttttttaacatctgtcttctcttcgaggctgtgttctctggggctgaggactacttttctgttgtatcttagtaagctagcacagggttatgataggggctcttgcgaaaagaatgaaagaaaagatatatgaatattctcatcattccatgctcttctctatatatcctttagggtagtgaccatcaggattcctcagaaagactccatagtcacttgagatatgcagaatcagatcatgtgggtaatgtgggtattttgtttcagcacaaagacccctgtccagacagtctggcaaatatgataaacttttggctaaaccatctggagcatgagtccttcccaggaggagtatggtcaggaaaacagagccatgctttgctgctgacttatctgaaaaccagccttggagtagcaaaaagcgaaggggtggggtgaggctagggtcggagtgggatttggacagggcctttggcaggacaaggacaacacggttctgctagtgattcagggggcctggagaaagtatctctgcacctcagtttccccatccgtaagttgaagatcgactagctgatccttaatggcccttttaacatggatactgtagtggacatctttagattttgcctttcaactacccagtcctctttttgttaagagacaccttccctccatcagctcatgtgggcagatgcgcagatgacacttctgacttcaagggtgggcatgtgatccaggcctggataaccagagcatctgatccccctggacaacgtgatggttcagggataggtacaaggcttgagcctggccagggtattccatctctttaaaagatggggtcttgctatgttgcccaggctggtctcgaactcctgggctcaagcaatcctcctgcttcagcctcccaaaatgctgggattacaggcatgaaccacctcaccccgtctattccatgtctttcagccacaatgttaggctcaggaatagacatgtgacctagatggtccagtaactctcagttctggaacatctaactgtaaaggaagagaatatttatgctcagttgctaaagaggacagaatacaattcaggagctgctgaccaatgtcctgccactaccagggagaacttgataatggagccaacggggaagaagaccaggccctggtgacagttggagcccctgaatacagctgtagctgaaaccagttacctgtgtgttcctaattacgagagccaataaatctcattctccattcattcagcttaaggtagtttgagttgtagtctctaccacttatgaccaaaggagccctgatctatacagaaattccatttttcctctaagcattaaggagtcaggcacaaaagactacatatagtagaatttcacttgtaagaaatgaccaggcttggccgggagccgtggctcacgcctgtaatcccagcactttgggaggccgaggcgggcagatcacctgaggtcaggagttcaagaccagtctggccaacatggtgaaaccccgtctctactaaaaatacaaaaattagctgagtgtggtggcgtggcacctgtaatctcagctactcgtgaggctaaggcaggagaatcacttgaacccaggaggcagaggttgcagtgagccgagatcatgccatcgcactccagcctgggcaacaagagtgaaactccatccaaaaaaaaaaaaaaaaaaacactactgaattgtatagtttaaactagtggatcttagagtatgtgagttgtaactactaaataaatacataaaaaagaagtttcattatagccagtgtagctcccccagggagtaaatgggagcatctgatccctctcagtttccttgtgatagtaatagaagttaccgaagcaaacactgcacaattggaatgtgctttatttcagggaaatataaagggaaatgaatgctattataacttggtagaacagaagaaatggctacctagctttgctttccaactacaaacataaatgaggatctcagcatttaaggtaaaacatgataagcacaaaaggagagttcactggggactggactccctcatttactctagaaattatgagaaccagcagcaatattcctcaagcatccatctcaacatcaagttcctttgttttatttaccagatgaccaggaatcatagatgagtttggctgcaactgtgtcttccactgccattcctagaatagacagaaatttggttcgcctttggtcaaaacaacttttcttgaaacaacccaggccccatggctggaagtttcctgatacatgtccatgttgccaatgcctattggaataacagggactgatacccagagatgagctcaggcttcaattgtctgcaaaggggcagagaatatgatagtaagaaacacccaccaacaaattgtgcatctttctaaatctagctcagggctgagcaaatttttttttttaatttttttttttttcgagatggagtctcgctctgttgcccaggctgaagtgcagtggcgcgattttggctcactgcaaactctgcctcccaggatcaagtgattctcctgcctcagcctcctgagtagctgggattacaggtgcatgccaccatgcctggctaattttttttttttttgtatttttagtagagacagggtttcaccatgttgaccaggctagtttcaaactcctgacctcaggcgatccgcccacctcggcctcccaaagtgctgggcttacaggcatgagccaccacgcctggcctgaacaaacttttcaaaaagggtcagacagtaaatcctttaggctttgtgggccacagggtctctattacaattattcaactctgcctttagagtagaaaacacagccaacaggtaaacaaaagagcctggctgtgggctgtgttccagtgaaattattgatgggactgaagcttgaattttgtatcattttcagacatcatgaaatattttctccccccattcatttgaaaatctaaaaaccatttctagctcataggccacacaaaagcaggcagcagagcaggtctggccccaggactgtagttttctgacgcttggtccagtttgaatgctgcatcctttgatatctcccctttgtcttgtaattttggtagataccttaacctctgcacccagcacagataattaggtgcttgatacgcatctgttagatgaaacaatgcaccaataaactgatccccaaaagtaagaaagcaaaaattgccaaaaaggacagaacaagtttctgcagcattttggctccttaagtaagggctggctgacctctgatctgccatgacctttgaagttttcagacaaaactggatccatgtgatgtctttgaaccaggctccagataaaattgtattgcctttgtcttccagtgcatgagagattttaaagacatttaccaacctgcaaggcatggatacttaaccaatggcatgggctctgggtggccagagcgctcctgatgctctgccaggcatttactcttttgctgcttgatcacgaagtatggaaggtcatgagagggggacagagggcactctcgaggggctcaggatagcaactgtttaccaaccagtttgggagtatttcagtgttttaggtgtatcagctctgttcccatgtactttatttatttattttttgagatggagtcttgctctgttgcccaggctggagtgcacgatgtcagctcactacaacctccaccttccgggttcaagtgattctcctgcctcaacctcccaagtagctgggattgcagatgtgcaccaccacgcctggctaatttttgtatttttagtagagatggagtttcaccatgttggccaggctggtctcaaactccttagctcaagtgatctgcccaccttggcctcccaaagtgttgggattacaggcgtgagccaccgagctcagcctgttcccatgtacttctgtttccttcaatctcatagggtggaagaggacctggggcaagggacagactggccactgggagcccaccctttgttgggcttctataaggtaccccatacaactcaggtggtagggggctccccatggaagccctcctcaaagcagcaagtgggagagtagggaaggagggaatgaacagggcttaggctatactttccatctgactctttcaggttgggtctctgccatttcccttaaggttcctgtcttttaacatctttgtcccctgccccctccacctctgaagggtaccttctgaatttcatcaagatctgcaccgaactgattcattttatatgcaaatcccacctaatcctcaatggtaacaggtggtgaggaaactgaggcctacagaggtcagatcacttgcctaaggacacctgcctttgagtggcggggaagggactctgacccaggactgctcagttccagagttcatgggcttagcactaggctaaaccatgtaaataattgacctgaatgatggagcacaatgattcagctgcagagtctggtgactcattgctctttccaccaatgggtgaacctgccttgtgcgctagttggatttgtgcccagggagcaatggatcttacccaaagacttgaacacggtggtcttctcacagtgggctggtttcactcccttaatcacttctcccagctcagcaaagatctcggcctaggaaacaaacatacgctgacccaggcatgaagctaaagtctgtgcagggttggcttttgaagccagcccagggaattcctgaattggataagagataaatttgattaaaaaaaaaaaaaaaaagagagagatcctttgtacactgaatgatattagggaggaggctggccccgaaatccttttggggtggcatttgcttttgtgataccataaacacagagattcgagttggtgctcagggagctgtcctgccaagatcattgtgtcagtgaggaaatagacatgctgttatctgaacatgcatgccagcagctcccttcttgttttatgctgattataaccgtaaaatgaggccagaaggtgggcaacacagtcttatcatgttggccacattgggaaggtttccaggctgcaagaagcttccaatcccacttctttagaggacagcccagcaaaaaaataaaatccactgagcttctccttccaggaacacacatgtcaccacccataatgcccatatttttctggaatggaattaaagagggttgcaaaatgtttaggagctccttcccctacaaggaggtggggtggctgaggtctggagcagaccaaactggaagggaagttaatgaaaccctgggatccaggtgaggccagccaggtggcagccctgactggggtcagaagggcctcacccctgacagcaggacatctccagactccttcagggcagcctcctgggaatccacgtacagcacagcttctttcatgagctcatcatccagttctctccagtcaggtctgctggctccaacagctaagagacagcaaaacagaccttaagcccaggattagtgccaaaggctgctaagaagcccaaagcacaggagagaggtgaacaaaggactcgtgaacacactcagattcaaaataccccctcattccccaggccatgctctcccaatcagtaggacgaaatacttattaagaaataggccaggtgtggtggctcacacctgtaatcccagcactttgggaggctgaggcaggcagatcacttgaagccaggagtttgagactagcctggccaacatggtgaaaccctgtgtctactaaaaatacaaaaaattatccaggcgtggtggctcacacctgtagtctttgctactctggaggctgaggcatgagaattgcttaaacctgggaggcggaggttgcagtgagccaagatcatgccactgcactccagcctgggcaacagagtgaggctccatctcaaaaaaacaaacaaacaaacaaaaaaaactacctaccattttgcctttctattctatatcccacctcattgctaaaagattttgagacgacatagcattcatttacagggtgtctactctctgtgggatgttttgcacgtactatttatggttctcgcaagtacatttcaaagtctggttctcacttaacagatgcacgaatggaggctcaaagaagtgaaggtgtttgccaaggttaaggatctgatgggtgaatccaggtctgagagagcacctaggcgctcacacctcttctgcttaacaggaacaccttcctcacaaaaatcccgaaacagagacatcacttggtgcttattcacacctcactctcctcttgatctccatcattcccattcctcaccctcaaccagttcttttaatatctatttttttctttttggagagagggtctcactctgttgcccaggctggagtgtagtggtgcaatcagaactcaccacaggctgggtgcagtggctcatgcctgtaatcctaacactctggaaggctgaggtgggtggttcacttgaggtcaggagttcaagaccagcctggccaacatggtgaaaccctgtctctactgaaatacaaaaattatctgggcatggtagcacacgcctgtaatcccagctacctgggaggctgaggcaggagaatctcttgaacctgggagttggaggttgcagcgagccaagactgcgccactgtgctccaaaccaggcgacagagtgagactccatctcaaaaaacaaacaaacaaaaactcaccacagcctcaaactcctgagctcaagtgatcctcccgcctcagcctcccaaactgttgggaccacagacgcctgccactatgcccctttccctctcctcacccccggttctctcttaactcatgacaaaagaaaaaaaacaacaacaacaaaaactcagtgtcagggtcatggagaagtctcgtcagaaagaaaactggctccgtcctggccctgaactgtcacatcctctatggagtccaggaccagaatgatgaatccaaggtgtcacgccccctggcaccaggacacaggagaatgcagaggctgccaccaaatgcctgcaaggccagggaggtaatgaaaatgaacaaagctggtcagagggactggattagatgtggtggagactgaggggcggggaagccagcaggcccttccgaaggggacagtcattgttcagctccagctaatcattaccacgtgtgaatgtagatccactgttaccagatatgccccagttgttttcttagaagagaaacaggaaatctatttgcatatgtcactccttgagttttagattactctatggtccaaaccaaacacatctgctggctggatccagcccctggctggctagtctttgaaaactgctataaagccttatacaaatataagacagcatttatatgccttcttccactgccgccccgttttctccctttgttccctcccgttctgttctccctcattctaatttccaaagagagttgtgtaaaaatgtccatcttgaaggttgtttgtgcggagagttctatagaacaaaagcactagcttaaggaagcttgtaaataaatcataagctggtgggaacaaaacccccgtttctcaggccactccttctcactggactatttcccctgcacaaccactgcttatgagccgggcgagttctcaaagggttgtgtgaggtcactcaggcggatggaggtgggccaggcagtaaagagagagaagcctgactcaaacaaggctctggcttggttgtgatggggctaaatgagtgagggtcgcagacaggcttgacagggtgtgggggcaggaggagggaggcatggggcagggtggaactgggcctgtccctccgctgagctgtaaactaagtaaaatctgttgttggtatttccctgttgtctgcgcttgtgacacatttttcttaaatgtatgtgttgcctctgtgaacacataaaccaattttgtccctgggccaggaaaacagaagagatgccttgactcaaaatcaagtcagcccttcctggagaatgattccaagtgagagagggatccaacataagggagattgtctgtggctggatgtgaggatggagagtccatatggtgggaaatttgggtcatctctgggagctgagaatggccccaaggaaaggggctccccccatcctccagtgtaaggaactgaatcctgccacaccatgggagcctggaagaggacccccgagcatgagatgagattgcagcccggatgttgcccaatttcttttttgtgagactttgcacagaggatccagctacccacacccagtctcctgaaccacgggaactgtgagatgataataatgtgttgttttaagctgaaaaaaaaatcaagtccatctttctgaagatgcagccttggaaacccatttcaccatgaactggttccttttgatttcccaggtccttccagaaatggtcttattgtccataaactcagccctgacttacctcttacccattccctggacccagtctgaccaccagtcccatgcagcctgagactttcaaattactttgatccattcctcaaacacgccatgttcgcttccacactcaaggcctttgcatctgctgtgccctctaccctgaatgcctttccttcagctcttggcatggctgctcttcctcctcattcaggtcacagctcaaaaaacacatcttagagagcttctcagataaccctattgaaaacacctctctctgcttctaccttccacctccaccaccagcctctatcacccagggccttgttctttccggtctcatctttagccagaacgatctagttcctctatgtgtttgtttgttgtctatctctcctcactgaaattaaccaccatgaaaccagtgaccttgactgcctggttattgtggcatccctggcatctagaatagtgcctggcacacggtagagattcagtcagcatgtatgattgaatgcgtcatcatttgacttggctctcgccggctcatctgcccacgtgtgcaaagctcttagcttctgagttcacaccatgtgcttgtcactaaaacacagggcaccaagaccatctttaaatcctctaaaatttgcctgctctgctcaccagaatccagtcttcctgttggaaggcaatcatgagtatcatttaaagcttggactctgaggatagagtgcctccgttcaaatcccagctctgccatcaagaacctctgattttgggcttggcacagtggctcacgcctgtaatcccagcactttgggaggctgaggcgggtggatcatttgaggtcaggagttcgagaccagcctggacaatgtggtgaaaccccatctctactaaaaatacaaaaaaattagctggcatggtggcgtgtgtctgtaatctcagctactcggcaggctgaggcaggagagtcacttaacatgggaggtggaggttgcagtgagctgagatcatgccactgcactccagcctgggtgacagagtgagactccatctcaaacaaacaaacaaacaaacaaacaaaaacttgtgactttggaaaagttatataatttctccatgccttggttcatccccctataaaatgtttatgataatagttcctgcctcataagttggttataagtattaaatgacattatacatagaataatgtcatttaatatacaaagaattatacaaagaattcatgacagcacctgcagtagtattagatgtagaccagctcttgctataacacccagggccatctgaaggtctacagaggccccaggcaccctcatgtctagagccccctctcctgcccctcatcctatcacacatattaaaaagcatatacatgtcacataaaaaattacagtacaaaagaaatttaaaggtttataattcttagtgttaagaaaaagtgactcatttggcctttctgatttaaatttcatcacattttagaattgagctgtgaattaccatttgccataattttacatgttatggtcaggcgtagtggctcatacttgtaatcagtcgcagcactttgggaggctgaagtgggtagagtgcttgaggccaggagttcgagaccagcctggccaacatggtgaaaccttgtctctaccaaaaattacaaaaaattagctgggcatggtggcacatgcctgtagtcccagctactcgggaggctgaagtgggagaatcgcttgaacccaggaggcagaggttgcagtgagctgagatctcgccactgcactccagcctgagcgacagagtgagaccctgtcccaaaaaaagaaaaaaaacttacattttatagaacattaaatattctttagtttcaggtttgtaatttcccttttacatttcttggagcaaatattgtttgtttgttttttaagacagagtctctctctgttgcccaggctaaagtgcagtggcacaatcttggctcactgcaacctctgcctcctgggttcaagccattctcatgcctcagcctcatgagtagctgggactacaggtgcaagccaccatgcctggctaacttttgtatttttagtagagacggggttttgccatgttgaccaggttagtcttaaactcctggcctcaagcaatccacctgcctcagtctcccaaagtgctgggattacaggcatgagccactgcacccagccaaatattgtttttttcaatctcacatgttttcaaggcccttaaatagcttgggcattctgcatgaataaactggctctgcaaatgtagtcgactggtcccgtctagagaggagcctggccaccacccatcatgccttatggagccactctacttaccattgatgtgagcccctggcttcacccattcaccaaacaaaatgggctctgttgccagggtgactgtgatgatcacatctgcacctgccacagcctcctggaccgaagaacagacccgtacctctccttgcactgtgtctgcaaacttctctgcattttctttggtgcggttccatatcctcaccttcattgggagtaacaagaaggatattggcgccattttttggctgcttatgttacactgagcccagggatgcggagggaaagttgaactactctggcataggggtcagtggttatctaaatcactcctaaatcattccccatggagaatggacatttgatcaggggtacagcattaacttagacacctagccaggtatttgaaaatcagcgttctctaccactttccccttttaaaatgagtggaagtatttcacttctaggccaagaggcacagcctcagtaacttcatagctattatatattaatagcataatgattagcagagcaagttctggagccaggtaggcttggaaccaatctccactctgctatttcctgaaattgcttcatgtcattcagccttagtttccacatctgtaaaatggaaatataactggcaaagtctgtgtggaactcacactttatgtctgagaccccgtaaaggagttgtaatgggtgggagattcatatgaaggattatttatgataatgtttttcatggaataacttgatcggtgaagaatacttaggaaattcaagatcagacgagtttgaaggtaaatggcatagccaatgaaaaggccaagaatggtagctacggctggaatcctgaaaggtgctggggttggagggtggggcagcggcctcaccaggagctggggacttgccgacttgcttgacaggtttcaatgtttgggtcaagggcttgtcacccgtcaactgaaaataaggcctacagaatttctcataaggaaatataatacatacggaaacaaactttatgtctaagcaagttcaccaagcaaggtgaaaaacaggacattttgcccggccggaagtgcatggttaacctcttcacccttcttgatagaagactatgcaaattttatgcaaaaattagataacctgaaaagtgatgttagaacattcagtaagagaggatataaaatggtgcatatctaacgtgactaaagctatgttataaaaagctgaagagggaagatcagaaaacattaactgtctttgaaaacagatgaaagggcatttttcttttgttttcttccttgtattaaaagtaatggcaactgggcgcagtggttcacgcctgtaatcccagaactttgggaggacaaggcaggtggatcacctgaggtcagaagttccagactagcctggccaacatggtgaaaccccatctctactaaaaatacaaaaattagccaggtgtggtagtgggcgcctataatccaagctacttgggaggctgaggcccaagaatcacttgaacccaggagatggaggttgcagtgagccgagattatgccactgcactccagcctgggcgacagcgcgagactccatttcaaaaaaaaaaaaaaaaaaaaaagtcatggccaaaactgcaattacttttgcactcacctaatagtctatatttctcaaggcagtggttttattttcatcattaaatcatactttaaaactgctccatccctttcatacacacacataaaataacaatagcatcaaaaattcccagggggaagcatgagacgcagtggggggaaggtggaccagtatggagactgcaaaagagagaggctgtggcctcctggtctccaggtctcatcccacccagtttcttgatccataaccttgaatacttaaaaactctggattctcctaagaaaaacataatagacaggagctaaaaggacaactgaatgtatacaagagatataatagaatcttttaaccgagtaagcttgctgtatcctcagacaaatgccctctgaactgaggactggaaacaggtaatcagatcttcccctgactcttatcctccatcccctccatcagggcttctgggaagtcatgaagatacaagaatggtctagatggggctcacaacttaattatttcagaataacctgtggtgcagtgaagcagtatagacaggtcaaggaccacccccttccctcttctctcccacccccacccctggacttacctccttaaaggagaactgctctgtgaagatctcataatggctgtaggcctggaccccagccccaaggatgcacagcacttcactgctgggaggtttcagaaactatatgagagaaatgaagtggcaaaggtcaagggagaccctagcagacgggtaaaaaactaagatggtttgagtatcaggtgacttctgccctctcttctgcctccctcaagagcttgcaggcaatcaagagaatttccttttgtgtctagtttcccccgtatcaagtgggaaaagaaggaagaaggcttcactgaacagctaatgtatgccaatgctttgcccccatgatctcatttagtctagacattgaccctacgagttggggactcctactatcttcttcttacagatgaagagactgaggttgccctggtaacagaaaggtgaacttgctctgggtcttacaactactttttaaaattatttatttatttctttttctttctttctttcttttctttttttttgagatggagtctcgctctgtcgcctaggctggagtgcagtggcacgatcttggctcattgcaacctctgcctcctgggttccagtgattatcctacctcagccccccgtggagctgggattataggtgtgcgccacaacacccagctaatttttgtattttcgatagagatggggtttcaccatgttggccaggctggtctcaaactcctgacctcaggtgatctgtgcacctcggcctcccaaagtactgggattacagacgtgagccaccgcacctagccaggtcttacaactattgaagggcacagtgtggctctaaagtcacgtcttccatactccaaagcccatgtcctttcttcatatctcaggtacatgctcagccatacccacttctcagagctctgagctgcttctaagagctgcctggattctgtgagcccttccttcccagggttctagctatattcactgggccaactctgttgatcttttcactgcctctgtcttcctctaaagacgaatgtagaattagcatttgtggcatctcctgagggtgtctgtgtttgagagcaggattctgtgatcaactcacgtccagtgccacctctccaatgaagcctttctgacctccttgatagaatgcaccaggccatagcacttatttgtttgtagattttcttctacaggtctttaagccccatgaggacagaggtagtcttatttgcacagaactggtacatacctactatgacctacaagaggtagcactgggcttctcaacctcggtactactaacatttgggctggacaattctttattggggaggggcaccaacctgtgtattataggatgtgcaacagtatctctggtttctatccattagatgttagtagcattttccaccccttcaagttgtgggaactaaaaacgtctgcacactcctaaatgtctctggagcaggtggcaaactcatgctcagtggagaaccactggcatagaggaaagacatcacttggccctcgacaccatatgtattaaataaaaccctcttctgccttttctctattccatttagtaaactttgagttccctgtggtctgttcttttataaaatgctactcactggaattttggagtataatatttaaaaagtgaaaagtcttcttaactactaattactagcaaaacagcatctctgaaatattaggaattaattttatctcctgcagctaccgaaggagagataccattctgtgccataaaatatagtttaacgtctctgatttgaaaaggtttcaaaatgataatatccacaagactagaaatcttatgttgctgtctgataaggataattagatttttttccttaattgttaccattttcttctgttctcagttaatatgaatctattcttgaaagtacaggtgagcttcagaaattgttacagtatcccataaaaataaccttcaacttcctaaactaaatgtgtaattctaattggttgtcttacttgataatttgttgccctggtaatagtgtgataattgatatttttaaaatttttttttttttccgagacagtctcgctttgtcgcccaggctggaatgcagcggtgtgatctcagctcactgcaacctctgcttcctgggttcaagcgattctcatgcctcagcctcccgagtagctgggattacaggtatgtgccaccatacttggctaatttttttttttttttttggtaaagatggggtttcgccatgttggccaggctggtctcgaactcctgacctcaagtgatccacctgcctcggcctccaaaagtgctgggattacaggtgtaagccactgcacccagccgatttttaatcatatgtttataagatttattaaacagcattagtggcacttcaatcttttctcctaagcatgcaggttattaagtacacgtatatgaatctgctgggtttctcatttaaagagtctgaaagtctgtttcatttgcatttgccaaggccttgcatggtctggccctcctatctctaaagctgtctctcataccaccatgccatgttcccctgcacttcctgtcttccagccatactggcttccttgcagcttcccaagctcatgtacttccttcaaccacagggcctttgcatgaattaattccttgccatacgatgctaggctgctttgtcccctctccccctcacaagtaactgattatccttcaatctcagctcaaatatcccctacagagacacagccacaggctagatcaagacatactgctttacactcttacagcacttgtcagcgttgtagtttcatatttattggtgtgaattttttttttttttttggagactgagtctcactcgttgtccaggctggagtgcagtggtgtgatcttggctcactgtaacctccgcctccaggattcaagcaattcccttgcctcagcctcccaagtagctgggattacaggcacctgccaccatgcccagctaatttttttttttttttttttttttttttttttagtacagatggggtttttccatgttggtcaggctggtcttgaactcctgacctcaggtaatctgcctgcctcagcctcccaaagtgctgggattgcaggcgtgagccactgcgcccagcctattgatgtgatctttggactatatcttgcctcccccactggaccctgtactacatgagggcaagtactgtatctggttttgcttaccccatgctgagcgcagaaccttgcatttggtggacactcaaatatttgttgaataaatgtatgttagtgctaaaccctaatatatactatcaccttgagaaaacatatcagaggcttcaatgaagcttatgtgagacccaagcacaaaaaatgtattatgttcatcagaccctagagctccgtatacttattctccccaacaagagccctaaatagaagagaaatgatggacaagaaaatattctactctcaaggcaacaagtaaaatagaccctttgttccttattgaaacagttcatctgagcccctggaaataaagctgtgaagtttcagcctaaactttgaagtgtctaaactttgaagtgtcaacccaaggcttcttgattcttctgggagcacagatttttattaatgcaacaaagcagtgttattgcaggctgggtctacaaaagtgtggtttccagacctggttgatcctcactctgtgattttgattcagtaggcatgggaatttgagtttttaaaaacttccctagctaatgctgctgcatagcttgcttctgttggaaacttcttatctgggacaagaccatgtggcctcaaaaggacccgcaggaacctggttgtatgacttcaggaaacccaagtttctattcttttatgcgtaaaatgaggccattaatactttctctgccttcctcacagaaactcgtagtccagacaaggggctggaaatgagtttgaaaaagactaaagctctttgcaaatgacagtaatacaagattcattctgttcccaaattaccagcaaacatagcaaggagtccttgattacttcagttgagtcaggtctggatataactaaaaaccagttcattgaggtgggtgctgttggtctactcccttcgcatacaattaccagattaatcctcccattcttccctccccagcaggtatctagaaaacctcgacatgcaacctgaacacctggtctttgctgctgcaactttccctgggttaccacgtttcctttataataacttaggaaaaccagtgtcccaagaccttgtacttccacatttaatgtgaaagactccagactccaatcgttcccacagacaccctgtttcctaagcctcatcctcttaactctaacttttaaaaatgctgtttttcttataggatgccttgacattgcttgggaacatcatcacccccattgcttactgttccctctgcctggagtgcccctccgtgtttttgcatggttcgctaactcactgctttcagctttgactcaaatgtcaccttctcagggaggcctttcttggataatgtaaaatgtgacagcttctccaatactctcacttctgctttatcttcacctaacatgttatgtggctttttggattattgttggttttattttttagcaaattctaagcacgctattaatcatttattaatatgtactaattatttaattacatattatttattactatttaacacattattaaactcaacagatgtttttgtttgttttgttttgtttcctttttgttttgttttttaagacactcactcttttgcccaggctagagtgcagtggctcgatctgggctcattgcaacctctgcctcctgagttcaaacgtttctcctgcctcactctcccgggtagctgagattataggcgcccaccaccacgaccagctaatttttgtgtttttacaagagacgaggtttcaccatgttgaccaggctggtctccaactcctgagctcaagtgatacgcctgcctcagcctcccaaaatgttgggattacaggcgtgagccactgtacccagcctgtgttttcctttttattggtattgtctacctcccctgtgtgtgcccctctgtttttctcactgccatttccctaacatttagaacagtgcctgacacatgatagaagcccagtcaatacttgtcgaatgaatacagggatctggcttggatatgttcagttcactcagcctcttgtgtagtactagctttggtctatgggacaattatactgtcttaccaggggcaatgtggtacagggacaagaagccagtcctggaagccagagaggtcaagtattaaattcttactctagcacttattagctgtgtgatcctgggcaattcacagaagctctctgagccatattccttgacctggaaggtggagagaatttctcatttcgattcttcaagactgatgggaagattgagaattatgcacataaggtacttgaaatctggtcatgcacactaattggtagctaataatttcgtgaattactgatatatctgacatctggagttccagctatgtccaacaggaaaccaaaataagttccccacttctcctttagtctctcaagattgagacaccagaccccacttgacagctcaccttaatggtacagccagccattcatcttaccttggtggcaatggcagaaactgcagctgttctctttgcagttatgacatttccatccatgaccttggaggaaaagagagacagtgagcaaggggaacccctgtccactgcataaattagaagaaacagttctaaaatattagcttaggaagttttatagcatcctacaaacagcatgggtttggcgtcagacctggatccgattcctccacttacgagatatgcaactttgaacaaacactttaatctttaagcactggtttcctcacctgtaaaaaagataatgccagccattcagagggttattgtgaggattaaatgcactggcatatctggaaacatctagcacatggtgagccctcaagaactgcccattttcttttcttgccctaggattctcaaaacaccaaattaagaaggaactagagagagaaggttgccaattgacatctggacaacggccatgaaactcttagtggctctccgttcctgctgcacatgtggaaagcttcgtgaagatgctcagataccacccttagattaacccagtctgtatctcttccaggagtgagacccagacagcccaggtgattccgatacacagcgaaggttgaaaattatgcctcgctagtaaaaaccatcctctgcactcctctccctgttattcatctcagctgatcatcaaaaaataggcatcatcaacctcattttacagatgaggaagtgaatcacgaagtcactgagcagattcagctgtcatctagtttcaaagccttgggttctacccccctagggaaccgctgttggcaggtagtatgaatgccatctcggttggatgagtgtaagttggggaaagctagatattctcaaaggagtgttaaacggccagattatttggcgatccagaaattcaggggaaaaggagggacattgtaagacccagcttggagcgcacagaccttaagagttaactgtcacacctgggagtgattcttgagtctttcactaaccagatgtgtgacctcaagcaaagtgactctactaacctgagcctcaaggacctcaacagaaattggggggaaggggagttaataaaaacacccatagaggaattttgcagaattgaatgtgatcagcgtctccttcttggcacataagtgcccaatatgtagcagttaaaatggcggtggtcttagaagagtctggacctatggaccgtggacttagactgagcagctctgaagtccaaccatgctaattgttggttacataaacctcggtaagttgaacatagttgctctgactcggtttcctcatctataaagtgggagtaatcatattacccatatcatagaatagttttaagtattaagaggattaataaatgtgaaatgtttagaaaagtgcctgatgcattataaaaagtactccataaacacaagctactgctaccttttgaaactatgattagatattaaaacaggtcacaccgtatacccctctgaagactcccagggattatagaacaccccttcttttccatgtcgacaaggattcagtaagtaagtcttcccttggctaatgggttcattcaagctgcgtatttggggcaactgagtataggacaaggacatatgcaagaatgacaacaagattattatttccacactgtcacatgcttgaggcagcagtgggcgctggtgccgtgttatgcatcctcaggcagtcctagaaatagatacatggacacagataaccttcactgttgctggtatccagtcacttgcagaggggcacgcgtagtcacaatcaagactccccctgctgcggagaacttacttttgagcttcaatctgggcccaggggccccattccaccccgggacaggaagttgctcaccgccagcagggtgccattgctgggctcaaagagtagcacagtagcctggtgggaagggacgaccgaggtgatgccgcggtcctcgtagaaggtgaccaacttggtggtcagtgcatcctctgcagcactgtaggcgggcatgacccccaggtagctacaaggagagagggagcagcttcagccccttcccatcaatgctggggtctcttagaaagtatccatatactttcctttttctttccttcctcaccaccccactggccctcttccagcccccgcatccctctgcccttcccttagacactatgcacagtatgttcagaagtctggctctggatcagaaaacctttccagctctgccacttagtagctgtgtaagcttaggtaagtcacttaacctctctgagtctcagttttccaccaatcaaatggtggtatcaatacctccctaggtggagagtgtgctgaaataaacaaggtaacacctgtaaaacgcccacttagcacaccgggtagcgcctattaaaagtggcagctgttagcaacggttaggcaagccgtctcttcccttctcccacccctcctcttcctgctcctcctttccccgctttccagtttctcctgcccctgaccccgaccctcctcactcaccccctgtgcttggtcaccggcaccacggtgcgcacgggctgcatgacccctccttcgggaccgctggagaagttggccagggccgtctctagaggcgggatgaggaggctggagctgcggaggtgttcctccacctcggccgcgctcaggaacgctggtacccggctcatctcgccacctgtgccttctaacctcagtctccgcaccgcgatccacgtaccctcggctgtgccctttatgagcgcgcccgctgctctgtggagccgcctgctggtcacagcccagcctccgggggcggagcaaccccgccccgccccgccagccctctcctcccccttcgcccacctcgacccctaagggtgggcgagatgggtcccttccagcaacggattccccaagatggacatcgcggtggcgtgctgggagtcaatattgtttggtccactttctcagttcctgtaatcagctgtagccacattccttgacttttgcttcctacataacccctccctattaactcgctttttgctgctgtctaggtcaccgtgcctgggaaagaatggacagggaaaacgctaacggggctcctttatttattaaattactgcctactgctaggagataaaaggagacggaggcttatttaatttttttttccttttaattctgtccccgtctagagtctcttatcctagtcttcctcccccctgtacccccagatgtctggcctttgattgctaagaacgcacagttttctcacaggctaactaacctaacaaaccttcgcctttaaaggggggaagtttgcagggcaaggtgtaatcttttccatctcacaaaaagccaaattgcaggatcttttcttccaggagtttttacctgagatggggaaataaaatcggaaaggaatgatgtaaagcttaaggcaataaatcctagtcatcaaatcagtgataggaaaagtaagttaattcaaagaaaagagagatgattttgacctggagtggttagataagggcttcatgaaagagtggggagaaaccaaggtctgaaataataatagtgacgacaacaatgataacatcaggttattgatctttactatgtaccagatactgcaccatgcactttatgtatattatctcatttaattatacaacaacctctaaggtagggaggtgttgttattagttttactgtccattggaggctctgagaagggaagaaatttagttcaaggtcatccaccaagtcagcagaggagctggctttgcccatggttggacttcagaattatattcctaatcattaagctactttggcagaaagagaggaagagggcattacaggccaagtaaagccctgaggtggaaggcatgttgaatagctctgggaacagtgagttgccagatgtgttaggctggaataaggtgctgaggtctaggagcatcagaagataaaactgagaacgattcttggagtcaggcagctgagaatggtgattcctaggaaagaaattacatgctccaagagagtaagcatttagaaagatgggtcttctgccaatgcaaaggatggaacagatgagcgagagcagagcctgggagaaggtcaagaggcaggactgctgaagttgtgctttgtggtattttggttggaagctacatagggcattttgtaggaaatggtcacatcatgataaaagacagtggatgagtaagtgtcaaaatcagtaccaatgaaatgagaaattgtacataatgtgtttagcaacagtgcttggcacagagtagccatgtaataagtgaacactgagagagaaagagagagagagagaagacactggtggttgggaaaagctgatttcaatgacacaattttgtttcttcggttcaccatccctagaaatttatgcccagagccgctgggcttatagaaatgtttctggcccatcacgtgtgctgttagcattaatattacatcacatttattgggtttagaaagcacagacatatagccctggcatgatagttcacgcctgtaatcctagcactttgggaggcccaagtgggtggattacctgaggtgaggagttcgagaccagcctggccaacatggtaaaatcttctctctactaaaaatacaaaaattagctgggtgtggtggcgggtgcctgtaatcccagctacccaggaggctgaggcaggagaattgctggaacccgggagatggaggctgcaatgagccaagattgcaccactgcactccagcctgtgtgacacagtaagacttttttggccctttgtttttgtgaatgtgaactaaaaataaaatcctatgccccccacctactgaatgaaccccctctgggccaagcagaccccagaaaaaccttaaagacttagtttccagccatgatgggatggcaaatcagatatgcctcattacatcctctcccttttagagtttagacacaactgagcagccttaatgttaatacagagatcacaagactgacagaacagactctttgtggcaatacgataacaaattataaacaggatctaaggccatgccaggaagggttaagtcacgcacccttacacttaaagaaaaaagctatgttctaactgccacagagtttttgttttctccagcagctaaacaagcactggcttgaagataagcaatatttttgtttttgttttccccagccctgctcagagaagatagggaacatggcttgggcacagtggctcacacctgtaatcccagcactttgggaggccaaggcgggcggatcatgtgaggtcaggagtttgagaccagcctggccaacgtgatgaaaccccatctctacaaaaagtacaaaaattagccaggtgtggtagcatgtgcctgtaatcccagctactcaggaggctgaggcaggagaattgcttgaaccagggaggtggaggttgcagtgagccgagatcgtgccactgcactccagcctggacaacagagtgattctctctctctctcactctctctctctctctctctctctctgtatatatatatatacacaaacatatatgtatatacatatatacgtatctatgtatctatatagatatgtatatgtatctatgtatctatatagatatgtatatatgtgcatatatatatatataaattttttttttgaaacaaagtccctctctgtcacccagactggagtgcagtggcatgatctcaagtgattctcctgcctcagcctctcaggtagctgggattacaggtgcatgccaccacccccggctaatttttgtactttcagtagagatggggttttgtcatgttggccaggctggtctcggtctcgaactcctgacctgagatgatccacccgccttggcctcccaaagtgctgggattacaggcatgagccaccgtgcccggctgaagatatgcaatattaaaacaattacaactcatccaaatcacagatattgactaaccgaccccttgttccaccagccataactacagcttgattggacaagagactgatttcagtaactttctcctgataagactaccgactataggatggttctggctgacttacagaggttgcacacttgcatgccttcatgtcctgaaaagaccttttgacgtatcaggctgaattgtaatacatttaaatgctgcaaccaccccaaaatgaacatgagttgtatgtaacatgcatgtttgttaaatacacatgcatcaggaccactttcatgaatattcatagcttcttctctcacctgttgaatatgtatatttagccaacctgttgagcataaagctcctaccccaaccctcctccttcaaagtgcctgtctctgatcttggccaaggcatgtgatatggtttggctccatgtccacacccaaatctcttcttatagctcccataattcccacatcttgtgggagggacccagtgggagatgactgaatcatggaggcgggtctttcccctgcggttctgatgatagtgaatgagtctcacgagatctgatggttttaaaaatgggagttgccctgcacaagctctctctttgctattgccctccatgtaagatgtgacttgttcctccttgccttccactatgattgtgaggcctccccagccatgtggaactgtaaatccaataagcctctttcttctgtaaattgcccagtctcaggcatgtgtttatagacagcatgaaaacggaataatacagcgtgcttcccagcataggatcccaccttgcaggctgtaacctcgtataagaaagtctcttcttgtctaaatttataaattgtgtggttttttttttaaagttaacaaggagaaaaaaagcaaaaccaaatactcatcaactaaaagagatatgaaataagaaagccagatatttatttgcttccatagtaaattcaggaatttagccccgattaaatagaaatcttatttctgactcccacattactagaaagtttattaatcttctttaagtcatgattataatagtaatttcattattttaacaatgacaaaataagaaacctcaataataggaattcactccagtgaatcctgtagaaacaggacaactctgcaaatcatctcaaatcatcttcctgataaagctttggttcacatcacccaggtcctcagtaaagtagcactgagaaaactagtcttggttgcatcacttcttttgagaccagaggcacagagaactaattgtcccaagcctccaataataagtattattaataagtagcatattaaatattaggtgttattgaggtttattttattattattaaaataatgaaattattattataattatgacttaacagaaagaagattaataaactttttagtaatgcaggggtcagtattgagaaagctggtgtaaatctcttttccccgcccttccctgagaccttgtcctgggacaagcctgggggccatgtaagctcctgtgcctgagcctctggaagttccctgctaacccctaacagaccctgcggaggaggtggttacttacatccccctagacttctgccactaccacagtgaagatggcagcagggtagagctgtaccatagtgaggtactcacctatggcacaaaatgtacgggattcactcagtagtcatgataaatattaaactaaaacatctaaatgcaatatttaaaataaaaatcaatgccaaaaaatccacagtgaacagagtacaaaaattttcaacaaagacggctcaggattactgacttttccttttgctgtagatgccaatacagctcctcacgaaattttatctttacattttattttaaaatgtaaaaatattgtataaaagtctttattttgactattgagttggcttcaccttgaatgctgcagccaaggcgcgtgtctcattccccttatccctaacctctgtcgtcctagagttgggggactgagcggtgggccaggacaagcaacggatgaagtatctcggaagccggagaagggtggtctggggctcttgggagcatgcgcggggtggggcggtggggggactgaggtggcgctcccggctcctccgcgcgcccccggcaccttccgcgcgtccccggctccccacactccgtccccggctccccacactcccaccccggtctgccccgggcgcccccggttccccacctcctggtgtgcctctggcgggtccgcgcaggatcaggctacagactcgcccgcgggcggctgcgcggcgggccgttggggagggtgttgggatgaggagccccaaccagatggacgcgcaccccgcagcggcggaggcggcggcgaggcttgagcagtgagtgctcgggagccccggccagcccttcctccttctgcctgcgtcctctgcgctggccgctgctccagacgccagggggcccacccgctgcccgtggtcggcgcgcggagctcgaaagcgcgcgcctctaacaaatgaaaacccatagggacttagggttgaattttaacttttttttttttttggcttattgtttagtgctagatagaagggtttgagcggtgtagtcaattttggtgctagtctgacttgaggcaacgtgacgtgacctacgcgtctcatcagtaatgcagaaataacattttatccacttcatcgggcttttctttttctttttcagaaaattgaggtaaaattcaaataacataaatttcaccttttttacccttcaaagtgcacagttccctgacttttagtatattcacgatgttgtgcgaccaacactaccatctaatcccattttcatcaccccccaaataaaccctgtactcattcagttacatcccattctcctctccccactgcctctcccaattgccaatctacttttttgtttgtggatttgtaggttctagacatttctttctttctttctttctttttgtctccagctgcatctacattgctgcagaggacataattccattcatttttatggctgtatagtattccatagtgtatatgtaccacgttttctttatccaatccaccattgataggcacctaggttgattctatgtctttgctattgtgaatgatgctgcaatgaacatacagacgcatgtatcttttagtagaatgatttattttcctttgcgtatatacctagtaatgggaatgccgggtcaaatggtagttctaagttatttgagaaatccccaaactgctttccacagtttctgaacaaatttacattcccaccaacagtgtataagtgttctcttttctccacagcctcaccagcatctgttttttgactttttaataattgccattctgactgatgtgagatgatattccattgtggtttttatttgcatttccctgatgactggtgatattgagcattttttcatatattttttggttactcgtatgtcttcttttgagaaatgtttgttccttttgcccatgttttatttgggttatttgtttttggcttgttgaattgtttcagttccttgtagttttgtatattagacccttgtcagatgcatagttgcaaaataaacttggggcttatgatacttcgcctgattatttacataaaacacagtgggcatagtgaatggcttttaaaagttggctttgctgggacttttatactaaattttggattagacttttaaaagtcttgaggctaggaagccaaaccaagtatttgcttggctgtatctgtaatacctgtatgaattgggttaatttctctcttcttgagttcccaaaatatactgaggctcgtggccctgccagaaagtgacattctttacttagtgcaagcacagaaaccatacaagggaactgtgtagacaaggaaccatgccagactttccaaagggctttttatcagcactataaaattgtaaagctaatctcaattcctccaagcagtctggtcatctctgaaaatatgccattccagccaaagccttgataaaatagccagtgtatctaattatgtcctgttataaaataaaacagatccttattgaacttatgcaaataactattttgccataaattaagaatactcacagtttccaaatttgggagaaatccagtagtgagaaaggcaaatgcttcaaatttgcccacaaaggtatatttacccaatttttgtaagctatgaatagctcaaaagaaaaaaggtttattaactctggaagcaaaacataaaaagaatcagcaatgtttcaagcaaaaaagttattaaaaatcatctttgtcctctatcagtttagtcccatgtagctaattattattccacttgatgttgggttagcaaccctcatgaatgcatcaggttttttattagagctctggaagtttttgcccactccaatggtgtgatctccaaagttatcagaaacctggattcaagagtacttgtcatagttctttccatgaagttccttaagaagaagccaattttggactgtagctgattataaaccactttttgagaagaatcaaaataaaacaataattgagaatgacaaatctcttagaatagacatagttaaagacagaatttttttttttttttgagacagagtctcactctatcgcccaggctggaatgcaatggcgtgatctcagctcactggaacctccacctcctgggttcaagcaattctcttgcctcagcctcccaagtagctgggattacaggcgccggccaccacgcccagctaattttttttttttttttttgtatttttagtagaggattttgccatgttggccagcctggtcttgaactcctgacctcaggtgacccacccgcctcggcctcccaaattgctggaattacaggcatgagccaccgcacccagcctaaagacataattgacaaggatatttgattatttctgtggcatacaatttaacatcattgtaatgattaccgataacatataccaagacatatcagaattgtaggaatttcttacaattttggaacatactttaataacacttttatgtaaatatgactcaaagaaagtcaagcaccatttcttatttgccagtgtttcctatataattttaacatattaaataagcctactatgtctctcttggacatctaggagttccttttggaagatacttaattttaggccgggcgcagtggctcactcctgtaatcccagcactttgggaggccaaggcgggtggatcatgaggtcaggagatggagaccatcctggctaacacggtgaaaccccatctctactaaaaatacaaaaaattagctgggcgtggtggtgggcgcctgtagtcccagctactagggaggctgaggcaggagaatggcgtgaacccaggaggcggagtttgcagtgagccaagatcacgccactgcactccagcctgggcgacagagcgagactccgtctcaaaaaaaaaaaaaaggaaaatacttaattttagaatttgaaatttgatttttggaagtatgtcaaatactaaaggcttaaaacacttcatcaaaatagaatcactggtcactgtaaaataatagtcattcatttactcaaagtgataattcaaagatttcaaatagaaaagcctttactctttgttagagaggaaattgttttccaaacaaccataagacctattttttggtagagtttgagaaggtatgatataacagaaatatgtatttggtcttcatcccttgttcctggcacagagctcccacagtccttggaatttctggaatgaatggaatatcttttcttattcaaaacttgaccatacgtgagtttatgctaataaagtgaccccaggaaggcccttagatagcttgaggataggtgctggttgccagaggaatcaaccatgtgatgaggattgaaactttcagcccacatcctcacccctgatctccaggagggaaggagacaggagattgagttcagtcaccaaaggccattgctttaaccaatcatgattacataatgaagtcttgatacaaactcttgaacaatgagatctggagagcttctgggttggtgaacccatcggtgtgctgggagggtggcacactggagagggcacagaagctctgtgtcccatgccccttgccctgtgcacttcttcatttgcctgttcttttgtaataaactgtaattgtaaatgtagcactttccttagttctgtgagttgtttttagcacattatcaaaccagaggaacaattgtgggagtcctaacatttgtagttatccaggcagaagtgcaggtaccctgtattccctatttgtggctgtgtctaaagcgggtgcaatcttgtgggattggttctttaacccatggagtctgtgctaacttataagcttaagcaacaaatgagtcaaataaaaaatcacaagggaaattcgaaaatactttgtagtgctagaattgaattcaattgtaggacacccagttggggtgtcagagaataggacaattggttgtttatttaaaaaccaaacaggaggaccaatgtaaattattctttagatgtttggtggaattcaccattgaagccatcttatcccaaccttttctttgctgagaggtttttagttactaattaaatatcttattataggtctattcagatattttacttgttcttgagttagttttgtagtttgtgtgtttctagaaatgtgtccttttcatctaggttatgaattgtgtccttttcatctaggttatcaattgccctacatttgttcatagtattctcttgtaatgttttttaatttttgtaagattggtagtaatgtcttctcttagtttcctgattttaataatttgaggcttctttcttattttggtcagtcaatataaaggtctttgatttgtgttgattctttaaagggattgtatattttccctggcctgttgtttttacattctctatttatctctgttttagtctttattatttcctgccttccaccggctttgggtttggtttgctcttctttttccagtttttaaggtggaagactagattatttatttgaaatagttttaaatgtaagaataaatgtgaaaaaactaaactgcttttcttataagttttggtataccatatttttgttttcattcatgtcaaagtattttctaatttcccttatgattttttatctgactcatttgttgcttaagtttgtattgtctaatttacacatatttgtgtattttcagatttccttctgttactgatttctaattttgttccattgcagtcataataagatgcttcatattatttcagttttttataatttattaagacttgttttgtggcctaattaatggtctgtcctggataatttttttatgtacacttgagaaaaaaatgtgtattttgttattgttgggtagagtattttatatatacctttaggtcaggtggtttattttgttgttcatatcttatatttgtttgatcaatgtagttgttctataattatttaaagtggggtattgacatctccaactactattgttgaaagcccttaaatctgtcagtttttgcttcatatattttagggctgtgttgttaggaccatatatgtttgttactgttgtatcttcttcatgaattaacccatttaatagtatataatgtccttcatctcttataaccgtttttatcttaaagcctattttgtctgacattagtagaatcattccagctctcttttggttaccgtttgcattgaatatatttttctgtcttttaaacttttatttgtgcctttaaatttaaattgaatctgttgtaggtagcatatggttggatcatgcttgttaaaatccattctgccaatctctatcctttaattggagcagtaatctatttatatttaatgtaatcactgatagggaaagacatacttctaccattttgtcataagaatgtcataagaatttacatattaggtgcaaacttaccctctacctcctcactcaggtgacaccctctcttctgtcaaagtgagagttgaagccagctgggctgctggcacaggtgcccggcttttattcccttatttggccctgcccacatcctgctgattggcccattttacagagcgctgattggcccatttacagagtgccgattggtccattttacagagtactgattgccagctgggcttctgggtggagtggggacttggagaacttttgtgtctagctaaaggattgtaaacacaccaatcagcactctgtaaaattgcaccaatcagcactctgtgtctagctaaaggattgtaaatggaccaatcagcactctgtaaaatggaccaatcagcactctgtaaaatggaccaatcagcactctgtaaaatggaccaatcagtgttctgtaaaatggaccaatcagcaggatgtgggtggggccaaataagggaataaaagctggccaccagagccagcagtggcaatgtcggatccccttccatgctgtgggaacttttttcttttgctgttcacaataagtcttgctgctgctcactgtttgggtccacactacctttgtgaactgtaacactaaccacgaaggttgtaggcttcattccttaagtcagtgagaccacgaacccaccgggagggacaaacaacctggatgtgccacctttaagagctgtaacactcactacaaaggtctgcagcttctctcctgaggtcagcaagaccacaaacccactggaaggaagaaactcgggacacatctgaacatctgaaggaacaactctggacacaccatctttaagaattgtaacactcaccgcaagggtccgtggcttctttcttgaagtcagcgagaccaagaacccacgggagggaaccaattctggccacaaaagcatcttacaaatatgctttttgctcagacttataatttcatctttttttccagtaatttgaactcagtcttgaagtcttacagtgacagttcagagccttacctcttaaacatgtttcttatttactcatatatattcataaactgttatacatatttaatttagtatttagaggaatctcagcatcaagtttgtttctctgaggatgtatgtcctttcaactgatgatatattccttatcctctttccactgttgagtcctaggctacatttcctatcacatctttgctttttcattggttatataaaataaacggtatgagaaataatcagcattggtttcttgttcgcatgagatgacaggaagacagatgatatggacatcagctttcccaaaaggattttccaaagctgtaattatcaacacaaactatgtttcaagaaatcaggggtagtatactttatgctaaaaacggagggtttgtgagaataatgttacagcttttaattttctctgtttaattttatcaacttgggagacttttgttatcctgggacagttcatttcatataaagcatgctaacattatctttttcattgcagattggaataatacttttaaaaactttctgcttgattcattcctgctggtacccatttataaccttgggatgagcatcagcaaatactatgatatccaagaggtgaatatgttgtgttcctgttgaaaagtattcctaactccataaattacagtacagaaagtgagtatctgaggctctacaaatctcatcagagctactggtagtcaattacttattacatgtgaataattctacctacattactgtgaatcttgacaataactcaagttatatgttatcctcattttgaaaaaactaaaccttacacaatgtaaaaacttgctcaacaccacaaaatttgtacaagatagcactaagattcaaagcttatgtgcataatgcattttctctgtgggaaagaatctctgtgattagtatctatattgtattatacattaatctcaatagaggggaaagcacttgaaaaaatttaacacccttttatgatgaaacttctcaacatctttgcatgtgcttatttgccacatgtgtatcatctttggtgaagtgaccggtgaacttttctttcatttattgttgaattggtcttttttcttactattgggttttgagaattctttgtacgttctgaatatcagccctttgtgtagtaagccatttgcaaatattttgtcccagactatggccttttatttttttcaaagcatcttttaagaaccaaacgtttttaattgtggtgaagttaaatttatcattttttagtgaattgtgcttttagtgctatatctaaaaaactttgcccaatacagagtcacaaaagcttgattggatgtcttcttctagaagttttacttaagagaaatgaaagcatatgaacatagaaacacttgtatgcaaacattcataaatagctttaattataaaggccaaaaattgaaaataacccaatgtccatcaacatgtgaatgggtaatcaaactgtgaattattcatacaatggaataccctcagcaataaaaatgaatgatctaccaaaaaagagacttttcagcaaaggaggactagaatgaaacatcttcactttgagtaaggaaatctagaaatatctattgctaatatcattttcaaggcaataccattgtggtagcatgaaatacataaaacatttagggaaaattttaaaaaagatgtgcagtacctgtacactgaagactgaaaacattgctgagaaaaattaaagatgacttgagataatggagaaatataccttattcatggatcagaagactcaatatttttaaattgtcaattgtccccaaattgatttatacgctcaaaacaatctcaatcaacatcctagaggctttttatttttggtagaaatttagctgattctaaaatttatatggaaattcaaaagaacttcattatccaaaaatatatattttcttaattgcaagattttgtgacaactcattttaaaacttattataaaactacagtaattaagacaatgtggtattaacataagtagagacatagatgacagatggatggatggatagatagatagatagaataagatacagagttcaaaaatagattcacacatgtatggccaattgattttggattcaaaagaactttattatcccaaactatacttttttaattgcaagactttgcaccaacttatttgaaaccttattataaaactacgataattaagacagtgtggtattagcatgagtagagacagagaagataaatgcatggatggatggatggatggattgatggatgaacggatggatggatgaatgaatagatggataggtaagtagatagaagatagatagatagatagatagatagatagaataagatacagagtccaaaaatagattcatacatgtatagtcagttgatttcagatgaggtgccaaagtaattcaaatgagaaaggatagtcatttcaattagtggtcatggccctaacctgtaaaagcttgtgattatttgatacctagcaaacagacaaataaaatccctataacctcttaactctatcccagtaggaagaaggttgtgaaaactgtgcattctaaaagacagcgtagattgaaacacccactttggatgcaccaagggaaaagcaaatctgagtgctacaggagacagtgaacaagggaatctctcatagagagcaggtgaggattctgcagaaaagagaatacggaacacagtggcaacagcggtagatccatcatgagctgggaaatactgaaaaaaatctctgagaactagacctagtcaatcaaaatcctggttatagggggaaataaataaagaggcttgaaaatgtgcaaagctataaatgttaatcttgagagatattaatttggaggttagagagaagcaacttagaaaatagaagtgccctttagaattagggtagcaaagagaaataaggacatgtccagcataatttaacttcatacagatattagcaagaatcacagaattgagtcgcttcattcccttagaaaaagttctatttgttaaagaaactgcacttcactgtattaatagaagaagatgaatatgtactaaga

SEQ ID NO: 54 - DNA, 103391 bp, Homo sapiens
cccatagtcctccactcttactccttcttccacccaagtctctgtttttttcctgctcagaacccagcagtgatgtggaggtggagacccacaggagccccggacttcacctgagctacctcaggtatcaattctgggagagtggggtggggaggagcatcataactaattatctgctgctggtgcgacttgcaacgtgagccaggcttggatagatggcatttgtacttcacctggtcattcccctttactaaaagtttgtatcttcttttaccacttctttccttgattgcttctattattctgggactacctctctttagaggaggaggaccctcttacagattctcttgtaactctggcctctggtttggttagttcattttagggagatctgaaggcaaagtcacagtagtggggtgggggtaggtcaaggccaaaggaattaggaaagattcccttattctcaaagggaacaatatgaagttttcctatttcagcagcagggggagcctgaacaccgcataggaaaggcttgggaggtcagacacgtggtagcagggactccaggtcttactgggggtggagagaggggagggctagaaccagggcagtggactgacattccaaagctctcttgggaaataggagacttaaaaagcttttatggagtctataaataaagaggatctttctgggttgaggaatggtgtggttggatgtcagtgggatcttcacataggggagtaggaagggggtggggaatggggaaaggtcacttgttcctgtgaaattaactccttcccacttgaccttatcacaaatggtttgtcctaggaaatctagaagtggagactctaacttagaactcctatcctgaaatagaaggggcttacctctctgccgttgacagtgatgatggctgggagggaatactaaaatatgacaggttttgagactcccctcaagctggtgacaccagtctcttcacccaggatttcttggcttctagagatttgatgtgtacagagcccttacctgaggaaaaggaaagggggttaaggaagttttgttaccagtgtcccatcttctacagccctagtagctcagtagcccatcttgggcactattcccagtttccttccagactattcagatactgactgcagttttaatttcacttccacaactttaataaggtcagctcaaaaggaaagatgaattccaacactattttttccctgctccgtcctgggcctatccctcctccgttagccaggcaagtgtgaatcattctgacccagaccaggtgcacaaaaccctgggaggggcttttgatgagtcagacatttcagccagaattcttatcccttagattctccatctctaaagccattgcccctctgggccacctgctttatagtcaggaagagtgggatctccctggaggactcctgtttgatacagttctcctcttttgtagtggtcaccaagagtggcaagataaagaaaaccctgagttgggcgggaccaggatgcctgaccgggacagctatgccaacggtaccgggagcagcggtggaggccctggaggtggtggcagcgaggaggccagtggggcaggggtaggcagtggcggggccagctcagatgccatctgtagagacttcttgaggaatgtgtgcaagcgaggcaagcgttgccgatatcgccacccagacatgagcgaggtgtccaacttgggggtgagcaaaaacgagttcatcttctgccatgacttccagaacaaggagtgtagccgcccaaattgccgtttcatccatggctccaaggaggatgaggatggctataagaagacaggagagcttcccccacggctgaggcagaaagtagcagctggccttggcctttcaccggctgacctaccaaatggcaaggaggaggtccctatctgccgtgactttctcaagggtgactgtcagagaggagccaagtgcaagttccgtcacctgcaacgggattttgagtttgatgctcggggtggaggaggcactggtgggggctcaacaggctcagtcctcccaggacgacgtcatgatctctatgatatctatgaccttcctgacaggggctttgaggaccatgagccaggcccaaaacgccggcgaggtggatgctgcccccctgatggccctcattttgagtcatatgaatatagtttggctccaccgcgaggggtggagtgcagactgctagaggaggagaatgccatgctcaggaagcgggtagaggagttaaagaagcaggtcagcaacctgctggccaccaatgaggtactactggaacaaaatgctcagttccgcaatcaggccaaggtcataaccctgagctccactgcaccagcgactgagcagactctggcccccactgtgggcactgttgccacttttaaccatggcattgcccagactcacactactctcagcagccaggctctacagcctcgtccagtgtcccagcaagaactggtggcccctgctggagctccagctgctcccccaactaatgctgcacctcctgctgctccaccacccccacccccacacttgaccccagagatcacgccactgtcagctgccctggctcaaacaattgcccagggaatggcacctccacctgtctccatggctcctgtggctgtatctgtggctcctgtggcccctgtggctgtatcgatggcccaacccttggcaggaatcacaatgagccacaccaccactcccatggtgacttaccctatcgcttcccagagcatgcgcatcacggccatgccacactgatggggctaatggacactcccctggtatagcctcgcagggctggggtcagggggcccttgcccactcacctagccttccccatccctgtctgaagggctcccttgagaactaggacaagagactacaaggagtatgtcctgaggaggggttgggatggtgtgttttctctcacctcccttttatgagggtcctcttgtccatcttcaagcctcacagtgggggcttgcagaggagtgcagactgaagccagcagagaggaaggactgactgaggggctgtgtcctcttatgggaatttgggaacatccctcgtcttgtcctctcttctgcacagcacaggttccagcactggttttagaagaaaaaaataccctgcccagagggaaagccaggaaagattgggaagtgggtggtcaggagagaaggcctgataggagccttcagacaatttgggtcctagttgcttgggttggacaatacaggaattgcttctgggccctgggaaagctgggaccatagtgctccagcccaaagactaggggagcattcattaccctagtttgacctgaaaatccatagggcagggcccactactttccaaagaaataaaagaacaattatttttaacaaatggaggcagtgaaaacttgcttagctattctgtgtggaagatgggagcagtaaatagatctcatgccaaaatgggataaagaccccagcctcacatagctttggtaagatggatagaagccagtgaagaagggtagggacccagaacaagaccaaatggggctttggggaaggcactttatggggtaaaagctttggagccacccagtctagttttaaaaatagtcccatctgtttctggtctctgtctgtatgtgctattcccaggttgcctcagtaaccagggctcctagggtcatttagcagggcaggcagtaaggagagtgtatttgctgaaatgcggatgggatgttacatagttgacagatccttattcaaacagagcaggacaggtggagttgatggccattgagttgatggcagttgccgctcagttgatggcagttaatgtccctcctaccccaccccttcagtggccagttcctgaagccttcaaggcttgggaggtctgggaaaagagagtccttctagggacacaagcctcagggtccatccctttcctctgtctccacataggaccagaagttttaaatctacttaagtcagtaaggccaggggccccaatagtcaaacctcagttcctcctcagctcacggctgatgtagggaaaacaactcaggtgtctagtctaatgggacagtagatttgggggtagagagtgatcctggattgtgttccccctcatcatgtctcctgctacctcttgctttcttgtctggttgatcactcaggtcacatctgggattggagatggtgggctaggtcaaggccagtcattaaaaaaaaaagcctaaagactaaaagtgggctaacattgtggattttagaaacaacacattgataagcttaatgttttttgggacacaatttttttttttttttttgagatggagtcttgcccagtcaccagaccggagtgcagtggcgcaatctcggttcactgtaacctgcgcctcctgggttcaagcgattctcttgcgtcagcctcccgagtagctgagactacaggcgcccgccaccacgcccggctaatttttttatttttagtagagacggggtttcatcgtgttggccagaatggtctctatctctcgtgatccgcccgcctcagcctcccaaagtgctgggattacaggcatgaaccaccgtgcccggcaattctagactattaaaagagatggtttaagagcatttagagaagaatgtaaccatagataccaacatgaattctcagtcaaatcctgactgactttatttcctccttgccaggttatctccaaagaggtagatttgggaaattttagacattgtatgtcttgtatgtatttactccagctgaagaccaccaagaatacacctggtaattgagcaagttgggtttaatgctcattgcagtgagggggagggctcaccattggggataacgtggtgtgtctcagcatgagggtgttaggaacgacttagagaacttagactttggttaagtgattttggggaagattcaagaaagtgggtgttcttttggattgggtgctgttaagggaatccaggataattgggtagcttgtctagaagaagggcagacaagtgaacctaagcacagtcgatgatgaagtcactcactagctgggaaaggggatgtttgctgttttgtggtttgcacactgaccttgttttgtgcttaaacaaaattgtgtagtgattttgttttttgtctcacttcatcgcagtcactgagtgaccttgtctgatgctggtgttttgtgagattgtttgtgtccaagagaactcattggctacctgtgagcaccaggtcagccctaacagctctgaagcctggctgtgtcaggccagttcccagattacaggagctactttcctctctctcacctgctaagtcatcacagataagaggaaaattacgggtcagttaatcgtagcattttttccatgcaaatggctctggttaaaaaataatgagaaaaaaatagtagcatttggtagaatcaaactgaacacttgtacttagtgttggttagcgcatttatgttagagaaatctctgttctctagtgataagcccaagggctatgttttattgtaaaaagaaaaaacccaactcgggtaaacatgtaaaaaacccatttatcaacagtaacacaggaagagctaaataatattcaaagtgtctgtaacttgaattgactaaaacactggagcactctcacactaaaaaattgcttagatcttgaactagtttgaggaacaatgttagagatttatattagcaataattcacatgagaacaaactgggacttccagttggctgcaaaaaaatagaatcttagccctcaagatgtccatttataaatatttattaagagcctgctatgttctaggcatctttctaggagctccataagggtagtagaaccttggtaatagattacaaatacagcagttctatgttctgcctaagtgtaaccacttagtagtgtgttgttctaaatgtaatttttaaagagggccattgacaaaccagtgtgttgctagaaaaaaaaggctggcaagagaaagcttcaaatagaagtcttcaaatatttgaagggctgcccagtggaggaagatcctgtttgctacacaggaagtaaaaagggatttctagaataatggctaactttttttttttttttttttttgagacggagtctagctgtgtggcccaggcttcagtgcagtggcacgatctctgctcactgcaaactctgcctccagggtttacgccattctgctgcctcagcctccagagtagctgggactataggtgcccagctaattttctttttgtatttttagtagagacggggtttcaccgtgttagccaggacggtctccatatcctgacctcgtgatccgcccacctcggcctcccaaagtgctgggattacaggcgttgagccaccgcacccagccggctagcatttgttgactgcttaatataagccaaggctctgtgctaggcactttacatgcaacatctcattgacacaatgggtaatattattgtacccattttacagaggagaaagcaggcttaaaaagtaacctgcccagggttctgcaagtaaggaatggggccaggaatctattcaggcagtctcactccagacgacaaaagaaagttctaatgatatagccatccaacaaagcgatcactacttggcagtaattttttttttttttttttgagacggagtatcactctgttgcccaggctggagtgtagtggcgtgatctcggcccactgcagcctccgcctctcgggttcaagtgattctcctgcctcagcctcccaagtagagtaactgggattacaggtacatgccaccatgctcggctaatttttgtatttttagtagagacggggtttcgccatgttggccaggctggtcttgaactcctgacctcaggtgatccaactgcctcggccttccaaagtgctgggattacaggcatgagccaccgcgactggcttggcagtaacttttgaggaataaagaatacagaaggagtttcctcaaatcttgttgcccttcccatctttgtgagctgagatcagagtaccgtatctcaccctctgcctcttggaggtgattatggtttacatataaatgcagattgcaagtccaggaagtttactctctctcctcctgtaggcctcatcctgtaagacacttcctctaacaaatgggcatcccttcctgttgtccacttactgcttatcaccaccaggtggcacctgggcagcagaattgtcagtgggcggggacccaccctgtttacttgtgttggtaactgcattgcagctgctgatcctgtggctcctgggccccagctgggacaagaacttcctgaggatgaagttttatcccctatataatttctgatgatctggatgaggtgaggaagggagaagtttggaaaagaacctccataggtcaccctctccattcccccattctcaggaacctccttgcctactccagtgcttggcaaatttcagtttatagagaggtttctctctaaggttcatccatgttccttctgtagttctgctttatcagttggtgagcaggtcactcataattcctccaatttccttgtttcccttttctacctgcttacctctgggaatatggaggatataggagacagaatattgtttcttaaatagttctgcaaactgaatgaagcagtcaagatactgctagccctagggaagtagagaaaaggaagtgaaaaaatttaagtgatagaggctgagcagggacaggttttaagcagctttggtaaacacaggctgatgaaatctatgccctgcagaaccagataaaatttatcagctgcaggcctcatcctgtaagacacttcctctaagaaatggctagtttcttcccagtgatcaaccccagttcttctgctgcatctgacagatttacataatatgccccatatatactgcattaaaaggtaatcatcttatgaccaacacttccctcatcaacttccaattagtctagttcctagatcctaggacaacactccacctctaacgccagttaactagtaacaatagtcatcggtgtaccctgcactttttccttcctaaacctacaccgtacactgtgggactgcactagttctgcacctgactgtatggcaaaccttccttctaactcaggcaaatgtgaaaaggaattgtctttcccttactcttgatccctcattttagtgtcctagaagttcttcagggtcagaaaattattggaaaatgtaataatttgcgctgcctccctcccttttggagccaactagtcttacatccatcctctaagatagagatgacttactaactcttggaaatttccaaaaagaaataaagcctcactttctattcactctgctttttttccccctttccctgaaggctggattatctcaactctgtaattctctgactctccagttttctccagggtcagtcgttacaccacacaaagaaggtaggggattagggacgggatagacggggttagttttcaaacactttcattccaaatacgatcgtatcctttccttttgtaagggcaggcaggaaaaagttgaaggataaggaatgtgcttagagtatgaaaactagagaaagtcggcaaaagaacatatatatatatcccagaccaaatcctgccaaaccgaatgagtagagggaaatcctgaagctccacaacccctcaacttcgcaacttgggctttctccaaaaccaagaaattggcggtgcagctctgcatgacgtcataccacaggcactccaatcccacgtgggggagctcttggtcccgcctctcctgaaatggtgcgccacgcctcctcctctttattaccaatcgaatgccgcccctgagcccctttcttccttttcccgccatctcagacctcccatcttggccttcgggcccaatcagggaggccctacctatccgaaacccggtccgttccccgcggaagaggggtggagtttcaaccttttaactccaccttggtctgtgcagcgcggaccaacccaaatcgccagaaaggaggggcgtggcttgaagtcccctcctccatcccggggatcacgttttgcctgggggagctgatcgcaagactaggcaacctccagccagtccctgggtcgggcggatcctcccagaggtggcacaatggagcgatctccaggagagggccccagccccagccccatggaccagccctctgctccctccgaccccactgaccagccccccgctgctcacgcaaagccagacccaggttctgggggccaacctgctggccctggcgcggcgggtgaggccctggcggtgctgacttcattcgggaggcggttgctggtgctgatacctgtgtatttggccggggcagtgggactcagcgtgggtttcgtgctcttcggcctcgccctctacctgggctggcgccgggtccgcgacgagaaagaacggagccttcgagcagcgaggcagctactggacgacgaggagcagctcactgcgaaaactctctatatgagtcatcgagagctacctgcctgggtgagcgaccaccctcggtcctctgtgcagcatagcccccttccaccccttccatctggggcttttcctccttatgcctagagtcagctccctgccttgggacagtgggccccagactttcccctctctccccgctagccgcctgcctgctggacgcgccactcttggaaccgactgctcactctccccacccaccctttcgcatgcccagactggatccttccacagaatcaggacttcttcctctacttgggcaacagcagtaataacatctggggaccccgtctcagccgaagctctccctcctagccaagccatcttgaacgtccctcttgcttttggtgccactcgcggctttgctgctcctggaaatcctggtcccgttacctctcaaaggtttccctagtctttcccatcctcctcgagactttttacctacttaaagccatacggttctctcttttctcgcttttatccccgggtacccgctaggacccagccccggcccctggacgaccctcgggcagccaccttcaagcctccagccgccagactgcagcgcggcagaggcggctgctggacggagggagggctacgggaggaggtggtgcggctgctgcagtgcccgcggcgcacactcccccgcactcctcggccggccacacccttttccggactgtgggctgcgcttgttccgttggggcagagacccttatttctgcggcggccgcgtctcctgtgctgaggcggatgccttctctctagtcttgcagaggcgaagccggttacccggcccctcccagcagaggtgccagtctagggggagaatggcagcagagaggaatcaaaattgacactagacagacacagccaagcttcccaggccctggactggaaaggggaggagaaagagggccaaatggctctaggggacctgtagcctaggcagcaagtgtttgtctcctcctcatcatcatggaaaccaatcttcctacccccaatacaaagcgcaggtgtcctttcccttaaaaggagtcacacagagaaagatagaggaaaacacacacacacaccccaaaaaacccacaaagccaggcctaattaggtcttctggcccctccctgactcaaggaaggacttgcttccctcttcaccttcctgctctagaagccccgtctgaggggagttgagaaggctggaaaaggggacttttttttttttcttttttgagacggagtctcgctctgttgccaagctggagtgcagtggcccgaacttggcacactgcaacctctgcctcttcaagcgattctcctgcctcagcctcctgggtagctgggattacagtcacgcgccaccacgcccggctaattttgtatttttagtagagacagggtttcaccatgctggtcaggctggtgtcgaactcctgacctcgtgatccgccggcctcggcctcccaaagtgctgggattacagatgcgagccaccgcggccagcctggaaccaggactttttaaatcccaggattccctcaaactccaatttgactggacctccccctccagaaagaatgcgcccttctcctcctcccgctcctctctctctcagcagctgtcatttcaccacgtccctgagctatccacagggcaacagcgtgacctctaccttgtcagctccccttattagagagacatcagcccccaaactctgtgaggaatgaacctttggggcatcctcgcccctcgcccaccctgagtgtgaggagtcacacacactccctctcctctgtggcacaccaccagcatcttagtaggaaaccagaggcgagggtgtgctgcacgtcactgtctctgccttccccacctccaggtcagcttcccagacgtggaaaaggctgaatggctcaataaggtgaggattgatttgatttttagtcttcatgaggggagaatgggaatttgtttcttcttgccagacccatcctcaaccctcagtgctctccgtggggaggattctgaaggaacttgccttgagagggaagactggactctcctctgaccatctctctttcctcccagattgtggcccaggtctggcccttcctgggccagtatatggagaagcttctggctgaaactgtggctccggctgttaggggatctaacccccatctgcaaacatttacatttacacgagtggaactgggtgaaaaggtatgtgtggaggagggaaagtgaggaggtaggctagggagggtgagtggcccggagtagactcaggtacttctccctatccctgccctctctcaggaatttctctctccctagccattgcgcatcattggagtcaaggttcacccaggtcagagaaaagagcagatcctgctggacttgaacatcaggtaataccactcaccactcttactgcttccccttcaatgtgtcctgttcagtccaggctacttcactccccctccccgcaacttcagccaaggactaactctcttggttctcttcttcaccaatccccagctatgtaggtgatgtgcagattgatgtggaagtgaagaaatatttttgcaaagcaggagtcaagggcatgcaggtaggccagatgtcaggggccacataatagggaatgtttgtcctgcgtttcatgggatatggggaagtgtgaggttggaaagaccaaggctgagaaagtctgggaggacagaagagggacttttctggggaaaggctttgattttctcttcttgcctcagctacatggcgttttgcgggtgatactggagccactcattggggaccttcccttcgtgggggctgtgtcaatgttcttcatccgacgcccggtaagggaaaacaatgaaggggtatggggaagcaggagaaacagaggactgggaggatgagggcagccagtgaaggggaatgagaagggaactgacaagaaggccgaggggttctggcaactgtttgatgggtatgaccacaccccataggatctgtcctgacccctgctctttccctccagaccctagacatcaactggacagggatgaccaacctgctggatatcccaggacttaggtatcaaggacttactgagcacctgctgagtgttccagcgctgggttgggggtttaagggacacagagcagtcaaagatgctgcttgtgtcctctaggagcctcaacttcatttggggagcaaagacaaatacccctgcaaagtttgatactgtgatttttctttgggttgggggagcaggaagggaatgcagagggctgaagactgcaaaaggcaatggggatggcagtgaagaagggagagagcagtaggtggggaattagggtagaagagtagcacaaaggattttcacaaaaggactttcttacagctttaggtctctcttgggtgtgggaaacatagttggggttaggagaaaattggaagttgaggccatacccactcctttctactcccccattcagctcactctctgacaccatgatcatggactccattgctgccttcctcgtgttgcccaaccgattactggtgccccttgtgcctgaccttcaagatgtggctcagttgcgttcccctctgcccagggtatggcctttcccccactagatagatccttctctcaggaaccccttgctgggtccttagtttctcaccatctgattccttcctccagggcattattcgaattcacctgctggctgctcgagggctgagttccaaggacaaatatgtgaagggcctgattgagggcaagtcagacccatatgcacttgtgcgtttgggtacccagacattctgcagtcgtgtcattgatgaagaactcaacccacagtggggagagacttatgaggtgggagagttgagcagctctgtgaaatggggaagccccaggaggttgtgagagaagatgctgattggatgatcctcacagctgcagccccatgagacactcagccttctgtgttccccaggtgatggtacacgaggtcccagggcaggagattgaagtggaggtgttcgacaaggatccagataaagatgactttctgggcaggtgagactctgcctgttaggattctaaagcccatgctggccaggcacggtggctcatgcctgtaatcccagcactttgggaggctgaggcgggcggatcacgaggtcaggagattgagaccatcctggctaacacggtgaaaccccatctctactaaaaatacaaaaattagccgggtgtggtggcgggcgcctgtactcccagctactcgggaggctgaggcaggagaatggtgggtgaacccgggaggaggagtttgcagtgagccgagatcgcgccactgcactccagcctgggcgacagagcgagactctgtctctaaagaaaaaaaataaaaataaaaaaaataaagcccatgctaccgaggttctggaggtaattatactcactttctgggcctgggaatcatgtatcattttccttcctaacctccccacccccagcccctaccatgcacatactcacgcatgcaggtgaatatcttctgagaggaataagggagtctgagatctgccagtcatttctgggtgggtgagtggagggccactgacatgctgctaattacaacactacccttttcttcctttcactaccctctcccccgccaaccctcagaatgaagctggatgtagggaaggtgttacaggctagcgttctggatgatgtaagttgggagaagaggaaggtgggggctgatctcaccctttgggtagatagtagttgctacattggtagggaagtagttgagcaggtatctgatctctactacatctcaatttcttctagtggttccctctacaaggtgggcaaggccaagttcacttgaggctagaatggctgtcacttttgtcagatgcagagaaactggagcaggtaagccacatgggaaataggaagctggcaggggagaaataggtagctggaagtgtaggggacttggaacggggaccaagatctgactactaccacccctccccaggttctacagtggaattggggagtctcctctcgaccagatcccccgtcagctgccatcttagttgtctacctggatcgggcccaggatcttcctgtgagtttggctgggtgaacaggagccctggatgtaacattccccaaccctgccttgctgaggatgcaaatgtccctgcctgctttgctccagaagtatcagcatgtaacataagggtcccagggaggggatcagatccatctcagggaaaggattctgatgcgatcccaccttccttcaccaaaaccaaaaccgaatcccccaagatggtgacctctgaattgtacccaccacagctgaagaaggggaacaaggaacccaaccctatggtacaactgtcaattcaggatgtgactcaggagagcaaggtgagggccaggacatcattgtgggtggccaggtaggacagggagaggcctattcttgggatggtttcccctttagaatgcctgttacatgcaggggttttctgcagaaacaggaatggtgctgtggtatacacccttaatccctcctctacatctccaggctgtctacagtaccaactgcccagtgtgggaggaagcgttccggttcttcctacaagaccctcaaagccaggagctcgatgtgcaagtgagataatcacctcttcatcccctcccgaataccctattctgacttcccagatctgtaccatttctcctctccttcttttcccttgattcctatttttaatccatctacctagactccccacctccctgaatatctctccattgttccccaactgtcgctccagaataatatttttttttttttttgagatggagtctcgctctgttgcccaggctggggtgcagtggtgcgatctcggcttaccgaaacctccaccacctgggttcaagcaattctcctgcctcagcctcccgagtagctgggattacaggcaggcaccaccatgcccggctaatttttgtatttttagtagagacagggtttcaccatgctggccaggctggtctcgaactcctgacctcagatgatccgcctgcctcagcctcccaaagtgctgggattataggcatgagccactgcacctggccttagttcataggtacttgttcttgaatgattttatatatgtgtgtcttgtctatgaaactggccagtaagcattgtgaaagcagatgctatgtttcgtgctttctccatgacctttaaaatgctgaatgttaacaattttattgaggcataatttacataccatagaatcactcattttaggtatacaaaaattattctgaggctgggcacggtacctaaaatgagtgattttatggtatgtaaattatgcctcaataaaattgctaacattcagcattttttttttttgagacagtttcgcttttgttgcccaggctggagtgcaatggcgtggtctcggctcaccgcaacctccacctcctgggttcaagtgattctcctgcctcagcctcctgagtagctgggattacagggatgtgccaccatgcctggctaattttttttgtatttttagtagagacggggtttctccatgttggtcaggctggtctcgaactcccaacctcaggtgatccgcccgtctcagcctcccaaagtgcttggattacaggcgtgagccaccgtgcccggcccaacattcagcattttaaaggtcatagaaaaagcacaaaacatagtatctgccttcacaatactcactggccagtttcagtttcatagacaagacatacacatataaaatcattcaagaacaagtacatatgaactaaggccaggcatggtggctcacacctgtaatcctagcactttgggaggccaaggcaggtggatcacctgaggtcaggagtttgagaatagcctggtcagcatggtgaaaccctatctctactaaaaatacaaaaattagccaggcatggtggtgcgtgcctgtaatcccagctacttgggaggctgaggtagaattgcttgagtccgggaggcggaggttgcagtgagccaagatagcgtcactgcactccagcctgggtgacagagtgagactccgtctcaaaaaaaaaaaaaaaatcaaaaatttgccaggtgtggtggcatgtgtcagtaatcccagctacttgggaggctgaggcagaagaatcatttgaacccgggaggtagaagttgtagtgagctgatttcaagcactgcactctagcctgggtgacagagcaagactctgtctccaaaaaaaaaaaaaaaaaaaaaaggaacagaagaatagcaacaattacatatgaatttgtgggagtaaaatatccatagtataggactaaggagggtcagagaaagggataggctggagtaactagggagattttgtgaagcaaaaaattggattttaattgagtcttgaaggatgagtaggatttaaataggccgagggaagagaatgaggactttccaaatagtgggagcagaatgaacaaaggtggaaggggccatggattgggcagaggactataaaagatggctctggccgaggtgggcggattgcctgagctcaggagtttgagaccagcctggggaacaccatgaaaccctgtctctactaaaaaatacaaaaatttagctgggcgtgacggcatgcgcctgtagtcccagctatttgggaggctgaggtaggagaatgggttgaacccaggaggtcgaagttgcagtgagccaagatggcgccattgcactccagcatgggcgacagagtgagactctgtctcaaaaaaaaaaaaaaaaaaaagatggccctgagtggagcaggaggtttgtgattggtacagagaggaatgaagttggagccatgttatcattttcacagtatgcctccctttcccctaatcccttcactacagtccttcctcctgtgcctgtaggtgaaggatgattccagggccctgactttaggagcactgacgctgcctctggcccgcctgctgactgccccagaactcatcctggaccagtggttccagctcagcagctctggtccaaactccagactctatatgaaactagtcatgagggtatggaaatagaggaggtactgaggtgtgggggaaaggcctgttgattctttggtattaagagtaaggaaagggacccccctaagattaaaagagctaatacatgtagaagtgccaagcaggcacaaaaacatatattgatctgactggtggaaggaatggcttatgagttgagggggtgtggagggaaccctgtagagatgagcccagccagggcagcacctagttcccctgtcacagcccctcctctaccccaccccacatgctttgcctgctggtgacgagctgcacttctttgattcagcatcatactacccttcctagatcctgtacttggattcatcagaaatatgcttccccacggtgcctggttgtcctggtgcttgggacgtggacagtgagaatccccagagaggcagcagtgtggatgccccacctcgaccctgtcacacgactcctgatagccagtttgggactgaggtgagtctatatctggaaaggactagggtctgtttgccccgctaagtatgcaaagcctgtttcagggcagattctgacaggtctctctccctttgccatctggcacccccccgtcccttttgcagcatgtgcttcggatccatgtattagaggcccaggacctgattgccaaagaccgtttcttggggggactggtgaagggcaagtcagacccctatgtcaaactaaagttggcaggacgaagcttccggagccatgttgttcgggaagatctcaatccccgctggaatgaggtttttgaggtcagaattgagtggctgtgactcctggttctgccccatttttcccccaatcccaaaagtggtccagaaacctctgaggttcagttgactggggggtccagtcatttgcagaggaaaaggagagaatctttcatctgcactattttctcccactaggtgatcgtcacatcagttccaggccaagagctagaggttgaagtctttgacaaggacttggacaaggatgattttctgggcaggtgagagcataggagtctacgtgaaaaacaggctggggctctttaggccatggagtctggcctccttggttctcaccatctagcttttgtcttaatctttctcttcaacaggtgtaaagtgcgtctcaccacagtcttaaacagtggcttccttgatgaggtgagcattgaattagagtcaacaacccctcctgatcctgcccaagcttcattctcaaagttctcctgtctgcatatccccaagtcttcaccctgcctacttccacagtggctgaccctggaggatgtcccatctggccgcctgcacttgcgcctggagcgtctcaccccccgtcccactgctgctgagttagaggaggtagggcaggagacttgaggaaggaagggacccaaggtggggcaggatgagctcttctcttagcgttcaaggcacatgccagaacccaaggtgtcagttaccactccccagccccgtgtgcccctccacaggtgctgcaggtgaatagtttgatccagactcagaagagtgcggagctggctgcggccctgctatccatctatatggagcgggcagaggacctcccggtgagatcccgctccccatgccccataacttcctggcccttcttccaccttcctccggtttggatggtcctggagtatttagaataagaaaaatggcccctctctttctgagggtagtgcaggggtgggaaaagttgtctgttcaaggccacgggtagtggctgccaagtaataatggagacatggctgctggctgtggatataatttgtgagggggatctgcctaactaggtccaaatttaagactaacacagtattgtctttctagctgcgaaaaggcaccaagcacctcagcccttatgctactctcactgtgggagatagttctcataaaaccaaggtatgaagaaatgctgcagggtaaaaatgggagggataagagaaataagagtatcagctactgatcataagccctcatctccaccagactatttcgcaaacttcagcccctgtctgggatgagagtgcctcctttctcatcaggaaaccacacactgagagcctagagttgcaggtactgtaaattcattcttcaaatatttagcagatttctgccatggccaggcaggaaaccaggcacagagcattcagagatgagataaaaggttgacttttttttttttttttgagacagagtcttgctctgtcgcccaggctggagtgcagtggtgctatcttggctcactgcaagctccgcctcctgggttcacaccattctcctgcctcagcctcccaagtagctgggactacaggtgcccgccaccacacctggctaatttttgcattttttttagtagagatggagtttcaccatgttagccaggctggtctcgaactcctgacctcaggtgatccgcccacctcggcctcccaaagtgctggaaatacaggtgtgagccaccgcacccggccaaaagattgacttcttatctttatggagctcacactctgttttgggagaaaaataaccagatgaaactttcagaatgataactgaggtaaaaggcactgtggggaagaaaggaagggttcaggctggggaaaggctggagatagaaaggcatccttagatgacccctgagcttgagggtagattttttttttttttttttgagactagagtctcactcttattgcccaggctagagtgcagtggcgcaatctcagctcactgcaacctcagccttccaggttcaagcgattctcctgcctcagcctcccgcgtacctgggattacatgcgcgtgccaccataccccaccaatttttagtagagacggggttttgccatgttggccaggctggtcttgaactcctgacctcaggttatccatccacctcagcctcccaaagtgctgggattataggtgtgagccactgcacccggcctttttttttttagacagggtcttactctgtcgcccaggctggagtgccgtggtgcaatcagggctcactacagcctcaactcttgggctctagcaatcctcctacctcagctgggataacaggtgcacactaccacacctagctaatttttgtatttttttgtggagatgaggttttaccatgtcatccaggctggtctcgaactcctggactcaagcattctgcccgcctcggcatcccaaagtgctgggattacaagcgtgagaaccgcgccccagcctaagggtagatttactggttctttcggaccacgaaaagaagagcaggaaaactctttaggctgagaaaaaaaatggaggagagagaaggcatatttattatagatcagagaggcaggcagagcaagatcataggagctgttgaatagtatgctagaaatatggattttatcctaaggcttagggaagcctttgtttattttatttattatttttttgaaacagagtcttgctctgttgcccaggctggagtacagtgatacgatctcagctcactgcaacctccctcctgggttcaatcgattctcctgcctcagcctcccgagtagatgggattataggtgcccgccaccacgcccagctaatttttgtatttttaagagagacggggtttcaccatgttggtcaggctggtctctaagtcctgacctcaagtgatccactgcctcggcctcccaaagtgctggaattacaggcgtcagccaccacacccagtcagggaagcctttaatgagaggtcacatatccagatttgcattttgggaagatcatagggataagagggtaaagaatggactggagagggacaacactgggggcagggagatcagtgaggagactgttagagcagtcaaagcaggaaacgactaaagcctgatgggatttgaagattgctgtgatatggagcaggtggaggagcaaggaacagcctagacactaactctggggtttttggcacagggtggctagatggataagggtgccgttgctgacttagggagtgcacagagagggaattttggaatttgagatctctgcaggacatccaagagaagacatgcagaaaacaaatctattgtccatgaggtgttcctcccttgccctcttattggaacatcatgagcaagcaaccactcataagtgtagtcatgggtgagatctcttaggcagcgtggagagtgaggagacaaaagatggccatgagccatcttacaggtgtgaaccactgtgcccggctgaaattaatagaatttaaaataatgtaacttaatgctagcagagtagaaaggaggtacaaatgagctcagttcttcatcttttatagcagggaatcaatagatacaagcatattagaattccgtgagaacaaagaaaacaggagggttttaaaggttgttacatttggaatatggcaataggagtaggatgggcaagaaacatttacttttagttctgtttttactgttgttttctgtatgctgtaggtattactggtataatttctgaaagctaggttgggcgcggtggctcacgcctgtaatcccagcactttgggaggccaaggcgggcagatcacaaggtcaggagatcgagaccatcctggctaacacggtgaaaccctgtctctattaaaaatacaaaaaattagccgggtgtggtggcggacacctgtagtcccagctacttgggaggctgaggcaggagaatggcgtgaacccaggaggcggagcttgcagtgagctgagattgcgccactgcactccagcctgggcaacagagcgagactccgtctcaaaaataataataataatttctgaaagtttatgaggtaaagatggtccactctactctggttaagaaaggaaggacaggccagacacagtggctcacacctgtaatcctagcaatttgggaggctgaggtgggtggatcacctgaggttgggagtttgagaccagcctgaccaacatggagaaaccccagctctactaaaaatacaaaattggctgggcgtggtggcaggtgcctgtaatcccagctactcaggaggttgaggcaggagaatcgcttgaacctgggaggcggaggttgcggtgagaccagatcacgccatgcactccagcctgggcaacaagagcgaaactctgtctcaaaaaaaaaaaaaaggaaggaaggacagagggagggactagcaactgttaccatggcttccctgcctttctcaaagggaaatctcaccaaaccacctatgagtccaagcgtttggacctttaaaacaccaggattaactcatttgttgatgcattcgcctcttgatcatggtcctgttgccccacaggttcggggtgagggcactggcgtgctgggctcattatccctgcccctctcagagctcctcgtggctgaccagctctgcttggaccgctggtttacactcagcagtggtcaggggcaggtgctactgagagcacagctaggggtgagtgacaggagatggtgggcaggatgagagggaggaggggagggccttcacaggtgagggacacccaggagggtgggaacagagggccgtgtccttagagtgagggaactgagagaactctgcccagctcacagctttcttgcccctagatcctggtgtcccagcactcgggagtggaagctcatagccacagctacagccacagctcctcatcgctgagtgaagaaccagagctctcggggggaccccctcacatcacctcctcagccccagagctccggcagcgcctaacacatgttgacaggtaaagggctgggacaggaaggtgggacgcagtcagaaataaaaagtattacaggttcactaggctctagctttccccagacctactgatatttctccacagtccccttgaggctccagccgggcctctgggccaggtgaaactgactctgtggtactacagtgaagaacgaaagctggtcagcattgttcatggttgccggtgagaccccatccctcctgtcctccagatcgcctccatcccttccctcaggttaccatatcacctacatcctcctgttgtaggtcccttcgacagaatggacgtgatcctcctgatccctatgtgtcactgttgctactgccagacaagaaccgaggcaccaagaggaggacctcacagaagaagaggaccctgagtcctgaatttaatgaacggtcagtcagtgggcattcaggtggagagatggcaggcttggaaaggactcctggcccctaacatccagtcctaccccaggtttgagtgggaactccccctggatgaggcccagagacgaaagctggatgtctctgtcaagtctaattcctccttcatgtcaagagagcgtgagctgctggggaaggtaagagggcaggatggcagggcagaggtgagggctggaagctgctggcaccaaggttatagtccctgtgaggaaggaagtaccccacgtgatcctttagaggtgactcacctctgcaatggtttgggacgagtatgtgatgaaggaacatggtctttggagatttcaaaacagcatcatcagaatgagatcctgtctcaaaaaataaaagaaataacatctttcccctatcatcttccaacacaggtgcagctggacctagctgagacagacctttcccagggtgtagcccggtggtgagtgtctgcgtgggtgggggatggtctggatatttcagtgggagaaattccaatcacaggaaaggaaaaaaagatacaatctgagcagagaaccattgattctatcaagtagagaagcccttggatcgtgtctcatttataaatatgatgacacaagagtcatctttctacatgagccctcttttcacaggtatgacctgatggacaacaaggacaagggcagctcctaggagctggcgagtcccagcctgactgctctgtcttcctgccttcgtctcgctccatcaccgcctcaatgtgatgagcctaaagctagggtccaagggcagagcctgtgcccttcagccctttcacctaacaggcccatattcgggcctttgcctgaccaaagagaagaaccgtatgttccctttactgcacggcctttatccttctgggcccctggggcggggacctgagctggctgtttcctgctttgcctgcacattgttctcccttcctcccaactcctcagggccttctgtatctgtgcctggccagtggcagcactagcagtggtattagcttatgccaaatacagctttggaaggatctttttttctttaactagatggtcaccttcttccctaccacacatgggtgggaaggtggacaggctaacctctccagctgtgagcctcttagactactgcatgtagcaaatgttcagcagctcaggcccccatgtccagttctgtccccactgtcctcaaccctgtcctgaaaattctactgctttgatggctggggccagtctcttgtcactttggaaactgaggacgcgtggattctactcaagcctccaagtagtggcatatcagtcttggagctcctagctggtgatacggagagggctttggaggacttgggacagcagggccaatttttttgcccaagtgcctaggctgctaactcactgactagaacttaatctggtactttacagttttgcaccaactctgccaagccactggatcttacattaaacatcatactcaaaccagctgtggttcttttccttaaggatagggaatcaatctacccatctgatgtttattcctactgtcaaaagcctttatccaattcgtgaatcatgtcagtttaattaatggtcaaagcctactaaggttgcagccaccaagaatgttgaggatggtcaagagacctgtgtaaagtagctgctgttgcatttcaggtgagactcatttccagtcacagtgatgaactctgttacccatccaacttgtctgctgaccactataggctttccagggaagggattcctaaacctggtaaacctgggagctctgtgccactgcacaggctcctggtgtctctgtgccactgcacaggctcctggtgtctctgtgctgtcagggcatgctcagctacattcaaaagggcttcaggcccatctagcaggagctgagaaatacacccatttcgatcatctgtacaccttgaactctgctccttgcaagaactttcctggaatgcaagctagagaagctgtgctccatctgttctgccaattgaaaggagagagatggacagagtgaactactgaaaacagggtcactggcataggaacttggggatttcataactgactcagagagactttactatcgtctcttgaaaaatataaaccttccttaggatgctgcccactgggagaagagggaagactcaggggaaaggattcctgctcagttccacaagttgtcgaaatttgcttaattagcaaaaactgaatttaaactccacactgtccacaaactcagcctctatgttctcagtgacccttttgtattcactgctggttcctctaccatctccacttccttcccatcaaagtaagaggaccccaagccttggctttgagcaaggaggtcttatttatttgctccattccccaactccggctctaaaatcacagggggaaaaactccaaaaacagagcaaagaaaatttttaaggtctcttgtcaaatttctagatactggccacgcgcagtggctcacacctgtaatcccagcactttggaaggccaaggcgggcggatcacgaggtcaggaggtcgagaccatcctggctaacacggtgaaacctcatctctactaaaaatacaaaaaaattagctgggcgtggtggtggacgcctgtagtcccagctactcgggaggctgaaacaggagagtcgcttgaaccagggaggcggaggttgcagtgagccaagatggcgccactgcactctagcctgggcgacacagcgaaactccatctcaaaaaaaaaaaattctatggcgtgaacccgggaggcggagcttgcagtgagccgagatcccgccactgcactccagcctgggcgacagagcgagactccgtctcaaaaaaaaaaaaaaaaaaaaaaaaaaaaaaaaaaattctagatactagctgggcatgcagcccaaggcctgctgttctagctggcttcagataatacaacctaggattttgtaatgtgtgattttaagaaaacattcttgagctagtttatcacttcaagtaattacatttccagaaaactagaggacatggcacaaattcttccatcccagaagggtccctactctttcctaacctttttgagttcaatatatataagggaagaggtactactatacatattaaatacaagatgatggctaagtgtgatggctcatgcctgtaatggcaacacttggggaggccggccgaggcagaggatccagagaaaactaccacccttaaaaaaaattagccaggcttggtggtatgcacctgtagtcccagctactcaggagtctgaggcaggaggatcgcttgagcccaggagttcaatgtaatagtgagctaggctcgtgccaccactctactccgccctgggtgacagagtgagaccttgtctccaaaaaaaagaaaaaaaaaaaaaaagataacaaccagaaaaaagaaaacaactaaatacatacaagatgagacacaaaacacaattgcacatttatatatgaagatggaacacattttaagggtcattagtcacatgaattaaatatacttctgtcatttctcaaacaactgacttttaacacacatacacgatgcacaccttttctggagaaagatatgactgcatatggttacgctatcactgattgcaaatactatcctcttggaatgtgtttttattggaccaaacaacgtgctgtagttaactaggtgtggcaacacagttgtctacccaacagccatttcccctcttccctacatacagaatcccagaatgtccctggtggcagtatgccagccccaggaaattaatcaagatcccctttgctgaataatcactttcccttgcaagttgaaatgaccctgacccagttttggtcaacaagatgttagaggaagtcagggactgtagcatctaaagaagaaagccctcattgccccttcctttctgcgtaggttattggtatgaggatattatgtctggaactgcagcagccttttttttttttttctttttttttctttttgagacagagttttgctcttctcacgcaggctggaatgcaatggcgtggtctcggcttgcagcaacctctgccttcggggttcaaacaattttcctgcctcagcctcctgagtacctgggattacaggcacctgccaccatacccagctaattttgtattttgagacagggttttcatcacgttggccaggctggtctcaaactcctgacctcaaataagctgcccgcctcggcctcccaaagtgctgggattacaggcatgagccaccgtgtcaggccagcagcagctttttttttttttttttttttgagacagagtctcattctgttgcccaggctggagtgcaatggtgtgatctcggctcactgcaacctccaccttgcggatgcaagtgattctcctgcctcagcctcctgagtagctgggactacaaatgcccgccaccacgctgggctaatttttgtattttcagtagagacggcgtttcaccatgttgtccaggctggtctcgaactgacctcaggtgatccgtctgcctcggcgtcccaaagtgctgggattacagacatgagccattgcacctggccatgaagatatttatatacatctcacattatttccttaagtggggccaggcgccgtggtttacacctgtaattccaacactataatcccagcactttgggaggcagaggccagcggatcacgaggtcaggagttcaagaccagcctggccaacataatgaaaccccatctgtactaaaaagacaaaaattgctgggcgcggtggctcacacctgtaatcccagcactttgggaggccgaggcgggcagatcacgaggtcaggagattgagaccatcctggctaacacagtgaaaccctgtctctactaaaaaatacaaaaaattagctgggtgtgggacgcctgtagtcccagcttcttgggaggctgaggcaggagaatggcatgaacccgggaggcggagcttgcagtgagccaagattgcaccactgcactccagcctgggtgacaagagtgagactccatctcaaaaaacaaacaaacaaacaaaaactataacaactaaatataagaaatagccaggtacggtggcgcacgaatttgaggttgcagtgagctatgattgtgccactgcatccagagcctgggcaacagagcaagcccctgtttctcgggggagaggaaaggaaatgtatacagaggccgggcgcaatggctcatgcctataattccagcactttgggaggccaaggcggtggctcacctgtcaggagttcgagaccaccctggccaacatggcaaaaccttatccctactaacaatacaaaaaaaaaattagccaggtatggtggcacacacctgtaatcccagctacttgggaggctgaggcatgagaatcacttgaaaccaggaggtggaggttgcagtgagctaagatgcaccactgcactccagcctgggccacagagcaagactcctgtctcccaaacaaaacacaaaaaggaacgtatactgaataaacatgcttgaagagagcagctaaagggccctaatacaatctccttctgcttctcttcctctcaaccttttccactgtgctctctgggagcctatttccacataacacttcccacccattccacctttctttttttttttttttttttttttaggggggtacagaatttcactcttgttgcccaggctggagtgtaatggcatgatctcggctcaccacaacctccacctcccgggttcaagcgaatctcctgcttcagccttcctgagtagctgggattacaggcatacaccaccacgtctggctaattttgtatttttagtagagacagggtttctccatgttggtcaggcttgtctcgaactcccgacctcagatgatccgcccacctcggcctcccaaagtgctgggattacaggcatgagccacggcgctcagcctttctctttttttttttagatggagtcaccctctgttgcccatgctggagtgcagtggcacaatctcagctcactgcaacctccgcctcctgggattctcatgcctcaggctcccaagtagctgagattgcaggcgcctgccaccacgcctggctaatttttgtatttttagtagagacagggtttcaccatgttggccacgctggtctcaaactcctgacctcaggtgatccaccttccttggcctcccaaagtgttgggattacaggaatgagccactacgcccggcctgctttttttaaaaaattttttaaggacagggtctcactctgttgcccaggctggagggcagtggcacaaacatggctcactgcagccttgacctactgggcccaagtgatcctcccacctcaggctcctgaatagctgggatcagaggcacacgtgccaccatgcctggctaatttttgaattttttttgtagagttggggtctcttgctatgttgccatggctggtcttgaacttctgggctcaagtgatcttcccactttggactcccaaagtgctgggaatgttcatgtctgattaaccccagttttgggaatgcctctaagatttctattttatctactgttctttgtgtaagagcatgtacttaccataatttctccttagatcaaaacaatcttgatcataaagcctggcttactgagtattcttgcctttccctgcagggtagacttcaattgtcctagaggttccttccctgtggtaagtcctggggtcaggacttactccaggggatgatgtcctggggatccaccatcgtgtctcaccactacccaagacacagacatggcttctgttcataaattcctattaaatatttctaagaaactggatttgtcagcctccttcctcaacctcttagcttccttggactttgggggtaagtgtgcatagacctgtgcactgcggaacagctccccaatggctttccatattctttcaatctaatgggccactctggacagctgaacatgtggaggttcctggaggacggcatgcctagggaaggcaagcaagcttcggactcacctccctccctgcccacaaaatgcaatctctaagaatatacaggccagtcaaggtaggtcatacctataatcccagcactttgggaggcacctgagatgggaagatcacttgagctcagtttgagactgggtaacacagtgagacctcatttctagaaaaaaacaaaaccaaagaaaaataagaatatacaaatcacatgctaagcagggagaggagagaggagagacaggcatttctcacagataattcacatatataatcaccctatgcccagttaagaccatgtttcgtccagttcctgttatttatgatcaagacagggatggcacagaaaatgaaggatagccttcccatctctgcaagggtcttaacgttttttccctgtactacttctctatagaaaatgctagaaagtcagatgatgccataaccactcatacttggcaaaatgccaaaaatgggaaaaggaaagaaaaaaaattacaagagccatattttgaaatcaatgtctgcaaaagtaatgaaagccacacaaaggcatctataatgtggccctttcccagtcttataaccacttaaaaatgtattccttcttcctctccgtctcttcacaacacctattgatccttacttcattgatgtaaaatggggaaaatatcagcgacctcataccttgggaagattaaaggaaagttatttaacaaaaacttatacagcacttatgctgtgccaggcctattctattttacacttttttttttttttgagttggagtctcactctgtcacccaggctggagtgcagtggtgcgatctcggctcactgcaacctgccgggttcaagtgattctccgacctcagcctcccaagtaactgagattacaggcgcccgccaccaggcccagctatttttttttttttttttttttttttttttttttgtatttttagtagtgacagggtttcaccatgttggccaggctggtctcgaactcctgacctcaggtgacccacctgcctcgcctcccaaagtgctgggaggtgtgagccaccaagcccggccctattttaccaataataacacttcgaatcctccgaagagccctatgaggtaggtaccattatcattattttacagatgaggaactgaggcccaggagagataactaaacctgctgagggtcactaactaggacctggtagaaccaggatttaaatctgagtaggctgtctgaaccccatccacttgagcaccctctgagataatttagccccttcaccggtacgagatctatggcggcctccagaaatggttgctaacttactattatcgttatttctgtcgtacaattcatttctacctttccaataaactttccccaaccagtgaacctcacttactgcccataaagttcacctgtgcctcaccaccctgccatcgcccgagttttctgctctgatctaatcctcacacgcctgtgcagcaccagcttccaacaccaggtgcaccgccagggtatttactgatccagtgagtgaaggtgggcccggccgggctggttcccatcctctgatcaacgcctaggggaaccagtgaactccaatgctgaccataagagtttcagaaagtagggctggaaagcccagccctccgctcagagacctgtgaagatcgaggaggatggcgcatatgctgccgcaggatggaaacctcgatcagagaaggctggggcaggtgactgggcttaattgcaaattttaacatttacttcagcaaccagctcattaaaaacaaactactctgaggcctcttttttttctaccaaaccgcgagaggaagcaaaagagagtgcagcggttctccccggggccgttaagtgcttccagctatctgacctccacgctgcctgctgcagcctcaatctttccccaggttctgagttctttcagcagtaggtccaggaaaacagccgccccgccccctccacctcccgagactaggagcccgccagggttaagtaggagggataccctaggggccccgcagggtttttagggttggggtggattggaaattgttcattgcctttcagttccgggacataaagcgcgctggaaggacactgagtcaccaaccaccgccatgggccggaagccaccgccctcgcgtcaactgcaatctagagcgcggcgcatcccgtgagcccgcggggaactacgactcccggcatgctccgcggccaccggaattaacccttcagggctgggggccgcgctatgccccgccccctccccagccccagacacggaccccgcagggtgagtttttgggggctgaggagggccattttctttaagatttagtgggggtgcgtgagtgtgtgtgtgtgtgtgtgtgtcgtgtgtgtgtgatgtattttgtaaaaatgggacaatttgcagtcatgagattcagacgctgttttgcgaatgggagacccagcatcaaccccggggcctaagtggaatcactgctatcttcctcagaatgctacctaaatcctttcctaatttaccccagaacaaaagtagcctgcaatccctccccactcccaaacgccccccaacttggactctctcccagcgcccctggcaaggtttgtgacctggcccctgagtcaggatttttattatacccctggttgtggggtgaatactcatggagccataggagcgcccacatcctcttggattagggaatttaagccgtctcccagagcctgcccttctcctcaggtgccaccaaagggtccccacaggttcagcaagcaccctaccttttgtttgtcttgaatgaccgtgggcttgtggaaggtttcttccatggaagaatgggtagcagatgttaaacctgatctttgcccccactcctgcccctaaaacaacactgggcacaggagacaatgagggatgtcatactcctgtttttatgactattcttcctttatactgtgaatagttccagttcttggctgggtgggggctcaggaactacaagtattagggatcattagactctaaggttaactacccctgctctttacaaagccatggtcagaagggagtggaggggctgggcagatgggcttcttgtttttgtcattgctcccagaccacactttaacttgttccagttcacacaagcctccctggctgctacccctcaccccacccttcaagaagactaaagctgctggatcacctgctttgcctcaccacccccatctcagtgccactggcaagcatcctatcctcaccctggaggttaactacctcattctgggcagtctctggcttcctcccctacccctaaaggaaacattgttcttttctggtcagcctttggggataaggggacagagggaagaagaccttggggcaggagtcctgaaccataggaggccaggggagtgagggcaggcggttatatctctcctctacctcatctttgccacagccaactggctccctgcccctgcccccgccccttgacatcccagactccctggctatttaaacagagatgggtgcccccatccgcacactgtcctttggccaccggacatcatgcctcccaagaaggatgttcccgtgaagaaaccagcagggccctccatctccaaacctgctgctaagccagcagcagcaggggctcctccagccaagaccaaagctgagccagctgtcccccaggcccctcagaaaacccaggagcctccagtcgatctctccaaagtggtggtgagtctctggaaagtgaagatagaattggagggggtggtttgagggtgggatacagcctaggggattagggggtatctagaaggtagggaatcagtgagccctggaatgagattggggctttcccttagtcccccatttggaagcatccagtcttatgactctgctgttgtctttgctgttctctccctctaacctataatcatgtgtgtacagcacatacacactcacttaccccctgctggaggcagggactcttagatggggaacatctgggttctgagaacagtttcaaggtgaagggaagagagctgttgcctgcccctggctggtggttcaattcaaaaggcctgcagctctgaactccaggaggggaggctgaagaggacagacttgttagacaatcacagctgggggccaggggtaaatttagcctttgttcagcccccagttatgtgtgggatgcagggctcagggcaatggagggagggaaacaggtggcatgggattaaccctgttcccaggaaaccctccccactgtaattcctcttcttgggattctcccaaggcccagagctgggaatgggactgaggtggctgggcttccagcctggtccctttgggcccctcctcagaagtggctgccagttggttgggaggagtgcgggagagggattgaataaactctcatctctccccacctgcttttttcttccacagatcgagtttaacaaggaccagctggagggtgaggagaagctcatctaaggccactgtcccatccccaatcccctggtcagattctctttctattcccctaaccccagtcctgaccttgaaacctcccatactagtcctcttttcctcccttgttctgttcacatagtttctgaaattcccttctgtctgggggtgatgggaaccctagtcagtgtctacactgacccttccttatactttagagttcaaggaggccttcgagctgtttgaccgagtgggggatggcaagatcctgtacagccagtgtggggacgtgatgagggccctgggccagaaccccaccaacgccgaggtgctcaaggtcctggggaaccccaagagtgatggtgaggggacccttgggaacaatttgggtttttagttttcaaaagttggatgttggtaacaaaaagaatgaggtggatctcaggacttcaaaaactgtcaaacacagaagcaggaaaatatcctaaatgctgaataggatgaaagcattgtggtagggttgggagctgggtcctatgtaatactacaatgacctctcctttacctctctccaacctccagagctgaagtcgcggcgtgtggactttgagactttcctgcccatgctccaggcagtggccaagaaccgaggccaaggcacatatgaggactacttggaggggtttcgtgtgtttgacaaggaggggaacggcaaagtcatgggagcagagctcagacatgttctcaccacccttggtgaggcaggcaagggggaccagaactcctttagagtggagagggggatggggtgggccagaaagactggacagataagcagagctagcaggaggcttactgtcctgcaggttgtcggcaggagactgagaaggtcagagctatgggggtagaatctgaaggactcgctcttccagaggctaaagtgccatccggagggcagaggaaaagggatgaggcgggaaacctgaattttcattttggaagagacgtgtgggttgtgtgttctggtacaagtctcgtaacctcctgggattgtttccttgtgggtcaatactttcagcagtactagggtgaaatggaaagcaagaggcatccatgaccaggggaggattcccttgaggactgaggctatgggagaagaagaggtaccactctaaagagcgtggcctggccaggtatggtggctcacgcctgtaatcccagcattttgggagaccaaggcgggcggatcaccttagctcgggagttcgagaccggcctggccaacatggtaaaaccccatctctattagtaatataaaaactaggcgggcatggtggcacgcacctataatcccagctacccaggaggctgaggcaggagaatcgctggaacccgggagtctgaggttgcagtgagccgagagatcatgccactgtactccagcctgggggacagagcaaggttctgtctcaaaaaaaaaaaaaaaggccagacacggtggctcaagcctgtaatcccagcactttgggaagccgaggcaggcggatcacttgagatcaggagttcaagaccagcctggccaacatggtgaaacctcgtctctactaaaaacacaaaaattagccaggcatgatggcgggtgcctgtaatcccagctacttggtaggctaaggcaggagaatcgctttaacccgggaggtggaggttgcggtgagccgagaccgtgccactgtactccagcctgggtgatagagcaagactcagtttaaaaaaaagcaaaacagcatgggctggccgggagcagtggctcactcctgtaatcctagcactttgggaggccaaggcaggaggatcgcttgagcccaggagttcgagaccagcctgggcaacgtagtgagattctatctctatttaaaaaaaaaaaaagtacaaggctgggcgtggtggctcacacctgtaatctcagcattttgggaggccgagatgggcagatcatttgagctcaggagttcgagaccagcctgagcaacatggcaaaaccatgtctctacaaaaaaatttaaaaattagccaggcgtggtggtgcacgcttgtagtcccagctacttcgaaggccgatgtgaatcactggagcccaggaggtggaagttgcagtgagccatgatgatgtcactgcactccagcctgggtgacagagggagaccctatctcaaaaaaaaaaaaaaaaaattacaattgttatgtttatattgttgtttacaaaaatatatggaaaaagccaggcgcggtggctcacgcctgtaatcctagcactttgggaggccgaggcaggtgtatgacctgaggtcaagagtttgagagcagcctgcccaacatggcgaaacctcgtctctaccaaaaatacaaaaaattagccgggcgcctgtaatcccagctactcgggagggtgaggcaggagaatcgcgtgaacacgggaggcggaggttgcagtgagccgagatcgctccgctccactgcactccagcctgagcgacaggagcgaaactccgtctcaaaaaaaaaaaggaaaagcgtggcctgggtgagtgaaggagggaaaggagggcctcagacgttgtgtctgggattcaggagagaagatgactgaggaggaggtggagaccgttctggcaggacacgaggacagcaacggctgcatcaactacgagggtgaggggacaaaaaagcgggagcggggccgagggaggagggcagcctggcgtcttgccgcgtgtgggcgggggcacccctggattacctagagtcagatgtattatccaaaggcctgcttctgaagcccctcttgcctcctctctctgcagccttcttgaaacacatcctaagcgtctgagtgctgcaggtagggccctcccaccccttcgccgcgccttacgaggcaagtctcccgcccttctctcagccaacatagaaaagcagcggagttcattctgctgtccggttgctgcacgggctccagcgcttcgcaactttggtttttttccacagatccagtggggtccggacactgggccccgcaggcgaaagcacgttccagccaccaggaggccacctattgtttcaaaataaagactgggttcctctcttggtttcagactgctatttttttcatggttgggggagcagcgggagacggggagggtgctaggaggagagggcgggaaaagagggctctctcctcttccaatcctctgatcttcctgctgttgggaggtgcagattcattgtgccccagcccacgtccccccacgacccccgcccccccacctccccccacgaccccccccacctccgagcgggttctgtgcccaggtggcgctggagaaaggaacagcggaccccgcccaagtcattactaatgtagcaatcgtctgcataaacccaggccacggttcctattggctgagtcctctgagggtgacgtcatcgggacgtactaagactagggttgggccgagagtcggagccattactgcaggaaaaggtcccggagagctgagcagtcaagatggtggggcccaggtcttgggagacgggcaggattggggacgagaggcaggaagagacgggtggggggcgaggagaaggcaggggtaggaggcaaagggaatctgaggacccgaaaggttggaggtggggttggaaagactggggccctgcggggaagcgagtctgcagcctgaaacaggagtttgtgggtcagagtttgtgggtcagagtttgtggggctgggatagaaactcgggggattggcgttcagatgctgaccacttccctcttctctgagcagtgtgacttcaccgaagaccagaccgcaggtaggttatctctgatccctaccgaggtcacccttagggagagggacaccctccccccagcacctatcctctaatcttaatctgtcatctctttagcacccccatgagattaccccctggattattttctcttcttctggatcctccattttcttttctcactttcttcctccctccccttccactctagatctgatcccaagcactgggtgagttttaggtggtgtgggtatgtgaaaaaacttggtcacttaatgcctgctgtgtgtggggtctcgggagggtgtataaagctgcctgctttcctttgtcctttaatcagctacttctgcctcttttctcctcttgtgataactgtccccgccctcccagcttgcagttgtgaagattgtagagcagtgacctgatattctgtgcagatggggacaagacaggggagtttgctaaggatatgactgtagctataccctctggaagttctctttatactggaggggtgcgaagtggcaggttgggatgaccctagtcccaggctgctgctcccacttccttataaggacaggactgagactgggcggtggcgaattcctgccctgagaagtgtagtagcagcagtggagattggcaggcctgccgcaggcagaggggttgtgtaaatggatgttaccaggctgccagaaggggaggaagcctctatatagaacacttgagttgggaggaagagaaatagagccctcttaagtagactttggtgtacagtttggtgcagatatctcgtttcctcagcatgatcaaagttgaatgggcagcagagctctgaggtagggtttggattaaccctcaaatcctgtgttgacattcatctgaatcctcagagttcaaggaggccttccagctgtttgaccgaacaggtgatggcaagatcctgtacagccagtgtggggatgtgatgagggccctgggccagaaccctaccaacgccgaggtgctcaaggtcctggggaaccccaagagtgatggtgaggggcctaaagaacaactcctcagtgtggtcatgggcccacagttcttcagctaagagcttccctttatcttcataggccccaaactcaagcaagtctggattagcaaatcccatggatttccttgcttttagtggggagtcatctgtcatctctctgttcagttgaggtctctataatcccctgtcctgagaacttgtgttacttctctggcctgacacttccacctcctttatggcagagatgaatgtgaaggtgctggactttgagcactttctgcccatgctgcagacagtggccaagaacaaggaccagggcacctatgaggattatgtcgaaggacttcgggtgtttgacaaggaaggaaatggcaccgtcatgggtgctgaaatccggcatgttcttgtcacactgggtaaggttctgtgtccttgtccttgagctgagatggcaccctgaggtacctcacttgtcacccaattccaaaaatgctttctttccccctgcaggtgagaagatgacagaggaagaagtagagatgctggtggcagggcatgaggacagcaatggttgtatcaactatgaaggtaagaggtgaactgcgctttctcagagaaagcagccatatggggcaggtcaagtatagtgtctggggctttccctatccctggacttgggctccaaaaagagccaggaggcaaggtgcagggccctgcccagcccagcccaggagtgggaggtcagggcggtataacaggaaaggaagggggtagtattgtagagggtgggaaggaatgagaagtgaaataatggaatgtctgtccccactgcctgacccctcaccccatgtctttgtcttgtcttcaccatgaatgtctcttccttcctgcagcgtttgtgaggcatatcctgtcggggtgacgggcccatggggcgggtacggctcctcccagcctctcctctagttgatctccccagtgtttcttttttccccaacctgtgctctttatcccctgcccttaccctactaccatctgacttcctcctggcatgtttctgcatggagctgactagggaggggagggattcctcaaagaggaagacaacctgggggtacagtacctccttacctctagaatgggccctgaggttttacttatgcggccctgggtgctggtgtctgggaactctcaccagcctgtataccagtcttgctttagggtgaccttctggccctggagcatgggtagctggcatagaggggtatgggttgcctgccccattctgctgctatagctgaacagtcctttccccttccctcgctgggcagcttggaggtaccctaacccaaaactctgtcctctcctcccgccagtggctgacagtagctgtaggtgtagtggagaacttttctgcctctgctgtgttcttgctgcttaggtttgggtgggggactaacagctgctgggaggggagctaggggcatggagaactggtcagactcaaggtggctcctctgcaaactgaccccagggttggttgctgtgggcatgttcccgcttatgctacctttgcagtctggtagtcccctggcccttggcgtacccctccacagccctgttccctggctcatcccacctttcctttccacagagctcgtccgcatggtgctgaatggctgaggaccttcccagtctccccagagtccgtgcctttccctgtgtgaattttgtatctagcctaaagtttccctaggctttcttgtctcagcaactttcccatcttgtctctcttggatgatgtttgccgtcagcattcaccaaataaacttgctctctgggccctcggttcggttctttctttcctgaacagggtaaaggggaagaaggtgagatggtgatgatttctgccctgaggcagagtccaaggtcaatcaatggtgcaggggttgaggaaagctgggggaggccctgtactagccatctgggcttcatttaaaaactactggccccattcatccatcttacacaagctacctcttgggagattaggaaagccatagatcccagtaggactaaggctggccatccctgttccattccatatcaggctgtcttctcctacccttccagctccttaaatctggcccccgccctcccaagctcccaataaggccttttgtggggaagcctgtggagtgtttattggagctaaagccaggccattattagcactgcctaagcctgtccgtcacctcagcagggtgaagggccaattataacaaaagtaggtaaggggcttgcctcctctctaataagggaaggagtgaaaccactacttctgaagggacagagatacaaaattccatgttgtgggaatgtccttccaagtcttaaacagcttttagggcaggtgagagcctctgctcctataccagcacatagtctcgacagttgtgctgccgttcgtgttttgtggggaggcgcagtgtctgtaggccgtgtggcttgcagagtgtctttcggcccaggtaaacgccgctgtgaaggactccaggaaagctgctcccatcacaatccccctgcctgacagccacaggtaagaacacagaatgcacccacaagatggaactgaaagcaaattaatttataaaaaaaaaaaaaagaaagaaagaaaaaaagagaaaatttacagaaaactttgaacagaagaaaggtgctaagacgcagagggagagaaacatggggacatgaggaacaaagggcctggtgggaggaaccaagaagaaccagtgcagagcctggagtcacacctgccttcccgtcacaggggagaagctgggacacgtggagcaggaatgcgggaagcagagttgagctgcgagccaagggttggtccaacccaaggttgggcaccctcttccactgctcccaaatccctgcatcctcatctggggagcccccagctatcagctgaagttctcatagtcttggtgggagagggaggaagctaaggggtgacccaccaagtcataatatggaggtgcttaagtgctttaaaaaacaatttcaggttttaaaacttcacatcctcttatagctcccttctctgtgccttccaggagtccatggatacagcccagggaaggaaggagaacagcccccagtgccctttcttctcctattacctaccacagaaatccccgaaattaggttttccccaccaaatacacatacgctgacatcaactaagcaagtgacttttaaaaacaaaactgacattcagagggaaaggaatcattggctgagctggggtggcctaaaacagcaacaatgaggaagccgcaggagggattattagtacgaatgaactcgaataagctcagcgtagggtgggggaggggagttggggccttgacttagtcactaaaaaggggcttggggagagatggaatctgcgccctgttctatccccagagctctccctggaatcttaattcccctttcctaaaactcactccccctcaaaaaatgtaaaaattggttattttttagtgggtagaagggagctccaatgtggctttttaaaatctactttttttttttttttttaatccatagaaaatgcagtagtttggagggaggtgtacccttagaagtggttaatagaaccttgtataaacacctttcaccagcccttcctttagggcagcattcccatcctatcctctctcccagacattataaacatcttttaaacagaagtccttgaataatctgatataaaaatgcatgcctctgttaggcatggtgagggctttggaggggcggaaggagctttccttacgtagtgatgaactctccaggctggggagggtcccagtggtgggggaagggctgttcctggaaccgtgatgtccacagggggtgagggggagagatgtctggctggctcctcactgtggaggtggcacaggggtgaccgtgcctgggctcggggctgtggggtctggaggcaggggggtgcctgggtctgtggagaaaaggaagataaatcagttagagtacgccggagagatggctccagacccagaccaccacagacagacagaaccgggcatggcatgcagtggctgggtggatgaatgaggtacccataatgttcaacttctgttcccaacactcttttctacctcatactcagaaaaacatatagaaagactctctatatggggcatttgaacgtgataggaataagcaaagggatgccactcaatcatcatgcaaacagctgcttttcaagtttacaactgagatgctctctgccacaggattgctccatgacccaccagtgaaaggccccaacatcatcccaaaggtggcagctgccaggctggggaatggtggaggacggccagagaggcccttcctcctgtattctaattttaccagagtgttcaaaaaggattgtggaaactctaatacctgacctcttccccacctgcccgctcaccctccctccaggtggacccctctccctcacccttctcccctcttggccccttctcacctggcagtgggctggcactgggcaggaggttgccctgaacagctgccacaatggcagggctttgggctgcggcggatccgagccccggcccgagaggcaaggaagatggcatggtggtggtcgccggcaggttaggatgtagagggttcgccatggacacaggcaggttaggtggggggagagtgcccggggcgaacgggagatggtggtgatgcccatgcaggttaggaggagcggggaggttaatactgatggagtcagctagactaccaaatgggatgatggatggagcaggaggaggaggaggaggcggcatgccaaaaggcaaacccaaaggagcattacccgccacgcctgggtgcccgctgcctggcactgcccctggcatcattgagggaggagtttgttggttggggaacggtgaggggcctgagaataaagatgagagatggagaaaattaggtataaaattttgcttaacaactcaccttttctattttttttttagacggagtctcactctgtcaccaggctggagtgcagtggcacgatcttggctcactgcaacctccgcctcccgggtttaagcaatctcctgcctcagcctcccgagtagctggtactacatgtacgcaccaccacgcccagctaatttttgtatttttactagagacggggtttcaacatgttggccaggatggtctcaatctcctgacctcgtgatccacccatttcggcctcccaaagaataactcacttttacaaacaaggataatctagccattccttggcactatcttccccttttctgacactagagtaagtgaataaaattccaaagctctcgagtttggggaaggactcctgctgatttaggggcctaagagagatgggcccatctgtagaaattgaggctaacctcatctccacactcatcttgtatcccctttgaggagaactgggacattcacctggattcctctagccaacaaaagttctggaacataacacttaccatggggtccaggggggggaacccctggtgggactgccccaggctggggggctccagctggttgctgctgctgtggccctgcagttgaccctgcctgcccaatctgttcagaagggcccaaacttcctggaggggccccactgccagcaggagcagggactacagaggctggagccacagccaagccatggactgcgggtggcccagcagcccctgttggggggataggctgggagcctgggggcagggctggtggtggctgctgctgctgttggtgcatctgttggaagtgctgctgccgagccctcatctccgcatacttcagctgctccatgtggaaggcttgtctgtcggccaggagctgctgcctctgatactccagctgccagtgccaattgagtattgttatccaattttcagcagatcccaaaggcaaatgcctcaacccctgctttgtcttcttctgaaagagcctgcctctcaatcagaaggttcccaaaatctacatcttgtgcttgtgctccctctgtcctccccacccgacttcgtgcaaattcccatgacctttatgtctcctgagtgcccacatggtttcttattgcaatgactttaacctggcccaagctcacttcagctacaaagctttgaacttgccattaccttgatttggaaaatgcttccagttccttttgtcaattcaagttcttttcttacttcaaaattcactaaaaagtcactgttcttaggaagctatcccagatcaattcatttgcctctgagctttagctttattctatgatctcaggacttagaaacttgatgtgcaatctctttatttttttgagactgagtctcactctgtcacccaggctggagtacagtagcgtgatctcagctcactgcaacctccgcctccccggttcaagcaattctcctgcctcagcctcccgagtagctgggattacaggtgtgtgccagcatgccgggctaattttttgtatttttttattctttagtagagacggggtttcaccatgttagccaggatggtctcgatctccttgatctcgtgatccacctgcctcagcctcccaaagtgctggaattacaggtgtgagccaccgcgcccggctgatgtgcaatctcttaatgtgaatttgtcagatactttaaaccttcttaactgtttctgatgtctccatattgtatattcatttgatgtctcccattaaaccttaagttctctgaggtccctatcttctatttctttttcttcttttttttttttttgagatagggtctcactctgtcacccaggctggaatgcaatggggcaaacatggctcagtgcagccttgacctcctgggctcaaacgatcctcccacctcagcttcctgagtagctgggaccacaggctcgcaccaccacgcccggctaatttgtttatttttaaaaaatgtttgggctgggcacggtggctcatgcctgaaatcccagcgctttgggaggctgaggtgggcggatcacctgaggtcaggagtttgagaccagcctggccaacatggtgaaaccctgtctctactaaaaatacaaaaattagctggtcatggtggcatgtgcctgtaatcccagctactcgggaggtgaggcaggagaatcgcttgaacccaggaggcggaggttgcagtgagccgtgattgcaccactgcactccagcctgggcgaaagagtaagactccatctcaaaaaaaaaaaaaaaagcgtgatgactcacctgtaatccggcactttgggaagcagagatgggctgatcacctgagatcgggagttcgagaccagcctgaccaacatagagaaaccccatctctactaaaaatacaaaattagctgggcatggtggcacatgcctgtaatcccagctactggggaggctgaggcaggagaatcgcttcccaggaggcggacgttgtggtgagcgaagatcacaccattgcactccagcctgggcaacaagagcgaaactctgtctcaaataaataaataaataaataaataaaataaattgttgagacagagatctcactatgttacccaggctggtcttgaactcctgggctcaagtgatccatctgcctcagtgtaccaaagtactaggattacaaatgtgggccactgtgcccagtccctattgtctatttctttttatgtcctccaaagacaaaatggttcaacactgtgtcggtcccattccctttccaagttcacctcctggatctgaggctcttaccctctctctcatcatccgttacgcccattcactcaatcactatttgagtctactatgggccaagcactgttcaaggacctggagatgcagcaatcaaaacaaccaactagagtccctgcctcatggagctgaccttctgtgggacttcagtccccagacttcacttgtgagaccacttaactgtctctaactggctgccctactcctgccctgttcctgccctgctctgctttgaagccctgtctgtctcaggctttccccactgttgcttatctttcactgaaacacacacacacacacacacactcaggctttccccactgttgcttatctctctttcactgaaacacacacacacacacacacacacacacacacacacacacacacacacgcccctccgattttaaactgaggcacagcgcagcagggttccagggctcctgctactcactgcttctcgctcccggtccatgatagtctccagctcctcaaagtgccgaagtttgatctccaactttttcatctgggtctccaccagcagggccaccaaagatttgatcttcctttcctcaacagcagccaagtgctagggaaggaggggcgagacagcacatcagtgggaggacccaactgaagacaatacagaagaaaggtagggtggatgctggcaggtataagaacaaatttgctgtggtcacaacccatggtgaaagggcttgacttttttgtgctgggattataggcgtgagccaccgtgtcttttttcttttttctttttttttttttgggacagtctcactctgttgcccaggctggagtacagtggcatgatctcagctcactgtaacctctacctcctgggttcaagcaattctcgtgcctttgcctccccagtacctgggattacagacatgcgccaccacgccggctaatttctgtgtttttagtagagatggggtttcaccatgttggccaggctggtctcaaacttacaacctcaggtgatccacctgcctcagcctcccaaagtcctgggattacacgcgtgagccactgcgcccagcctttttaaaaaattaaattattttggccaggtgtgatggctcatgcctgtaatcccagcgctttgggaggctaaggcgagcagatcacttgagtccaggagtttgagaccagcctggggcaacagggtgaaaccccatctctgctaaaaatacaaaaattaaccgggcatgctggcacgtgcctgtaatcctagctacttgggaggctgaggtgggagaatcgcttgaacctgggaggtggaggttgcagtgagccgagattgtgccactgcactccagcctgggcaacagagtgagactccatctcaaaaaatacataaataaataaacaagcatggaggctgggcacggtggctcacgcctgtaattccagcagtttgggaggccaaagcgggtggatcacctgaggttaggagttcaagaccagcctggccaacatggtgaaaccccatctctactaaaaatacaaagagttagccaggcgtggtgtagcacgcctgtagtcccagctactcgggaggctgaggcaggagaatcacttgaacttgggaggtggaggctgcagtgagccgagatctgacagagcaagactccgtctcaaaagaagaacatggagatagtgtggcaaagggtaacatggagtcaaatactgacagggttgaaaacaggcccaatggtgatatattttttaaagcttagagaagggatgactaactttacctcctcctgagataaaaataaaaaataaataggtcagcattatttaaggtgtgagtgaggaaagatttcctctaagtgagatgagattagagaagtggacattttcttccctgaggtcttcaaggtctggcctcaccttagctttcactgcggcggcggccagggcggcggcagcagcggtggagaggttgccctcgccaatgtcccgctccacctttgtcttcctttccccctcagactccaccacttccttcagcacttcctcctgcccttcctttggctccttctccttctcaggatcgactgggccaggacaagggttgagttagccccacagcttcacctctgtcctgcacccccacctacccttgtgggaggctcacctattgggtctccatcactcttctcggactccttctcactgtcgccttctttccctttctcctcatccttcttgggagcctcgctggttttctcttttgcttcctcctctatagcaccccctccttctcggggttcctgaaattccagtgatagaaaaggagagttatcagggattagggtgattagttctcacacagaggggccagacggggaactaaatttattcctcttactttggaggtgatctgattctaggagacaaccccgtccaaaaccagcccttgcccacctaagctgaacaaggccaacttccccatcaccacagtgctgcacgcagcccctgcagcttccagaaatccctctataccttgggctccttcttctcatctgtggcctggccttccacccgagcctcgtcattcccgctctcctctgggcccatgagaaaagaaagaaaacaggaaatgtttaatacacagtcgtctgtgtctaacacttttctttttttttagagacagggtcttgctgtgttgcccaggttggtctcaaactcctgggcccacgcaatcctcccacctcagcctcctgagcagcttggactatgggtgtgagccgttgcacccagcttctccataacacctgtttttttttgttttttgtttttttgtgacagggtctcactcttgtcgcccaggctggagtgcagtagcacaatcatggctcactgcagccttgacttcccaggctcaagtggttctctcacctcagcctcctgtgtatctggggctacaggcgcatgccaccatgcctggctaacttttttggtattttttgtagagacgggattttgccatgttgcccagactggtctcaaaccatctgcccacctcagcctcccaaagtactgggattacaggcatgagccactgcacccagccttcacaagacttttttttttttttttttttttttgagagacgaagtcttgctctgttgcccaggctggagtgcagtggcttgatcttggctcactgcaacctctggcacccaggtttaagtgattctcctgcctcagcctctgaagtagctgggattacaggcacgtgccaccacgcccagctaatttttgtatatttagtagagacagggtttcagcatcttggccaggctggtcttgaactcccgacctcgtgatccacccacctcggcctcccaaagtgctgagattacaggcatgagccactgcgcccggccttcacaagacttttctaacagccccttctacaagcaaagatttttctacccaaaatcttcatgagaggactagtagggctccagagcccctgaggtaaactcatggggaaaataaaaaccctaccaatgttctcattcatgttgtgctctaatgccaacttgaggcagaaatggcacaggaggccaggtagctctggatcttgtgaaaggcaagaaatctgggaacctgcctggccttaccaatccgctcaggctcatcagaggtggttcctgcaatgccactgctttccagaccgaaggcagggtccgccttgcctgttactttggctgcttcttccacttttcgaacatgggcctccaccaaggccgtgggtacctcttccttcattttggagaactcctctgcaagacccagaaagaatgaggctgggagcggcacagtggaacagttctggcaatccctgcaaaagcttactcacaagcccatgtcttcatctaagctagtatggagcctagacaggtgcctgagctgaggcccgcacagacaaggccagcagggcagccaaacttgagaggattcacagtctgagtaactagcccttcaaaagcaaactaagaaggccaggtggaaccacccacccccattacctagggctgactttgcagcagcagaggcgactcggggatcgacgacagaggccaggaaggcaacagtgctcataacagggttgcccgactgactgaaggggatgggttggtaggccagggggcctagggaggcctctgagtcctccaggtatgggtcttcaatgggaagacgaagaaaatgcaagatgcactcgtcctgtgtgcggcttcccacatgctcggacactttgttccagtcatctttgtacatttccagtgcctggtggtagtggtggagacataactccgcttacttagccacttttctcgaaggctgactccccccatcctactaagggcagctggtttcaaagttctctatgttctggtatttgtgtactctgctaggtccaagggggatcttgaagtagcactaagaaaggatatgaagttaatgaaatggcccaaatccccagcctggagctggtcctgaagctcactggagccttgacctcctaggctcaagcaatcctcccacttagcctcctgagtagctgggaccacaggtgtgtgccaccacacctggctaatttttaaaatttttcgtagagacggagtctcactatgttgcccaggttcatctcgaactcctggactcaagtgatcctcctgccttggcctcccaaagtgctgggattacaggcgtgagcctctacacggagcccacttctgttttcagagaaaaactctcttttctttgccccaattacctccaggagaagcagggtttcctgttctgtccactcacgagtggcactggctgcagccttgctctgcaggggaaacacaggcaggtgagaagaaaggagcctgtgacctctgaggagcgaacattctctacccctagagtcggcccgcacctcctaccttggagggaacattcttttttgtgtacatgtctgtgcgcagcccaaagttttgcatgtctgttggtttctctttgcctttgtcaggaaagttgagcatttgttgggaagcagaggtctgctatttgtggagggaaagaaacaggtgagtacaagtgaccaccgggagccaggggctgacagagagaaaaaacagacagaaggagcttctttcccaaagccagggacacccctgggtgggacttcctcccttactgctgtagttcctctgctctcatgtctcttcttcccgggcaggggccccccaataaaggggaaaatgagcagcccagcagggtctgcaccccacctaccagctctggcttgcccttagccgtctctggcaccaggtcatccagctctttgccctttcgcccagccttggtatcagcatcaacctggcggccctgggggacagagcttggcgtcatggaggctgggcaggaaatgaccaggccaaggccctggaggcctcaagaccatatgctgggcggcccacaagctctgggggcactcatgccactgttccatgttcccttcatgattaataagacatgtcgttggcatgatatccatacatattcacattatctttataggttctcttaggagctggacaattaggttctaatcctagatttggtactctgtgaccttgggcaagccacataaccttcttcctaatttttgtaatggatgaagtggaaatggaaaaaaaaatgaagatgataattatgaggcaaaaatgaaaaaatgtggcaaagatgacaaagtttaaaaatttcatgcaagttaattttaagccatttttctctattgactcccctacattagcctgtctactccttgagtaaaaggataatctcttctccctcagcaattacagccttaggtacaaaggctgagagaggatgctaaacacatggggctgattcccgtgaccctttgcatcccatggaaaaggaagaagcctcaaaacactcctgaaccattaccctaaaaaccagaaaaagaaaagttcaaagaagcccaatcttcccaacccgccccatccccatagcacctcaccctacctgaggtgtcttgggctgcagaggcaccagccctgatggtgtgtcagccaagacatggaagtgagaggtaggcggaggccccattggggttggtcgactctcagcatccacctggtagttaataagaccccactgttctaggaaggcatggaccctgtgcagagagaggcagagacagggtcacacggatagccagaaaggtgcacgaggaagaggaaaagtggggggtagaaggggcataaaccccctccccacccaaccccggccttttcctctgttcattgtactccttaagaaatctcacctactccagttgttcatttatcacctaaatgccagtgacacccaagtctacatcttcagcctgggccaatctctatatctacctacctaccgaacatttcttcctgaatagctagtaaaactgaaccagtttctttctttttttccctaagagagactgaagtgcagtggtgtgatcaccgctcactgcagcctccacctccagggctcaggggatcctcccacctcagcctcctgagtcactaagaccacaggcacgtgccaccatgcctagctaatttttttgcattttctctagagatggggttttgccattttgtccaggctggtctcgaacttctgggctccagcaatcctcccaccttggtctcccaaaatgtttggattataggcatgagccaccacacctggcctgaaccagtatctttcaattacagacatgctccttctttgtcctatattctacacttcagagaatgccattgctaatccctcaagtcattcattccccaaacctgtacttcacctttctctagaggtgcttttttctgtctgctcctctgtgttccttgctggcatctctactgttgccaaaacacatccataggcaggcatcctcatgtacccccttcccctcagccacaagacccacctcatgatggcacagacatcacccgctaggtttcggcggcaggcggtagaggtaagatactcttgggggttcagtcggtaagtgtcaatcataaagtttcgataggccaggtagcttagaagaaagagagagagaaacaagaagaagaaaaataaatgtttgttaaagggctaaaggaaaaaatggtaagagagctaatgacttctcctgcatgataaagatggaaaaaagtagattatttgactctacatgctgagtgcctgctatgtgctagatgaaagggtttcaaatatgtcttacttttccttgatggggttttctttaaatgaattatctccttggctatacttagggatatttcatacaatttttttttttgagatggagtttccctcttgttgcccaggctggaatgcaatggcatgatcttggctcatggcaacttccgcctcctgggttcaagagattctcctgcctcagcctcctcagtagctctgattacaggcatgtgccaccacggccggctaattttgtatttttagtagagacagggtttctccatgttggtcaggctggtctcaaactcctgacctcaggtgagcctcctgcctcagcctcccaaagtgctgggattacaggcatgagccactgcacctagccattttatacaatttttaaacaaggaattagaagttaagaaaatactcatttccaaactcagatgttaaaaggaagtccttattcatgcatatagctagtcagcataccacggtaaaaaacatatgttttgaagttgaaaagatctaagttcaaatcccagttctaccatgaggaccttggcaatttacttcgaatttttaaacctcagtttcctcatttgtaaaatggaatgtctgttgagaggtctataaagtactagtatagtgcctggcgcattgtaggggctcaaaaaaatggcagctatcatgtggtacagtgtaaagtttcagatcatgggccagattaaaggattcagatcctggttttatttactagctctgtgactttatgcaggtgacttgactcctctataccctatctgtcaactgaagatgatatctacctctaaggttgacgtaaagattaaattactcaatgtaggttggacatttagtatagtgcctgggagatactaagctctcaatagatgcaggcaattatcatcatttactatttttttttttctgagatggagtttcactcttgttgcccaggctggagtacaatgatgagatcttggctcactgcaacctccacctcccgggctcaagtgattctcctgcctcagcctcccaagtagctgggattacaggtgcgtgcctccacacccagctaatttttgtatttttagtagagacggggtttcaccatgttggcctggctggtctcgaactcctgacctcgtgatctgcccgcctgggcctcccaaagtgctggaattacaggcgtgagccaccatgcccagccatcatttactattttataccaagagttcagttcctactccaaccctgcctgcatgtcatgttgaattcatttcacctgatcactactttcttttcacacatactgctttctccaggaagagaaggaagagagaaccatagcaagctatgaagaaaaaacacggagggacccccagagaggggaagctgtggaatagctgggaagaaaacttgttcagttctcagtctcacccacctcatcaatgtggttatcttgaagtattcctaaccaaagaagactgccatgtcttatccaaagccaagcaggtttggcctgaggcaaaatctttttttttttcttgagacggagtcttgctctgtcgcccaggctggagtgcagtggcgcaatctcggctcactgcaagctctgtctcccaggttcatgccattctcctgcctcagcctcccaagtagctggaactacaggcgcctgccaccacgcccagctaattttttttttttttgagacggagtctcgctctgtcaccccggctggagtgcagtggcgtgatctcggctcactgcaacctctgcctctcaggttcaagtgattctcctgcctcagcctccagactagctgggactacagatgcatgccaccacgcccggctaattttttttgtttttgtttttttgttttttttgagacggagtttcactcttgttgcccaggctggagtgcaatggcgtaatctcggctcactgcaacctccgcctcccgggttcaagcgattctcctgcctcagcctccctagtagttgggattacaggcacgtgccaccacgcccagctagttttgtatttttagtagagacggggtttctccatgttggtcaggctgagctcgaactcctgacctcgggtgatccgcccgcctcagcctcccgaattgctgggattacaggcatgagccaccgcgcctggtctttttagtagagatggggtttcatcatgttagccagcatggtcgcgatctcctgaccttgtgatccgcccgcctcggcctcccaaagtgctgggattacaggcgtgagccaccacacccagccttgttcattaatttttttagatacggggtcttgccgtgtcagccaggctggagagcagtggtgtgatcatggctcactgcagcctcaaactcctgggctcaagcaatcttcccatttcagcttccgaagtagctgggaccacaggtatgccccaccaggcccagctaattttttttcacttctttagagatgggagtcttgctatgttgctcatgctattcttgaactcctggcctcaaggaatccttctgtctcagtgtcccaagtagctgggatgatttacagtcgtgagccaccgtggctcctacacttctttcccagtgagccctctccatcccttaatttatataaactggtcttctattagttccttctcttgtttttctattaaaacctactctcaggaaccagcctggtaatagtaatttacactttaatcaaaacttttgtgctaggaatatctgcagtatagacgatatcagtaatatggatttaaaggctctataccctgttaaaaagaagttgaggcactggagtaggtacttgttatgtatagaacatgcttaatatcacccttgggcaaatcctaaagaacatgtgtctacatgctaggccagggctgcctaaaggcagatattgtgcctttgtaagcctagcatagtgcctggctcatggaagatgctcaagaaatgtttgctaaactgaatgttactggatcaggaagggtgaatgtggggacaggagggagaaggagaatcatgagatgagatttccttacatctctggagtcttggacttgttcttgccgttgaagaactcggggagagccctccgctcaatggcatgaacactgcaagaaaagccagaatggtttcagaagaaggcattggtgaagggatgggggccccaaagggaggaaaagcctagaaggcaaagaaggaaaagagctcgaaattgctgaagttagaagcttggggagaacatcccacaggctgtaagactcaaaaggacacaaggagctcccctaaaactaaagtgtactctggtctatttgggtgaggaaaaaataacttatttggaggaggcagggagaagaacagcctgttgacccctggaggcagggaaataaggactcagtgagaagttggggacaaccatacctattgtagtcaaaccaggcagcgtagctgggaatgatgatgtggtgggtctgttcagtcacattgtcctcatgcaggtctggattcttggtctgctctcccttgttccccgtactgttctcatcctcatcctacgagtatggaggctgctggacactcagcattcctgcttcctccctagcaaccctctgcttctcccacaccccaggaatgtggacactaaagatgggtgatgggactgagcagtcatgggccccaggactctgaaagggtcagagttttgaacaaagctggaattagtctacagtgggtaaagtctgggcagtgaaaagtttgggcagaatgaactttataatcacaaatcagaatcacatagagaggtagggcctctctaaactggctccaccttgcccgtcgtctccatgctttcatcttcctgttcatctgaaagagaaaaaccaagatgtaaggctggagcctcctgaggggcaagaaagccctaccaaaagcccatcaggctagcgaaaagggggcagctgagccctccccttcccttggctctgactgccgtgcccaagaggctcctgtcttacccaggtcggtcatggtgccgcctttgactggggccgactctgagtctttctttgtgttgactgcgaaaacagagagtcattttatcagacagattttgcctaattcaagccttcaatttaatagttccagacatcctactttctccaaaaattgtctccacctgattgcaaaatatagtaattctctccagtcacaattattctagggcttcaaacttcttgctactttccccacttctccaaccaaaaattaatttaacttatttctctatgtacattcataaatgattcttgtctttgacaggcctttatctccatctatgtatctgtaagcttttaatggtctgatactgaatctgaccaaatcactctgtggaagaatggttaagtgttaaacatttttgaaagcagaggatactttcctcaactgaattcatatacatatgctcaggagcaaacatagagaagagagagagctgattgatgaggaggtagaagccagaactcttcttggtggcagccctaatcctacccctgaaatacacttctggaatacctggggtgagtctacagaatacagactgtaaaccagtattggtggagcaatgtctccaaagtggggttctaacataggacgcaaaagatgatccactgcaactcagggagagaatacagaacttctcttcatgttttttgttttgtttttttgagacggagtctcgctctgtcgcccaggctggagtgcagtggtgcgatctcggctcactgcaacctccacctcccagattcaagtgattctcctgcctcagcctcccgaatagctaggattacaggcgcccaccaccacgcctggcaaatttttgtatttttcgtaaagatggggtttcaccgtgttagccaggatggtcttgatctcttgacctcgtgatccgcctgcctcggcctcccaaagtgctgggattacaggcgtaagccaccgcgccctgattcttcatgtttgtttttatcattctttacatttttcaattttttagatatgtttgtgttttaaaacgttcccatggtagcggcttaacagtacaagtacataattaatgcatatatacatttttttttctttttttttatttgagatggagtctcgccctgttgcccaggctggagtgcagtggcgtgatctcagctcactgcaagctccgcctcccaggttcacgccattctcctgcctcagcctcctgagtagctaggactacaggcacccgccaccacgctcagctaatttttttgtatttttggtatagacagggtttcaccatgttagccaggatggtctcgatctcctgacctcgtgatccgcccacctcggcctgccaaagtgctgggattacaggcatgagccaccgtgcccggccctttttttttttgagatggagttttgctcttgtcgcccaggctggagtgcagtggtacaatctcggctccctgcaacctctacctcccaggttcaagcaattctcctgcctcggtctcccgagtagctgggattacaggtgcccaccaccacgcccagctaatttttgtatttttagtagagatggggtttcaccatgttggccaggctggtctcgaattcctgacctcaggtgatccgcccgcctcggcctcccaaaatgctgggattacagtcataagccaccgtgcctggccatgctcaaatatattttactgtcagaaacacataatcaaagagtttggagacaactactatcaggcacaaagcacagtccacaactcagatatgaatatacagttagaggattttccagggtaatgaccgtaattccaataaccagctaaatttaaggaaaagatcctgtagactgggaggtggacctgagaaatcagctcacttggggtttggcaaaggagagtcaagacggggagtgggggtggatcccaggagctcagcctggcctgtacctgttttgggaagtgtcacctcttctacattggggactggtgagggctcgtccatgtcctttgtcaggtcttcttgctcctcttctctgtggccacgctttgacttagtgtaaggtgttgagggactgggaaggaaagagagtgaaagagaacccagtcatccttggacaaggagtccctggaagttgaagttcaagggaagggaagtgacagagaattccaagggtagagctgagtacaaacagaaaccagtaatcacacagtaatgggaagtggcaaaggcttttcacttgataaagctctctttaaatgtactagtggggccagaaccagaactaacaactgagcagctaaagatctcctcatcttccctctcaggacacctgcagtattatggcacacccaggtcagggccaggtggttataggaagggatttgtctttccttccttcaacatgatgtggagagaatggtgaacacgggggcaggctaggggctggcacaccctttcttagcatttttcttctttgcttctggggttggtgaaggagagggggagcgcttcctcttcttatagtttccccccttcttgtcccgtcgatctgaatctgggctgttcacctataggatggagaatcaggacaaatgtcagcctacaatccccactgaagatttgttctgagacttatgctaagggcgccaggaaaaaaagaacaggatttgtcacctcatctgtcagtgtcttggctgaaatcttctttcggcgggagacagggtttttgtcatcatttacttcatagtcttcctcattcatccattcattgaaggtgtcggtgtccaggatccactttgcatgaacctaaagtacaaaggcagatcatgctgcagagaagcctggaagccacagctctgtctggggacccttaacagaaaaagctcaagggcatacaagcctctgtttcacttccaaagggtagactgttcctggcattctttttggggaagaggggatacaagaaaagctcaccttcctaggtttctcaggagttggagcatcttccacagatgcctcaatttcactcgctgggatccacgtgtcgtaactgccatgggaaattgagcacacagtagaatcaatgggatagaattgtggaaaagtaaagtgcagatcttttaccctttccatttacagaaagtattgggttcttggcttattttttttgtattctattcattataaagtagtaaaagcacattacgaaacatttcaaaaatagagaacaaaaagaatcacccttacgtaactactcttgatacttgtatatctgtttttcctccacagtaatttttttttttttttgatacagagtcttgctcttgctctgtcacccaggttggagtgcagtggcgcgatctcggctcactgcaacctccgcctcccgggttcaagcgattctcctgcctcagcctcccgagtagctgggattacaggtgcctgccactgcgcccggctaatttttatatttttagtacagacggggtttcaccatcttggccaggctggtctcaagctcctgacctcgtgatccacccacctcggcctctcaaagtgctgggattacaggcatgagacaccgcgtccagctggggtttttgtttttgttaagacagggtctcactttgctgcctaggctggtcttgaacttccagcctttagtgatcctcctgccttggcttcccaaagtgctagtattataggagtgagctactgtgcctggtccacaattttctttttacataatcataaccatactagatgatgtttttacataatcataaccatactagatgatattttacatgctttttttttttgagacagggtcttgctctattgcccaggttgaagtgcagtggtgcaatcatggcacaatgcagactcaacctcctgggctcaagcaatcctcccacctcagccccccaagtagctaggactacaggtgcatgccaccatgcccagctaatttctgtattttttttttttgtaaagacagggtttcaccatgttgcctaggctggtctcaaactcctgggctcaagcaatctgcccacctcagcctccccaagtgctgggattataggcattagccactgcacccagcctacgtgctattttttgttttgttttgttttgttgagacagagtctcgctctgtcgcccaggctagagtgcagtggtgtgatcttggctcactgcaacctctgctgccccggttcaagcgattatcctgcttctcagcctcctaagtagctaaaactacaggcgtgtgccaccacgccctgctaattttttttttttttttgtatttttagtagagacggggtttcagcatgttggccaggctggtctcgaactcctaacctcaggtgatccgcctgccttggcctcccaaagtgctgggactacaggcgtgagccaccatgccaggcctacatgctactttttgcaattattaataatattcacttataaattatccatgttatatcactttaaagactgcataatagtccactgagtagatatacaaatttactgaaacattttcctactgttagacatttagattgtttctaacatttacttatcgaaaatgatgctgggataatcaattcacacataaagcctcaatccttttagcccaaggcttgtccactaagtccaaacctcccccaagacagaggttcacttactaggtgagaggaaaacaaattaagtgatctaaaaataactctgaaagagtggcctcttgctctgctagatgtcctagggcttctgggtctggctcttatacttaaacctgccccaggaacccatcctcacctgtcaggatagtagccccagtgcagaagaacctgcttatccctcttcatgactggtcgtacccattcctctggggatagaggaagagaagggagagatataagctaaagggggacacaaaaaaaatactgtacaaaagccctaactaatgcactctcctgttgtagcaggggacttggtaataggaacttaaggtggtaagaggattcaagattgaaagaagaggaggagcccaggtactgaatggtgatcttagtcctctgcctcctagtccaaaccatccactcaagtggacaggaaaacccaggtctcaccttcttctagattccccgggacaggatacacaacatgggaggcattgttcttatcctcagtgactgttccctggatggtaaaaggagaagcgggtaaattatggtcccctctgaattactcaaggtttagccacagagctgccttcctaaccatattttgcttataatagtattaaagttagtttgtattctctaagcacacaccagctaagtggcagagggaaacagctgggattgtgctaataatggagaaaagtcaaagaattaaaaattgccaaaaataatcttctgaacagataatctatacatgggaaatttaaagtccactgtacatccttatcaatgacatctattcattactataaagttccaaagagcaggaatttcatttatctgagatcacgcaatctctagctcagtagaagtggatactatttttccccaggccaacatagtctctagaacagtaatgcaaacctgtcaggactgaaaaatgggagaagcagacagaaaaagacagactcaaggctttaactcaagtctttttccaagtagacagagccacctctgaagcagaaaacatggtaattcagggctgctgcttggtatagaaaacactgggaaaacagtcatggagtttctgaaacctctcctcaccagaccatttacctggtgtctcttgataatgtcctttaatttccctagtagtttgggctcaatttctgggcacagaaaaatgttaggtcgagacaggcaattattctgtggagagaagaaatagaatgagattataggaaaggggtgttttagattctcactgagggaagggagataaatagggtatatgcctattacctgcaccaaggacttctcaatggtcataaacatttccacattgcggtccatgcgtgatggattctggaaatcgtaacgccgccttgtgaagaggcaataatctagtgagtggtatagctcaggtctgcagatgaggtgagggcacgtgacttttttgtttgttttttgagatggagtcttgctctgtcacctaggctggagtgcagtggcgcgatcccggctcactgcaacctctgcctcccaggttcaagcaattctcctgtctcagcctccccagtagctgggactataggcacacaccacctcacgtggctaatttttgtatttttagtaagtagagacgaggtttcaccatattggtcaaactggtcttgaactcctgacctcaggtgatccacctgcctcggcctcccaaagtgctgggattacaggcatgagccaccacacccggcctttttttttttcttgagagggagtcccgctctgttgcccaggctggagtgcactggcgcgatcttggccagctgcaacctctgcctcctatgtgcaagccattctcctgcctcagcctcccaagtagctgagactacaggtgcccgccaccatgcccggctaatttttgtattttagtagagatggggttttgccaagttggccaggctggtctcaaactcctgacctcaaatgatccacccacctcggcctcccaaagtgctgggattacaggtgtgagccactgcgcccagccatgacttcttaatatgggaaattaggaggcaagcttgctcacagctattgccaaacatcacctgggatctgaggttcactgatctcaactccatgaatcactctctgtgcttacttcaaagggacaaaaaaaggtttgagatgccaacctaagaatcccttttcctctacaaaacacacagtgatactcacacactcactcttggagactgttttggctctgactcccaaccatcttcctgacgtagtaagtcaggtctactgacccagcaaaataaagagactcacaagaatttctaccccagaaagatcccagggaatcaaaaagggggatttcctctaaactaaatataagaagaatagagagaatcatctcaccatccctggtcactcttgaatttgtaggcagctgcaagaatgtggcacaaggagcctcccgctttgaaatctaggaaacatttgatctacaaaatcaagatacggaaaaagcatgtcaaggttccactgtaaattctctcatcacttaataatctaataatcctttcacaaaatcccatgctgaattgatctcccttttttttttttttttttgagatggagtttcactcttgttgcccaggctggagtgcaatggcgcgatcttggctcactgcaacctctgcctcccaggttcaagcaattctcctgtctcagcctcctgagtagctggcattacaggcatgagccaccacacccggctaattttgtatttttagtagagacggggtttctccatgttggtcaggctggtctccaactccagacctcaggtgatctgcccgcctcggcctcccaaagtgctgagattacaggcgtgagccaccacgcccggcctcaaagctgaaattctttaacccttgtgccattgcatcatgtggcctggaagaggggagtgaaagaaaccaacacacagaaagcaccaccttgtgctaacactttactggattacctcaggtaccattaaggaaactctacaaggtaggtttactaatcccatctagagatgaaggaaccaagactcatgaatgttgcccaagatcacagagccatccaatggcaaagccaggatttgaacacaagcctgcacaaatccaaatctcaagtccccttttaaccatgccatgagagacctgtggactgatcccaggtactctgaaataatttgttgcacaaaatattactaagacaaaaagaatggtaaactggagactaggccaagccaataatgccctgatcagggatagggatggtggaaaataacccaaatttcaaaaattacaaaattcacaaatctttttttaaaatacaactcttcagtttgaaggattcaccaccaccaccccccaccctccctgctacttctgcactcaccggcagtttagtgagcggtgcattgctgacatgtttgccaaaaacttcttcctgaaattgtagcaactgtacaaccaggctagacagggacttgttggtgggtggttcagcttgtatatactaaggaaaaagagggaaaggaaagaaaaatagatctcagataaattgtccactatctcccatatttctcccccaggggctctggaagcatgtggagcaaagaaaatagtgcccttctccccatttagtctctataaagaaaatggcaaaagggaggccctggacaccccaaccaggaagctgaaattctgctgccaccagcccaggtggccagtgttggggggaacagggaagcttactactcttcctcagttatactctgaaattggagttgcaggaccctattatcttggcacctcatctttaaccaacagcactgagggttgtaaaattctggaggtttataaagttcaggtcatggaagcaatacctctggggctctaagagagacatttcttaggggaactctgtaaagccatgattccccctataatgtagcctaacaagaaaaggtacaaggaagtgaaggagggcaagttgactgagtgagcttgtgcattttgcttctgaagactgggtataaatgtcttcataggccctcctagacaggaagggccatccactacccagcctgatggagaagagcaagacaacatctaccctgtccgaggaaactgtatctgagacaagtaaccctggccctacttctatgtttccacactctgctacctagtagcatcctagccttccattctaatttgaacctgagccaggagactttctttttactttttgacccgttttctccccactcatcacaaagaagacagtgcctctcagtgagaggtgaaaagagatagatctgtgaagggaaaggtaaatgacaaagagctaagagcatggaagctgaaccaggtcacaactgtcaattcccccaaggccggaggctaagcccctagcctgatctccctgcaaaaggtcaaaggtagaagcctgggaataagagcctctcacaggcgtagagacatgccatagaaatagcagctatttgtcaggattctcacacccagagagaccccaagggcagggccaggctcacaaccagcatcagtaggaagttctcctaagccactaagcacacttctgacgagctgcaaagccggcaggaagaactggggagctgaaagaaagccataaagagaatccctctctgagggtagtgagaaaaagagaggcagaccatttccagagaaaaccaggcctagagacaaagacgacaccaggaagaggtttggtagaaaagacaggtaaggattcttgaaccttttgttcaccaccttatgatctccagttatggggtttgggtgtgaggggctagagataggaagctcaccctaacctctcgaccccaaacccagggtactgcaaagctaggttgcaaggtgacttcattgtaaaatcgaggaaaggtttcggaaggggccgctacccaggaactcctataccccggctccctgagagattctgttgccccttagatgaaggtgggggatgagcggcggagacaggtgatccctgggtggagacctttttcaggctgatgagcagccaacggcttgctctgtgactgtttaccctcctgctttccattctctctctctgaacatacacaaagcaccggagaggcctcagccccgctggtacctggctccgtggggagctctggcgggcacgctccgggttgcgggggagcccattgggcacccggtccacacccggccggccgcctctcccagaaaagccaggagggcgatggctgaggggaaggtgggctaatggcaccggggcccgccgggcagtagagaaaaacaaggggcagagggcgcagcagtgggggcgggggctgggctcagaggctgggggtgcggggagagggaggctgggggaggggcgcgggagcgcaggagggcgcgcggggggctgcttgggaggccgcgggggaggggctggggcgcctggagggtaggcaggatcccggggctgcagggccgcggtccctttgtcccgcccccggtccccgcgcggcccggcccggcccgcgtaccttcttgtagttcttgccgagccacagccgcacgttgtcgaactgggtcacggtgtccgcggcctcgtagtacttcacgttggggccgccgtccttcttccgcaccgccatcttctccggctcgggccccgccgccgcccgccccactcagctcagctcccgcctcctccgcctcctcctccgcccgcctcccgccgcctcccgccgccgcggccgccgcctcccgccgcctgggccggccccggtccgcgctgcgccccctgccggcaggccgggcgcggcggcggagctccaggcgcgggccgaccctggcggcctccccggcagcggaggcgggagcctccggggagaaggacgcttcctggagggggcgccattctcctgagatcgctcttaccagacgcgaagccctttccctctttttgcctcagctcgggagtgtcacctcgctatcccactccaggcggccgccagtcgctggagcagccccaacccgtagacccgagtggtcctcaccttgcgcattcctaacccgacgaagcccctcgtcccccaaaaccccaaacccctttccccaagaagttccttccttccatccattcacagcagctccccatttaaacttttcagagtctccctcactcctcgcgccttgtccacccagcactcccctcacttgttaacccaaatgtcccctagtcgccaccctggcggcccagtgccttccctcaactgcttcctccgcaggcctcgctgtcgcctcctaagtaggtgtgagctcctactcgagaccccgactcttcgctaggcaggagaccctccctccctgggtcacccagtccatccgactctttttctttgggtggcgtagataggaggtaaggaaccgaggggtggggagtcctcaggtgtgtgtgtgtcggggccggtaccctgcttccggttcccgcacgcattcccggattgcagtgcggaccccttctgtaagcgcgcgataaagcgcggttttggaagtcacggtggccgagtggttaaggcgttggactcgaaatccaatggggtttccccgcacaggttcgaatcctgttcgtgacgggttttttttttttttctttcttcttcttattattaaaagggagtctcgctctgttgctcaggctggagtgcagtggcgcgatctcggctcaccgcaacctccgcttcccgggttcaagcaattctcctgccttagcttcccgagtagctgggaccacaggcatgcgtcaccatacctggctaatttttgtatttttagtagagacaggttcaccatattggccaggctggtctcaaactcctgacctcaggttatctgcccgcctcggcctcccaaaatgctgggattacaggcgtcgacttttttaacccctttcacagcacataaaggtaaccccagttctcacacgtttctttcgtgcactttctctctccaaaagggaagccgccaaaaggtcttaacccctggatttgggaggatgggagtgatcttgggaagtttaattatgcacgactgtattggctgctagactgtgaggcattttcagaattttgtaacttcaggcttcctgggagagctttggcacatgtctcattcttttgagggcatagggaaggatttggttgaagggttacattttgggaatgtgagtggctgttttgcaatattagtcaaacttagagtttcctctaaatttcatgaccagaagtcacaccttgtaggtctgattacaccgaagacccaggaaacaggattctctcatctggatttccttgaggtgtacagggctagaagggagtagtctattgaaacatcattgcagatccagttagagccaaggtatgggaagataattctcactttttattgagtgcttattatgtgccagatactgttttaaattatctatgtgtattaaccaagcaaggaaattaatctcatctttaacctttaaccctcctatactcatctcaccccatttttcctatcccctaatttctgattgtggggaggatctaggctgcttgttgaggattttgttgtttgttttggggggttgtttttgtgacagggtcccgctctgtcgcccaggctggagtgcattggtgcgatctcagttcactgcaacctcaaactcccaggcccaagcaatcctccctcctcagtagctgggactacaggcatgcaccaccacgcccagctaactttttgtatttttagtagagacggcgttctgggatttcgccatgttgcccagactggtctcaaactcctggactcaagcaatccgcctgcctcagcctcccaaagtggtgggattacaggtgtgagccactgtgcctggccaaggatgttctttttgtatttcttgcacagccttttgtccaaaaggaatcccaaagggcagggggctctagggtaatacatagagctttctacacatttataccttagagtttcccaccttcataccactgctcaggctgttatttccagcatgaccctcacattgcctccctgtccctcaccattaacactttccaaaattctttaggcccctcctctttgatgctcttgatcactccagctgcctgtcagtctaccaccaccaccattcactaaattgcatgcaaggacttctcccttgatatgctaacataaaaataaaataaaaacaggggtgggtgtggtggctcacgcctgtaatcccagcactttgggaggctgaggcaggcggatcacgaggtcaggagttcaagaccagcctggccaatgtagtgaaatcccatctctactaaaaatgcaaaaattagctgggtgtggttggcgggcgcctgtaatcccagctacttgggaagctgaggtaggagaaatcacttgaacccaagaggcagaggttgcagtgagccaagatcgtgccactgcactccagcttgggcgatgcagcaagactctgtctcaaataaaataaaattaaaataaaatagaaacaggttccatttattttaccttctaaatatgtctcaaatatgctcacttttctcaggggtgagtgcaggctgagctagagccttcatttggaaggtagtggtatttgtgagcaccatacgaggtaatatatagaaaactgcactaaagcatccacactgcagtccgggaccttaaacccttctatggctgctttctgtgttgcaggatatgaccccttttctctcaccactcttccatattcactacattctgtccactggcattcttttagttcttcctggtagttatttagccttgctcatggtgttctctgcctggaataatctttctcttccacactttctactcattctccacctaaatgttggttctcctgtggagttttctctgaccacttgttgcctaccacatcctatgctctcaacttattatgtgaagtctttcttcccctgtggcatataaacacattaaacacagataaggagtcagtttttaaaatttttttgcataaatgggtgttttttacagtagttatgtgtacatgttttaatctttagactggtatataagcttcttgagagttagggctgtgtattttatttatttgtatcttctctacaaggccttatagatgtgatcaactatgtgttgaatgaatttataaaatctcataggctcatgattctccttcctaccaaatcccaatttgcacaggttctcatatttaaatatctggagagccaagaccagaattgaccagcagagggcaaccaacaactatgttgtgaagggaagaaggctccatggtttacaaaatggaggatctggaccaagaagggaaatatggcagaggtagtttgctacttgaagttcatcccttttactctcaaatgcttctcttgtaacttttgtgggtgagaggccgaggcttcaaaccttcatatacaatagatcattttaaatttctaccatccccatgtacccaccccatctccccaattccttcacccttcctcttccactccaacaaatcctaactattcttttacctttctttaccttgcatgatctggccccctctctctcaccattcttacatatttacatatcacccactggcattctttagttcctgctacagtatgtggccttccatattttccctgaagtaaccttctccacttaagcctgtagtcccactcatttaaacctcctaaggaaccttccataaatatccttccataacaccttaaaattcctctactccactggatcaatccttcatgaattcagtacaaacaaaaccccaccttcatttgacactttcaaatttccacattgttttctacttccttttatttttcgaataaaatgtatacctttctgcctccagttccatactatcagataccccgtcatctggtttctgcctcctgaagtgttttggtttttttttcttttttacttttttactttttatttttttttgagacagagtcttgctctctcacctaggctggagtgcagtggcacaagctcggctcactgcaaccaccacctcccaggttcaagcaattctcctgcctcagcctcccaagtagctggtattacaggtccctgtcaccatgcgcctggctaattttttttttttgtatttttagtagggacggggttttgctatgttgaccaggctggttttgaactcctgacctcaagtgatccacctgcctcagcctccccaagtgctgagattacaggtgtgagccaccgcgcccggcctcctgaagttttttagacgttaatagaaaccactggacaaatttaataatctcttctcagtctccatcctttctgtgtttgaaacaacattgatttcttactggccttcagaaacacttattgtttttctccttctcagtatactgcttctccacctcatttgctttcttcttcctcctgtggaatttccaccaaagcttcattctcccgagacaaaatctcagagccacctttccaggtatgtcctcagctaaaccatggtcctttatctccagctgttcacatctctgcacagctgacctagtgtcacctaatatgcaaacaaagcttctcttcctctctcacaatcatcgttctgaacttttcccacttttgttgataccactattcactcaattccttcatttccagctctaagaattaattatctgaagtttgttttctcccaagcccatcacactgattcatcagttgcttccccaagcacatcatcttaattcatgcctgttacgatggccttcaaggtgccctagtttcaccacactgaaatccaccctatattagtgtgattacactgctttcatcatattattcccctgtccaggaactcagttccccatctaaacaaacacatgatcctattatcaacataccctgcctaaattgcccgtttttcttacccttacatctttccactaagataccttccatctaatctggctggtcatctccgtgtgacagcccaacccctgccatccctcatgaagttccttctctttactaactaggtagtctcaccatataatgatcttttcagcaataaattcttagatcttaaaagtattattattttgcctggacacggtggctcacgcctgtaattccagcactttgggaggccgaggcgggtggatcacctgaggtcaggagtttgagaccagcctggccaacatggtgaaaccccgtctctactaaaaataaaaaaattatccgggcatagtggcgcatgcctgtaatcctagctactcaggaggctggggcacgagaatcgcttgaaccccggaggcagaggttgcagtgagccgtgatcgcaccactgcactccagcctgggcgacagagtgagactttgtctcaaaaaaaaaattagtctcactttgtcgcccaggctggagtgcagtggtgcgatcatggctcactgtataacctctgcctcccagggtcaagggattctcctgcctcagcctcccgagtagctaggattataggcgcacgccaccacaccgccttatttttgcattgtagagacaggattttaccatgctgccaggctggtcatgaactcctgacctcaagtgatcctctcacctcggcttcccaaagtgctgggattacaggcatgagccactgggcctggacttaaaattatttttatgtaactaactttttttttttttttgagacagagtctcactctgtctccaggctggagtgccgtggcgccatctcggctcactgcaacctccgcctcctggattcaagtgattctcctgtctcagcctccggagtagctgggactataggcacatgctaccacgcccagctaatttttgtatttttagtagagatgaggttttaccatgttggccaggatggtctcactctcttaacctcgtgatccacctgccttggcctcccaaagtgctgggattacaggcgtgagccaccgcaccggctggtaatgttttcttttttttttttgagacagagtcttgctctgtcacccaggctggagtgcagtggcgcgatcttggctcactgcaagctccacctcccgggttcacgccattctcctgcctcagcctccccagcaggtgggactacaggcgcatgccgccacgcccggctaatttttttgtatttttagtagagacggggtttcaccgtgttagccaggatggtctcaatctcctgaccttgtgatccgcccgccttggcctcccaaagtgctgggattacaggcgtgagccaccgcgcccggccagtaatgttttttaaagctaaagttggggaagaactatatataagatttgagataggatcttgctctgttgccaaggctggagtgtggtggcacgatcttggctcactgtgacctccatctcccgggctcatgcgatcctcccacctcagtttccccagtagctggggactacaggcatgcaccaccacacccaatgaacttttaaattttttataaagacacagtttcaccatattgcccaggctggtcttgaactcttgggctcaagcaatccacccaccttggcctcccaaagtgctgggattacaggcatgaaccactgcacccagcaataacttagtattatcctctttcaagttgtcgacttgttccaaattctaagaggcttgggtctctgcagtttttttttttttttttttttcttgagacggagttttgctcttgttgcccaggctggagtgcaatggcgtgatcttggctcaccgcaacctctgcctcccaggttcaagcgattctcctgcctcagcctcctgagtagctgggattacaggcatgtgccaccacacccggctaattttgtatttttagtagagatggggtttctccatgttggtcaggctggttttgaactcccgacctccagtgatctgcccgcctcggccttccaaagtgctgggattacaggcatgagccactgtgcccagcgggtctctgcagtttatccagtaaagcaaatcattttaagacttgggctgaaatgacctcatcctacacttgcatcagggatgctctcatggcagaaaacatttccggaactccttcacagctagtttatgagccacatttaagtgattcattacttcaaaattacttttaaaaaattagccaactttattatgcatctatttgccagattttgttccagattttatctggaattcctcattccagatagctaagaagtcccattcttagccttcttcctgttcttaagtgtttgcatgcattcctagcatttcttgatctcttctgggcagataactactccatacacatctttagccctagcttcttgttttgttttgttttttttgagacggagtctcactcttgttgcccaggctggagtgcaatggcggtgatctcatctcactgcaacctctgcctcctgggttcaagtgattctcctgcctcagcctcccaagtcgctgggattataggcatgcaccaccacgcccagctaatttttattatttttagtagagatggggtttcgccatgttggccaggctggtctcgaactcctggcctcaggtgatccacccacctcagcctcccaaagtgctgggatcacaggtgtgagccattgcacctggcccctagcttcttgttcttaagctccagaccatgtttccatttcctgactaaacacatctatgtgggggcactcccaacccagtgttccccagatgaactcatttcttcacccccaaaacctgctcatcctcttctactccctatttaggctaatgataccatgttctcatccacagtctggaaatctccatctttatctgtgactcatttttggttacttgtccatgttttttgtttgtttgtttgtttgtttttgagaagagtctcactctgtcgcccaggctggagtggaatggtgcgatctcggctcactgcaacctccacctcccaggttcaagcaattctgcctcagcctcccaagtagctgggattacaggtgtgcacaagcacgcccagctaatatttgtatttttagtagagacggggtttcaccatattggccaggctggtctcaaactcctgacctcaggtgatccacccacctcggcatcccaaagtgccgagattacaggcatgacccaccgcgcctggcctgttgttgttttttaagagatgggtcttactctgttggctcaccatagcctctgggctcaagcaatcctcctgcctcagtcttccaagtagctagtactacagtcatgcactaccatgcccagcaatagtgtctttttattaaaagttgttaggatgactaaattaatgtttaatgtttacagtagtgcctcacagtaaataatctggccattacatttctttattgccagtgtccaatcctgttcagaacttaaccctgatgattcctttacgaagccttccttcccacattccaccagatatgtagttggcccctttcctcctcattgtcccattgtacttagtccctatctattagcaacatactattctatatttcccattatttgttgttctagtgtgtgtcacctacaatgctgcaagttcctttaaagtctgttcttattttttttctgagacagggtctcattcttggcactcaggctagagtgcagcggcgcaaacacagctcactgcagcctcaatctcccaggctcaagagatcctcccaccttagcctcccaagtagctgggaccacaggcatgtgccactatgccacttttttttttccatagagacagggtcttgccatgttgcccaagctgttcacaaactcctgggctcaaggaatcctcccaccttggaccccaaagtgctgagattacaggcgtgaggcactggcccctttaaagtcttatttctcaattatttatacatcttaaatgcttggtactatgtctaacacatgacaggtacaccataaatgttggctgaatctaatcagttactaaaacctgtcaatttttcttcccaaatgtcattctctctttcctgcagtatttcaagcccttatcctctgcttccttgaattactacaaagctcactaacactgccaacaccagtttcttacattcttcccattcttgcattctctcagtttcttgcattctttccagagtaatgggttggaagtcattcctcttctcaaaaacttaccggtaaagtccaaattccctagcatgcattcaaggccttccaataattggccccaaattacttctagtcttatcttccattatttcccttcattattcgtcttccagtaaactctatgctccagattacattagtctctgccttcttcaacattttcttcaccctttttttttttttttttgagacagtttcactcttgttgctcaggctggagtgcaatggtgcgatctcggctcacctcaacctctgcctcccaggttcaagtgattctcctgccttagccttccgagtagctgggattacatgcaccaccacgcccagctaaagttttttgtatttttagtagagatggggtttctccatgttggtcaggctggtctcaaactcctgacctcaggtgatccacccgcctcagcctcccaaagtgctgggattacaggtgtgagccactgcacccagccctcttatttgtttttattcatgctgggatctcaacttaaagtgcatattggtggaccttactttttgttttttgcccacaagcattttaagcagatgaggtctcaggacagggcggtggcagtgagccaacatcacaccactgcgctccagcctgggtaacagagtgggaccctgcctcaaaaaaaaggagacgggatctcagtctctcacccaggctggagtgcagtggtgcaatcacagctctctgtatccttcaattcctgggctcaagggatcctcccacctcagcctctcaagcagctgggactacaggcacatgccaccacacttggctaattttttaaaaattctttttgtagagacaaaggctcactgtattttgtaggctggtcttgaactcttgggctcaaatggtcctcccacctcagcctcccaaagtactaggattacaggcatgagccactgtgcctggcccacaagctttttcttttttttttttaatttgggccagcacttaaaagctgtgaaatttagcatagccaggcacggtggctcacacctgtaatcccagcactttgggaggccgaggcaggtagaccacctgaggtcaggagttcgagaccagcctggccaatgtggtgaaaccctgtctcgactaaaaatacaaaaactaactgggcatggtggtgggtgcctgtaatcccagctactcgggaggctgaggcaggagaatcacttgaaccagggaggcggaggttgcagtgagcaccactgcactccagcctgggcaacaagagcaaaactcggtctcaaaaaaaaaaaaaaaaaaaaaaagaatcaggctaatgatggggcaatagggcatatctcctaatgttacaaaatgaagaacttctctctcctgtgatgtgttctatccccagaactgtctaacttgaatctctcaaggccctatctaattttgtttagtaaaacgggctaggccaggcgcggtggctcatgcctgtaatccaagcactttgggaggccaaggcgggtggatcagttgaggtcaggagttcaagaccagccggcccaacataggtttaaaaccccgtctttactaaaaatacaaaaattagccgggcatggtggcacgtgcctgtagtcccagctacttgggaggctgatgaggcaagagaatcacttgagcccaggaggtggaggttgcagcgagctgagatcgtgccactgcactcctgcctgggggacaaagcgagaccccatctgaaaagaaaaaaagcagtcaagttcaaacgaccattctccagaaaactggctcaatcttttcttttctttgagacggagtcttgctctgtctcccaggctggagtgcagtggcacgatctcggctcactgcaagctccgcctcctgggttcacgcaattctcctgcctcagcctcccgagtagctgggactacaggcgcccgccaccacgcctggctaatttttttttttatatttttagcagagacggggtttcaccatgttagccaggatggtctcgatctcatgacctcgtgatccgcccgcctcggcctcccaaagtgctgggattacaggcatgagcccccgcgcctggccaatcttttcaacaaattagggttacacaaaaaaaggtggtttcatgaacccagatagagggtaaaagagaaataacctgatgtaattcgtggtcctggattggacccaggtttagacacaaattagctacaaaaggacttttcagacaggtgcaatggctcacacttgtaatcccaacactttgggaggctgaggtgggcagatcacttgagctcaggagtttgagaccaacctgggcaacatggtgaaaccctgtctctacaaaatatacaagaaacaaatcagctgggcatggtggtgcacatctgtggtcccagctgcttgggaggctgagatgggaggactgcttgagcccagcaggaggtcaaggctatagtgagctgtagtgagtcgtgattgtgccactgcactctagcctaggtgacaagagtgagatcctgtgtcaaaaaaaaaaaaaagacttttcttgggacaattagggtaatgtaaacatgggtttgtagtagattattcattatacattgttaattgtaaacacttgttatttaggtaatgtcaaaaatatttttatttttccaatgtatatactgaagtaaaaaattaagacaatgaagccaggtgcagtggctcacacttgtaatcccagcactttgggaggccaaggcaggtggattccttgagctcaggagtttgagaccagcctcagcaacatggtgaaaccccatctctacaaaaaatacaaaaaattagcccggtgtggtggcgcatgcctgtggtcccagctacctaagaggctgaggtaggaggatcacttgagcctgggaggtggaggttgcagtgagccaaaattacgtcatgcactccagcctcagctacagagccagaccctatctaaaaaaaaaaaaaaaaaaaaaaaaaaaattaagacagtgtatcaaagtcactgaaagagatgaaacaaaaaaaattttactagtattaaaacagattaagacaattccaggtgcagtagccccagctactccagaagctgaagtgggaagaccactagagcccaggagtttgaggctacagtgagctatatgatggtgccactgcactccagtctgggtgacagtgttctttctactccctccttcccccagttctcctgaccttaaaagtttagaacaggttggcaaatttttttctgtaaaagaccaagtattttaggctttgttccagctacttaaccctgctgttgtaatgtgaaagcagccacagacaatatataaacaagtgggcataactgtattccaataaagttttttacaaaagcaggcagtggggttgtaacctgtagtttgctgacctctgacctataacaagtaacacttcctgaaaagcctttcctgatacccatcagaatcaggagctttatcgtccttggctcacatattactagtaaatccacttagcacatttatgatcccttattatatattcatctccattagggactaagttctttgcaggtaggtgccattttgctacataagcctcctcatgttcactctagtgagtatctcacagggcagacattcaatgaatatttgtttctaaaaatcgtatcttctgtaaaaggacaatatgacaccattcataacattcacaagaatgagcagcaagttctaaaagtaattttaaaggagtttaaggggggaaaagcactgctaatgtcactaggatacatacattgcctcttatgctctatactgtgacatgcttatcagtattttataaacataccttgtgtgcatagaagcgcagactcagcacagaaatgccttttttttttttttcaagccactagagtatcaagagtactattaggtttacatcaggtgcatgataaatgctcaaatttaaaacaaacttctgggaggaggaaaagatatccctttttcttttcttttcttttttttttttgagacaggctcttgctctgtcaccaggctggagtgcagtggcatgatctcagctcactgcaacctccacctcccaggttcaagcgattcttgtgccttagccttccaaggagctgggatcatagtggcgtcccaccatgtctggctatcctttttcttatgacagggaaaggtagcagcaaatacttatgaagactggtttttttttttttttttttgagacggagtcttgctctgttgcccaggctggagtgcagtggcgtgatctcagctcactgcaagctccgcctcccaggttcacaccattctcctgcctcagcctcctgagtagctgggaggacaggcgcctgtccggctaatttatttatatttttagtagagacagggtttcaccatgttagccaggatggtctcgatctcctgacgttgtgatccacccaccttggcctcccaaagtgctgggattacagacgtgagccaccgtgcccggcctatgaagacttttttttttttttttttttttagacggagccttgctctgtcgcccaggctggaatgcagtggcccaatctctgctcactgcaagctctgcctcccgggttcacgccattctcctgcctcagcctcctaagtagctgggactacaggtgcctgccaccacgcccggctaattttttgtatttttagtagagacggggtttcactgtgttagccaggatggtctcgaactcctgaccttgtgatccacccacctcggcctcccaaagtgctgggattacaggcgtgagccaccgcgcccggctatgaagactatttttataagtaaataattatgaaacctctgcaagtacatttccctcctcacatttacgttcttagctaggaaacactgggaggtagagacttctctgcctgcaaaggaattctagattctaaagcaaagttgcttgtgggacaaaggaaaaagatatatacatatcttctgtagaaattatcccaaaaactcaggaccactcagggaagacatggaatttaggataaaggcagaccctgggaagcacacagttcagatcactagagagctttggctgctacagaacaggagataggagggaagaatgcaggagggtacatgggaaagcagctgtgaagtgcacactactcccagacatcctcctgaaagagaagttagcactaagataagggtaggtaacaaagtaaggaagaaagggaattaaggtgagagaaaggcaaaagcagaggggaaaccttctcaagaaagggagtaatgctgaagaatttagagagttgagtaaaaggtttattattagtgcagtcaacaccatggaacagcacatacaacacaaccagcaacctgcagagacactagtgcaaagggtagggaagcctttcactgagcttcctggctccatctgagggtaaggacaggacagtatgagccttggttaaggcaggtaggggaaaggggagtggaagaaatgtagtaaccagagtaagtatagcagcgttttcaaattcctgagcacaatgtcccagagctggaaccctactcccctcaagctttccaccccaatcccagtggagccatgatccaactacccagacctgcagcaagctagcctggaataaaattctgagaggaagccattacatggtggggaggagcctttctatctccaaccacactcccacctccatattaaaataatcacacctattatctctccccttctcttactctgccagtcactctagggatcaaggtataccccaggtaacctgaaatggaactgaagtccccaggggggtgtgggtgagacacggcacagcctgtacttagagataaaatttctgatttgcatggtgaagcttagaacccagctatacagctccaaggaaacttggggaagggggagttgccttcaaaatgaatactctaaatccagagttttatgataaggccctggaagggctaggaggaaatttttccagagggcacaggcatcgatgctggactgtcatatccttcacaggaagagaggaagctcctcatttcagttggggttacagaggtttggggcagatatcgtaagttcagccgaggactcccttggctcttcctatattaaagccaaaggttgtgctgaaaaggaaaaaatataaaacacacccccatccctgtcccaccctatccagaacccccacaataggaacatcaaaagaaaagtttcaagtttgatttttttttcttttttcctttcttaaaaaaaaaaaaaggaagtaaataaattaaattgccaacaatgtggctgagatagccatgatcaggccattcttaaaaaaaagaggggggggggcagtaggtggagtttgtgaaatataaacaaacaatggccaaagaaaattatcaaagtaactaactacagtcacagggctagagaggggtctatggaacaattatggcctgtgccacaagaggcagtgccaaccatattttagcaaaagctaggagtagcttcttgctaaacacatcaacccccaacagattaacccctaccctaaaccctggcattccctaattatgaaaacttgtaggaaagaagagctcatctggaaattttcagtatcccaacctgcatactggtagacccagtgggtgcctacacctttaaggtgggctgaacagggatactgcttggcacagaggtccagtctttccctaagggccatcagtgatggccaattaacggcctcactacttatttctagagatttggctccacccttaccatttcttcaggatgtctgctgcttagagtcaacaggcctgactgctctgattccctggttttggaggagagggacgattagagattccttcctctgtcctgatcctccagggaaattgaatctctttgtgctttctgaaaataactggaaccagggaccctaagcaggaaaatggatggaggtgggggctttcccacccagactgataatttatagacattttaggggaatatggcaaagggaggaaatctgggtttcccacctgaaaggctgagcaaactaccccaaggcccttcagtgccagaagggcagggagatgtgtggctcaggtataagccacagtattaagaatggtgggtaggactcaggtcccagctgctggagtgatgggattttctgatttccatctcttcctgatagccagtcgagttctcttatatctcttccacgccatgcgcaaatatcatgacaaggcctggctcttgcaccatgtcatcccccatgtgctggttctcacaggccatcacgacaacagcctgcttgccagggatgcgcttggccacgtagttctcatagtagcgtcggttcatctgtctagtctctagtgtggccagaccctggggccagctacgctcgtgggcattttcaatcagctcgttgacaatagaagcaggacagccactctccaccagggagcgcttgattacagcctggagcacagcatcaggagtcgagatcatccctccccagcgggtcactcttgctggctgaagggagttcacccacctgtgtggaggtggttaaagatggtcattccagctcatctcctttctctgtattggctttttctgctaatagaaataactacccactctgcactcagcttacctattcttccttctttccttccatcattggctcagaaaccccaaatctttccccacttggtcccaactgagtcaccacatgttactcaccagattaaattccacaagtctgcactctgtctctgttacttttctttgaaattccaatacttagcacatatagcgcctaacacagttagtgctctatgtttagtgaataaaacaattattcctctatcctatgtcccactcagcactatttgccctgtatatattgattcacacttacagtttactctatgaactgtataggactccagaactgaaagagatcttagacttcacttgtatacttcgcttgtttttgctgcattttagagatcactttcctggacttgcactctgcctcctcttctctgggttgtaagctacctgaagacaggacgatatcttctatttctttttggccctcctagcactccacagcctttaatacagggctttgtacatgggtactcacctaattctggataaagtgcatccttgggcaggctttccctccatccacccaaacacataagacatcctgtagtggagctaagggttatcctcttctcctctgcccctgtccttaatgccaatatctgagaagcagtgacccccagcccagctctccaatgccctccttctgctactctcctgctcttcctcctttcaggccttgttgtcaggacatgaaatcactccacgtcctgagtgacactcactctaggatctcgttgtattcaattgtctcctccaggttctgaaggttggggttgacactgcggattgcacgcatgtatgcctttagcagctggatgtctcgcttctgttgtggggaagaagaacaggaataatggttaaggcagacagcagaaaaaagacaaaagtttatccaagaatgagggcaactgagagatctgaagaacaaccagtttgtaagcttcaggaagacagggataagactgtctcactcacagctgtctccttagtacttacaaatgtgccttcacagaggaggcatgtgataactggtaggtgaattaatgctatgaatgggatgaagaaaagtcaaggagagctccaatctgattccctgctaagccacaggcagaatatccactcatctaggctcacaagtgtaagcactggtctgtgtgttcacaactggtttttattacccacaggcaggcagttatctgcatatgagggatatgttctcccccgtgtcttggggcctacctgctccgccagctggtgtttgtgttcagctgacgtcttctccagctctgcgatgcgtgtctgctgctgctgtaccactgagcgcaggtgcttaatgcagttatggttgggcagctcatctttgggcatctccaggctgcagaccagggtggggaaagagcagaacagaggtgatccctgggacatgtatgcaaatggcctattctgtggcagataactgctaagtagattttgtcctacccaaaatttctaacattcatttcaggcctccctcttgtttattcccttcactttcttcgtccaagcttcctacttgcccctttgctgtctattttccttaaatttctttccccaatcaagacacagtgttttatctattttttaaatttattttattttgtatttttattattttttttgacacggagtttcgctcttgttgcccaaactggagtgcgatggcatgatctcagctcagcgcaacctctgcctcccaggttcaagcgattctcctgcctcagcctcccgagtagctgggattacaggtgcgcgccaccatggccggctaactttttgtatttttagtagaaatggggtttctccatgttagccaggctggtctcaaactcctggcctcacgtgatctgcccccctcggccttccaaagtgttgggattacaggcgtgagccaccgcgcctggcctttttttttttttttcgagaccaagtttcactcttgtcacccaggctggagtgcaatggcacggtctcagctcactgcaacctccgcctcatgggttcaagtaattcttgtgcctcagcctcccgagtagctgggattacaggtgcccaccaccacacctggctaatttttatatttttagtagagatggggtttcaccatgttggccacgctggtcttgaactcctgacctcaggtgatccgcccgcctcgtcctcccaaagtgctgggattacaggcgtgagccaccgcacggggcctatttatttattttgacacactgtttttatctactgcacagctctccttttcctcctacagattctgcctgtgcacttattccttcagagaagccctatattcacagccccagctatcaacattctttttattttttagttagggggaacagagtctcattctgtcacccaggctggagtgcaatggcgcgatctcagctcactacaacctctacctctggttttaagtgattctcatgcctcagcctcctgagtagctgggattacaggcgagcaccaccacacttggctaattttttttttttttttttgagacggagtctcgctctgttgcccaggctggagtgcagtggctcaatctctgctcactgcaagctccccgtcccaggttcatgccgttctcctgcctcagcctcccaagtagctgggactacaggtgcctgccaccacgcctggctagttttttgtatttttagtagagacggggtttcaatgtgttagccaggatggtctcaatctcctgacctcgtgatccacccgccttggcctcccaaagtgctgggattacaggcgtgagccaccgcgcccggccccacacctggctaatttttgtatttttagtagagacaaggttttgccatgttggccaggttggtcttgaactcctggcctgaagtgacttgcccacttcggcctcccaaagtgctaggattacaggtgtgagctaacatgcccttcagctatcaacatttagtcgaatatttcataacccacagaaataaaaaaatagggcaagaggaaatatgagaaggctggcaattatagcagtcaacctgacaaacggaaagtagtattggactgaaagggaagaatagagtcaatcaagctttaatgttattacacaaatttactaaattgctgtgccccttcttttgttaaagcaagagcaaaatgattatagttggaaaagcagcaagaaagtaagatcttagagcaggaagccaaggaggctaagaatactccttgccaacatgccaaagagacctcctcagctagtgaggagggcagccagagacaggggcataaatgagatggcccttatccatgtggggcagaagggaacaaatctcacccacagccctgttcacaggtcacaggccgcttcgggttgtgctcacagtcgctgaggtgagacatgaggttgtcaagccggacaacggcactacagccgaacacagcgttgtcacaggcaatctgcagctttgacaacatgttccgcatgatccgaggtactgggcgcagatgggcgaccgtcacaacactacggtccactggacatgtctgttgctgagagaaccactgggtgatgcaggcgttgcagaaagcatgttcacaatgaggtgcctagaagagagaacaaggcaaaaggggcgcaagggaattagcaggacctaagagcctggatatgatataactctacaaagccaatcaagcctttgagcagcctctacgacaagaggtccactgggtcacagcaaagtatagatctactacgggcaaggcattgtaggggacaggcttaagatacgtttcctgctgggcacggtggctcatgcctgtaatcccagcactttgggaggctaaggcaggcacactgcttgacctcaggagtttgagaccatcccagacaacatgacaaaaccccatctctacaaaaattacaaaaattagccgggcataggccgggcgcagtggctcacgcctgtaatctcagcactttgggaggccgaggcaggcggatcatgaggtcaggagttcaagaccagcctgaccgacatggtgaaaccctgtctctactaaaaataaaaaaattagccaggggtggtggcgcatgcctgtaatcacagctactcaggaggctaaggcaggagaatagcttgaacccaggaggtggaggttgcagtgagccaagatcacaccactgcactctagcctgggcaatacatctcgaaaaaaaaaagctgggcctggtggcacgtgcctatagtcccagctagccaggaggctgaggtgggaggatggaggatggcttgagcccataaggcggaggttgcagtgaaccaagactgcaccactgcactccagcctgggtgacagagccagaacctgtttcaaaataaataaataaatatatatatatatattccctgtgctcaagattaaaaatgagttgtgaaacaagacaaacaagtaaaaagttatataacaataagagatacaaatgatattctaggacaataggacagatgacacaaggcagccaattattaattgccatctggattgcatacacaataattgccaaaaatgtccagaggagggtgaggtcttttcaggctagctcaatcacggcaggtatttatgaagaggacagaatttgatatgggtcttgaaggataattcagatgatagatttagagaggaggaggacatatttactggcaaaaattcaatgtaagaaagctaggccaggcatggtggatggcgcctgtaatcccagcactttgggaggctgaggtgggcggataatgaggtcaggagattgagaccatcctggctaacatagcgaaaccctgtctctactaaaaatacaaaaaattagccgggcgtggtggcgggtgcctgtagtctcagctatttaggaggctgaggcagaagaatggcgtgaacctgggaggcagagcttgcagtgagccaagatcatgccactgcactccagcctaggctaaagtgtgagactccatctcaaaaaaacaaaacaaaacaaagctaaataaggccgggcatggtggctcatgcctgtaatcccagcactttgggaggccaaggcaggcagatcacttgagatcagttcaagaccagactggccaacatggtgaaacacagatatattcatatatacatatgtatacacaaatacatatatatgcagacatctattcatatttgcttatatctgccttaagacacactggaaggataccaaataaactaataaaaatagttatctgtgggggaattaggtgcacagtaataaagacagaagtgagaattctcactgtataccttttgatttctgaactatgttcatttttcacctattcaaaaaataaataattatgatgtggggaaatcagcatccctagcaggagccttctaaccttagaaatgtgtctgggaacctggcatcatgagggttgcctgctctgctcctcagaagataaagcctggaggtagatgggtggcttctgactagactgtcaccaactacgactcacctttccataagtgacttgcctaaaatgatagtgccagaaaacagacaaggccctgccagggtgaggagggaacctgacacaccctgtgacctcttgacactactacttgatgacttgctccacacccatctaatatgcctctaatggcagcagactgcaaaggcctagaaagaagacaggtccagagttggttgccattggaatgcagtctgaattttattcagctcaaggcatcagtactccttttggagtagtactgggagaaaaaataaaggctcaaggggagcccctgggagttaggtgagcagtgaatgggggaagggccatgaaacctcattgcctagtgtcctggtttggaaaatgtgataatctctagatagccaggaaagagaaaggattaattggtatttacagaatgagggcaataaggatcctggaggatgctgtcccatgaatacaactcttaaggattcacctcactcattgtacttgcctggtaatcgtgagcttctcctcatacttgccccaggatgatacaactgactctggtctggcaaggctggcagagaaatgacctattgaaggtggcagctttcacatcaaaatgcagagtgcatggctgtatcaaaagctggtcttttcagtagatcccaggaaaaaaataggtcagtacatacagttccccacttcctatttgtttttgtttttttttttttgagatggagtctcactctgtcacccaggctggagtgcagtggcacaatctcggctcactgcaacctcctactcccgggttcaagcaattctcctgtctagcctcctgagtagctgggactacaggtgtgtgccaccacgcccagctaatttttgtatttttagtagagacggggtttcaccatgttggccaggatggctcttgaactcgtgatccacccaccttggcctcccaaagtgctgggattacaggtgtgagccactgtgcccagccttcctatttgttagacagtaggcaggtagaagaggcctgcagggagcctggctgattacctgaagcactacatcataaaaatgcagagagaacttattaggagagtccagaagttcaatcacggacaggaagatggaacctagtaagagttcctgtagaggaaaggaagctacccagctactatcacaagacagaaacaagcagctgactgttttacaggagaaatctttcagagtgacctcagaaaaaaatctgaaccactggatctctgtggcatccacctctagattgattctggaaggccttattcttgtagtcaccattactcctttgacctaaatctctattgggtgagggtggagagaagaacacagtgacttcaccatgggtcccgctgcccatgaatattttctactagttccactgctacctgttgccccaccaaacctgccatcagaccaactcacctgtactggctcctccaagactccactgcaaatagggcagataagatcttcgtcaacatccccctggaaacgggttacatcataccccatgtctcatcactgaaacccaggtcctgaaaggacaacaggaaaaagaggccagttcagaagaagcctacaaatatgtgacaaacatacactcattgccaagatccattcatttatccaacaaatatttactgggagtctactatgcagcagtcatttggctcggtggaagctgactcaagaaatttaattctggccaggtgcagtggatcacgcctgtaatcccaacactttgggaggccgaggcaggcggatcacctgaggtcaggagttcaagaccagcctggccaacatggtgaaaccctgtctctactaaaaatacaaaaattagctgggtgtggtatgcgcatctgtaatcccagctactcgggaggctgaggcaggagaagcatttgaacccaggaggcagaggttgcagtgagccgagatcgcgccactgcactccagcctggggaacacagcgagcctcagtctctaaaaaaaaaaaaaaaattaattctaaggcctggcacagtggctcacgcctgtaatcccagcactttgggaggccgggacaggcagatgagctgaggtcaggagttcaagaccagcctggccaacatgatgaaaacccagctctactaaaaatacaaaaattagctgggcgtggtgatgcacatctgtaatcccagctacttggaaggctgaggcacaagaatcacttgaacccaggaggcagaggctgcagtgagccgagattgcaccacagctctctagcctaggcaacagagtaagactctgccttaaaaaaaaaagaaaaaaagaaatgtaattctaatgggggaagacattatataagcacacatttaaaatataaagtgataaatactcagagtagagacaggaccttatgaggacaagagacatgaatacctaacccaggctgaaagcagagggtggttttgacaagttttccaggactgggcgtcaccagaaacgtgtcctgtagggcaagagtcagctaaatgttgggggagcagggcattagggtgttatgcacataaaatagcacatccaaatgcccagaagagggcatatgataggttcagagaatttcaagtgattcaagaaaaggctgacctgagaggtgggagggagggcctgtcaagagacaaggctggagaggcaagcaagggccatgctgtgaaaagtctgtgaggattttggactttattctgaagggtatgagagagccactgaaggacttaaaaaacaatgtgataatagttccattttagaatcagtatgttaacaggggagaaactggagaccggaagaacatctaagtcaggagagtgacggtaagagtctgaacttaggtggtggtggtgatggggataaagaagagaagagagggccgggcatggtggctcatgcctgtaatcccagcactttgggaggctgaggcagacggatcatgaggtcaagagatcaacaccatcctggccaacatggcgaaaccccgtctctactaaaaatacaaaaattagccaggcgtggtggtgcgcacctgtagtcccagctactcgggaggctgaggcaggagaatcgcttgaacccaggaggcggaggttgcagtgagccgagattgcaccactgtattctagcccagtgacagagcacgactctgtctcaaaaaaaaaaaaaaaaaaaaagagaggtccaaaagagcaaggactcaaacagcggcaatggcgccatgccccttctttgggctcccaaaggtcaaacccaaagaagaggtcagtaaacaactggctgggcgcagtggctcacgcctgtaatcctagcactttgggaggccgaggtgggtggatcacctgaggtcaggagttcaagaccagcctggccaacatggtgaaaccccatctctactaaaaatacaaaaattagctgggcatggtggtgggcacctgtaatcctagctacttgggagggtgaggcaggagaactgcttgaacccaggaggtgaaggttgcagtgagctgagatcatgccactgcactccagcctaggcgacagagcaagactctgtctcaaaaaaaaaaaagaagaaacacataatccttgtcctcaaactaaggtgtaggcttgagcccaatgagtacataggaaaaaaaacacataaaaacacataaacgtattaagcaaattattaacaagtaaaagtcaataatttatgtaagttgtaaatatacaaaaaagaacaaatggtacagattaatcacagaaagctttctgcagaaagaagttttaagaactggactttcaagggcagaaggaatcccgagcgacagagaagagggttgaggcctggaatgggattctgaatcaaagctctttaccttccaagtgttggggggcaggttccctgttcacaaggctccaaccccctgatgcctccactcagtgccactgaagagattctcccagtaacccatcttgttggctattctccgactgagtattccttcccagtgacaagctccatcgcccaggggatgaatgtgatgtcacaatcaggagtactctagtaataggaacaaggaagagaaaggagagtcaggagaactacctccacttggcaaggagactggacagatggatctggcagttggttggggaggatgagacaactccattaagcactacagttttcagtgctaggcaaataagactaccttctaaggagggagctcaccagctaaggaagcacacacacggggtccagtagatttgaacatagctgggagggggaaagaaaaggacaagagaggccgggcgtggtggctcacgcctgtaatcccagctcttagggaggccaaggcgggtggatcacgaggtcaggagatcaagaccgtcctggctaacacggtgaaaccccgtctctactaaaaatacaaaaaattagctgggcgaggtggcaggcgcctgtagtcccagctactcgggaggctgaggcaggagaatggcgtgaacctaggagctgcagcttgcagtgagccgagaccgcgccaccgcactccagcctgggcgacacagcaagactccgtcttaaaaaaaaaaaaaaaaaagacaagaggaaaagtagaggagttgttggagatttaagattcttttattcagtgcacataactaccagtaataatgattccaaatctgtgactacaaaatgcatagatccaggttgcgatggctcacgcctgtgatcccagcactttgggaggccgaggcgggtggatcacctgaggtcaggagtcggagatgagcctggccaacatggcgaaaccccatctctactaaaaatataaaaattagccgggtatggtggcagatgcctgtaatcccagctactcaggaggctgaggcagggagaattgcttgaacccaggaggcggaggttgcagtgagccaagatcgcgccactgcactccagcctaggcgacagagcaagactctgactcaaaaaaaaagcaaaatgcatagatccataatacattatgtgtacaggatgatgctttaatgcagaggtccccaaatccccagatggaccagtaccagactgtggcctatcaggaaccgggtcgtacagcaggaggtgagcaggaaacaagcgagcattaaggcctgtgctccatgtcctgtcagatcagcagcggcatttgattctcattggagcatgaaccctattgtgaactgcccatgcgagggatctaggttgcccactccctatgagaatctaatgcctgatgatctgaggtggtagagttccatcacaaaaccatcccctcgcccaccatctgtggaaaaactatcttccacaaaaaggctggggatgctgctttaatgtttccaaagtgctttcacataaattattattattatttcgagatagagtctcgctctgtcacctaggctagagtgcaatggcgcgatcttggctcactgaagccttggcctcccgagttcaagtgattctcctacctcagcctccagagtagctaggattacaggcacccaccaccatgcccggctaatttttgtatttttagtagagacggggtttcaccatgttggccaggctggtctcgaactcctgacctcaggtgatccacccgcctcagcctcccaaaatgctgggattacaagtgtgagccaccgcgcctggcccacataaattattattatttttttgagatagggtcttgctctattgcccaggctggagtacagtggcatgatcatagctcactacagcctcgccttcccagcaggctccagcaatcctcccacctcagtctcccaaatagctgggaccacaggcacacaccaccatgcctggctaatttttgtatttttggtagagatggggttttgccatgttgcccaggctggtcttgaactcctgggcaggctccagcaatcctcccacctcagcctcccgaagtgctgggattacaggcaccagccactgcgcccacccccaaatctacacatttaaacaagtcaagtaaccctgctgtagtttttctgttgcttcaactgtcaagtagggaaaatgatacctgccttatatattaatataaggtatatataatatatacatatttattatatatatatatgttattttttttttgagacaaagtgttgctctgtcgccaggctggagtacagtggcacgatcttggctcactgcaacctctgcctcccgggttcaagcgattctcctgcctcatcctcccaagtagctgggactacaggcatgtgccaccatgctgagctaatttttgtatttttagtagagacggggtttcaccatgttggccaggatggtctcaatctcctgaccttgtgatccgcccgcctcggcctcccaaagtgctgggattataggcgtgagccaccatgcttggcctatttttctttttttttttgagatggagtcttcctctgtcgctcaggatggagtgcagtgatgcaatctcctcagctcactccaacctccacttcccaggttcaaacaattctcctgcctcagcctcctgagtagctgggatcacaggcatgtgtcaccatgccaggctaatttttattttatttatttatttatttattttttttttgagacggagtctggctctgtcacccaggctggagtgcagtgatgcgatctcggctcactacaagttccgcctcccaggttcacaccattctcctgccccagcctcccaagtagctgggactacaggcgcccgccaggacgcccagctaattttttttttttatttttagtagagacagggtttcaccacgttagccaggatgatcttgatctcctgacctcgtgatctgcctgcctcggcctcccaaagtgctgggattacaggcgtgagccaccgcgcccagccaatttttatattttagtagagacagggtttcaacatgttggccaggctggtctcaaactggcctcatatgatccaccacctttggcctcccaaagtgctgggattacaggcgtgagccactgcgcccggcgtaatataaggtgtatatatgtgtgtgtgtgtatatatgtgtatatacacgcgcgcaccccttatacatactgtctgcaaatcaaatgaaataataaatacgaaaggaggctggacgcagtggctcacacccgtaatcccagcactttgggaggccgaagtgagtggatcacctgagtccaagagtttgagaccagcctgggcaacatagtgaaaccttgtctctacaaaaaatacaaaaattagccgggcatgatggcgtgagtgcctgtagtcccggctactgaggaggctgaagggggaaggtcaactgagccgaggaggcagaggttgcagtgagcagagatcgcagcaccgcactccggcctgggtgacagagtgagaccctgtctcaaaaataaataaataaataaataaataaataaataaataaatatgaaaggatactgaatactgttatcctcaagtaagattatttgtagcaacagaatacaaaataaggctgggtgcagtggctcatgcctgtaatcctagcactttgggaagccgagatggaccaatcacctgaggtcagggttttgttttgttttttttggcggggggtgtggggagacagagtctcactctgttgcccaggttggagttcagtggtggaatctcagctcactgcaacctctgcctcctgggttcaagcaattctcctgcctcagcttcccaagtagctgggactacaggtgcatgcagccatgccccggctaattttttatatttttagtagagacggggtttcactgtgttgcccaggctggtctcgaacttttgagctcaggcaatccgcccgcctcgtcctcccaaagtgctaggattacaggcgtgagccaccgcgcccggctacagtcagaggtttgagaccagcctggccaacatggtgaaaccccatctcaactaaaaatacaaaaaattagccaggcatggtggcaggtacctgtaatcccagctattcaagaggctgaggcaggagaatcgcttgaacccagaaagaggtggcactgagccgagattgtgccactgcactccagcgtgggtgacagagtgagactccgtttcaaaaaaaaaaaaaaacaagaatgcaaaataaatttagagtactgagagtcggagaggaaatgcttgacaaaagcttgttccttctttttactagaaggcagggctagccacaggtcggtcggcttaacattgcatcactcacattccctaccactagtccactacattcttatttggggcaaaactatcagccaacaacactatcagtctcttgccctattgtcagactctaaaacccctgtatagaaagggataacactatcacgggccagtccccaagaacagtggcctcaataacagccccacttgctattaaatgaaatgaagtttctgaacggggaagcagtctgtcaatccctcaagcaaaacgccttcacccctcctggctttctgctcttcctctagccccctcctccccactacccaatttcccaaagtcctgagttagggaaggccttccagtgtgtggtgtgtgaaccctgccagagagccaggctgcaaaccaagcgcagggatgtgaagaatgtgagattccttcatggagggctgggagggggtgaggagcggggaaggaatgagaggacaaggctgccaacgacaaggcatgggagaggagccaagctatggcgcttcgagggcgggggtttaggttccaccgcccctgcccaggctggcccccggaatgctcccttcctccccttctggcccgtcaatcattgcccatttaaacaccacgctgttcccccagttctgcaggtgccggtcctccagctagccccggccccctcccgcacttctcaaagctcccctattccaatggaccttccccaacaacccgttctccagagcccccttctcacctcccgactcctcgccagtgctgctcccttctcacatttttatctctaccaccatccctcctcctgaaccccagttatttcaaccccccgccccaatacccctgggacatcacctcctcccctcccacaccctcttttaggtggaagatcgcgcaggcgcagtacgcaccgccctggaagcggcctggagtctccgcaacctgacccagtcggagctgaggccgcagcggccacagtactgccctggtgccgggtcccagcctctcccgggaagggaagggaaaggggaaggaggggaaagaagactcctaccactcgtcgccgcctcagacggatcctttgccccgcccaccgctgctacgcaacccggcggaagctcgtcaccaaaccccgcctctttgtttaactcagcccctacaccagcagccaggagctgcctacgaggagggacgaaggctggccaggcctccactctagacaggaagtctagtctagagtctatatggtcccagccaggactatgtagccatttaggagggagaactctatgttcttcccggcaaaaacgtgtgggcctggccggccacgcttcgctttggaggggtgcaggtgacttgtgtcttagagctgacgcagattgttgcgagatcattgcggagaggcaggcctgcagcgtgacctgctgcgggtccggcccctctcccttttccagagccctggtcagcatcccagagcttcgtaaccccttgactcctgtcatgggaatggatattgcagttaacaaggcggccgcggggtggggagtgagggagtctgaccgcaaagctt

SEQ ID NO: 55 - DNA, 150275 bp, Homo sapiens
acagttcaatagtgctttcattattttctaatcaattataccttcaaagggctatttcattataaatgatgaaggctacagggcacataagtaaataaacacataagtaaataaactatcacattcggattcttaactaattacacaactactagtagcaagccattccagtggggttttcttcgtatttctaatatctttgtatacataaacattactatacaaatgaatacaccatatacttaaataagttaatcaatcactaccagatataatataggtcaaggctttccacctgataaaattagatcagaatcagtgttaagacttagaaaagcctaaggatcacccagtctgatcctttcgttttacaaatggatttagcaaatgtagtaaactggtgaacaaggaaaacattcaaatgctaatctactttttcaggaattagtccaaatcctaaaaggaacacatagtagatctcagtttagactttaaaaatgacatcaaattttagctcagctaaaggtgttactattattaccacacttttaaggtgtaagtgggagcttccttttcactttcaacagtattaaatccacagctttgaattctgtttcaagacactttttcaatgacaggaaatgcagaaaggagaaaaatcatggtcaggcatttaaagacctcttatttgacaactaattcaaagaactaacagcgattttctttaaaaagctgaatcaaagagttcacatgcatagtataagactattataaaaatattttcttcacatttgcataaaaatttttcaacacacaaatggcttttaaacccatgaaaatatgctcattaagagaaatgaaaattaaaataacaaaacaacaaaattcctctcacatttgcagaaatctaagtcacttggcctagaaaaagatttgtcgttggaatgctgactttatgattctctaattttaaaacttttaacaatcatttctatttaagagcaagtctgagctcattcatgtgtatgtgcctctatttatacataaaatttactactaacatatttttgagaaagtaaggagaaaatagatatactttcatatttctgatggaaatataacctctatgaagaagaatttgacagtaactatgaaaattaacaatactaatatcctttgacccagcagttccacttctaggagtttatcatacagactctcacatatgagagataccacaggtacatggatactcactgcagcacttcttgtagtagcaaaaaactggtaacaacttgaatgtccattaatagaagactggctaaaattatagtagactcaaaattgaacactactgcagccattaaataagtgacaactatataaattttaacatggaaagatctctaaaagatattaagtcaataatgtgttgcatacagcaccatgagttttaaaatttataatatatgtagagacacatactcacgcatgggcacatatatgcttataatttaacagaatattcctagcgtgcataaagaagctggtaataactatcaagaacaggcctgggtagttggggaatgagggacagaaaagtacttctcactctataccctttttaaaaatttcattctatttacacttttcaaaaaaaaaacaacaacttttcttttttttttttttgagacagtgtcttgctgtcacccaggctgcagtgcagtggcatgatctcggctcaccgcaaccttggtctcccaggttcaagagattctcatatctcagcctcctgactagctgggattacaggtgcgcactaccatgcctggctaatttttatatttttagtagcagcagggtttcgccatgttgaccaggctggtctcgaactcctgacctcaagtgatacacccacctcagcctccccaagtgctgggattataggcataagccactgtgcccagccaaaaaaatttaacttttaaaatacttatttttaaatttagatatctgacctatggtgtattccaaatcaaagaactctcaaattttccttggtcaatagtttttaaattcaagattcataaagtcagccttccaaggacaaatcttgaagcccagtgagtccgtaatcaacatcagttccggcagaattaaaatcctaaagtccagttctaagcagaaacacattattatttatattacggtagaattagagtggtaaaactgagacctcacctgaccaggtctccatgaagctgtaaataaagactttctcttccctctccagcacatatttctgatgctggtgtctctacagtgcaaaggacgagatgtaagtcagaggaagaggaggaggaggaagaggaagaggaggtggtggtggttgtagtggcagtggtagtgtctgctccataaaggtaaacacagcctctctttacatcttctcttagccagtctctttctcgagaaccaaacctacttctcctattcaaacaatttctgctcccattgcgtttcatatttctctaaaaaatatcaagagaaagaaatcgttagctagaacatctgactgaattagacatttcagtcctcaccccacctctctctactttatattccccaacattctgctcaagtatcccctccttttgtggagcacttcacatctatcatgctcattcgtaataactcagataacttaattttctttactgctgtctgtgtttccatccatcatcttcgttgacctctcttttccttgtgttttcagaaacgtgtcaagaataacgaaacagcgggttgcagtggctcaggcctgtaatcccagcactttggggggccaaggtaagaggactgcttgaggccaggagttcaagactagcctaggtaagatggcaacatcccatctctacaaaagaaatttttttttatatattagccaggcatggtggcacacgcctgtagtcccagctacttgagggtggagaacagattgagttggagaacagattgaacccgggagattgaggttgcagtgagccgtgattgtgccactgcaaccctatctgggtgacagagcgagaccttgtctctcaaaaatagaaattttaatattttgcctgggcacagtggctcacatctgtaatcccagcactttgggaggccaaggctggcggatcacctgaggtcaggaattcgagaccagcctggccagcatggtgaaaccctatctctactaaaaaatacaaaaaaattagccagctgtggtggcacacgcctgtaatcctagctacctgggaggcagaggtgtgaagattgcttgaacctgggaggcagaggtttcagtgagccaagacagcgccactgcactccggcctgggtgacagagcaagactccatctcaaaaaaaaagaaactttaggctgggcaaggtggctcacacctgtaatcccaacactttaggaggcccaggtgagggatcatttgaggtcaagaattcgagaccagcttggccaacatggtaaagccccatctccactaaaaatacaaaaaaaaaaaaaaaacaaaaaattagccgagtgtggtggcacgtgcctgtaatcccagctacttgggaggctgaggtaggagaatcacttgaacccaggaggcagagattgcagtgagccgagattgtgccaccgcactccagtctgggcaacagagactctgtctcaaaaaaaaaaaaaaaactttaatctataaaccatacacagtattgtcttatctaatttaaacttcatctaatccttaacaatacttatgtttcaccctgtaattttatttagttcaatattgctttagagatacaactgtgttaatatacccagttcattcatttgaataatattcccttatacaaatacaccaaactttatccactctcctgttgacagcattcagtttgcttccaatttttcactgctagaaacaatccagcaataaacatttttgtacatgtctccttatgaaaatgtgtgtttctctagggtcctaaccctttgctttacatcccaaataagccaagtgtagtatcaacacaatactgcacaaatatactttccattcctgccctgtttcaaaaaaaattaatgtcgcatttgataatttaggtatgtgaaattcatatattgccaagttatctcaaagcaaaaacaatttctacaggtaatataacaagtttctaaagatcagcatttgcctgctctatttttatgatgggctatttctgttctttttgataaaaaagaaatttccactgacatttccgcagccatacctctccagcttcgttccctactactgccctttactccatgtttcaatcacctccaactacctgcagctctccaaacacaccaagtacaccacaattctgtggcctgtctgaaatggctttctccacctcatccatatgacaagttattcttcaaaatcctactcaggcatcaccttctctatggagccttccatatctcctatccttattctccctagacagaattaatgactaccagacatttttactagacagaattaatgaattatctagacagaattaagaacttcttcaccttgagtacacctctaatactacatcgatgacaatgggttttatttatttatttgatatttcttcctcttctccatttctagcatgttaacacctgggtgacacagaagtgtttgtagaactcagctgacatcacagaaacctattcccaatctgtaccttagtccaattagctctggcaagaagctgaacaaacttgggggggaaaattcccatttctatggagaaccctacatctttgcagcagctgcaaagtgaatgggagtaaataaaatactttcagtagtattcctcattggaaaatagaaatacctataaatacagcaaatactatttttataattactaagattaaatatttgagggtaatacatttctaaagatgtcagagaaagaggaatgaaaagttagcaggtatttctatgtgggaaaaaagaaaaacaagagtaagaatggctttattgtttaaatttagaactcaggaaaactgatcattttgcagatcttggggatttaggcattgctattcaaaaccatgaggattattgaatctaactttagagaagtaggataaatccctgctacaagtgagaactagttttctcatcaaatgcattttctcaaagctgaacatctcagaatgaaagggctttcaagggcttactgcataaacatagggaccatcgtatttgtactaagtaattttaaccactgaatagtcaaatactgctaatagttaaatatttagtaggtaaatactgttaaattttaaatactcctcattttttaatctttgggaaagattaactggaccatctgaaaacagtattccatatagtatagcaatatttatacaaagctccgcattctctactcagtggagaaaaaagagtaagcagacactgtttcacacaaacaaaaaagtcgtcttcagaacaactttctaaggtcaaataatggtccactgaccttctaaatcttagaaaagtcaaggaagactccaggaagttttgtttgttttgagacacgatctcgctctgtcacccagcctggactacagtggcgtgatcatagcccacggcagcttcgaactcctgacctcaagtgatcctaaagcctcagccttcagagtagctgggactacatgcacatgccaccacacccagctaattttttgtatgtttttaagagatggagtcttgctatgttgcccaggctggtcttgaatttctggactcaagcaatcctcctgcttgggccttccaaagtgctgggattacaagcatgagccaccacaccaggcctgatttttcttctgtgaggatttttaacagtcatttttagtgcatatatatttaccttagattataaattccttaaggaactttacattatcaaaacatatatgcggtcgggcgcagtggctcacacctgtaatcccagcactttgggaggccaaggcaggcggatcacaaggtcaggagttcgagaccagcctggccaacatagtgaaaccccgtctctactaaaaatacaaaaacattagctgggcgtggtggtgcacgcctgaaatcccaaatacttgggaggctgaggcaaggaaatcacttgaacctgggaggcggaggccacagtgagccgagattgcgccactgcaatccagcctgggtgacagtgcaagactctatctcaaaaaaaaaaaaaacaaaacacatgcctgtaatcccagcacttcaggaggccaaggagggaggatcacttgaggtcaggggttcaagaccagcctgggcaacatagtgaaaccgcgtctcaaaaaaaattaaaataaaataaagattaaaacaacaacaacaaaatatacacgctgttggtcatcatttacctcaaaggatctatctcctgtctacatgatacattccgccctaagaagataaactgctaagttacaacttcagtatatatcattctcttaaacctgaccgatgggcacttaaaaggcctggatattaagcaaagcaaaggcttacagcaacaatctagatggactgtttagctgttattagccactgctgaattgcctagtgcttccttcttctcaagaatgtcttgctccactgcttaacacatcagttaactgctggaaaaaccttcctaggagccaggactgcagatgacacggtcctctgaggtgctttcaacttttagaatcaccattctactggaattgctaggttgagaaaattattttccccttactcttatagaattgttatcacaaatttatttgaaagggaacacaatgacaattacctcttacatcaaacaagtatacaaagagcgtattttagatttaaagatctttctagccgggcgcagtggctcatgcctgtaatcccagcactttgggaggctgaggcgggcaggatcacctgaggtcaggagctcgagaccagcctggccaacgtagcaaaaccccgtctctattaaaaatacagaagaattacccgggggtggtggcacgcatgcctgtaatcccagctaccctggaggctgaggcatgagaatcgcttgaacacagtaggtggagactgcagtgagcggagatcacgccactgtactccagcgtgggctacacaatgaggctatctctctaaaaagtatcttttttaatttttttggcattaattgtttatacatactttgctcaacacccaaaactattcttgaaaaaaaaaaaagaatctcatgacacacaccgacattagttgtaacttcgtatcttctataagctatgggcctgggtgacacaaggagactctgtctttaaaaaaaaaaaaaatctttctagaaggcaaaagtcttgagggtaagccatgaattaaatacccactgcttcaattttacacttttgtttgtttgtttttttggagacagcatctccctctgttgcccaggctggagtgccgtggcacgatctcggctcaccgcaacctccaccgcccgggttcaagcgattttcctgcctcaggctcctgagtagctgggattacaggtgcacaacaccatgcccagctaattttttttttttttttttttttttgagacggagtgtcgctgttgtccaggctgcagtgcagtggcacaatctcggctcactgcaggctccgccccccggggttcatgccattctcctgcctcagcctcccgagtagctgggactacaggcgcccaccacctcgcctggctaattttttgtatttttagtagagacggggtttcactgtgttagccaggatggtctcgatctcctgacctcgtgatccaccagcctcggcctcccaaagtgctgggattacaggcgtgagccaccgcgcctggccacgcccagctaatttttaaaaatatttttagcagagacggggtttcactatgttggccaggctggtcttgaactcttggcctcaaatgatccacccgcctcggcctcccaaagtgttgggattatagtagttagccactgtgcccagcccagttttatacttttaactctaaaagtgttccatgagggcaatgatcagttcaaaggtgatatactattacacactcacatacaataataagatatacatggtataaacagggtctggtaaagtaactctccatattcagttagttctgcaagaatgtgaaatacggccgggtgcggtggctcatgcctgtaatcccagcactttggcaggctgaggcaggcggatcacctgaggccaggacttcaacaccagcctgaccaacatagagaaaccctgtctctactaaaaatacaaaattagccaggcgtagtggcacatgcctgtaatcccagctacacgagaggctgaggcaggagaatcgcttgaacccgggaggcggtgagccaagatcgtgccattgcactccagcatgggcaacaagagcgaaactccacctcggaaaaaaaaacaaaagacgaaaaaaaaaaaaacaatgtgaaatactcttaggtagaagatgtttctgcattcaaaactttaaaacaatatagactcatatctgggaatacacacgttattaaatattgtgaaagcggtggggagggatgggatgagatagagaaagaatatgtcagcgctttaaaaatgttttggggctgggtgcggtggctcatgcctgtaatcccagcactttgggatgccgaggagggacagcctttaagcccaggagttgaaggccagcctaggcaacaaggtaagacctcatctctactaaaaaaacaaaacaaacaaacaaaaaaaaaaacgtgcctatgatcccagctactcaggaagctaaggcaggaggatcacttgagccatgatcgcgccactgcattctagcctgggcaagagagaggctctgcctcaaaaaaataataacaataataacgttttgggctgggtgcagtggctcatgcctgtaattccagtgctttcggagcccaaggttaagaggatcacttgaggccaggagtttgagatcaacatagcaagaccccatctctacaaaaataaaaataaaaattagccaggcatgtgcctatagtcctagctacttgagaggctgaggtacttgagctcaggagtttgaacctgcagtgagctatgatcacaccactgcactccagcgtgggctacacaatgaagctatgtctctaaaaaaaaatctttttaaattttttttggcattaattgtttatacatactttgctaaacacccaaaactgttcttgaaaaaaaaaaaatgaatctcatgacacacaccgacattagctgtaacttcctatcttctataagctgagtaaaaaagttaatcattactaaaaaaaaaccataaaccccaaattgtaggaaacacctggaaaatttacaaacctatggtccagcaattcgctaaataaatctgggggcacattttgaaggaaattttccagtatcccaggatagatggaactggatctagtctggctaagttagactggcttagttatattagccttttgaagaatatctgtattatctgacaataatgttcatgatttggtattaggtataaaagagttacaaaaaagaatgaagttttggaagggtcttcagagaaaaatgagtgggagatgactcttcccaattcagagtattctactgtaatacttcttttccagcatcacttggcacaattcaaccactcagctacttaacaaaactgtatgaggccgggcgtggtggctcatccttgtaattccaacacttcgggaggccaaggcgggcggatcactggagatcaggagttcaagaccagcctgggaaacatagcgcaaccctgtctctactaaaaatacaaaaaaatcagtggggtgtggtggcgggtgcccgtgatcctagctactcaagaggctgaggcaggagaatcgcttgaaccctggaggcagaggttgcagagatcgagtcactgcactcaggcttgggtgacagagtgagaccctgtctcaaaaaataaataaaaagaaaaaaaactgagaggcagtagcacaaaaaatgttttatattttacagagttctagtttacgttgttccatggattcactgggttctattattgtttttccgtgttcccatctttgtaacatcgtactaaccttcataacatgtaaatactgctgaacctcaatcccaataaactactaaaggatttttaacatcatacgttttgttttgcaatgtatttttgaaacacatcaaatttaaattttctttcctttccatccttctactgggcaagtttcatatcctgaattcctcatgtagaactctagaaggaattccattccacctgcggaaggacacctagtttacgtatttgacctacagaaaaatttctctgcaactctttcaaatgctagtaaaaaactccacccagtcagcctcccacaacccctccctttaaccatcttctcctccccactatcgccaccctaccttgtgcattccttcgtaaacttacttctcatcaccttcaaggttccactcccctcttgcctacatctgttttcatatcctcccactcccccaattcctgccaagaagccccgctagctgcctgttgcataacggctcccccattccgtctccctcggcagtcggccccgctcccgggagcaggaatgcccctttcggcccggcccctcctcccttccgcaacacgcccagcaagtccccgcgacgcagctccagcggggattctctctccaagctgggcgggtcgtccttgccggctggcacctcgggtagcgagccccgagggcagaggagccggctccacccggcctggccccgaaccctccgcggcgccggccaatcgccgctgccatcctcccgctggggtgatgtcttcaggtgtccgggaggggagaaagccctgcgtacttccagccccgctcctgtgccaggaaccggcggccctccgagccctccggagccggcctccgggccccgagcgcggcgaggcaagcaggggcggcgaagggtccgggtgggcggcggctacccgcagcccaaaggcgtgggcctgcgaggcgggcggcgcgcggccagggatgggcagcagcggggtaccgaggcgccgaggcctggacgcgggcgcggcgcggaggcctcggcgtccccagccgggtgtggggcggccgactgactgacgccgggcgggggccgccgactgcctcagccactgcgcggggcgggggcggcagcggcctctagcctccctcgttccctccctagtccgcttgcccgctcgcccgctcgctcgctcgctggtccatccgcctcctcaccttcaggacccggatccctcccggccggcggctcgcgggcgcttcgggcggctccgggggctccagcgggcccgcgggccccggctccacctcccccatcggcgacccaggattcacagagacgcccggcccgcgcgacggcgtgcggagcctcggcggcgcgcgcgagcaaccggtggccccgccccccgcggcccgccggctccgcccctccggcggctcgccagctccgcccctcccgcagccccgctggacctaagcagctgccggcgccgagtggcccgggcgccaccgagccgcattccggccgcggcccgcgtggcggaacctggcaccaccgcagagcgctgggcctccactgcccgccgccctaggcttggaggactagagcgcaaggaggggtatttgctgctttccccgccctctaagaaacccgcgggagaaagaagcaggtggcgccggcacctgtcaattgtgacaagacgctgccctccgccagggtggctcttgtaacttccctcacctgccaagccgttgaacgaactgttgagaatactcaccttggcaaggccttttctcttccttatcagagatgcgtgcgaccttcttaagcaaattcaacccaacctcgtacaaaacgtccgctcacctcccagccatgttttaattcccttgcctcctcctggagcaaaattatcagaattcggtgctctgcttcaagcagtaatatggcctgtgacccggtttatgatttatttgcaaggctgattcagaaaaaaacttttaaaagttaacttcttttcttttctttgttttgtttttcttttcgttctcgcagtgatagtagttttgttgccaatgggccaaatttggagtcagccagcctgtttccagatctcccctctgcccttctttagatctatacccctgtgcaagttacttgatctaagcctttcgttcttaagctgtgagaaagagattaaaatctgccaagtagttatgatgaagatttagtgcatacaaagtgcctaacgtatagtggggatccatagtagccattataattccaaaattctaaattgaagatccaatcggtttctcgaaaagtactctgtcgattcctcctaaattttcctaggaaggcttctagacttccagatttttagggcttcccctcatacatagggtgttgaatcttcaagcaacttgtaaggaattagacagcaaaaaacagtaatttcttcactttcatagaactgtaattccagtactttgggaagccaaggcaggcagattacttgaggccaggagtccgagaccagcctgaccaacatagcgaaaccctgtctataccaaaaatacaaaaaaatgagctgggcagggtggcgcacgcctgtaatcccagccacttgggaggtggaggcaggagaatcgcttgaacccgggaggcggaggttgcagtgagacgagatcgtgccactgcactccagcctgggtgacaaagcaggaccctttgtccctattatccattgcttcagtttgcctcattcagactaactgtatgtctagaataattgcaggcttagtacaagacttttagatttaacagagcagtctgtgtcccccatctgagatatgtatccatttggagatattttaaatgccaggaccaaatttggctcttgcaggttccgacccctttctgacctactttctcccttcacaagttagctttgtatataccaaaattccaatctccagtaatcttcatttcttggcctcattttaatgcattaaaaacgatttgtcactgtgagtctggtttaaggtgggagaaaactcttaggtcatccacctcctggattttccttccaccttgaaattattttcaggaaaggtactcaaagtagttggattcccatttcagtgcttactgggtaatttctcccaacaagaaaactggtatataagcaataggcaccaatatggagacagaagcaaattttaacaagggcaggcaagcagtgataagaaaaaaatgtggtttagaacaagtgtttctggctgggtgcagtggctcatgcctgtaattcagcactttgggaggccaagacgggcagatcacctgaggtcaggagtttgaacccagcctggccaacatggcaaaaccccatctctactaaaaatacaaaaattaggcagtgtgggggcacgagcctgtaggcccagctactcaggaggctgaggcaggagaatcacttgaacttgggaggtggaggttgcagtgagccgagatatcgcgccactgcactgcagtctgggtgacagagggagactcttgtctcaaggaaaaaaaaaagtgtttttcaaaagccttttatattttttttatttttgagacagggtctcgctttgttgctcaggctggagtacggtatggacacaatcatagctcactgcaggttcaacctccatgggctaaggtgatcatgccacctcagcctcccagtagctgggaccacaagtgagcaccaccctacgcttggctactttttgcattttttttgtagagatggggcttcaccatattgtccaagctggtctcgaactcctgagctcaagccatccgcccacttcagcctcccaaaatgctgggattacaggtgtgagccaccacacctggctgtaagagtctgtttcttgaggcattatacattaccttttccagatttcatgagtagaagctctttattgactgactacacaaaaaggaaagatcttgttgcagaactaaagtttcagctcatgctggggaacagcagtggtgaataattgtttaattaaagggatagtaggcataagcattgctatttacttcttcattctggcaacagtagttcctctttcaaaagggaaaacataaaaaaaaaaacccatccgcccaaaagtttcaggggctaatttatgatgtaactacctttaatggttcccatgatttaagatccaattcagtagtgacaaccagttgatttttttcaaatcatgtagtgccattaacattttatactttgtttcaaaggtcacatattgatgttctcccccagttcaaggcactgtgcattatgtatgccaagggttatgtaactacaatttctggaaatggtaaacagctgagactaaccctaaaaataaattcctctgggattttttttgtgcgaaaatccatctgccctcactgcaggttcatcattacaaaaatcactgtttagctcaaaccaagagacagagaagtcatcatgatctctcctttctgtctccttcctgtagcagctgtgcttcccctctctggtatgtacacacgcacacaccttctttatgccaggagcttttccagatcttcactacaaaatgggaagtctggagaagggaagctcatgcctatcagatgttgggagaggaagcagatgagacttatatttacttatttatatctagtacgcactccagtgatccacaaagtcatctttgggcctaaatcccttgttattctaccaataggttaagcagatttggatattcctaattttggttccaaataaacaggcagtgtttacctagcttcaaagtttggagaatttttctgtgaacattttgatatttttcaaatatggggacaattgaattgacaattgaagacataggatagaaaacccttaaaagtgataaaaattaatttggtgcttctgaattgaaattcagatctgaatactatttgttgtattgttaaatgtctattactggctaaacttttctattttcctctaattacatgaaggtgccaactaaatttaatattagaaacaactatgaattttaactaactcatacataagattatagaaatgttgcttatcaaacagtaccaaagggcacttctgcataaactagataactgccagggcctacacccttccccttttcaatcgggactatcacactctcccctttctcaatcaagggactgtcagggatcatcagaataacagaaaacctaaagctaccaacctccaaaacacagagttgacagccaggcacagtgactcacgcctgtaatcccagaactttgggaggcagaggctagtggatcacttgagcccaggagtttgagactagcttgggcaacatagtgagaccctgtctctaccaaaggaaaaaaaaaaatacaaaaattagccaggcatggtggtgcatgccagtagtcccagctactagaacggctgaggtgggaggactgcctgaaccagggcagtcaaagctgaagtgatcagtgaccgcaccactgcactccagctgggtgacacagcgagactctgtcttaaaaaaagacaagccaggtgcggtggcttacgcctgtaatccccgcactttgggaagttgaggcaagaggattgcttgaggccaagagttcaagaccagcctaggcaacatagcaagaccacatccctacaaaagttaatatatacaaaatacacagttcatataaaatagaccatgaaatataactcattttgactggtcaagccttcctctgcccagtcacagatacacttgaaaaattcacaaaaagcagcttataaagaaaacccataaccacccttaatatacatttcatcttggtttctctgccttgagaattgacctatggagattaagcatgaaattaatcatattatagttaaaatgtccaattgcacttaggacttttttactgtctataacacaagtttgttgttgttgttgtttttgagatgaagtttcactcttgtcaccccaggctggagtgcaatggcgtgatctcggctcactgtaacctccgcttcctgtggtcaagcaattctcctgcctcagcctcccgagtagctgggattacaggcatgcgccaccacacgtggctgattttgtatttttagtagagacagggattctccatgttggtcaggctggtctctaactcccaacctcaggtgatccgcccacctcggcctcccaaagtgctgggattacaggcgtgagccaccgcgcctggctacaagtttttaagtgattcaaattcctctcttggtgagacttatgtgtgaaaggaatactaacaggtcagtaagttagctcaacctctggaataagaattcatctaagtcttctaatccaattgtaagaagcaaggaagcaaattttaaatcattgggtattgactttttattattagtcactgttcataatttgtttcaaccaaaagacagtacacacagcagaattctaatgcatcccatgtaaatgtttacatccattttattcctcactcgcctctaagacttatcatttaactttaaatttttttttttacatctcaaaaatatgtctgcaataattagagcttcattagctgtcccacttggaaacagctttttaatatttttacagtaaagaagatgtgatggggcataatgaaaatgtaacttacaacactaagaaagaaaagggcctttataggaacacagtgggagttcataaaggaaagagttcagaagctctttcccatggggcccccaaatggaaaacaaaaacaaaacacacaaagcgcaaccgcaggttctttgagggaagaaaaaaaaaaaaaaaaaaaccaactccaaggctccatcttgaagccagaatcagcctcttggaagtctgtaaagcaactgtgcaagctgcttcggcatttccttctgttaaagtgttccaggtcctggaaccctgtcgatgggacccactcactgatattgcttgaaaaagttattcacttccagttctacaagcagccccactctcccgagccaaagctggtcaaaagtgttttaaacttcaggactttctgtgcaattctctctccaatgatcctacccactcccaaagtcatgaatacacagacatgtaaaaccactctcccaactacaaagttcatgaacacccactttttcctctctagttttctcagtttaggacactgtggttaaaatacattcactagaaaaaaatagacacattcaaactcctttcccctagttctcatggcccaaatattttccaatgcagaagataatgaagttgaaccttgaaagcagtactccctaacttccaatttctacgacataaaaaaaatgggaagcatgttatataaaccattagtgttggacagttttaaaagtctattttcatatatgaatgggacaaacaaggagtacaaatcacacctttaaactagcaagaggaaagaatcccctcccaaatgttacactgaggaatgtttctttaaatgataaagaccttaaaattaacagatgatcactatgcacagcctaaaacttccgtgactgtccaaaccacctcaaggtaacagcaccaaagcactgtgggagaagcttctcagggagagcacccttcctacagttttttgagattacttagatgaattaattctcctttaggattccccgggatggggcagaaactagaatagaaacgactcttgaagagggaaataatgaagtacaagtgcatgtgaaattgtcaaagtaagtgtgtgagggctcactgcttatcaccccagggttatcaaaacagccttggaaaatgctctttcctcacaatgcctgtgaagtcgtaaatccatccaaatttgctcccccttgagtggttatactcgggaaaggaattattgaaatgtgcaagtattcaaagaaattgaaacatttctccatttagctgcaaggccaagtgagaggaaaactaattctgatcctagaaactaaggcacgctgaagctttcaaagatccaatcatttgaaacagtcttcacaaccatcagtatcctaggcagttatttggctgctagtccttcagtatggtgcttgtgttctgattccaaaatcaattcatattctacgcagcaccctttgtgttaaggccatgatattttactccttctagacaaagctatgaatgatcataaactctacctcgaaactatgatcacccaaggaaatgctctgtcagcagagtagacccttcccagctccattagctgacagtgtcttatagcatggtcttgaacagatttcttcagagattcaacccagttcaaataaaaaaacctgagctggttagctacaaatataagagagaaaataaagcctctacacaaagaggaatgttaagacaaattctattcaagaaatccaccaacattatgttaatcctatcatgtttcacagcattaagtatccatccaatgaaatcagtctgcaaagaaacccttaaaggctatttttcattgcacaggcagagcagttgtctgaaatatgcactagtccacacttacattactgaaaactatgcaggagatattatcctgttcttgactcagtcaaccatttacccagtggagtaagttttagcagatcttgctcatacacactagtaagaccagaaactttcccgtggagcctttagttcaactccagtttgtcaaatgttaggaatattccagcatctgatacagagctagatttgacaagacactgaagattttaagtaaaggcttggtgaaatgaaggggaaaaaaagggatatttgtttccaggtttaagattgaagccatagtagtcattatactgtattcaatacagtaacaattgcaaacattgtaagagcaaggtgggcctcactttttctttcttcagtatataagacatggcgcctgaatacttgaacatacatagtacattcaatgtgtaccacagagagagtcacctctacttcattccagcaactcaatttcaaagtttgataacatatgggtcctttctaaaaagcacttggcactctcactagtttaaaaagctcaagtctttgatgtgaatattcatgagattcgtcttttaaaagagaccaatttctcagactgaggaaaggctattcctaccctatggtgtccgtaagacctcctctgacataggggtatggaagctacaaggcttcactccaacaccataaagtacaatatggaaagatttctttaaccgtgtggtctttatttcagtgccagtgttacagatacaacacaaatgttccagttagaaggaattcaaacggaatgccaaggtccaagccaggctcaagaaataaaaagggaggtttggagtaatagataagatgactccaatactcactcttcctaagggcaaaggtacttttgatacagagtctgatctttgaaactggtgaactcctcttccacccattaccatagttcaaacaggcaagttatgggcttaggagcactttaaaatttgtggtgggaatagggtcattaataactatgaatatatcttttagaaggtgaccattttgcactttaaagggaatcaattttgaaaatcatggagactattcatgactacagctaaagaatggcgagaaaggggagctggaagagccttggaagtttctattacaaatagagcaccatatccttcatgccaaatctcaacaaaagctctttttaactccatctgtccagtgtttacaaataaactcgcaaggtctgaccagttcttggtaacaaacatacatgtgtgtgtctgtgtgtatacagcaatgcacagaaaaggctaccaggagcctaatgcctctttcaaacattgggggaaccagtagaaaaaggcagggctccctaatgtccattattacatttccattccgaatgccagatgttaaaagtgcctgaagatggtaacccagctagtgaggaataaataccccaccttgcccagtccacagagaaacaacagtagaaagaaggggcaactctttgctgcagagacaaagtgagtgttttttcgccatggattgcagtcctctcctccagaccagctgcttatttcctcaggggcccagggaatgttgattctggctgtaaatgtgggaggggtggagaagtgcggaaaaaggagaagaggaagagtgcaaagtagcctccagaagcagccagcctcaacagtggaggagaggacattagtctttaacaatgcttcaaggtcagcagtaactttaggaaaatcctcctcagcagttctcttcagctcctcatgcccgtggtacagttgggggggacttgccagcaatcacaacctccttcccagagttcctttgattgagtgggataaagaatgagaatggtgccaaaccctcattgccaggactgagggggaaagttgttcacctctgctagatcttgcattgctgagcccttgtgattatatgtaagcttgatccgcattcgcagctgttgctataagaggaaaagagaagtgcaaattatatactgaaatgaaatctccagaatctgtccggtccacaaatagacttttaatcttagaggtcaaaacttaaagcaaagctgtctgttaagaatgacaggtaaacaacaacaaaaaacacccagtactctaggcttgagccaagaagctaacaatgtcatgccaccaagttgagaaagcgcatctgcagaatacacggttagctttaatccttgaactgcattaaaaggacagaactccttgggagcattttttcttttcttttcttttgaaacagggttttgttcttattgcccaggctggagtgcagtggcacaatcttggctcaccgccacaccagactaatatttttatttttagtagagacggggtttcaccatgttggccaggctggtcttcaactcctgacctcagataatacacccacctcagcctcctaaaatgctggcattacaggcgtgagccaccatggagcattctcctagtaacattttgctgagtccttttcaaaaagattcaaaccttgtatccaagtctcttaaaaaatgaggtgaacatatactcatcgtacgctctccattcagatacactgttgctttatctgaaaaacctacagtaaatgtgaacatgaccttttgttcctaaagcataaaattttaaaaaatgacttaactcacaggtaacagcagtagttttaagagaactcaattagacactttttgtatggcagatttcaaatacaaatgcactaagacattttttactctctgtatcagatggtcaaaggagtttgtgcttgtactatagaggccgatgctcaaaatatagtgaatagcagaggaaaggcaagtgttacaagagaaagaaagtatactgttacttatgagcaactagtagagctctattaaagaaattctctgaaccattttcaaaaactgaaaaccaactgattactattaaggtgagcttatttctttgagaagagataataaaaatattgcttaatttcagtttctaaagctatttttcatttggctgcttcatttaaaatgcctctatttttctattcatacttaataactgtagcagtaaatgtaggtatttggtttcaacaaatgctcttacctcagatttcaacttgtgtataaattaaaatgtctaagcttctcccctacccccaaaaaccagacctttaatctagctttttttgaagttgcattttaataagatgccactaagccacctgatgtctctgggttccatttgttatttacaaaagagcaaggaagttagaccaggcattttcattgatctcttctctaactatgagtcagaaaaacctaaagaaacaaagcagaattttatttcgggaaatatgcttacacttcggctcagatattggctacaaatgtgctactcaccttctgagggttcagaactttaatgacttgtgtgatggtccccgtgttaaatgctgggacaatgctgctgctaggagacaagagctgcagctggaatgtctaggggggaacaaagggcactcttcagaaaaagaattacacaacgctaggtcagagataccaaaaaccatttagacacccagatgatgggtcaagcaacagatttcactactactaagttttgcctactacttgttttctagatatcaggaattcacagcacgtgagttgactccctgtggtatttgtaaaaatccactgttcggttctttgatcatgacaactagtaataaaccacattctcctttctggcagaaggaattctagcctacctcttttcaaaagctgaccaattcttcttctggcaacttcacttaatggtaactgatcaactatgcaagtaaaatatcggtgcttttggcttaaaaaacagccagaaagaaatgaaaagaaaagcttcccaaaaatagcaaaccaacatactggtcaccaactataagcttttaggcttttgtgtgattggataactgggatgcagagacttgaacttttgttttttaaagcctgcataatctataatgtgtcagagcctcctctccacatgacagaaggaacggaaagacttgcagaaccagcctatacagcaaaagacctagataagccaaacagtattaatttgttgaatgctggtggggtttatttgcttgcttatagaaataagagttgaaagtgctggctgggtgtggtggctcaagcctgtaatcccagcactttgggaggtcaaggcgagcggatcacgaggtcaggagttcgagaccagcctggccaacacagtgaaaccccgtctctactaaaaatacaaaaattagctgggcatggtggcacatgcctgtagtcccagctactcgggaggctgaggcaggagaatcgcttgaacccaggaggttgtggtgagccgagactgtgccactgcactccagcctgggcaacagagcaagactccgtctcaaaaaaaaaaaaaaagtgctatatagggcaagctaggtaaaccatactgtactacgtagctattgtatgaactagcatttgaaaatctttcctaaaagtagattaaacttctaaaatatttgagagagagagacactagtcttctctagggccaaaagttgcaagagtgaagattcactctcaatgtacagatatattacactgggggctgggcacggtattcccagcactttgggaggccaaggcgggcagatcacctgaggtcaggagatctagattagtctggtcaacatggcaaaaccccatctctactaaaaatacaaaaattagctgggtatggtggcgcatgcctgtaatcccagctactcaggaggctgaggcaagagatttgcttgaacccaggaggcagaggttgcctgggtgacagagtgagactccatctcaaaaaaaaaaaaaaaaaaaatatatatatatatatatatatatatatatggtcttattcataattctgccacattaaaattatgtaagctaaagtattattcattactaccatatttcattaaatgtaagataccaatcgtaattcacaccattattttatgtaccactgagatagaaaacatgctgcccactgaattatgacaagataccaatttttaaatgtatcctaattttagaaacattaaaacacgaaattagtacatagtagaacctataaaatatgactttttttttttttttagatggagtctcgctctgtcgcccaggctggagtgcagtggtgcgatctcggctcactgcaagctccatctcccaggttcatgccattctcctgcctcagcctcctgagtagctgggactacaggcgcccgccaccacgcccggctaatttattatttatttatttatttatttatttatttatttatttatttatttattttttgagacgagtctcgctctgttgcccaggctggagtccagtggggtgatctcggctcactgcaagctccacctcccgggctcacgccattctcccgcctcagcctcccaagtagctgacactacaggcgcccgccaccacgcccggctaattttttttttttttttttttttagtagagacggggtttcaccgtgttagccaggatggtctcaatctcctgacctcgtgggatccgcctgcctcggcctcccaaagtgctgggattacaggcgtgagccaccgcgcccagcaaaatatgacattttaagttgaaaatacattatcatgttgcactgtacagtacaccaccaaaaatgtcatgttttaatagcagaagtgataagtcactagagcagcagcctaaagtaacaagtataaaacctaagttgaagaaactaaatatactgagcactgaacagatgaaaagtgcttcaaacagtgcctgattcaaaaaacttatttattcctttaagcaaccttaggaagtggctatcattatcaccaccctctttgcaaatgaagacactgaggcatagaggttcagtgactttcttcatgtcatacaactactactaaaatccaaacagaatggctctagagttcattagtggtctttcaccaattgacactactgctccccttttttttcttcttttttttggacagcgtctcactctatcacccaggctaaagtgcagtggcatgatcttggctaactgcaacttccacctcctgggttcaagtgagtctcccacctcagcctcctgagtagctgggaccacaggcacgcaccattgcacctggctaattttttgtatttttggtaaagatggtgtttcaccatgttgctgaggctggtctcaaactcctgagctcaagcgatccacccgcctcagcctcccaaattgctgggattacaggcgtgagataccgtgtccagctaactgcttcttaaacatctaaattattctggctcctacaaagtgtaagcaaagagggttgcatgagagtcagaggatggggaaaaaataaaaaaagactgcaaagtcagcagtacccacaaacaaagaaaacatcctcaatttccaagtccaagtgtgttgtcggaatgtctaaatgccatatttcacatgccactgccaagattaggttagcttagtctaaaccagtggttggcaaactatggcccactggccaagaatcgcccaacatctgattttgcaaataacattttattggaacagaactatgttcattcatttacatgtcatctacagctgtttctgtactataagagcagaactgagtaccaataaagaccagatagcagcctaaaatacttactgtctcatctttttaagaaaaactacccactcctcattctcaacttttctttatttagaactctttgtttgtttgttttgagatggagtctcgctctgtcacccaggctggagtgcagtggcataatctgagctcactgcatcctcagcctcctgggttcaagcaattctcctgcctcatcagcctcccgagtaactgggattagaggaacctgccatcacgcccggctaatttttttttttttttgtacttttagtagagacgggagtttcaccatgttggccaggttctcgaactcctgatctcaagtgatctgcctgcctcagcctcccaaagtactgggattacagccgtgagccactgcacccggcctcaagatttttcactattcataaatgaacataaatatccttaaactaaaatttggtgtaaaccaaaccttgattcacaaaaacagttactgtatctataataaattggatgttaacgaaggaggaatgtttctctcatttatgtatcaagagagaaaaaatttcaattctgatctggttaactagaagataataccagatagacaaagtctctcatcttacttaactttaatcctatgccatattttatgtttttaggtctttaacactgtattactaaagcctaacctatcctcaatgccctgagcattaactgatcacctcgtagaattctgctctcactactattagaattgtttttctttatcctacaatgctaaccatcagaatacttgtaacctagtaaaaattattcactaaaaatgatatgcttccatgaaccataagctacattattgttagtttgaattaagtctacaaatttaatctgtaaacattaaaacatatcctttaccaaacacatgaaaaaaaaaagccagccaatctttaatcaaaggaaacatctaaagaagacattgtagtacctttggtactgcagcttggaaaacaaagtccgtcatatctagctctgtgctgttggaggcctgtatcgttatcactgttacactggggttggtatttgaccgttcaaaggtgaattctatcttcaagccattcttactgtatgctgtgatggaggggatgcctgagaaagtacaggaagataagtcttattgtagtcagcctaatgcttgcagaattattacttctttttcttaataaccacatctcattactcagtgctccatgtaatgatggtaacaacagtcatcgtacctgcagcaatatcattgaagagaggctgtgatgaaagcccatccaacaagaaggggggctgggatatctgtgggactgaggcaggggcaggagcagcagctggagcacctaaaggaaatattttaatggaaagttaaccttaggcagcatgacaaagcttaccaagaaattatagggaaaattatttcggtctcaggttaaggaaagattccttaaacaagatgcaaaaagcatagaccacaaagagaaagaactaaaaactcaagtactttaaaacgagcaacttctgtttattaaaaaatactgtaagaaaaagtacagtctgagcaacatggcgagaccctgtctctacaaaaaaaaatacaaaaattagccaggcatggtggtgtgcgcctgtagtcccagctacttgggagactgcagtgggaggatcactggagcctggaaagttgaggctacagtgagcttgcaccactgtactccagcctgggggacagagcgagactctgtcgcaaaaaaaaaaaaaaaagtaaagagagagagcccacagacaggagaaaatgtttgctatacagtaatgaatggataagtatccaaacgataactgtcttctataaaaccaataagaaacagataacccaatttaaaagtgtcaagatataaaaacacgcaagtcacaaaagaggaaacctgaatgaaaagggaatcttacaaacagatgctcaattttaccagtaatgatggaagtggaatttaaaattatagtgagatactacctcatgtctaccagaatggtgaaaatttcgatgtctgataattccagatgttggcaagaagatggaacgatgggaaattttaagctctgctataggaaggtaaactggcacaaccaatctagagagtaatttggcaacagtagagttgaacatcagtatatccttaaactgaggtttctcaaccttgacagtaatagcttttaggcttcctaattctttgttgtagggggctgccttgtttattgtaggatattaagtagcacccctgggcttttatgcattagacggtagcatcctcccagttgtaacaaccaaaaatatcttcagacactgccaacccctggagggcaaaatcttccccagttgagaaccgattaccccttcttaggaatgcttttaattaatccttgcatgtgttcactgggagatacatccaaaagcattcatagcaggaacactcctaatggtgaaatactggaaacaaccaaaatgtctgtcatcttgataatgaataagtaaactgatatattgatatactaaaatactacacatgtacaacagtaaaaagtgaattcactagaaatacacttaacatggattattcataactcattctcacaattacaatgtttagcaaaaaaaggtgcaaaaaagaacacattcagttggataccttgtctaaaaaggtaaaaattggcaaaataatactacatactatatcaagaaatgcacaggaatggcaaacaccaatgttaaacactactttaggatagacagtagttacgtctggaatcaaaaagaaatgggatgagagggaaatacacaaagaacatcaaccctcttaatattttattttacaaactaggtagatcaaaacattcattaaattttgtagatgttaaatgctgtataataaaattttcacacacacacacgcaccctgtgaggggtggtataaagtggggtgggaaaaagaaatagattaccattcttatttaatctttccaaataagaacaacttgacaatcatacaatagaagataattcatagaacatgagggatatcaagattcgaagaagaagcataaggaaattcagtaaaattaagagaatgtatttaatatttaaatagatttcaaactacttgtgaaattaactgaaaatatgccatttaaaaaagaactatcacaatgaaataaaggaaggctagaatatcatctttttttaagaaattgacagcaagaatgagggggaaaaaagatactaaagaatactagaaaagtaaatgacaggctgggcgcgatggctcatgcctgtaatcccagcactttgggaggtcgaggcgggtggatcacctgaggtcaggagtttgagaccagcctggccaacacagcgaaaccctatctctactaaaaatacaaaaattagccgggtgtggtggcacgcgcctatagtcccagccactcgggaggctgaggcaggagaatcgcttgaatctgggaggcaaaggttgcagtgagccaagatcacaccattgcactccagcctgggtgacagagcaagacaccatctcaaaaacaaaaacaagtaaatgacatattaaaaattagcaaagagaatagaaatacggatggctaagcaagcacgagaagctaaaataaatgcaaacaccatttgtgcagtccagcagattatcaatgaagcagacaaagaaatattcatacagttctcctagtctaaaaaatcaaatcgagaaaatttcccccaattcccattttcaaaacaattttagaaatgtgttctcatggaaaatcagaggctactcaagatacaggcagcatataggtccccaactccctcaaattttcacttttctttgtcctgtaaaagtatagcaaggtagtttaggagaagagcagaaacttactgctccaaaccctttaaaaacacatgttaaatctattctgaatttctactgacttaaatttctatataatggggtaaaactgtaatgataaattaagaaatctagaattcaaaattttaaaacttaatgtaaaaagtggaaaaacatctttaaaacacattatgaataaggcaagaaaacccagactttttaacattttatcattttgctttaacatataacactaggaaaacaagacagtaggaacaaaaagaaaagactccacaataaatgagctaaggatacaggaatgttcagaaaggaacctcatctataatacaaatatgtgaataaatattaaacattctctgtgatcaaaaaataatagggcctctctctgctgaccaagcctggcagagggctacaaaatttaaaaaataataataaaaataaaatataataggaccaaattttcacccaatagggctttttaaaatgataatatacaatgcttatgactgtgcggttaaacatataaattgaggaaaaggtaaataatatttaccaagtgcctactatgtatcatgcactgaataggtcaatgggcctcacaaatatcttatggagtaagtattaatcatcctaattttaaccagattcagaaagactaagtcacttagtctaacaaattaatctaaaataagaacaaattgatgtaatatttgttgaggccgctaggtaagaaaaatctagaaacaaaataccccatactggctgggtgcggtgactcatgcctgtaatcccagcactttgggaggccaaggcgggaggatcatttgaggtcaggagttcaagaccagcctggccaacatggtgaaaccccatctctaataaaaaaatacaaaaattagctgggcatggtggcacgtgcctataaatcccagctactcgggaggctgaggcaggagaatcacttgaacccgggaggcagaggttgcagtgagccgagatcgtgctgttgcactccagcccgggcaacaaagcaagattccgtttcaaaaaaaccaaaaaaaaaagccaaactacccaatactaacgaactgagtaaacagagcaaatttgttgataaagtattagtcacctaaaattataattatgaaggctatatatattaacatggaaatactaacatattaggtgaagtatatgctatggtttaactgtggggttgttttttctttgccggttatccagtacagctttgacatttgaggatttgaaattgaccatttgtaaatgattcataagtacatgacaagtaacattttgaaattttgttaagacacagacataaatcctatactctgtgactccactgtattaggaaaaaaaaaaatcagcctgtgggaatgagcttagctaaccatccaacttgttatcctatgtctattttttactcaaggtcatgtgtgctttaactcttcattatcctcttaaagaagacagcaaaaccccgtctctactaaaaatacaaaaaattagccgggcatggtggcattcgcctataatcccagctactcaggaggctgaggcaggaggctcacttgaacgcaggaggcagaggttgaagtgagccgagataatcccactgcactccagcctggctgacagagtgagactctgtctcaaaaaaaaaaaaaaaaagacactttaacctttcagctatactttacactgaaatttaggatagaagttgtaggccaggcgtggtggctcacacctgtaatcccagcactttgggaggctgaggtgggtggatcacgaggtcgggaccaacctggcctacatggtgaaaccctgtctctcctaaaactacaaaaattagccaggcgcagtagcaggcgcctgtaatcccagctattcaggaggctgaggcaggagacctgcttgaacccaggttgcagaggctgcagtgagccgagatcatgctactgcactccagcctgggtgacagagtgagactctgtctcaaaaaaaaaaaaaaaaaggccaggcgaagtggctcacgcctgtaatcccagcactttgggaggccgaggcagggggatcatgaggtcaggagttcaggaccagcctgacgaacatggagaaaccccatctctactaaaaatacgaaaattagccagggcatggtggtgcgtgcctgtgatcccagctactcaggaggctgaggcagaagaatcgcttgaacccgggaggcggaggttgcagtgagtcgagatcgtgccactgcactccagcctgtgcaacagagcaagactccatctcaaaataaaaataaaagttgtattggactcgggtttatcatattgctgaacatgtcaattacaaatgactggtatatatgaacagaagaaaaaatattcccaaatgaaaagttatgtttgaatattatgagtgattgcccttcagttgctttaattacagaaagtgtgaaagggaagaggtaagtagcaggttaacatctctccacaaatggccacagctactgaaaactaaccattagtgggaaggaaccaagaagaagtcatgtcttgggacactaaaagcaaaggtgatacgggatatattttttgagcttgaaagagaaagtgtgtttttttttttttttttttggagacagagtcttgctctgtcacccaggctgcagtacacactggcgcgatctcggctcactgcaacctccgtctctcaggttcaagcgattctcctgcctcagcctccggagtagctgggattataggcatgcaccacttcacccggctaattgttgtatttttagtagagatggcgtttcaccatgttggccaggctggtctagaactcctgacctcaggtgatccacctgcctctgcctcccaaagtgctgggattacaggcatgagccactgcgcccagccaggaaaagtagtttctatcttaaaacactatgaataatttattcacccaaaattaggagtttgcctttaagaaatccgtataaattatctttagagcattattagtatacaacatataacccggatattgtgaagatttgactcttgcttctgatttagcctctcccatcttcaaatgattcacgtgctggaaagtctgggttcagtttagtttttccctgaggcctctatcttttcccaggtattaaatagctccagactgcctcacctgtaaggttgatgtctcccagcaaatcaagaagttctccaccagcagaagatggtttgcttgtaggcgcagttggaataacaggtgttatgtcatttcctcccaacaaatccaataaatcattggcctaaacaaggtaacaacacctcaattcattattatttgatttgtctagtatacatctaatgcaaagctctttcaatatgtaaaaataaggaaggaaatcatcaaccaacccaggaacattaaagggactcagctaagagacaagctgtaagggactataaaatcgtaagaagccccagatgagcaagtgaaaggctggctacctggctggtgggctgtggcccagagggtggcggtttggtctctagtggagctggttctgtctctccatttgtctgcacaatctcagtagggccatttgtggtcactttttccatgacaggcattctctcaagtagggcagacctagaagaatctgaagtggttaaattctaggcagttaacctagattccctacccaaaataatcaccattaactatgttgagcccaagcatggagatctatctcccctccccatccaacacacacactaaaatagaaggtagattacaagaatacatgacctaaattcctggctggattaagggcagacaaaaaaatcttgaataaacagactgcccagctaaatcccaaagcatatatttcagtggtagagagactgagatgaaagaaaggtaaatccataggtattaacagtcaagaagatactgtataatagaagaataaaagatgacccaaacactagaatgttaacagtaaaagaatttgaatgagattatttgtcttgaaaaaatacaactcccacttcttttttttttgagacagagtcttgctctgtcgccaggctggagtgcagtggcatgatcttggctcactgaaacatccgcctcccaggttcaaatgattctcctgcttcagcctctcgagtagctgggaatacaggcatgcgccaccatgcccaactaatttttttgtatttttagtagagacggggtttcaccatgttggccaggatggtctcgatctcttgacctcgtgatctgcccgcctcggcctcccaaagtgctgggattacaggcgtgagccaccacgcccggcctcccacttcttaactaaataaaatagaaaataaagcaaactttccatatcaaaaaaagtgtaagtgttggaggtggaatgaaagagagttaatttatttctttagagactaggcagaatagaagatggacaaaacagaagcagacaagcaattagaactaaatagggatacgaggaacaattaataaagcacaaggaatgaatcttctttatggattaccatgacaatttagtcaggatgctaagagatacacgcattgcttagtttctttcgctcacctcatgtggtcatatttcttgaaaagtgcattatattctactgccctctgctggagttccacatcaatgctgcttccgtagatggaaaccactttcttaattcggctatagataaaatgacaaacgaaataaaatacccaaaagaaaattcacaaataagcagagataatgtttaataagccagaattttctggttaaaatactgaaatactcattttttcttaatttatatagtttttcaaaaacaaaacactttactttcatccatttatctgacattcgcattatactattctcattgtaacactagatttttgtctgttaaatatgccatccccattcagcaacaatgatggtgtggaaaaaacacatatatatatgccactccctaaactttgctagacaaaagtaccaactattactttgccacaaaagaaatttgtactgttcattctcttctttgataatttttaaataatttttaatctataaaagggtcagagcctcaaaatgttgaccccaaattcttccagttcagaattttaaaagtaattcaataccattttttataagacttcacatttaaaagtgaagcagaaagactacaagaactacgttggccttaaatatgcttgggtgggaaagtgacctgagaatctactttattcaaaaaagcaaagaggagaattaaaagatttaatcaccaaaacattcatgattttattcctattaagacttgtcaaaatataataaaccaaaaccttggccagattacaaggtcaggagttcgagaccagtctggccaaaatggtgaaaccccatctccaccaaaaaatacaaaaattagccaggcatggtggtgtgcgcctgtaatcccagctactcaggaggctgaggcaggagaattgcttgaaccctggagatggagattgcagtgagccgagattgtatgccactgcactccagcctggcaacagagcaagattctgtcataaaataaaatgaaatataaaatacaaataaaccaaaacctttatatggggaagtagattctcaacttaaaaagaaaaaaaaaaggtattagaaatctcattctaaaaacgtaacttttaggccaggtggagtgggtcacatctgtaatccctgcactttgggaggtcagggcaggaggatcacttgagcccaggagtttgagaccagcctgggcaaacaaacgaaacactttctctacaaaaaaatgtaaaaattagccaggcacgatggtgtgcacttatagtcccagctcctctggaggctgagacaggaagatcccttaagcccaggagttcaaggttgcagtaaaatatgatggcgccactgcaccccatcctgggtaagagagcgagaccctgtctcaacaaacaaacaaaaccccctaaacttttctgcttcaaaataatccacaagggagtaaaagaatgagagggaacaaagtgctgatgaataaagattaaccacaaattgatcactgtgactgtggagaaataagtaatggaaatttgtgttattattctctctacttttgtctatgcttgaaattttccatgataacaagttttttgggattttttttgttttttaattacaaaacaacctgttcaccctatgtttcttcaatactcactttacagtacaagtgaatcgagtggaaagcttcataatggcagtgagggcataacctcgtgtcacagaggtggacatattagagattaggacactttctaaaatatccaacacttcatcctctgttacctgaggaggaggaggaaaaagaagacgatgaagaatgagtagcatgattaagcatctaaatctgatatcaagtcaggggaagcagccagaaagacaatcctaccgttacaaaagcctctaactcaacctgtgctttgccagggtaactgtccaagctgttctatcaaccagagtagttgggggtaaaaaaaagtgctctggttctatcaaccagagcaggtgggggtaaaaagagtgaaaaatgaccactggggctgagaggcaatattagagcttcaagtggcagaaacagaagaagaaaagaaaaacatacagagttcaagtgttgttgccacaattttcccttttaaagccagtcctttaatgtgcaaataagaacatggatacatgtctcatttcttcttgtttaccagccagagggtaagagaaacagtaattcagtccactaggacagagacttgggcctaaagtggttttaaaatctcacaatggggccaggcaaagtggctcacacctgttttgttttttttttgttttttttgttttgagacggagtctggctctgtcacccaggctggaatgcagtggcgcaatcttggctcactgcaagctccacctcccgggttcacgccattctcctgcctcagcctcccgagtagctgggactacaggtgcctgccaccacgcccggccaattttttctactttttagtagagatagggtttcactgtgttagccaggatggtctggctaaccaccctgcaggtgacctcatgatccacccgccttggcctcccaaagtgctgggattacaggcatgagccaccacactcagcaatgcctgttaatcccaacactttgagaggccaaggcaggcagattgcttgagtccagaagttcaagaccagcctgggcaacacggtgaaaccctgtctctacaaaaaaaaagtagaataaactagccagggtggtgcctgcctatagtcccagctactcaggaggctgaggtgggaagatcgcttgaaacccaggagatcaaggctgcagtgaattgtgatcccaccatggcactccagcttgggtgacagagtgagactctattaaaaaaaaaaaaacaaaaaacctcacaatggctcaataagttccatctcaaaaaatggcaggttttccaatataattcgcgtttgcttctttaaaaagttgggtattttttaaatttttttgagacagggtctcactcctgagtagctgggactagacaccatcatacctgtctaatatttgtgtcttttgtagagacagagtttcaccatgttgcccaggctggtctcaaactcctgggctcaagcgatgctcccatctcagcctcccaaagcgctgggattataggcatgagccaccacgcctggcctaaaaagttttcaaggaatcaacctcaactccccattaaacactactctcctataaccaaaaccactattttcccccacttaaccaagagtgacaaggagtacctgaataggctcttcctcttcacactggccagatacaagaagatcaccatattcacctatacaccatgcagccacttgtaccaaaggttgctgtgaaaagaaaagtcaacgtttctcaagaacttcaatttttccaaagttatttaatgcaaatcataggtcatctcataataaagatcaaaactgtgcatatctagagtgttagaaataaagacataccaaaggggagagaggaggggggaaaaaaaagaagaaaaacataccagaaaaattgagggtaaaattaccccctaaaatagttgaatgaagtacttacttgagaataatcaccaagaattgctttgtacaggcgctggacagtataggcatgcatctccacactattagttattaactggattaaattggggactgcatcatcacgaacataacttcctgcctaaaaggaaatgcagacaattacccctagaaacacacagaaatgatgataacaagtgttagctattattattactgtgtgttttttcctttctttttttgagacagagtctcgctctgtcacccaggctggagtgcgatagcgcgatcttggctcactgcaacctccacctcccaggttcaagcgattctcatgcctcagcctcccaagtagctgggactacaggtacatgccaccacacctggctaattttttctatttttagtagagatggggtttcaccatgttggtcagggtggtctcgaactcctgacctcagatgatccacctgcctcggcctctcaaagtgctgggattacaggcgtgtgccactgcgcccagccattactattgtttttaaaagaagaataccagaaaacaccctcaaagataaatttggttccaattctcaggttcataacagctcaaacttcaaagtcttatttaaatatgttacatttttaaattttattttatttttaaaaattttctctttgtccaaaggccgggtgtggtggctcacgcctgtaatcccagcactttgggaggccaaggcgggtggatcacaaggtcaggagatcgagaccatcctggctaacacgatgaaaccccgtctctactaaaaatacaaaaaattagccgggcatgtggtgggtgcttgtagtcccagctactcaggaggctgagacagcagaatggcgtgaacccaggaggccgagcttgcagtgagccgagtttgcgccactgcactccagcctgagcaacagactgagactccgtctcaaaaaaaaaaaaaaaaaaatttctctttgtccaaattaaaaaaggaaggctggacacagtggctcacacctgtaatcgcagcactttggatggctgaagcaagatgactgcttgaggccaggagtttgacacaagcctgggccacacagcaagactccatcactaccaacaataataataataataataataatgtaaaggtttaaaactttatcacccaaccttggtcaatctcccattcctaaatagaacaatagatttaatttgtaagactgagaccagtcctaaccatgtgtattttggaaaggaaaaaaaagaaaaaaaaaaaaaaacagccaggtgatcagggttttatcaggtcactcctgttaagaaacacaaagacagaggaagaattctgggaaaatgatcagaaggaaaggtgagaagctaaaaagcaggtaatttgcagtatagtttatttacatccttccgtaaagcagagtgcattaaatacaagaaagcatcagggtgatctaatgggtttgtataataagactacttcattcaacagcagcagaatacacatttttcttaaacttacactgaaccaagaaagaccatattctgggtcataaaaaatatcttaacaaatttcaaataacataaatcatagacagtatgctcttagaccacacagaattaaactagaaatctgcaacacaaagacaggtgcaaaaaaatcccaaaatatttggagattaaaagaacatacttctaaataacacatgggtcaaaaacaacattataagagaaaactataagccaatctctctcatgaatacacatataaaaatactcaacaagatattagcaaatcaaacccaacaaagttataaaaagaataatataccctgaccacgtattccaggtatgtaaggctggttaggcattcaaatatcaatgtaacccagcatgtaacaggctaaagaaaacaaatcacatgatcataagagaacacaagtcagttagaaaaataaaatcaggggcacaaaaaaaaagcttttgaattctcataaacactttccttcaggagtgttaatttctcccttcttttgagcctcatgaaaactaggaaaacatgtcctgttcatcattatgttaattacattttgttagattataatttttccccttgctaatcaaatttattaacttttaaccttttaccaagttaattcattgtaagtaaactaaaaaacgagtatgccccagagagaattccacagcaacaaatacatatacatataagtcataatttcataagtcaacaaatacatataagtcataatttcaatgatataattttctccctacagatgtttcataatttacttaatccccatttggggactactagttgtttccggttttctcctactataaacaatattaggatgaatacttttacatacacatttttgtgtacttgtcctattattttttcaggctaaagtcctaaaaattgaattaatgaatcaaagggtacaatttaaggcttttcctacatgctaccaaactgcatagtaaaaagatggcatcatcctatactcccataaagtgaagagtactgcctgtttctctattttctaacactgggaattagattaaaaaatacgaaatgtgaaaaatgatacctcaattttactttatttctttaataagaaaattttttcaaatgttaattagccatttctttcttcatgaattgctggttcaaataccaatttttccattagagtggtatttcctatcaattataaattattcatagattgaatatattaatatgctgtcataagttaatgttttccccagttgttaatttgccttttaaatcgtagactgttcccctttttgttattcaatttttaaattttaatatggttaaatttgtggcttttcctttacagtagctacttctagtgacttaattaatggaaatggttttctttacatgtcactgcactttcatttttactcttaaatacctaatccttgcctactaattgaataataaacacagaaaccctgaatttctgcaagaatgccaaagaaaggatcccatccaaaacaggatttcaaatcctgagtaactttagccattcaaaaccctgcaatggcttcctaacatattcaaaataaaatgcaagctcccatgaggcctacatagtctggctccgcttatgtctctgacatccatcctaccattctctgcctctctcactttatggcttcacttgccttcctgttgctctccaagcaagctatgcttgttcctacctcaggtctttgcacttagggttccctccgtatggtacactattcctcacgatctctgcatggcttgcacctcatgtctcttaggtctctactcaaatgttatctcctctgagagacctccctgactaactctaatctaaaacacttggccagttgccctatatcccaccttatcctgccatcattatattcctccatgctgctttaggtttttcttcatggcatttattcctaactgacattaatgttacctatttacttgtgaatttcttacctccctgactagaacataaacttcatgataacatcagtatatcccagcacttcgtatatgctgtctgaaagaagctacttaccgttgtcaaaacacgcataattgtgtctatatgccatcgtttggaaggtgcatacctgaaaaaaacaatggaaagggacacttggaaccagtaaaatataccgttttcagtgactagaaaatcctgcccaagcagggtgactcacacctgtcatcccaacatcttgggaggccgaggtgggagatcacctgagctcaggagttcgagaccagcctgggcaacacggtgaaactccatctcaccaaaaaatacaaaaattagctgggtgtggtggtgggtgcctgtagttcagctactctgggaggttgaggtaggaggattgcctgagcctaggaggttgaggctacagtgagaaagaagagagagaaaagaaagagaagaaacagaagaaagaaaagaaagggaagaaagagaagagaagaaagaaaagaaagaaggaaagaagatggaaggaaagaaggaaggaaggaaggaaggaacaaaaaagagagagaaagaaaagaaagaaaaagaaagaaagaaagaaaggaaggaaaggaaaagaaaggaaaagaaaagagaagaaaatcctgtcctacagtcttttctaggttccctggataagtgaacatatctggaaacatttcaacttcaaatctagcagcaaatgccatttcaaagagtgataaaaaggtatacagtcaactgacttcagtggctcatgcctataatcccagtactttgggacgccaaggaggaaggagtgcttgaggccaggagttccacacaaacctgggtaacatagcaagaccccatctctacaaaataaaaattaaaaaattagtggcacatgatgatttgcagctacagtcccagctactcaggaggctgaggcagaaggatggcttaagcccagaagtccaggctgcagtaagctatgactgggccactgccctccagcctgggtgacagagcaagactccgtttctaaaattaaagaaaaaaaaaaaagagggtacatagtcaaactcagatgtttcccataagattgcaataagagttgctaagctgagaaatgagatttgttttcagtttcagagaaaatgaatcattcagtcagggcaggagacgataaagaagaaagaagaaaagggactgttttcagaccaagacaacatttggactaaaaacttgtttccttaaattcagagtggaaagaagagaaagaatagctgtactactaaaatcataaggtacttcctcaaaattctgcatagagctgcaattcaggtgctgtaactgttctattgcctttattaaaacagcatcacaggccaggtgtggtggctgatgcctgtaatcctagcactttgggaggctgaggcaggcgaatcgcttgagtccaggagttcgagaccagcctggacaacatagcgaaaccccatctctacaaaaagaaaaaaacaaacccagaaattagcagggtgtggtggcgtaagcctatggtcccagctacttggggggctgaggcaggaggatcccctgaacctgggaggtcaaggttgcactgagccgagactgtgccactgcactccagcctaggtgacaaagtgagaccctgtctcaaaaaaacccaaaacaaaaaaaaccagcatcatagatgagaggttaaagaacagataaaggagaagatttcataaaagtgtgaaatttttttggtctcagcatatttaaatgctggctataatagccttctccaagctaatttataattgagggtttgaaataaatgttatgtgttttaaacatatttaaagtagtttccccatttttttttttttgttttgtttttgagatggagtcttgctctgtcacctaggctggagtgcagtggcataaccttggctcactgcaacctccacctcccaggttcaagtgattctcctgcctcagcctgccgagtagctgggactacaggcgcgtgccaccaggcccaacaaatttttgtatttttagtggcgacagggtttcactatgttggccaggctggtctcgaactcctgacttcatgatccacctgccttggcctcccaaactgctgagactgcaggcgtgtgccaccgcgcccagccccctccccatgttttaaagacacttccaaaagttccaagcagactttaccaataaaggtaaaaattaaatcttacttttctgcagcaagaaagattccagatgcacagtctgctttaaattctggctcacacgaatccagaaaataaagtaattctttcatcatgcctcggatattattcccatttaccagggcaaaactcaattccattgcacgccttgcagaagggaaaaattaaaaacagttaagaaatttatagtggaaatgaaacaaagacccaggtatgcactctgtgaacaccaagtactgccagatgtgctgacgtccttgcacgatcttgtgatcccaatctttgcacacgaaataaccaaggagatgtattcttacataatcaaagttagttttgatattttgaatcttcatgcaatattcttcttcaaaagtccctacgagatataccactaatgtccaaacatgcagcttgggttcaacaggctgttctacaaaggtggaagttagaatacctgagagtctcaaaaagaggggcaacaaataaatgtattacccaataataatacctatctgcctcattccttaaaaatgtgacatgttaagtcaccatattctacttttattacaccccactctgtccaaacatgatgtaatatagtttatgtcaaaaggtatgcagaaaattcaaattaaaaacaaattcaaggccgagcgtggtggctcacacctgttttctcaccactttgggaggccaaggcaggcgaatcacctgaggtcaggagtttgagaccagcatggccaacatggtgaaagcacttctgtactaaaaatacaaaaattagccgggcatggtggtgggcgcctgtagtcccaggtactagggaggctgaggtaggagaattgcttgaacccaggagacagagattgcagtgaagtgaggcactccagcctcggaaacagagtgagactctgtctcaaaaaaaaaaaaaaaaaattcaaagggaaaatgagggccatgagaaggaaaaaaaaaatggcatgtcctaggaggacaaataagagtttctataactgcctattcaaagttggcaatgaagttaaaaataggaatgtttaacatgtaaaagctgtaaggttgctatatgcatctttccatacttggtcaataatatcaaacactatatgtacactgactttcaaaagtaacaatttaggctgggcacaagtggctcacgcctgtaatcccagcactttgggaggccaaggcaggcagatcacctgaggtcaggagttcgagaccaacctagccaatacggcaaaaccctgtctctactaaaaatataaaaattagccgggtgtggtggcaggcgcctgtaatcccaggtacttgagaggctgagacaggagaatcgcttgaactcaggagacggaagttgcagtgagccgaggtcgcaccaccacactccagcctgagcgacacaagactccgtctccaaaaaaaaaaaaaaattaacgagtggggatactttcatcttagctaacatgtaagtagcaaaaaattcaatccttagatataataacttttatagggtgcttatgtaatttacatatattaattcaatttatcctgcataaccctatgaagtggttgcccttctatctgtattttacttatgaggcaattgaggcactgaaagtttaagtaatttgacccagtctattaaaggcagagtcagaaaatgaaatgaggcagtctggctccagagtctaagctcttactgttatatatcctttcaaagagacacaagtttcactttttttgaaattcacagcccagtaatgagctagagagaaacaacacaaaaagagtcagaaggctaatatctattcccaggactgccccttacaaggattaaggtttaggttaagtcatttgatccccatgggactgaattgtaactaatctgttaattagggatagaagtagttgcttaggctctctcattggcctgctctgagaacccactgagagggtacttataaaatcttttgcaaagcactatataaaagttggtgttattaagtttaggtcttatctttagattgctcaagcacttagcaccttttatttgtacctgttctgtgcaaatcaaaggaactcaccatcaataaatgtttgttaactgaatggtttcagagatcactttaaatatactttgttctagatttgaacatacaaccaaaagttcagaggccaactttagctaagttctacatattctacaaacatctagagttctaagaagacatccagtagaattactccactgagggaagagatttatgctttttgagagtgctacctgctgcctaacagtcatttcaggatacactgttctaagcaatatgctgccttcaggatcctggggcgtaagtactgtgaaaaacgtgtgctgtcagcagtttgagtgtcagcattgtgacaagacacttagccgatggatcactccgtactttcatcctccaacacacaaagcacagtacctccactaggtaaacttttgcctagcttatctgtgcctgttgtatttatcaaagagccaaggacaacttcagtgtgcacttaagtattcttattggcctccttaacaacctaaacttctccctgccaatcctttctaaaaaaaggattcactgagcagagtccatctgtgaacacaatgactaaatacataaatgtcaacactcttgctctgaaaacaaagtatcacatggcagcggcatagagctatcaataatctgtcactcaatttaccaaaaacactagactgagaaaggctctcagtttgttaccgttttattgagacatccaaatctttaagacagtccacaattgtgcttctgtgcctctgtactgcattatgatctgtctgtacagtcttcaacaaagatgtcagagccacatatctggatgaaacagttgcaaaataacagagttaaaatgtaaaattcaggatagtttttctccgtttaaataataaaaagaaagacgtctaatggataagagaaagcatacatttttatttaaaagaaagttagtgaacataaaagtaacatttcaaaggtataagcgataccataatctaaaatagtggcaaccaggaggtgctttggattttagatttgtattcatggtcaagtccttttaaacttctaaaagtaggccgggcatggtggctcacacctgtaatcccagcactgtgggaggccgaggcaggtggatacctgaggtcaggagttcaagaccagcctggccaacatggtgaaaccctatctctaataaaaatataaaaagtagctgggcacatgggtgttaggtgcctgtagtcccagctactcgaggggctgaggcatgagaattgctggaacctgggaggctgcggttgcagtgggctgagatcatgccactgcactccagcctgggtgacagagcgagactctgtctcaaaaaaaaataaaattgggactgggcgcggtggctcatgcctataatcccagcactttgggaggcccaggtgggcggatcaagaggtcaggagattaagaccaccctggctaccatggtgaaaccacgtctctactaaaaatacaaaaaactagctgggcgtggtggcaggcacctgtagtcccagctactcaggaggctgaggcaggagaatggcgtgaacccaggaggtggagcttgcagtcagcggagatcgtgccactgcactccagcctaggcgacagagcgagactctgtctcaaaaaaaaaaaaaattaattaaattaaattaaatataaaatataaaataaatagaagtgactgactcaattctttaaaagttttccaaatagtaaaacaaaaagagcatataatatgtcttttaaggctgcctttcccccaaaatgcaattttacttttaacatgtgagttttctctgcttttatttgatctagtaccaaaactgtatctataaaaatttgagtttaaaatccaagtatttaacttagtatgttagtgttttaacattttatttatgtatttattttttaatagagatggggtcccccactatgttgcccaggctggtctcaaactcttgggctcaagcgttcctcccaccttagcctgccaaagtgctggattacaggtgtgagccaccacgcccggcaatccaagtgttctttagaaggagaagataactcagggtgccacaataattatttccacatctttttttttttttttttgaaacagggtctcggccaggtgtggtggctcacgcctgtaatcccagcacttcaggaggacaaggtgggctgattacctaaggttaggagttaaagaccagcccagccaacatggtgaaaccccgtctctactaaaaatacaaaaaaattagctgggcgtggtggcgttcgcctgtaaacccagctactcgggagggtgaggcaagagaatcgcttgaactcgggaggcggaggttgcagtgagccaagattgtgccactgcactccagcctgggcaacaagagcgaaactccatctcaaaaaaaaaaaaaaaaagaaacagggtctctctgtgtcacctagactggaatgcagtggcatgatcacagctcactgcagctttaacctcctgggttcaggtgatcctcccacctcagcctcctgagtagctgggactacaggtgcacatcaccaagccacctggctcatttttgtatttttctgtagagatggagttttgccatgttgcccaggctggtctcgaactcctgggatcatgatctacccatctctgcctcccaaagtgttggcattacaggggtgaaccactacgcctagcttccacatcttttcatgtttaatacaagaaaaatttctcctgattagaaaaacaggtaagcaggaatacgtactacatacaggaaaataacaaaataaaagataatactgatcaattcatttacctaaaaaactagctagagttcacaaagacattccagatttgctacctgaaatgttacatatttcttaatttagagcaggggtcaacaaactacagcccacctgtaaaacccagctctctgctgttttcgtacatcaaaatatttttttcatactagctcccaagtttcatgtaaataaatcaatttactgaacacagacacactcatcatttacatattatctatggctaatttcatgctaaggggcagaggtgagtagttaccaaagactccatggcccacaaagcctaaaatatttaccatctgaccctttacagaaaaattttgctgactcctgatttacagaacaaataggaatatatgccatgagataaatcctcaagttcttcacaaaacagtgttttaagaccagaaaaacataaaaattctgagctaaaagttctaaatatgtgacttaatacatgtatgatcttgagcagaatcgctcttaaaatactgggcttataatatccaagataaaagacatatttcagttaacttacctaatattcttgtcattgttcaataagaaacgacccaggatatttatggctaggacctaaagagaaacagcataggtcgaaatttaggaaaatggaagttttatattgtttcctgagtttaaaggatcacttcatgacctctggtgcttcacagactgctagcaaaaaaaaaaaggagctgggtgcggtggctcacgcctgtaatcccagaactttgggaggccaaggccggtggatcgccaggtcagtgagtcaagatcataccactgtattccagtcggagcaacagagcaagactccatctcaaaaaaaaaaaaaaaaaaaaaaaggaaaaaatctaaaggcaaactcttaaaatcatattctaaaggtaagtgctggaaggttgttttaatgctttgacagtgttttgtcagtggaagaataatattagtacagcctctttagagggaaatctggcaataactatatttaaaatgaatatatattccctgttttatcaatttcacttttaggaattgatctgacaaacaactgtacatatagacaaaagtctactgtggcactactgataactgcaaatgataggagataccctaaaactccgttaatagcaaatttgctaattatactatggcacacccatgcaatatggaatgtcacgcagccattaagacagaatgcattctgacacatggttcaaccttgaagacattatgttaaatgaaataagataatctgcttttcaaaaggataaaaactgaacaattccacttatatgaggtactgtgatatggtgaaatacatatgtggtttttgtccctgtttcctggcatacaactcctaaatcccttggaatttcctgtgtgacagcatctttagttctaatgatatgactctcaatgggctcctaagatagcctcagaatggagactggtttccaggggaacaaccatgatattagacgattggaactttcagtctcatcccccaaccttggggaggggagagatgctgaaggttaagctgatcaccgatgatttaatcaatcatgtctgtgtaatgaggcctccaaaaatcccaaatggacagggttcagaggagcttccagatagctgaacatgtggagcttcctggagggcagcacatctggagagggtatggaagcttccaactccttcccacatgccttgccctatgcatctcttccatctggctgttcatctatatcctttataacaaaccagcaagcataagtaaagtgttttcctgagttctgtgagccactctagcaaactaaccaaaactgaggagggggttgtgggaaccctgacttacaactggttagtcagaagcacaggtcacaatctgagcttgggagtggcatctgaagttggggcggcggggggtcagtcttctgggactgagccctcaaactgtgggatgtgacaccttatctccagggagacagtgtcagaattgaattcaattagaagatacccagctggtattcaccagaaaactgcttgatgtatagggaaatagccccaacacatatggcgtcagaagtgaaatgctggagctggacatgatggctcacattactcgggaggctgaggtggaaagattgcttgaggccaggagttcaagatcagcctgagcaacagggagagaccctgtcactaaaacaaaacaaaaaagaagtgaagtgttgaatgattgtgtgagagtagagagtaaaaagtagaaaaaacattttgggtttttttcttgtatctcttcagaggcacctgagagtagtcaaattcacagacggaaagtagaatggtggttgccagggactacagatagttacagcatggagagttattgtttaatggatacagactttaagaacacaaaaaagttctggagataaactatagtactggttacacaacaagatgagtgtactaactgaactgttcacttaaaaatgcttaaaatggttaattttatgttatatatattttatcacaattaagaaaaaaagaacatgacttatctctatgcatgaatttggaagtggctccaagataatgttaggtgaacaaagtatggtgcgaacaatatatatggtatgttaccattctgtctgaaaggtggggagaggaaaagaacttaacctaagttactttggttatctaactagatactataatgctaccgacaaaaagaactgtacacaaatattatactctagtaaatttgctttttacaaggctataggctaatagttctaatattaataaatgatagaatgaacaaattcatgaaggagaagggataactcctctttatagaagaattccaattaatgagaaaaaaatgagggaaatgaaaaattgtcattagaatacatcttaataattgttgtgggccagatcctctggtggatactaaaactgataggtaaaagtctgagaataggatatttacatagtctcaaaatatctgccaaaatatttttaattacaaaagaaaaaataatgactttacagtggacagacccagcagacaccatctcaaccaaatgatcaaggttaacgtcaccaatgataagacaaatatatctactatattgctacacctgagatctcccaaagtttattataatcaatgttaagccttcagtgggaaggaatatttcagataccaaaaatccagcattccacattttgcatcattctttcttaaagtcgagttccaaatggaatacaattctgaagtactgaagtccaagtcaaccattctaagtgaaacatttagggggggaagaaaagattcaaaaagacttactcgcaatccactctctgacttaatatccatgatagtcaaaaccgtttcataaagaatagcatttcctacatttttactagtctcagtattagtggcaacctgaaaagacatatcgagggcagtacataagtgataaaaacaatgctcccaaaacatattcacaggtaacaagaggcattttgtgattacagctatgaatgaggaaacacaaataaaaactgctccatataaccataatcattctactcccagcgaaactaaaataaatatatatttaatatgtttggtctactcacctgtgctaatatatcattcatagcttcacttgaatcatcatcatttcgtcctaaaattcttaataaccgcaaaattcgtacctaacgtgcaaaagatgagaggtgtcaacaaattatgtctcacacaaagaaatctcacttggtatgaaattcaaataactaaatgaagtcttagaaattcatttggaaccatttattcatatcagaaatagtcaaaaatcaaacagaagaattgaaaacattttctttatttagagaagctatatatgcttctacatctaataaagttattataaaacaacccacacttcagtactccacagctaaaggatactaccagatactaccacctgcagagctatattaaataattcaaataataaatgattttgactattaaaactgtaatttgaagtggggcacagtggctcttgcctgtaatcccagtactttgagaggctgaggggggcgggctacttgagtccaggagtttgagaccagcctaggcaacatggcaaaaccctgtctctacaaaatatacaaaatgagccgggcatggtggcatgcacctgaaatcccagctacttgggaagatcacttgaccctgggaggtcgaggctgcagtgaggcaagattgtgccactgcactccagcctaagtgacagagcaagacctgtaattgtatcctcttaatctaatatagaattgtgtcactattcattaatataattaatcaattaactaccaaatttctactcaacacaaacttaagaggaaggaaattgtctacttaaagatattaaattcatataacatttatttaaaacgttctttcaacctcacctgcaaaaaggggtcactgataccagaaacatcatgttctggtgaatatccggacatgatgaggttctttaaaatacgaactaattggggcacaagctgcagagaagaaagatgcatcaaaaaacagtgaatattgaagaatgtctcatgaataagcaggtcctttggtttagaaaaagggtgtaagggtcccagtccaagcaaattctactgatttaatatactagtgtattgtagatgtttgataaacttaggagtaacttagggcaatattcaagaagtagtatgtattttatctggataaaaccaaaccagacttttttatgcaagagttatatgtaaagatattacaaataatattgggtcagaaagcctatgggaaccaggtaaaacagatgcctatggggcataccgcatttctagttctgtagaacttgaaaagcctaggtggcaaaaacatgttcagttttcacccattcaaacatttgcatgtaacatgtcatcatgccaaaatacaactagtgatcttattaaaattatagctttaaaacatacaacctcaaatagagaaaaaaatctcttctcttaagatagaagagttatacccttttccaacaaacaacagggaataccaaagctgacaatagtaatacggtaatcaaatggaagacacatgaaaaaattacatctttcatcttaagagacatcaaggccatgaataatttcctcttcctattcttaactcctatgatacaatttttttaaatttcaggacttatttatatatatggctttatggcctgttttcttgtcttttcaatgagactatacattccttataatcaggaatttccttcctatccttcctttactttatccattaagagtcctaacacatagtaaaggcaattttactgccaagccgaagatgttttaaatattggcactcatttcatttctgttgatcaattacttgatattaaaacaaaaggtttgccacaataggaactttttatgtttccaactaaaaactcaatttttagctatataaacaactctaatgaccaaaaattaagttaaatagtgtgcaaagtgaattgcattccatctcttttgcaggcaattttagctacaactctgctgcaactcagttattttttctcactatatttagactctgtcccttccctactccccaagcctaaaaggggatcaagattgaaatgaaaagccaagctatatccaaggcatgcactcaaagcattcaaaacattaaggccacttataaacacaagaaaacacagtatgtaagaatttaaataagttgagccataacagtttggaattaagtaacttataagtcacctaaacaaaagtctactttggacaactccaaataagacaaatctaagccatggagatctgtaaattcattaaatctgtcaactatgggcaaagttatattagagataataatataccttttaaaaccactttaaatcaatatttttgtaataaaatgaagaccaagtagttaccaaccttatcttacatacttcccaatggtctgttttttttgtactagatataaccctagttattttttatctggtttatttcttggaaaagtcatttttccttgggctactaaattcagaaattgttttatccactgccaaaaaggccagcacatcacataacattaccctgggacacagagcacaaatgactaaatgttcagcatacaattcttggaacccagtttcatttttcagacaaaaatgcaagttattaaaactgatgacaagacaaacaaaataagatgacacagggaaaggctgcagccatgaaaatcagttggtgcccactactctacctcaaaatccttttaatattccaaaacttctatgtaagattaagtacaggtaagagagaaataaaatctctaagtgtgaactgaaagctcagcagtacatacggagctttttaaagtatgaggttacccacatgcggttctaaaatatctacttcaaaaagcagcagcattttgtgtcaaagctccagactaatctggaattgccatcaccaaagccactgggaaactgctcaaagtttctcaagtaaagataaagaaaaggcagagaagaaggcttacaactcaggaaaggctgcaactgaaatccaaggctgactttggagtcaggagtttaagtgacaaaacaaaaactagactaggaagttagccaaagatggtagaacaataactcacagtattaagcacagcttcagcattagtatattttaaaagccacatttgtggatcgatacacaaaagctactaaggacctaatgccagcatgcaccatctaaaagagggttaattcttaccttttcattctaacatacagcaggattccaaacagacaacaggaacaaaacatacaaagcaagcattagggacagatacgggtctcatactatattacaataatttaatcaagacatgaacatctaagggaaaaaaagccaaaaaagaactcctgttagagccttactagatctaaagtacaaagtgagttctatttatggaatgaccagcatcctataaaagaagttcaatgcatgtaactacccaaagaacagtcttcttctgagtctaaaattaagtggagaaacagaaatgtccagtttaaaatactagtttaaaaaaaaaaaaaaaaaaaaaaaggccgggcgcggtagctcacgcctgtaatcccagcacttgaggaggctgaggcgggtggatcacctgaggtcaagagttcgaaccagcctggctaacatggtgaaaccccatctctactaaaaatacaaaacaaaattagccgggcatggtggcaggcgcctgtagtcccagctactcaggaggctgagggaggagaatcacttgaacccaggaggtggaggttgcagtgagccaagattgcaccactgcacctcagcctgggcgacagagccagactccgccacaaaaaaaaaaaaagagagaagggagtacttaagagaactaagacttccatcacaggagtcaatgtcctaaaacgaacagtagagtaaaagtaataaaaaaatttttagttttaaccttaaaaaaatagaaaagagctgggcgcggtggctcacgcctgtaatcacagcactttgggaggctgaggcgggtggatcacgaggtcaggagatcaagaccatcctggctaacacagtgaaaccctgactctactaaaaatacaaaaaattagccaggcgtggtgccaggcacctgcagtcccagctacttgggaggctgaggcagcaggagaatggcatgaacccgggaggcggaacttgcagcgagccaagatcgcgccactgcactccagcatgggcgacagagcaagactctgtctcaaaaaaaaaaaaaaaaaaaaaaagaaaagaaaagaaattcctgcctttaaaaaaaaaatacaaaaaaaaaaaaaaaaaaaacaggccaggagcagtggctcacacctgtaatcccagcactttgggaggctgaggcgggctgatcacctgaggtcaggagttcaagaccagcttggccaacatggtgaaaccccgactctcctaaaaatacaaaaattagatgggcatggtggcgcgcacctgtaatcccagctacaaggaaggctgaggcaggagaatcacttgaacccaggaggaggaggttgcagtgagctgagatcacgccattgcactccagcctgggcaaaaagagcaaaactacatctcaaaaaaaaaaacaacacacacaaaactcctatttctaatttgacctcagatcatgtttcttgactcaaatgtgaaaacagtagataaaacacatgagattggtgtgtctgccaacaatgagagaagacttctattatgaaagggaaaacacaatactagtgccagttctcacttatatgcctaaatctggcttccaggccaattgcatagcagggctagttaaatcccttattcagatccatagcttgctttcaaaaaaaaataagaagaaaatcatgtacttttcaggaaaatcatttttcaatcaagaaaggcttaggcatacagaatggcacctacctttctgaaatgcgcaagcatgtctgggcttcgctcacacatttctgtgaggaggactacagatgtgtggaggacacctgaaagaaaagatcaaaggaaaactaaaaatgaggcctattattcaattttatagaacaggactttgagttcctgaaggtcaattccaaaaggatagttgctacttttgctttttaatcccccaaagcatctaagcattgaagtgaatacaaaggaagaacttaatagatgcctgatttaaaactggccaagttggtaaaatcggaatgttttcaacaattatgtgatcaaaataattatgaaaaagtgacgaccaatacatatgtctctccatctgagaatatccataaaaacacacaatgcaagctaggtatgatctgttctatacttaatcagtaagctattatctgagtactaacagataattcaagaggcaaaaatcttagtaagattttacatttccagataaaacgcatcaaaactctgagaaaactttggatgacaaagtaaatttaactgctccagagtcagtaaaaacaatctcacaatgcttttcactaaataataaatacgtgctccaaataattcagttgttcaacaagtatattttgagcattctgggcacagcactgaatttgtcaaattaaatataccatacaatttttcctcttagcatttaagccacatgaattttctttattcagaacttatttcactgacttcaaataaaaataaaatgtttgagaaaagaacagtcacattccatttaattcctctgttttatacaaagattctgagtacctaatacaagcttctgtcagaaataacccaaaagaattctcacaatttttgagtctggcagggtctggctctgtagcccaggctatagtgcagtggtacaatcttggctcattgcaacttctgcctcccaggtacaagccatcctcccacttcagcctcctgagtggctgggaccacaggcatgtgccatcacacccagctaattctggtattttttacagagatgggttctgactttgttgcccaggctggtcctgagctcaaatgatctgcccaccttggcctcccaaagtgctgggattacaggcatgagctaccacgcccagccgcacaaatcttatactcctaccacatgataatggaattttttcttttattgtaaaataggcaagaaatcaaaggattttacacatgaaaattatgggtaggctcatttgtatattacactaaatattaacaacttaatatttttaataaagtaaaagaggaccagagatgaaagataagtttactatgaaggaatcaatctcttaatataaaactaggatatgtgagtggaaagacttgtcagaccagaccttcctggaaaagtgtctaaggcacagcagaaacgcgactccactgttctgagagacacaggactaacatagccttaagccttttctctttccctttctccctcaatacttcatgaatacatccaaattacattaccatggttcttctcattcaataaattttttgttgctggtaaaaacatctccataagttcaggaactttcctgatgacatgaacagcacacagtgctgcctatgaaaaaaaaaataaaagaacaaaaggtttatttcaattatgccagggcaaccaatcttattaaaaaaccaccaacacaaaaatctcaccaactagttcatctactagaaaaataaagaaggaagaggttagatattagatttatggctcgacacagtgatagcccactcctataatccagcactttgggagccccaaggcaggagaatcacttgagcccaggagtttgagaacagcctgggcaacacagtaagaacctgcctctatttaaaaaaaattaagaggagagaaaattatttattaactggttggggagttccagtttatactattatattaaagagatcttctagttcacctctccctttgttcatatattgctagacaagtaggcaaaaactttctacattagactatgtatggttaatatgaatttatcaaaaagttaaacataatttatgtggagttttaaggaagtaaaaatagataacaatctcaatctgtgataatcatacctctgagtaagatgactaacagcctataaaaacatcacacaactgaaagatatatactgtaaatgctataaatctactgttatgtttaatagtatctatgtggccctcaaatgactctactgacatcaagaaaatcatttgaaaaatacttagtctctactaaagaaaagatggttttactagcttgttcactggaaaataaaagtacatttaaacactgatttttgtatatcccccaaagtaactataactactatatgtttgagtcaaataccataaaagtttagatatattaacaaaaaaaatttctgctaattccatccatgttatatttgggaggaaaaaatatctttttttcttttcttttcttttttttttgagacggagtctcgctcagtcgcccaggctagagtacaatggcgcaatgtcggctcactgcaagctccgcctcctgggttcacatcattctcctgcctcagcctccaggtgagggactacaggcgcccgccaccacgcccggctaattttttttgtatttttagtagagacggggtttcaccatgttagccaggatggtcttgatctcctgaccttgtgatccacccatcttggcctcccaaagtgctgggattacaggcatgagccaccatgcccagcctatcttttttttctaacctgcaggaatgtttcattttaatatgacaatgagctttctgaacaagagtagctcacatattctttaagaaaaaggaccagcttacaaattaagaaaataatttaactttgtttgcagccatcattaactgcatatcatcctgggaaatggcttggccttttcaatgcctctttcccaaaccattaatagagaggcacagtaaatgccaaacagatcacagtttatgttcatttcttggacttctaaattccatacacttcattttcaaaggttgtagggttcaagcaatttttaaaaactcaataaaatgcttatatcaacaaataaaatcagatagaagaataattctcttctattactaatccattcagaaagtgggttctacatcattccctaataattatctaggtcccaatagaactgcccttccagagacacaaaggcactaatacaaagatatgggtattaattattaggacaaaagtaaattcataaaaatctgttcataatcaccttgctgtaatactgtttagaatcagataacttaggaatttggtatgccacctaggatatatccagtaacatttgtttgtttataaatcatttccttaagaaaagaggaattaaggttaatatataatcatgtaaaacagatttactacacagaaaaaatgactttacattatcatcagatctttcaaaaatgagtaatctgccttctcatctccataatactccctaatccaaacagacatttggttcattaaaagttaccttttttcttaagtaagagttggaggttttcaggagcttctctacctctcctgcaagatctctgcacatctctgaggagcccatgcagccgagggtacaaagtgctaacccctgtacgaattgcgtgctatgattaagatcactgcaaaagaaaagaggaaggtaggaacaagcctggtgctccccaagaagcagcttcacaatttcaaactagttcaggatgactcaagatttctccaataacaaaaacaataggattatttgttgcagaaaatgtttatcccaactttattacaaattatcaatatagtaaacagactgacagtccctcctataggcttacaagccaatgtttccaggtaccaaagcagtggaagttgaaaaacatgttatctactggatgtcagacacacactttagaaaactcagcaaacttggcagcagggtaggggtggttcacacctgtaatcctagcactttcagaggccgaggcaagtggatcacctgaagtcaagagttcgagaccagcctggccaacatggtgaaacctcatctccactaaaactgtaaaaattggccgagcgtggtggcgggcgcctataatcccagctacttgggaggctgagtagctacccaggttcaagtgattcttctgcctcagcctctcaagtagctgggactacaggcgcacgccaccacgtcccattaatttttgtattttgtatttttagtagaaacggggtttcaccacattggccaggctggtcttgaactcctgacctcgtgatctgagatcacgccactgcagtccagcctgggcaacagagcgagactccgtctcaaaaagaaaaaaaaaaaaaaaccagaacaaagtaggccaggcacagtggctcaagcctgtaaccctagtactttgggaagccgaggtgcatggataatctgaggtcaggagttcgagaccagcctggccaacatggtgaaaccccgtctctactaaaaatacaaaaattagccaggcgtggtggcaggtgcctataatcccagctacgcaggaggctgaggcaggagaatcacttcaaccagactggcagttgggggaggacggtggcagcggaggaggatgcagtgagtcaagatcacgccacttcactccagcctgggcaaaagagcaagactccgtctcaaagaaaatacaaaaaagaacaaagtagttaacagttgttagaagaaagaaaagtaagacttacttcttgatacagttggtcatgagaagatggacatcttgtctttcatctaacagcagcattgcccctaaatagccaatgcgtttgtctgtaaatttttgagaggcaataagcttgaggcactccaactgcaaaaaaagaaaaaaaaaaagaaggaaattaaaacttgctaccacaatctagaaaagcagtgtttttaacccagagtccccagctggctaaagtaaagtacaaatgtgtttcatcaaactacctaaatcttttcttttttttgagacggggtttcgctctggttggccaggctggagtgcaatggtgtgatctcggctcactgcaacctctgcctcccaggttcaagccattctcctgcctcagcctcccgagtagctgggattacaggaattagccaccatgcctggctaatttttgcatttttagtagagacagggtttcaccatgttggtcaggctggtctcaaactcctgacctctgccgatccacctgccttggcctcccaaagtgctgggattacaggcatgagccaccgcgcctggctttttttttttttttttttttttgagatggggtttttgctcttgtcgcccaggctagagtgcaatggcgcgatcccagcttactgcaacctccacctcctgggttcaagcgattctcctgcctcagcctcccaagtaaatgggactacaggcccccaccaccaaacccaggtaattttttttttgtatttttagaacagacagggtttcaacatgttggccaggctggtcacggactcctgaccacagatgattcgcccgcctcagcctcccaaagtgctggtattacaggcctgagccaccgcgcccggccaaactacctaaatctttttagaaggcaaagatttaagacctttggatatcttaatagaaatcaagttctagaacagatcattttatcaaggccccatgatatttgccattcaaataatctctcagttttgcattagttttgcagattcacacaaacacaaactagaagtattataagagattaacaaaccaaattcctactttaatccccaagttacattaaatgagcacctaacgtgtacttaaggtatagttccattttgggaattaaaaaaaactcaataactagaaatacaccaacccatactaaccatgaggaatgtataattaatttaaaaagagagaggcaataactaagtttaatataatgtggaaagtatgtgaaccaagtacattcagagcttgatccaagtactacgggagagggcgagggtttaggaatccaatacagaaaaaacaaaaaacagaggaaaactcagtagtggaattaagctaaaacgatttacatttcttctttacatcattgttagaaatagcttcttagggcttaagagttcttgtaaattagtttgtccctctactttgcctttcttgaaccaccttcaaaatcactttgacatactttatcactccatcttgacaaacatggaaaaggccaaaacattacctctagagcagtattcaaagtgcgtacacaagacagactaaccaagaagagttataaaaaccatgatcccctttagaatcatacctcccaagggaaggggctcaaatggatacctgtgtatacaggaagctaaaatcacgtgagactactttccattatgaatttatctactaaattcgaaagtgaaattgaggaaagtaaaacagttccacagagttgtttcaagctatttaaaaattgctctctcaatgtacctgcattaaaaacatctaaagttagctgaatgactatactatcacgagcatttcaaagaagtctccaaggaacataaccaggatcaaaaaggaaaacataaatgcctgtgaaatggaaaagattatgtaagtaacaaatcttccctttcttcttcacattgaatttaaatttaaacagcaatttctgaaacagaagttgatgaaagtcatctttacaatgtcaacagaaaatttactaaggtgaatgagaaaatcagaagctaaaatattatcaaacaaaccttactctttttcaaactggtttttcaatcttctcatttcataattctataagtattttagtagtgaaagcaaatgttccaagaatcagatatcagagttttcatcatcctcattcaatcttacttctgacaaactccaagcattacacagataaattatccaaaaatattttattaggaataggacatactcttaggcattaatactactttgtggttttagggtcaagtgtggtttttttgttttggttttttttgcacgaccatttcttattaaactatacaaaaaaaggcaggccaggagcagtggctcatgcctgtaatcccagcactttgggaggccaaggtggatggatcacctgagatcaggagttcgagaccagcctggtcaacatgatgaaaccccgtttctactaaaaataaaaaattagccaggtgtggtggtgggcgcctgtaatcccagctactcgggaggctgaggcaggagaatggtttgaaatttgaaggcgggaggttgcagtgagctgagatcgcgccactgcactccagcctaggaaaacagccaaactgttacaaaaaaaaaaaaaaaaaaaaaaaaaaaactataccaaaaagggaggggagggaggcagctgtggggtttggccccaaccccagcccacccccagtctggcgctgtcttagaggaggggatctgagggagatcccaggcaggatagggatgaggcaggacatgaggctaggggatgcagaggttaggcaggagaggctaccagagggtggggggagcgggagggaggcaagaagaaaacaaagagagaggagcaactgggggccagctggggagctcagatggagtaggtcaggaggtggaacaatggtagagtgagggtggaggggtcagtgtctgggagaggtggaaatgagaaagctggggagaaagaagagggtggcggctctggtgcagggcccatagcaaggagccaggcgaagagtggctggacttgtctgttcccaccccaacctccaggccgagagaggcctcccatccccagcctgttggcaggcggtcatgccgatgccccattctgtcttctactgctagggatccggttcatcctcctcttcggcagctctcttcagctcgggcccttcatcatctccttcttcctcttcgggcccgttctcctcctcctccaccacttctttctttcgctctttctggcttgcctcctcctccaccttctccttcaggtccttggtgcccaactcagccactgcctccatgcttttctccaacatggtgctaggactggagctggcaggcagctagggtcccagggccaagacagaggggccctggacagtggagggcggctgagaccagaacctggcattgtgacagtggtggcggcagcagcagttgctcagtcgggtcaagttttaagatagtcacactaagtcaccagtgactgacgaatacaagctgttttttgtaacatttaagacatacctaaaatttgctctcttcctctgtgtgcagtaggcacagagaagaagtggaaaaacaaaacaaataacaacaacaaaaaaaccttacctaaaaactaaacagcaaaaagaaaagctgaaatttaaaggggcaagcattatttcaatattcccccatttatagtgactctgcttcaaaaacaagcatttgctttttgaaggtgacaaatctaagggaaaatataaggttatatgactggaaatagcatctgatatatacactccagtgatggattaactctgatcacactttatacttaagtggccagccatagtgctgagaacataccatgtttaatctttaagaatattatcaaggccgggcgcagtggctcacacctgtaatcctagcactttgggaggccgaggtgggtggactgcctgagctcaggagttctagaccagcctgcgcaacacggtgaaaccctgtctctactgaaatacaaaaaattagccaggcgtagcggcgtgagcctgtaatcccagctacccgggaggctgaggaaggagaatcacttgaaagcaggaggagtaggttgcagtgagctgagatcgcgccactgccctccagccagggcaacaaattgagattctgtcttaaaaaaaaaaaaagaaagaaagaaaaaaaaaaagaatgttatcaaagttatcaaatgttgaaaaagaaagataaaggtttggggggaaaaagtacaatgggggagatgcacacaaaaggagggcatccgtttttccgcagcaatctccaaatctccaaaagcaaaactccacactgttgcatgagttaaagaacagaaggaaaaaagtaatcaattacatgcatctgccccttaggtaacaatctcaaatatttcaatggagtactactactccacttaaagcgacttgaaaaacctacctgaaacatttctaaccacaactctagcagacgctttaataagaccagagtaaacagtccagcttttatatccaaattccacacaattaatggaaaacttttacttcaaactcttctcagcagaagcattctagtcagccattagcaacaagcctaagagatcgaagttttcagccccctttgtaacaaatacagtgcctgaagaagtggttcccaaacttaactggtcagaacaggtaggagagttttgaaaactatgggtcaccgcccccaccccacccccgccaatattctgatggagtaaatttgacatagacactgacaatttaatttttacaaagtttttctatatgactctcttttttggggagtaggggggagagtctcactctgacacccaggctggagtgcagtggtgctatctcggctcaacacaacctcctctgactctcacgttcaagcagttctcgtgcctcaacctcccaagtagctggaactacagatgcgtgccaccaaccccagctaatttttgtgtttttagtagagatggggttttgtcacgttaaccaggctggtctcaaactcctggcttcaagtgatctgcccacctcgcctcccaaagcactggtattacaggtgtgagcaatcacaccccgccaaatggctcttaatgttacaattttctttgaatttcaaagctattttacgaagagaattttccatgtttctggcctttttacatcttcctgtagcaagtacaaatgttgccatttatcagtgtttaatccggttacccctggataaaagctgcacctattttgttagcttttagaacagtttcgcacacggtcagatgcacatctaaattgctcacacctgtaatcccagcactttggggaggccaaggcgggagtattccttaagcccaggagctcgagacaagtccaggcaacccagcaagaccccatctctacaaaatttaaaaacaaaaaattttgtttcagtttttttttgttttttttttttttttgagacgaagtctggctctgtcacccaggctggggtgcagtggtgcgatctcggctcactgcaacctctgcctcctgggttcaagcaattctcctgcctcagcttcccaagtagctaagactacaggcacgcaccactatatccggctaatttttgtatttttagtagagatggggttccgccatgttggccaggctggtcttgaactcctgacctcaagcaatccacccgttttggcctcgtgctgggattacaggcgtgagccaccgcgccggccaaaagtttcttaaacaaagttttgtcttaaaattttgtttaaaaatttttttaaatcagccaggcgtggtggcatgcacctgtagtctcaactactcaggaggctcaggcaccaggatcgcttgagcctcctgttgaaggctgcagtgaactacgattgcaccactgcactccagcctgagtgacagagtaagatcctgtctcttaatttaaaaaaaaaaaaaaaaaaaattgcagctttatgatatgaacaatcaccttaatgaaaacatgcaattgaaattctgtaaattttaacaggcctgcaactgattgggtagacctttttaaaagtcacctttatttattttatttttttgtttagagacaggtcttgctctatcgcccaagctgaagtacaatggcatgatcacagttcactgttagttcacagttagtaacctctaactcttgggctcaggccatcctgctgcctcagcctcccaagtagctacaactacaggcatatgccaccacatgaggctaattttttacttttttttttttttttgagctggagtctcactctgtcgcccaggctggagcggggtttcaccgtattgccctggctagtgtcaaactcctgagctcaggccatccgcctgcctcagcttcctaaagtgctggaattacatgcatgagccactgtaccctaccctaactttttacttttgtagagatgaggtctcactatgttacctgggctggtcttgaattcctgtcctcaaacgatccttctgccttggcctcccaaagtgctgggattataggcatggggcaccatacccaacctatttctttttaatattcagaaataactgcctggtttatacacacacacacctaaaatcatcatttttgaaaagcaagcttgttacaactgcactaccactatgtaggcctgacaacataaaatctatatagaccagagtctgtttcttcattcttctggcagaaaaacaaaaaacaaaaacctgacattcctagtgaatccaattttttcttttgagaaaattatgaaatattccactcaaaatacataaaaatcacgtaactgtcactgacacaccaagcagctttatcaaatcttaacatttcaccctatttattttacattacaaattcaaatgaagtcttctgtgtactgggcctcaatctcatttctccatcccagaagtaatcagaaccctaaactgctgctcatgactgccatgccatatattcttactacacatggagagacaggtggttttaaatgttttaaactttaaacaaatatcaaactgtattcccgctcttttcactcaacagctttgagtattactcacatcaagacaagaagatctaattcagtcataactcactgctacatagtatcccacttttgaatataaacttacctattatctgaggacaaacagattgtttgcaatgttttacctattagaaacactgctgaaatgaatactcttatacatacatgtctttgtatactggaaaatttatctaggttatatacctaaggaggcttgatcaaattcagacttttcaggttttgctttgttctgttgtgatctcattttgcaaatatgcaccacttagagccagtggtatgaactttcaccaggaggcgtataattatttctggtagtcgtctctcttttgtgacattagcagcaactgacgatcatcatgggttgcaaaatgattagattctaattcattccttcatttattagttggactacagctctaagaagaaacttctctatacagaaggaaggccatactattgctaaggaaaggcaatataaacgtttatttcaatcaattgcaattattatcctttttttattgacacagagtctcactctgccaaccaggatggagtgcagtggcacgatctcgcctcactgcaacctccgcctcccaggttcaagtgattctcaagcctcagcctccggaatacctgggattacaggtatctgccaccatgcccggctaatttttgtatttttagtagagatggggtttcactatgtttgtcaggctggtctcgaactcctgagctcaagcaatctgcccgcctcagcctcacaaaagactgagattacaagtttagtcaccgcacccagcctacaattattattattattattattatttttattattattttgagatggagtctcgctctgttgcccagggtggagtgcagtggcgcagtcttggctcactgcaacctccacctcccgggttcaagcgattctcctgcctcagtctcctgagtagctgggattaataggcgcctgacaccacacctggttaatttttgtatttttagtagagacagggtttcatcatgttggccaggatggtattgaactcctgacctcgtgatctgcctgcctcggcctcccaaagtgctgggattacaggtgtgagccaccatgcccagccgattattattcttattaatactcaaattatctcttttgggggtatgactgcctcttctggtgattactgaaaccttctgacatgatctttgcagtctttcttgctttctggcatagtaacatcattcaagcttattttgtacatttccttaccctggatttgggatcagccatctttccaatgggctgaaaatagtatctggagaccacagtctaggcttaaggatagctcattgcttctggtctggtcattaattctaaggcttttcaaggaatagtactagcttaagtactttattttaagaaaaaaattccttaatgtgagaaagcgtgtctactaaaccctatgacagtcacccacatattactgtagagcatttgtttacggctttaacaagagtggctattatcatcacttatttgcaataatgtactacctgtacagtgtaataagaaaataagaaaatgtataaggatatcaaaggaaaaaaaagaactgccattgtttgcagacaatagtagtattgactacatggaaacaatgacgtccacagagactcttagaaccaagttcaataatgtggcaaagtagataaatattattaaaaatcaattatatcactacagatctacaacataattatttaaaattttaaaggatactatttgcaacagaaacaagagctctaaagaacctacaaatatatttctccaaagatgtgttaagacttaaaaatcctgtgttttaaaggaaatttttttttaattttttaaaaagatgtataagactgtacagaaaacattgtaaaatttagagaagctaaagaagtgcagtcctatgctacacagatggaagggaagaatatcctacacaggtaattgggtatggcaagcaaggctagaactgaggaaaaacagaatcaggcccagcctaaaagcagcacactactgacatatggaaatgtagatttccattccacaaatcttactatgtttctaagagaaactagaagtccagatttctatggaaattcttttttcttttttatgtactggcagaaacaattttaaataccacacaggacaaaaaagaacacatctgtggaagaatttggccccgagccaccagttttctactcctgcaatctacctacttatctttagataattcattaatatttctgggttgtgcttaacctacacacgcaaaaggttacacacactacaggaaatctatcaccacttttgttataaaaatgctgaggatactgtctcttacattattaagagactcctagacaaaaggtccatataaaaaatctcttagaattcagtgcttcaaaaaacattgccgtcctttaggaaatggtaaaatgcataacatgaggctttttatatacaaaatgtgtctaacacttataacttaatcttcataataacactataaagtaggcattaagattgtccccattttacagatgaggaaactgagacacagaaaggttaaagatcttgctcaaagccagaagtcacatccaggcaatctggttctctgcagttttgctcttccatcttggcaataacaactacctgagaggtgactgtctcttttcttgccttagctgtcgcaccaacagcaactacactggccttatgctctaaatgcttcctttttccaactcttaatttctactattatttttctctttaatgtagatgctggtagtttatgccatctcaaatcctttgtacagcaaggcagggctaagatatttttttgttgttgttgtttgagacagagtctcgctttgtcgcccaggctggagtgcaatggtatgatctcggctcactgcaacctccaccttccaggttcaagtgattctcctgcctcagcctcccaagtagctgggattacaggcacccaccatcacgcctggctaatttttgtatttttagtagagacagagtttcaccatgttggccaggatggtctcaaactcctgacttcaggtgatccccctaccttggcctcccaaagtgccaggattacaggcgtaagtcaccgtgtccatcctaccccttaagttttattgcaaaacttaagacttttaaaatatagctactagaaatttttaaatttctatgtagcttgtgttttatttctatcagcaccatactagatactgtagtaaaaagttttaaaaaggtgaaattagttttaataatattctttaatcaatatatctaaaatatcatttcaacgtatgatcaacacaaaaattataattaggtattttacacttgcttttgcactaaagcttctatatacagtatgtactttacacttacagcacatctcaatttgtacattttcatcagaaatagctaaactaaaaagaaaaaaaaagaaatagctgaactgtatttagatttcataaaatttactatttataaagtagactcacatacccaagttgtttaaaacatatttaaaagtcttccaataactaggctgggtgtggtggctcacacctgtaattccagcactttgggaggccaagacggtggatcatttgaggtcaggagttcaagactagtctggacaacatggtgaaaccctgtctctaccaaaaatacaaaaattagccgggtgtggtggcaggtgcctgtagcccagctactcaggaggctgaggcaggagaatcgcttgaacctgggtagtgaaggctgcaatgagccaagattgtgccattgtactccagcctgagtgacaagagcgaaaccctgcctcaaaaaaaaaaaaaaaaaaaaaaaagtgggctgggaatggtggctcacgcctgtaatcccagcactttgggaggccgaggcgggcagatcacgaggtcagatcgagaccaccctggctaacacagtgaaatcccgtctctactaaaaacacaaaaaaattagccaggcatggtggcaggcgcctgtagtcccagctactagggaggctgaggaaggagaatggcgtgaacccaggaggcagagtttgcagtgagctgagatcacaccattgcactccagcctgggcaacagggcgagactccatctcaaagaaaaaaaaaagtggctattattatacactaaatgaaaatggcactgtgatcatacgtgcaggtgacaaaatctagatatgaaccttttaaaggcatattataaaggtaattccaacggatggggtaccaaattactgatatgaacaagatggtgactcattgaaacagaggaaacagaataagaacttaaaattatgattcccagtcccattcagaaaaatattttatgataaaattttagcacagttttctcgagcatttactttctaagaattaaatattttatcaaataattaagtcccaaaatacccccaaatgccacctaaccttaaaagcacattctatttaaacatattaaagaaatgaatcttagaaaatatagagagattttttacaaaatgaaatatcccccaaagtcttaaatctactctgattccaaattcaagaatttgcccttagtccagggactgtggcttacacctataatcacagcactttgggaggttgaggcccaaagatcacttgagcccaggagttcaacaccaaccagggaactgtggcagaaatccaactcaacaaaaattttttttttttgagaaagagtctcattctgttgccaggctggagtacagtggcacgatctcagctcactgcaacctgtacctcccggattcaaacgattctcctgcttcagcctcctgagtagctgggactacaggcacgcaccaccatgcccagctaatttttgtatttttagtagagagggggttccaccatgttggccaggatagcctctatctcttgacctcatgatccacccacctcggcctcccaaagttctgggtgtacaggcgtgagccaccgcacccagcccaaattttttttttaattagctgaccgggcacaatagtgcacgcctgtaatctcagtactttgagaggccaagacacatggattgcttgagctcaagagttcaaaatgagcctgagcaacacagcaaagccctgtctctataaaaaatacaaaaattagccgggtgtggttcccagaaggtcgaggctgcagtgagcccagtagaaagtaagcctgaggtgtccactgcacaatccagcctgggcaacagagtgagatcccgtctcaaaaaattagctgggcccgggcacagtggctcacttctgtaatcccagaactttaggaggccgagacagacagataacgaggtcaggaattcgagaccagcctggccaatatggtaacattccgtctctactaaaaatacaaaaattagccgggtgtggtggcacacacctgtagtcccagctactcgggaggctgaggcagaagaatcttttgaacccagtaggtggaggttgaagtgagccgagatcacgccactggactccagcctgggcaacacagcgagactctgtctcaaaaaaaaaaaaaaaaaaaaaaaaaattagctgggtgtggtgccatgcacctgcagtcccagtgactcgagaggctgaggtaggagaacttgagcccagtaggttgaggtgacagtgagccatcacagagccacagcatgggccatagagcaagaccctgcctctaaaaacaacaaaaaaagaatatgctcttaaagaacttccttgggaatatgtaaatgtactgcttccaaaatgttaataatgcttatcgctgaggaattaagagtcttctccctcactagacttttttatagcccaatttctaatatatcagatttctgtaaatctaacctaatacttaaaatcaatcaaccgatcaacaagaacacgtaggcatctatttgctttatactatgacacacagtatatggataaccacctggatcaatttttgatgtggtaaagcttataactgaaacatcagagcctcagggtttcattccactcctaacactctacgaatgaaatatgaaatatatttcaaagaacatattatatttttagaaactattcatgtgaaagagaagaatgctattatgacactaattctgtcccaaaccaaatatatgactatattgatgacccagcagttgcttctgcctggctccttttcttttgatccagtcccctttcctctgatactaacacatcaatttttctttgggaaattaatggactcccactcttgatcatgtatttctaaagatgttgaccccactccaaaccccaagatgaccataaaacccaagtcagtctgataagattaaatcccagtacttttttgttttaacttgggggcaggagatctccttccactgaaattactgacctaaacagtaaataagctgatgactatctttcctgatagtgttgcacattctttctttcagttgggcagtctgttccttagagagactatttagcatataatacaattcttaaattattaaaataaaatttaatagcactaatatgaaataaaaaaaacccactatttccttttccatgactaaatcccacttatgacaatataaacatgcaaagaagaaagtacttatcattgagactatcattctcaaagcccagaatggacatcttagatagtaaccatttgtgcatgggagagaatcagctgccagatctgctctagttacagcaatcaaggcacaaagtaactagaacaaaatagacgccaccaattggcaaccacctaatttccttaactgaaaaacatattgtgaacttctccacacaacgctgtgcccagataaagcaattaagaagacatttagcaagcttttttttttaaaaaaaaaagaaataggatcttactctattgcccaggctggagtacagtggtgcaatcgtagctcaatgaggcctcaaaactcctggggcacaagcaatcctcttgacttagcttcctgagtagctgggactaaaggcatgctctaccacaccatgcttttttttttttttaagagcagggtctcactatgttgcccaggctgatctcaaactcctggcctcaagtgattctcccacttcagtgtcccaagtagctgggattacaggcacaagccaccatgcccagcaagaaacattttcttaaatattcattatagtccaggtactctggcagaaccaccacataatcctggtcaatctttaagcaagctagctgccaccatcaaaacattctctcatccgtataatgagactcccagtggaaaggataattgatagcaatatcatgcctttccaggtctgtggcttgctctctcaatcttaccctcagttccacaatgatcagactacaaggctatcaaaagtacctccccaccagaaaaagatggacaatccctgagcaacaatgtcaaagaatacccttgctacatgtagtctcagcccagcctacctgtccaaagtgagcagggtagcccagcatgtgcatatacagtaattttgccacattccgacatcggtatgtattgtcttcttctctaaaagatgaccggattgcagcacattctttctggatcatttctcgttcttcagcttgggttcgggctgtccggatggtccggatcagctcccgcaatctgatgggggctggcatcctctggatatggaaagacattaaatagagatgttcacattttttactaccaaagctattcacacaacttcccatttaaatttttgactagtttttaagaattcaagacttgccaaatccagcttagcgaagctaaacaaagcgtgctaagcttccgcaaagctattacatacagacctctcaactctgtacatttctggaaaggctacaaacaaatatggttaagtattaaattaagcaaaataaaacaaagaatacactaaatatgtaaagtctatcactaatatcaaaatatctcagaaactaatacaactcaaatctttactcaatccttaaagtaataaggaaaggcctatgcctaaccttagaaaagatagatattatctgttcaactgctgttaaacataacatagctcaacaaaaataaatatggtcacaatcatagctcaactcaacaaaatatgagagattaagagagaagaccaattgtcagattaaaacacattcaacaaactgtaaccatcccagtacactgtgtgtatactttgaaaatgtgatgagaaaaaaataaactaacctcagaaaataaggctattagtgtcatgaatatcttttaaaagtaaaaaaaaaaaaacgttaataagggacatataacagcctaaataattgttaacaaacagaaaaaacagaacgtgcactacctaatttcaagaattactacaaagctatagtaatcagggaaatgtggaactaactgaatgtaagaatagactgaagcaggccaggcacggtggctcacgcctgtaatcccagcactttgggaggccaaggtgggcggatcacctgaggtcgggagttcgagaccagcctgaccaacatggagaaaccccatctctactaaaaatacaaaattagccggccatggtggcacatgcctgtaatcccagctactcaggagaattgcttgaacccaggaggtggaggtttcagtgagccaagattgcaccattgccctctagcctgagcaacaagagtgaaactccatctcaaaaaaaaaaaaaaaagaatagaaacaaaactgaaagtttaggaataaacccacacaaatatacacaagtgatttttaacaaagaggccaaagttattcaataggagcaagatagtctttcaatgaatggtgctggcaactatttctctccatgggggaaaaaaattaacctcaatcctaaccacacacaatacacaaaaattaactaaaaatggatcacaaacctaaaagtcaaagctaaaactaaaaatcttccagaagaaaacacagaggaaaatctttgcaaacaggttaaacagagagacttcacacacaaccacaaagtataaaagaaaaacttaataactgtaccctatcaaagtttaaaatttttgctctccaaaggacatcattatgaaaataggacacaccagctgggcacagtggctcacgcctttaatgccagcactttgggaggccaaggcaggcagatcacctgaggtcagaagttcgaaaccagcctggccaacattgcaaaaccctgtctctacaaaaaatacaaaaattagctgggcatggtggcacacacctgtaggctcagctacttgggatactgagggaggaggattgcttgagcctgggaggcaagactgcagtgagccaagatcacaccactgcaatccagcctgggcaacagagcaagactgtctcaaaaaaacaaaaaaaaaaaacaaaaaaaacaaaaacaaaaaatcctcacagaactgtaaaacaataaaccagaagagtcaattttaccatatgttaactttaaagagtttattttaaagtaaacaaaaaagcccttgaactaaacaattgagacctatttgatcagttatagaatatatacctgagaaaattactagttattctaacctgcttaaaggcatatttaaccactcaagtaacaaaacattactgtaaaatcttgtgaagaatgttgtatgtagatagggaaacgctgtctctacaaataataaaaaaaagttagccaaacatagtggcacacgactactgtcccagctactcaggagattgaggcaggaggatagcctgagccctagaggctgaggctgcagtaagctgtgacactgtatcctgggtgacagagtgagaccctgtctcaaaaaaaaaaaaaaaaaaagttgtgtgtaatgggtatattaagatatggtcacacggctgggcctataaaagctaacactaaactctgactttttttttttttttttttggtggagtttcgctcgttgcccaggctggagtgcaatggcgcaatctcggctcactgcaacctccacctcctgggttcaagcacttctcctgcctcagcctcccaagtaggtggtattacaggcatgcaccaccatgcttggctaatttttgtatttttagtagagacagggtttcaccatgttggtcaggttggtctcgaactcctgacctcaggtgatccacccgccttggcctcccaaagtgctgggattacaggtgtgagccaccacgccaggccaacactaaactcttatacaagggatggctgaaggtagtctcacctcaaaaatgaagtcattttcggagtcaataaactagagacgtgaactatgggggatggaaggctaaaataaggttctattaatctgaaccataaaggtgtcaagatgtctacacaggagtttcagtatggcaggttgaaagaccgtgccctccaaacacaggcaggtcaaaaaagccaccagttaagctatgtcccttttggcattctaaactggtaaaatcagactgaaagagaagataatgcttaacatatgtggagaagggcaatgacaaatcttcaggaatttttacttatttctaccctagatatataagaaagtctattctgaaaatcccagccctttccaaccctgaaaaacaaagaaatgtgagtccgtattttggccaaagcactgaaaggaaggaggcacaccacaggaaccaagcattggaagtaacaggaagttaaagaattacaagtgaggaggccgggtgcagtggctcacacctgtaatcctagcactttgggagcattgagatgggtggatcacctgaggtcaggagttcgagaccagcctggccaacatggcaaaaccccgtctctactaaagatacaaaaaatagccaggcgtggtggcgcacacctgtgatcccagctcctacagaggctgaggcaggagaatcgctttaacccgggaagtggagattgcagtgagtcaagatcgcaccactgcactccagccagggtgacggagcgagactctgtcaaaaagaaagaaaaaaaaaaggaattacaagtgaggctgggcacggtggctcacacctgcaatcacagcactttgggacacagacccgagcagatcgcttgagcccaagagttcaagaatagcctgggcgacatgctgaaaccctgtctctacagaacataaacaaaatgagccaggcatggtggcatgcacctgtggtcccagctacttgggaggctgaggtgggaggatgacctgagcctaggagtgaggctgcagtgagctgagatcaggccactgcactccagcctgggcgatggcacaagatcctgtctcaaaaaacagaaaaagcaaacaaacaaaacaaataacaataataaactccaacctttttttaaaaagtccggaacacagtaatgaaactatacagaacatagctgagaatccaaaaacacatttttattatctcaagcagccaatatagagagtgacacatcaacacactataacatctactttactccagatagaagtcctcattcagcccgttctggaatagaagctacaaatcagaaaactgtaagggaaagaggggaggagggtggacccaggagatagaaactgctttagaaaagggtatctatgatagttaaaaatgtcacccaacaccaagggaagaaacaaaagcagcaacaaaaacaaacaaataaataaaaacctatatacagcagaaacaagcatttttaaaacagtctggagctacttagtgtgtaaccaaaaagtagccaactcccactaaggtcctaagagcaccaataaattataaacagtaccacaatatagtttttgttgttgttttttgctttctttttgagacagggtctcactctgccacccaggctggagtgcagtggtgcgatctcggctcactgcaatctctgcctccttggctcactgcaatctctgcctccttggctcaagcgatcctcccacctcagctccccaagtagctgggactacaggcgcaagccaccacaccaggctgactggctgatttttgtattttttttagagatgaggtttcatcatgttgcccaggctggtctcaaactcctgagctcaagtgatccacccaccttggcctcccaaagccctgggattacaggcatgagcaaccgcacctggaccataatgtggttttataaaaagaccttgattctccaagaagtggttaaaataagattaacatttaacattcaatgcacagggaaaaaacatgaatacaaaattatatctgtattataaccaacttctaaaaatcttacagttcagataccatctgcccttactaatttaactacctgacccatcaaagactgagaaaggtatgttaaagtctaccactatgattgtgcttctgtcaatttctccatttacatataaccacttacatttagtatttcgatggtttcactctatgcttaagtgttccatattttatattcattatggcttgtacactataacaaaataaaatgtccctctttgtcctgtttttttaaagcaaataataaaaacatctcttaaaacaaggatggaaagcgaacacaaaaatattaaaagtctgacttaagggacacggattatagattaatgtgtttcagtttttattaacagttatatgataaataatgataaaaacagaggaaaaaaggaaacataaaattcattttagaaaaatttctatccaaaatggttaagcaaaattgggttttggagcttaaactaaataagattactttatatgcccaaagaatcaaaattataaacaaactaaaggaaaaaaatgtaaatagaagaaaaaaataatgtgtgcatgtttcaattctcctaaaatttatggccaaaatggtgaagatggctattttccaacatctccacaaatccctttaaggataaagatttttctcatacagcaataccattctcaggccatgagaagtgctttttttttttttttttttttttttttttactttgaaatgcctatttttcccactaaatacaagctccctaaggctagatcttcatttgccttgttcactcttgtatcctcctataagaatacaaacttgataaatactatatttattaaatcctaaatgctaaaatatctttaaaaaaattgaattgtcctttccaaagcacacaaaataaaggtgtaccagctgctcaccaacagctatggaaaaagggtgtcagaactcaacccagttctctcttctaccctgcccagataacgttctccctgctttagaactcacactgcccactgtgcactttcagctactgacagccaactatcaaggacacaaccaaaaagctggagcttctgcaactatgtggtcagtcttcccctaacagacctcaagttatttgagctctaaatctaaaaacaaaattctaaaacttaacttttcaacattaaaatcacctatttttctatccaacaaagattgtacttgaagaagtctttctggctaaacaatgagaaaagacccaagcaaataagcaagacttcaattaacttcaccattgactactgtgtcagtcacagaatgtcagtctagctgagaatgttcaagggatgtaagttaacatcaggcaaaaccctccaaagaagttaccatgctttccctcttgcattctccagatggcctatatttttatattatgggccatacagaacccctatttcagatttttatttcatatgtatatctgagttgctttaacgccatttacaacctgcaaaatactatgactagaatgtgacactagaaaagcttaaatcaaatcaactgattgtattatgcttcaatcagacttttactttacaatacatcttattctggctatcattacactgatctagcctagctggttttctcactgcctgtgtttttgtggttttctttcttttgaggggagtagaggggtgcatacctatttcccctatatgaagaaatgtgttcacagaagggaaatggtctacagtgaataaacggaaaagaccagagttagaacttcactgtttgaataggagagattaaatctggggataggccaggcgtggtggctcacgcctgtaatcccagcactttgggaggccgaggcaggtagactgctcaagtccaggagttcaagaccagcctgagcaacatggcgacacccagtctctactaaaaatacaaaaattagttgggagtggtggcgcatgcgtctgtagtcctagctattcgggaggctgatgtgggaggatcacttgagccaaggggacttgggttgcagtgagctgagatcgaatcactgcactccagcctgggttgtgaagtaagaccgtctcaaaaataataataatacaatgaaataaatctggggataagtattctggtctttagagaggcaaacagcattgtaagacaagcataattctttgatcaggtttcaccatggcttaaaatgacaaaacactcaagaccaactttatatggtctgtttcaggctcacagtgcaactttctgattattaaatacttccttaagcgcctcaactcccaagtacctccatacaaggaatagtgtcctgtggaatgcagacacaagtaattcaggagaaaagcatatcccccccttgtgaattacaatactacagtattattataacttacaaatcagtgtgtttgattggtctcaatcacccctaggagatgaactactaaaatggaatttctggatcttcaaggctaaagaataggctgtggaatgtaggatcacattgagataccaccccaccctgtctaggcagccagctggcatccctctaagaggacttaagttcaattctccctaaattgtcacagtaattacaggaatcttattttatgcttaattatccataaccaaaattcaccagaactgagatctaaaaagcagatgtctataaatgcaaacatgcctactgaacaattcaacagcactgagatgcataaaaagcagactgggcacagtggctcaggcctgtaatcccagcactctgggaggccgaggagggcagaatgcttgattccaggagttcaagaccagcctaggcaacacagcaagaccctgactcttaaaaaaaaaattatatatatatatatatatgtatgtatatgtatataagcatgaaaagcaataaaggccaagtaaacaatgatcgctaaacaagacaaacatctaatctgacactaatgaaataaaaaaaaatttcattctcccaaccataatcttattagcaaaaccatactaaagtactctcaattcaagaagtatcatcaaattctcaaaacgaaaatttggcttaaagacatgacccaaagggtataattaatgttgaaggaggttatctgatgtaaatatggatgcctttttaacttctatatatagtctgctatctttcaagtaatgagcatgtaaaacttggaataaaacttgctttgaaaaaaagcaaacaaattaacaaaaacgtataaataaagcaactgtaaactttcaaacctagtaaggtgtcattcattccagaaaaacttatctaagtgtactcttccctaggatgacaagcagaaacattagaaagttacttaatatagccggagacggtggctcacccctgtaatcccagcactttgggaggctgaggtaggcagatcatgaggtcaggagttcaagaccagcctgaccaacatagtgaaaccccatctctactaaaaatacaaaaattagccgggcgcagtggtgcacgcctgtgaccccagctactcaggaggctgaggcaggagaatcgcttgaacccaggaggcggggattgcagtgacctgagatcgtgccactgcactccagcctgggcgacagagcaagacgcagtctcaaaaaaaaaaagttacttaatactaagatgacaaattttccctagcatattcttcatgaatccaagttctattaattctggatatacaaggagagtgggggagttgtccaaagaaaattaaagatggtataatatttacttttaattaatgtatctgatattaactagttagaaatggagggtaaacagtcccattgacaatagtgtcaaaataaaatacgtaggaataaatttagtaagaaaggtataggaactatacgaaaaaaactacgaaatctataaaatatttgttgaaagacctaaaataaacttgaacaaacagacacacactacagcaaggaaaaattatcatcaaaaactgttaaggctgggtgcggtggctcacgccagtaatcccaacactttagaggccaaggtgggaggatcacttgaggccatgagttagaaaccagcctgggcaatacagtgagactgtgtctctacactgcctcccagattcaagcaattctcctgccttaccctaccgagtagccaggactataggcgcgtgccaccacgctcagctaatttttttgtatttttagtagagacaaggtttcaccttgttagctaggatgatctcagtctcctgacctcgtgatccgccagcctcggcctcccaaagtgctgggattacaggcatgagccactgcacccagctggaatggattctaagacagtttcagaaaccaaagaggaaaagagggatatatataattacctgaaaatgtctgtgacataaataagattaaaagataaatgaggccgggcgtggtgcggtggctcacgcctgtaatcccagcactttggaaggcagaggcaggcagatcacctgaggtcaggagtttgagaccagcctggccaacatggcgaatctctgtctctactaaaagtacaaaaattagccgggcatggtggcgggcacctgtaatcccagctacccaggaagctgaggcaggagaattgcttgaacccaggaggcagaggctgcagtgagccgagatcacaccactgcactctagcctgggcgacaagggtgagactctgtctcccaggaaaaaaaaaaaggataaatgaaagacaagaaaaatacacgtgccatataacaaagaattaacattccataagcgctcctacaggaggaaaaaaaaagagaaagaaaaatgaagcaaggacatgagcagacaattctcggtaaaggaaatccaatggctattatacgtatcaaataaggctagccccagtaacagggaagttaaaattaagacaaactgcatgacccatttatcatctagcagactagtaaaaattaaactatgtatttatacccagtggtttcatgatatggagaagttactgctatttgggatgaaaattatgataacctatttagagagtaatctagcaataataatatttaaaatatatttctctgttaacccagaattccccctttggagactacagaaataaaagcatcagcatataaggcggcatgtacaaggatatttattgtagcactttgttaagtggcaaaaatctagaaatgatctaaatgtccacaggaaaataataaattatggtacatccacgctataagacacaataggactgtttaaaggaacaagatagaattatatttactgtgggctgagtgcagtggctcacacctgtaatctcagcactttgggaggccacaggaggcagactgctcaagtccaggagtttgagaccagcctgagcaatacagctatatctcatctcttattaaaaaactaataggctgggagcggtggctcacacctgtaatcccagcactttgggaggccaaggtaggcggatcatgaagtcaggagatcaagaccatcctggctaacatggtgaaacccaattctactaaaaatacagaaaattagcggggtgtggtgacaggtgcctgcagtcccagctactcgggaggctgatgcaggagaatggcgtgaacccaggaagcagagcatgcagtgagccgagactgcgccactgcactccagccttcgtgacagagcgaggttccatcttaaaaataataataataataataataataaaaaattatattggctgggtgcggtggctcacgcctgtaaccccagcactttgggaggccgatgcaggcagattgctcaagcccaggagttcgagatcagcctgagcaacatagcaaaatgtcatcttttaaaaaaataataataaagaattatattgccgggcacggtggctcacgcctgtaatcccagcactttgggaggccgaggcaggtggatcacgaggtcaggagatcaagaccatcctggttaacatggtgaaactctgtctctactaaaaaaaaaaatacaaaaaaattagccgggtgtggtggtgggcgcctgtagtcccagctactcgggaggctgaggcaggagaatggcgtgaacccaggaggtggagcttgcagtgagccgagatcgcaccactgcactctagcctgggtgatagagcaagactccccatctcaaaaaaaaaaaaaaaaagaattatattggccaggcacggtggctcacacctgtaatcctagcactttgggaggccaaggtgggaggatcatgtgaggtcgggagttcaaaaccagcctgaccaacatggagaaacccccccgtctcgggtcgggtgcgggggctcacgcctttaatcctagcactttgggaggccaaggtgggcagatcacgaggtcaggagatggagaccatcctggctaacatggtgaaaccccatctctactaaaaatacagaacattagccaggcgtggtggtgggtgcctgtagtcccagctactcgggaggctgacgcaggagaatggcgtgaacctgggaggcagaacttgcagtgagctgggatcgcgccactgcactccagcctgggcaacacagcgagactccgtctcaaaaaaaaaaaagaaagaaaccccatctctactaaaaatacaaacttagcggggcatggtggcacatgtctgtaatcccaactactcgggaggctgaggcaggagaatcacttgaacctgggaggcggaggttgcggtgagctgagatcacgccattgcactccagcctgggcagcaaaagcaaaactccgtctcaaaaaaacaaaacaaaaatgaattatattggctgggcgcggtggctcatgcctgtaatcccagcactttgggaggccaaggcaggcagatcacttaaggtcaggagtttgataccagccaggccaacatggcgaaacctcatctctactaaaaatacaaaaattatctgggtgtggtggcaggtgcctataatcccagctactctgaagtctgaggcaggagaatcactgaacccaggaggcggagattcccaccacctgggtgacagggtaagactccatctcaaaaaaaacaaacaaacaaaaaaaaagaattatatttactgaccatgacatgttaaaaaaaaaaaaaagcgtgtcatagagtaatataaataatatgatctctctttagtaaaaacaaaaaattcctatgtacacttacgtgagtatgtacagtacttaactaagcattgagagaaatattgaagcgtaaattcattcataatctgttaaaatttggggttaaaattaagactgtcatagaacagatgatgtaacactacagggtaaacactatagggtaaacatccctaatccaaaatctgaaattctccaaaacctgacattttttgattgttgacatgatgcttgaagaaatgctcttcaaggccgggcgcggtgggtcacgcctgttatcccagcaggggaggctgaggcgggcagatcacaaggtcaggagatcacgaccatcctggctaacatggtgaaagcccgtctctactgaaaatacaaaaaattagccaggcgtggtggcgggcgcctgcagtcccagctactctggagactgaggcaggagaatggcatgaacccgggaggcggagcttgcagtgagccgagattgcgccactgcactccagcctgggcgacagggcgagactccgtaaccaaaaaaaaaaaaaaaaaagaaaagaaaaaaatgctctgcaagtgtttcagattttggattttaggattagggatgtacaagtggtgtaacgcaaatattccaaaatctgaaaaaatccaaaatatgaaacatttctggtctcaagcatttcagataagagatactcaatgtgtatttggttgaaagagctaacttatataaatgattatacagttgtacaactcaaagtaaaaggagttccattagtgtttttacagctcaagttagtgaacctatttaactaaacctcaaaactaaacaactgaaaaagtgttcagtcttaaaaggaagcaaaagaagcgttttttacttacctcttttttttgagacagtctatctctgtcacccaggctggagtgcagtggcacagtcttagctcactgcagccttgaactcctgggttcaagtgatcttcctgcctcaggctcccaggcagctaaggctactggcaaagacaccacaacccagctactttaaaaaattttgggccaggcgcggtagctcatgcctgtaatcccggcactttgggaggccgaggtgggtggatcacctgaggtcaggaggtcaagaccagcctgtccaacatggtgaaaccccatctctactaaaagtacaaaaattaactgggcatggtggcgggcgcctgtaattctagctacttgggaggctgaggcagaagaatcgcttgaacccaggaggcggaggttgaggtgagccgagatcgcaccactgcactccagcctgggtgacagagcaagactctgtctcaaaaaaaaaattcgtacagccagagtcccactgtgtttcccaggctggtttcaaactcctgtcctcaagtgatccttctgacttggcttcccaaagtactgggattacagacatgagccaccaggtctggccagcgaagtttatttttaggttgagaaaacacgtaacatctttacatatctttgaaagatttaaaatattttagccaggctcggtggctcacacctataatcccagcactttgggaggctgaagcaggtgaatcacctgaggtcaggatttcgagaccagcctggccaacgtgacaaaaccccgtctccactaaaaatacaaaaagtagccaggtacagtggtgcacgcctgcagtcccagctactcgggaggctgagcacaagaatcgcgggaacccaggaggtagaggctgtagtaagctgagatggcaccactgcactccagcctgggtgacagagtgagactctgtctcaaaaagaataaataaataaataataagatgtttttatttataaattacaaaagtcacatgtattttttcctcatcttttaaaaaaatgacttcttccttctaaacctacttaatttgttgccaacatttatgatttactaattaaatctctccaatggtctgagtaggcttttttttaaagtaaaatttccaagtacctagtgaaaaaaagcatttctcatttcaatcatctcatcctaaaccttgcccttttatgctaaagtgttagttaatgctgactcaacacatttggcaagtgagttttttttctcccacttctggacccttcaaactttaaccagtttttccagcaaccaaaactcatgccatattaagtgtattgtgttactaggtcagtgaagaaaaaaacttaacacgtatcttcaaagtaaaaatgacacctcattcatgcctgtaatcccagcactttgggaggccaaggctggtggatcacttgagcccaggaattcaagatcagcctggtcaacagggtgaagccctgtctctactaaaaatacaaaaattagctaggcatggtggcgcacacctgtagtcccagctactcgggaggctgaggcagaagaattgcttgaaccagggggcggaggttgcagtaagcagagatggctccgatgcactccagcctgggcaacagaggaggactccgtctcaaaaaaaaaaaaaaaaaagacacctcttttcccttttctatttcttgacctcattgaaataaaattttctatacaaaaaggcaactgtaaaaatgctactacattttgataaacatattttatttatttattttttttttggagacaagagtctcgctctgtccccaggctggagtgcagtggcgtgatctcagctcaccacaacctccacctcccaggttcaagtgattctcctgcctcagtctcccgagtagctgggactacaggcgcgcaccatcatgcccagctaatttttctatttttttgtagagatggggtttaaccatgttggccaggatggtctcgatctcctgacctcgtgatccacccgcctcggcctcccaaagtgctgggattacaggcatgagccacctcgcccagccaacaaagatcatttcaaaacctgtaagccaagaaatacaaaagatttctatatgctctcttaattttttttttttttttttgagacagagcctccatctgtcacccaggctggagtgcagtggcgtgatctcagctcactgcaacctccacctccctgttcaagcaatcctcccacctgagcctcctaagtagctgggaatgcaggtgcacatcaccatgcccggctaacttttgtatttttagtacagacgggatttcatcatgttgaccaggctagtatcaaactcctgacctcaagtgatccgcctgcctcggcctcccaaagtgctgggattacaggcatgaaccactgcaccagcctgctctcttaagtttaaaattgcttgtgggcaaggcatggtggcacacacctttaataccagcactttgggagacagaggtgggaggacctcttgagcccaggaatttgaaaccagcctgggcaacatggcgaatccccgtctccacaaaaaaataataaatcaggcggcacatgcctacagtcccagctacttaggaggctgaagtgggaggatcacttgaacctgggaggaggtcgaggctgcagtgagctgagattgcaccactgcactccagcctgggtgaaagagtgagaacctgtctcaatcaatcaatcaataaaaataaaattgcttgttacttataagctgagaggagttgaaaaaaaattgtttgctactttcaacattattctgcattagaaactgagtaaaagcaacagagaataaagaaagccaaaatcaagaaccgaaaacagactgaacgcagtggctcctcctgcctgtaatcccagcactttgggaggccaaggtgggtggatcacttgagctcaggagttcgagaccagcctagccaacatggtgaaaccccgcctctactaaaaatacaaaaattagctgggcatggtggcgcacgcttgtaatcccagctactcgggaggctgaggcagcagaaatcactggaatccaggaggtggaggttgcacagtgagccgagatcgagccactgcactccagcctgggagacagagtaagactttgtctcaaaaaacaaacaaaaaagaactgaaaacaattcataaagcaaggacagactaaattacaaacacctaaaacagtatttttaaatgttctgaagctctaagtaagagttttaaagttttgatagcaattaagtcctgctatatacacaaaattttaaaatcctcatcaaatgcaaataaggggattaagcattgtggaaaatctgttttggtatgtagattgccaattcaatttttttaattaaaaataatatcttggaaaatactcattcaactttttaaatttgtataaattaaaagttttggccaggtgaggtggctcacacctgtaatctcagcactttgcgaggccgaggcaagaggattgcttgagcccagcctgggcaacatgacaaaacactatctatacaaaaaatacaaaaattagccctgcgtggtagcacacgcctgtagtcccagctacgtggagggctgaggcaggaggatcgcttgagtccaggaggtccaggctgcagtgagctgagaccactgcactccagcctgggcaacagagtgagaccctgtctcaaacaataaaaataataaaaaaaaaaaaaaagagtttttataaatcataaagaagttggttttgtttgcataccactgatttttaaaactccttttttaaataaacactggggtgaaatatcaccaaggcattcctggcaaattctgtactttaaagtttcactctaaaatctgccctcaaatctagaactgctatcaatgacagaggtcagaccaaagaacaagcaactgcccccaaaagaaaacggaggtttcctaaacgcaaagcagacattcaaatatgcactgatcaatggtgcactaaacaacactttgctaggaatttgttaaggcaaaaggaccctttctacagtgaatgcaaactatctaagaatgaatttttaaaagtttaatatttttaaatattttggtagagacggagtctcattaggttgcccaggctggcctccaactcctgggctcaagggatccaccttccacctcccaaagtgttgggattacaagcatgagccactgagcgcccgcctgaatgacatttaaataccaatatattaaagcatgaaaaacactgagttaactaacatctatgtgatagctcttctaacaccttacttgaaaagtctaagtcagaaatggaacatttcagtagtaactgcgagggcatacttactaaatgagtgagcattacataggtgttcagtgtttgacagttcctttaaaccaaaagagaaaattccattgcttcagggtaatacagaactcacgtatctaatagtaactaatatatttttgaaaaatctgcttaaataacaagatcactgagtatttaaactgaaaatattgttttcttctgagacatcatatgacctatagaggaatttatctacaatctcatttcaataacctgataataataatgcatctataagtggcttagcaatattaaaaagcttgactcaattcaagttataaatttaaacttcaaccactagactgtgatctcaaataagttaatttctcttttgcagatgtgaaaacccaggctgagatgaaataagggtgattcaatcacactcgcctaacttgaaacgtaggaaatgtatcagtgaataactgtgaaatactttttgccaggcacggtggctcacgcctgtaatcctagcactttgggaggccgaggcgggcggattacctgagctcaggagttcgagatctgcctgggcaacatgatgaaaccccatctctactaaaatacaacaacaaaaaattagccgggcgtggcggcgtgtgcctgtagtcccagctacttgggaggctgaggcaggagaactgcttgaacccgggaggcgtaggttgcagtgagccgagaccgtgccactgcactccagcctggagacagagggagacttcgtctcaaaaaataaataaataaaaataaagacatactttttattcaagcatgctagactgcaaacatgcctttagaataaaagtgacgagattacgagtacttagagggttcatatttttcaaacgtgaaagttagggtgtgtgacaagttaggtatttgacaagtattctagggaacggtggaagtgaatatttaaaattcagctatccccagaaaaacccaatacatgaaatcattacaagtattttttagaatcagtcagcaaagatcattactgtacaaacacttcaaagttaaggtcactaagaaagcactaactcctcccttctgttaactaatcactgtaaagcagcccaactctcctttctacctacctcagattaatatttttctccatggacagatttccgtgctcagggatatataataggggagaaaaaaaaataccacacaagtgtcagtaagcaccaaaaagctaagtattcagcacagggagggaatccacatatgagaaaacatttgacagctcttgcctcccaaaagccatttaatctgcttcataaacataatctgcttcataaacattaccctgagcgagtggttcgatggatctcctacaccgagtcctaaccgggaaacacaatcaaccgaaccgtcccgactctttcaggcaatcaggaagaccgggagaattattagacgctgacgtccgcagggccaggagctgagaaaagggtaaacagtatactcgcaggtaggttgaaaaaaacaaaacaacaacatatacacacacacacgaaaaattgggaaagaagttggtcggaaggttagagagaggcgaggccgatgtccggttccgagaggacggcactgcaggggcaggcagcgattaactgggcatttggatatgctgggagttatctgacagacctgacacgggtacaagacacaagaacgctgatacgtggctcagagaagacacgcgggggtggggcccgccccgctaaaccccaggctccctgaatgagccctcaaagatcgcagcctgagaaagtcaagggttcaaggaggcccgtaccggcggggcaacgccacaacacggaacgccgcggcgcgcggaacctcccggtccgaggcctcggggtcggccctccagaagtcggagcagcccctggggctcccggcctctcctggcccagcttctctgtcttctcttctcaacacccacagcctgggactggacccctgaaactgaaaggaagcttccggtcgagcgcccgcggcagcggcggggcaaaagcagcaatatgctctcagcgccgggagtgacactcaccggcccgaaacctcgaatgaaaccagcagctccgggggcggcggcagcagtggcagcaggaaccgaacatccaaaatggcggctccctcggcctcaccaccgctaccgcaggcggagggatcctgaggaaggagggagtttttaactaacttcacacactattgaggaaacttcgctccctgtcctcctctcctggtcgtttccgtgtcctcgtactgcaacttatcgtgccttttctctcgaattatccaagaactcggaccctgccgaggactatttgccaaggaggaggcgactgctcctggcagagcgacgcaaacgtagcaaggatcggggctgtcactgatgacgcgagacgctgctgccgagtcaccgctgcgatgagtctgagcgagaaagatccggcctaccccgtagcggacggacattggttccgcttggtgagggggtaggggggtggggggtaggggggtgggggggtagggggggtggagctgggctaccaggaagcggtggagccacctggagggggcggagctaagtcaggtagcccaggaagtgagagcaagcgagacaggtgggggcggagaagacagcagggctgaaaaggtcttcgtccacgggaatcccgaactctttgctgtctcctttaagatttttgctttctttataacttaaggagcatgctccaggtggtattctatggttttatggtgtctttgcaacatattttatgaagagttaagaggatgactgaaaagaatggattccacgcccggtaccgcggtgcttgcactgctcaagtcacttaaactctccagggattcaatttcctcatatgtagaaagaagacttggactcatgttagctgaaacccttacagaatgggctttcggtctatgactccatgaattaataaccagggccaaagaaagtctaaccagacagttcctaacctgataaataattactaacatatgacgtgagtcttttccatgtgaatgtaaagagggcctgatatcttggcctgtttaaaggaaaggtgacctacctagactaaaatccttctgctagattggcaacaaagtacaatacaacacagcagcaggctgggtgccaaagagaacagaaccaaccacacaaaaaaaattttttttttttttttgagacaaagtctcgctctgttgcccaggctggagtgcagtggcgggatcccggctcactacaaccttgcctcccggggtcaagcaatttctcgtgcttcagcctcgcaagtagctgggattacaggctcccgccaccacggccgtctaatatttgcatttttagtagagagagggtttcgccatgttggccaggctggtcttgaactcctgacctcaggtgatctgcctgcgtcggcctcccaaagtgtggagatgacaggtgtgagccaccggcctggccagaactaaccacaaatcttgagtttaggatttgggtgtcatagagagaaggttgcacttttttccttagtcattttcatgcagggatttcaaaacacttaacaaaaattgctctaagtaggccgggcacagtggctgacgcatgtaatcccagtactttaggaggccggggtgggcggatcacctgaggtcaggagttcgagaccagactggccaacatggtgaaactccatctccactaaaaatacaaaattagccgggcatggtggtgggcacctgtaatcccagctactcggaaggctgagacaggagaatcgcttgaacctgggaggcagaggttgcagatagccgagtctgggcgacagagtgagaccctgtctcacaaaaacaaaaaaaaattgaaccaagtaggcccatctgtacaattttgtccctgaactactggggcatgccaagtggctggaaagaaaggaggccatgggtgcgataataattatcatttgtattattaaatattgatatcacattgttcataaggcactttcatgtgtataatctaatctgaccctctggacaacctcctgagtcaggctaggcaagcataagtaacttagttttacaaataaggaaaaagaggctccaagaaactaacttggctaaaagacacatcctctcccctcctccactggggttctgctacagagctatagagtgcctttttttttgagacagagtttcactcttgttgcccgagctggagtgcaatggcgtgatcttggctcactgcagcctccgcctcccaggttcaagtgattgtcctgcctcagtctcccaagtagctgggactacaggcgcatgccaccacgcccagctaattttttgtatttttagtagaaacggggtttcaccatgttacccaagctggtctcgaactcctgacctcaggtgattcacccacctcggcctcccaaagtgctgggattacaggcatgagccaccatgccaggccagagtgccattttataaattagcatagggtaccacaatcttccaccacccctacctacccacccacctacctacctacctacctacacacatacctacactctcagggtggatggagtcaacccccaacaagtggtttagagaacagaatgtttacagaattcagatcctctgccatgctgctactgtacagtgcaaccatggactacaaggctagtaaatagtggaatgaagccaaaacacaatttcctctgaggtatagctatgcagggaacacaggccaaacttagtttggggtttccacataagtaagaagtttgcaggttgcaaagcagagttagctaaagtattccgtttggaacaccacaaaaaaatgcttagaggtcaaatttaaatgtgtatcattgtgaaccacaaaagaaaaattaagccagctacctaaggaggagagagctttttttttttttgagacggagtctcactctgtccccaggctggagtgcagtggcacgatctcaactcactgcaaactccgcctcctgagttcacgccattctgctgcctcagcctccagagcagctgggactacaggcgcccgccaccacacctggctagttttttgtgtttttagtagagacgaggtttcacatgttagccaggatggtcttgatctcctgacctcgtgatccgcccgccttggcctcccaaagtactgggattacaggcgtgagccaccgctcccggccccggaaagatcttttttcctaccatatcgagtgcagagcgttaaagagttttaaacattaaaaactaaaccctttctcagtactttttaacttacatttctctttattttgtttttgtttttgagacagagtctctgtcgccaggccggagtgcagtggcatgatctcagcttgctgcaacctccacctcccgagttcaagtggttctcctgcctcagcctcccgagtagctgggactacaggcacgtgccactacatccggctaatttttgtatttttagtacagacggggtttcatcatgttggccaggctggtcttgatctcttgaccttatgatctgcccgcctcagcctcccaaagtgctgggattacagacgtgagccaccgcgcccaggccatttatctttatttataattaccaaacccttcttccatgcaactaaaattaaaagcagttgccccagctgggcacagtggctcacacctgtaatcctagcacttcggggggccaaggtgggaggatcacttgatccaaggagtttgagaacagcccaggtaacatagtgagaccctatctttcttccttccttccttcctcccttcctcccccctccccgcccctctttctttctttctttctttcacggagtttcactcttgttgcccaggctggagtgcaatggcacaatctcggctcactgcagcctccacctcccgggttcaagcaattctcctgcctcagcctcctgagtagctgggattacaggcatgcgccaccacgcccagctaattttgtatattttagtagagacagggtttctccatgttggccaggctggtctcgaactcctggcttcaggtgatccacctgcctcggcctcccaaagggctgagattacaggcatgagccaccatgcccggcctcctcatcttttaaataaatgaataaaataaataaataaaagcaattgccccaatatgtagcatagtcacattatcttggaatctttggtttccatggctagtgatttaagtttagaaaggcttactccccatcttctcaaacataatccctaattccagataaataaattacagcacatctataaaaggtaatactatgctaccaataaaatgaaaaccttattattatagtatggcagactttaaaaggaaatattataaaacaatgttataaaatgagcttgcaaagtgtatattgagccacctcaggctcctgagtagctgggactacaggtgcataccaccatgcccgcctaatttttttaaaaattttttgtagagacacggttttgccatgttacccaagctggtctggaactcatgggctcatgcgatcctcccactttgccctcccaaagtgctggaattacaggcgtgaggcactgccattggccaaagattattatttttatgggtttgtttactactgataacttacatgcatagaaaaaaattgaaggacaaaactaaaatttaaaaatggcttttttgggccgggcgcagtggctcacacctgtaatcccagcactttgggaggccaaggcaggcagatcatgaggtcaggagatcaagaccatcctggctaacatggtgcaaccccgtctctactaaaaatacaaaaaattagccgggtgtggtggtgggcgcctgtagtcccagctactcgggaggctgaggcacgagaatggtgtgaacccaggaggcggagcttgcagtgagcagagattgcaccactgcactccagcctgggggacagagcgagactccgtcttaaacaaaacaaacaacaacaaaaaaatggcttttttggatgatgggattacagataatttttactttattatattatattatattttgtttttgcaacgagcacaccattcttttagttaaaaagaaaattcttataagaaaatgcagttttatggatttttgtttttattttatttatttattattttgagacagagtcttgctctgttgcccaggctggagtacagtggcgtgatctcagctcactgcaacctctgcctgccaggttcaagagattgtcatgcctcagcctctcgagtagctgggattacaggtgcctgccaccacactcagctaatttgtgtatttttagtagagatggggtttcaccatgttggccaggctggtctggaactcctgacctcaggtgatctgcccaccttcacctcctaaagtgctggtattaccgtgcctggccaatttttgtttttaaaacaacaatatcctgaaagtgttaaacaaacttagtaagagataataactaggaaaaaaattttggtttttttttttttgagacaaggtgttgctctgttgcccaggctggggtgcagtggcacaatcacagctcactgcagcctcgacttcccgagctcaagtgatcctcccacctcagccgggactacaggtgcataccaccatacccagctaattttttttttttttttgtagagacggggttttgctatgttagccaagctggtctggaattcttgggctcaagtgatcctcccacctcaccctccccaagtgctggaattacaggcatgagccactgtgcttggccaaagattattatttttatggttttgtttactaccgaggactgcttcaatttaacaatgaataggccgggcacggtggctcacacctgtaatcccaacatgattactttgggaggctgaggcaggcagatcacctgaggtcaggagttcaaaaccagccttcccaacatggcaaaaccccatctctactaaaaatacaaaaattagccaggcatggtggcgtacacctgtaatcccagctactcgggaggctgaggcaggaaaatcacttgaaaatcacagaagtcgcagttagccaagatcgcgccactgcactccagcctgggcgatagagcaagactccatctcgaaaataaataagtaaataataataataacaacaatttaacaaagaacaacaacaaaaaataaaactgaagaaacattggctagcagacagaccacttagatgccagtcttggctaggtttaattcattttttgcccagagcaaggtgttaaacatctctgagcctgtttactcagctttccaatatttatttgtcttgcctgttccaaaatggatttagagtggcttgttatgcaaaagggatcagctacatgaaagcactttgaaaagcctgaagcatcataagaatgtaaatactgaaatttttgtgccgcctcatcattcaactaaagcatttactgactgccctttataagtaacagtagtacagtgtgtcttacatttacaaaagtattttcaggctgggcgcagtggctcatgcctgtaatcccagcactttgggaggccaaggtgggtggatcacttgaggtcaggagttcgagaccagcctggccaacatggtgaaaccttgtctctactaaaaacacaaaaattagccgggcatggtggcacgcaccagtaatcccagctactcaggaggctgaggcaggagaattgcttgaacccatgagacagaggttgcagtgagccaagatcgcgccactgcattccatcctaggtgacaaagtgagatgctgtctcaaaaaaaaaaaaattaattagttggacatcatggcatgtgcctgtagtcccagctactcagaaggctaaggcaggattttttgacaccagaaaggtaaggctgcagtgagcaatgattgcaccactgcactccagtctgagtggcagaataggactctgtctcaaaaaatatattaaaaaaagaaagagtgagagagagagagaaacaaaaggaggaggggaggggaggagaggctcagagagattaaatgatcggtcacactttcatacagtagaggccagactcaaatgtagtccttccatctctggatttgtcttctagcccatatagtaatcattcaaacaggctacctgattatttcccctatgccacactgtcctgggtgcaccagaatctgtaatagacataacaaaagagactgcccctatccttcagataattacaatctcattgaggaaaacgagattttttaaaaatccaaaaatataaaataagccagtgatatcattcagcagataagtcctagttcagaaagagaagaaaacggagaggtcgctgaagttctagttcagaaggagcagaagaaggagaggttgctgggagctagagcagtgaaagatggcttttggaatacatagtatctggtggaatctggggtactagaggggaactgtcttgtttgggcttaggatgcagtgagtttctttctttctttttttttttttttttttttggagacaaaaaaaaaagggtctcgctatgttgcccaggctggagtgcagtgacacaatctcggctgactgcaacctccacctcctggattcaagtgattctcctgcctcagcctcctgagtagctaggactacaggggtatgccactgcacccagctaatttttgtatttttagtagagatggggtttcatcatgttggccaggctggtctcgaactcctgacctcgtgatcctcccacctcagcctcccaaagtgctaggattacagacttgagccacctcatccggcacagtgagtttcttaaatgattcggtcagtatcagcagctgaagcccatgtgacctttagagcagatggggaaagctctctctgaagaaatgcagttagcatctttcacaaagaacccttcctgcctctccacgtgccagagatctcagccgagaaaggagagtgaagaggggcacagccgtgtaagaaatacaatgacgtgagtcaaagaggcggctccactggcctgttttgttatcctttgagtcacacgaatctataaataagactgaaagacagagagaaattagtctgtctgctgtttctgtaatgttttcacaaaaagcattttcacaattcttttaaagcacagtccctaatcacgatgtatgctggcctgagacaagagtttaggaattcatctttaacttatgacaaaagccagaaaggatgtaaaaattaaaattccaacagccaactccatacactctttgacctcttaccaagagcattaggaattctgctatatgtagaagagtaaagaccaaagcccggaggacattagcttctgccaaccttcttctttgtttcagaattttttttttttaaagaggcagccctaggccgggcgcggtggctcgtgtctgtaatccagcactttgggaagccaaggcaggtggatcacctgaggtcaggagttcaagaccagcctggcccacatggcgaaaccctgtctcttctaaaaatacaaaaattagccaggcgtggttgcaggcaccggtaatcccagctacttgggaggctgagccaggataatcacctgaaaccgggaggtggaggttgcagtgagccgagactgtaccactgcactccagcctgggcaatagagtgagactccatctcaaaaaaaaaaaaaaaaaaaaaaagaggcagcccaaagtgccacctgagatgctttatgttacaatattttctttttcttagagtagtttttcttgacttgtaaattattctgtattattttggcacttttggagggaaaaactttaccaggtatgagactgcaatcaacttaaattccaaattgaggaaatggtgccattctcctgttaggaatgacaaaattaaggtcactagaagagaatgcaccatctagaaacaaagcaggatttctgacccattgttttctactcaagtaattttatttccttaatatggacaccattaagccaggagcagtggctcatacatgtagtaccagctactcaggaggatgaggcaggaaaaacccttgagcccaggagtttgagaccagctaggacagcatagtgaaacctcatctcgaaaatatgtataaatgtgggcaccgtcatttgtctagaaaaatctatagtaaattgttttgttttcctttcattgcaaagtctcatacttgttcttccaaaatcagttctatgagttgctttaaaattagcctgggacgtccaagaagtgttaagacatctgcagtaactggggcagccagtccctggaggccaactcagggaacaacaaactccttcgccaagccgtccacacatgccagctgatggtctaggacccaagtatgtgccaagagtgaggtgtcttacttctaaggagaggcaagcagtttgctatgcaagcgggtcgctggccctggacctaaagatcttctctctaactccatattctttaaataaacttgtcttttatgaggagtggaaaatcttagaatgaagcattcaaaatgaaactgatttttttttttttttttttttttttttgagatggagtctcgctctggcacacaggctggagtgcagtgttgcaatctcggctcactgcaacctctgcctcccgggttcaagctattctcctgtctcagcctcctgagtagctgggattacaggcgcgtgccaccacgcctggctaatttttttgtatttttagtagagacagggtttcaccatgttggtcaggctggtctccaactcctgtcctcctgatccgcccgccatggcctcccaaaatgctgggattacaggcgtgagccaccgcgcccggccccaaaccgggtttttaaagagtcattggtttataggtatcaccttctcatatgcaaaaggaggaatgtaaactcccccggatatgtaaaagagaattctgaaccaaaaattttgcataaccaataattacatctaaaaattaatttggcttttgggtatgagcctaaaacgaaacttaaaaataaagtatattgaaaagaaaaatggggccgggcgcggtggctcatacccctaatcccagcactttgggaggccaaggcgggtggatcacaaggtcaggagatcaacaccatcctggctaacacggtgaaaccccgtctccactaaaaatgcaaaaaaaaaattagccgggcgtggtggcgggtgcctgtagtcccagctactcgggaggctgaggcaggagaatggtgtgaacccgggaggcggaacttgcagtgagcggagatcgcgcaccattgcactccagcctggggtacagagggagactccgtctcaaaaaaaaaaagaaaaagaaaaaggaaaaatgggccaggtgtggtggctcatgccaataatcctaacacttcgggaggctgaggtgggaggattgcttgagtccaggagttcaagaccagcctgggcaacatggcgaaaccctgtctctacaaaaaatactaaagaagccaggcgtggtggcttatgcctgtaatcccagcactttgggaggctgaggtgggcagatcacctgaggtcaggagttcgagaccagcctggccaacatggtgaaaccctgtctctactaaaaatacaaaaattagccaggcgtggtggtgcatgcctgtaatcccagttactcgggaggctgaggcaggagaatcggttgaactcgggaggcagaggctgcagtgagcagagatcgtgccattacactccagcctgggcaacaagagtgaaactccgtctcaaaaaaaaaaaaaaaaaagtccagatgcagtggctcacgcctgtaatccatcactttgggaggctgaggagggcagatcacgaggtcagaagattgagaccatcctggctaacacggtgaaaccccgtctctactaaaaatacaaaaaattagccaggcgtgttggcatgcacctgtagtcccagctacttgggaggctgaggcaggagaatctcctgaatctgggagtcagaagttgcagtgagccgagatagtgccactgcactccagcctgggcgacagagcgagattccatctcgaaaggaagaaagaaagacagagagagagagagagagagagagagagagagagagagaggaaggaaggaaagaaggaaggaagggagggagggaggaaattaaccaggtgtgttgatgcctgcctgtagtcccagctactcaggaggctgagatgggaggatcacctgagctgggggaggtaaagactgcagtgagcagtgatcaagccactgtactccagcctgggcgacagagtaagaccctgtctcaaaaaataaaaaataaaaacaaacaaaagctagttacgcaagaaaccaaaaaataataatattttggccttcttttctagcctctccagtctcacagaatcactaacatttagtccactagaagataagaaataatggaaactaatatttgttgcgcacatactaagtgctaaagaaatttatatatattatttattttttcttttctttttttcttgaaagggagtttcacttcattgcccagacgggaatgcaatgtcataatcatggctcactgcagcttcaacctcctgggatcaagccatcctcccacgttagcctccgaagtagctaggaatacaggcgtgcaccaccatgcccagctatttttgttttttaattcttttatagagatggggtctcaccatgttgcccaggctggtcatgaactcctggactcaagcaattatctctccttgacctcccaaagtgctgggattataggcgtgagaaacagtacttggacaaaataaatagtcttataacaactcaaatatcttcaatgaggccaggtgtggtggctcacacctgtaatcccagcaatttgagaagccaatgtgggagggtcacttgaagccaagagttcagaccagcctggccaacatggcgaaaccacgtttctactaaaaatacaaaaaatacccgggggttgtggcacacaactgtaatcccagctacttgggaggctgaggtaggagaatcgcttgaacctgggaggtggatgttgcagtgagctgagatcacgccactgcactccagcctgggcaacagagcaagactccatctcaaaaaaaaaaaaaaaaaaaaaaaaaaaaaaatatatatatatatatatatatatatatatatatatatatatatcttcagtgaatactaaacaactccaacttctaccagcattctctataattaccaggaaccaatgaaggaaggaaatcattcttccagtcatcattctgaaagaaaaaagatcactggtgggaagtagaggagggcagatatctgaagtcaggagttccagaccagcctggccaacatggtgaaaccccgtctccactaaaaatacaaaaattaactgggcatggtgtcgcgcacctgtaatcccagctactcgggaggcagaggttgcagtaagccaagactgtgccactgcactccagcctgggcaacagagcaagaccctgcctcaaaaaaaaaaaaagaaaagaaaagaaaaaagatcactgggaagtaattggtttgtgttacaaatgcatatttcgcacatagtaggccttcaataaatatctcttaaaatgaatagaaatttagttacccattatcacagtcgagcttccttcctgtttggggtgaagtttttttgttttttgttttttttttgagatggagtctgcctctgtccccaggctggagtgcagtgctgccaccttggctcactgcaagctccgcctcccaggttcatgccattctcctgcctcagcctcccgagtagctgggactacaggcacccgccaccatgcccggctaattttgtttttgtatttttagtagagacggggtttcactgtgttagccaggatggtctcaatctcctgtcctcgagatccgcccgcctcagcctcccaaagtgctgggattacaggcgtgagccaccgcgcctggcctgtttggggtgaagttttttttttagtgctttctaacaattagccttagagtgaccataggtcttgctgcttctgtcatgtatggcctcatataagaacccaggaaatgttttgtctttgaacctggagatgctatttgtgaaagatgtttgtttaataaaatcagaggaggcggccgggcgcagtggctcacacctgtaatcctagcactttgggaggctgaggcaggcggatcacctgaggtcgggagttcaagaccagtctgaccaacatggagaaaccccgtctctactaaaaatacaaaattagccgggcatggtggcacatgcctgtaatcccagctactcgagacgctgaggcaggagaatcgcttgaacccaggaggcagaggttgcagtgagccgagattgcgccattgcactccagcctgggcaacaagagcaaaactccatctcaaaaaaaaaaaaaaaaaaaaatcagaaggcaccttctccaataaataaacagagaggggaaaaggagtaatgggaaaaaaaggaagtgttgaagattaaaagacttcagatacatatcaaccaaatacaatatgtggatctttttggatcttgatttcacaaaataactgcaaaattcatttttgacagttggataaatttaatatatagatgaatattatatgatattaaggacttcttttatttatattttattttatttatttatttattttgagatggagtctcactcttgtcacccaggctgggatgcaatggtgtgatctcggctcactgctacctccgccttccgggttcaagcaattctcctgcctcagcctcctgagtagctgggattacaggcgcgcaccaccacgcccagctaatttctgtatttttagtagaaacagggttccaccatgttggacaggttggtcttgaactcctgacttcatgatccacccgcctcagcctcccaaagtgctgggattacaggtgtgagccaccgtgcctggccaggacttattttcattataatgagaataatgacattgttttatgttaaacaaaggatatgtgttagagatatgtaatgaagtatttacagttgcaattatataatttctcacatttgcttaaattcttcctctgctttctcccccagaaaagttaagaagagtccgggcgcggtggctcacgcatgtaatcccagcactttgggaggctaaggcgggtggatcacgaggtcaggagatcgagatcatcctggttaacacagtgaaaccctgtctctactaaaaatacaaaaattagccaggcgtggtggtaggtgcctgtagtcctagctactcgggaggctgaggcaggagaatagtgtgaacccgggaggtggagcttgcagtgaaccgagatggcaccactgcactccagcctgggtgacagggcgaaactccaactcaagaaaaaaaaaggaaaagaaaagaaaagttgagaagagatagatgaaataagagcagcagaatattgataactattgaaactgaatgataggtacatgggagttcatatgtaatactaattttataaaggcagtatctaaaattttccttaataaagttttctttgttttatttttaaatcagaggactcgactttcgagaatagaagctgagcaatatacaaggtgtggttgagacaaataatttcaacaagaaaatcagacttggattatgtctgaaatataaagtctcagaaaaagagcttcaggctcagaaatgcctagcaagtaatgaggaaaattttgaagtaaaaacaaacaaacaaacaaaaaaagcctagcaaagtaatcaaagaagttctctttatgctgaaggaagaaaaagtgaagaaaattagtgcctacagctctttagtttttatttatttgacctcttcagatttatgtatacatattttgtgaggttttcttttttattgagaaaaggtcttgctctgtcacgagggctggagtgcagtgatgcgatcgtggctcactgcaaccttgaccccttgggttcaagatcctcccacctcagaccccagaatagctgggaccacaggaacacaccatcacgtccagctaatttatttttatattttgtagaaatgaagtttccccatgtcgccaaggctggtctcaaactcttgggctcaaatgattctcttgccttggcatcgcaaaatgctgagattataggtgtgagcccccatacccacccaaagttttaatactattttctttcttttttctttttctttttttttttgagacagagtttcactcttgttgcccaggttggagtgcaatgatgcgctctcggctcaatgcaacctccgcctcctggattcaaatgattctcctgcctcagcctcccgagtagctaggattacaggtatgtgccaccatgccaggctaattttgtatttttagtagagatgggtttcaccatgttgaccaggctggtcttgaactcctgacctcaggtgatccacccgcctccacctcccaaagtgctgggattacaggcgtgagtcactgcacctggacttaatactattttcaacataaaagtaaattgttttccatattatatgaattgaatatatctaatctaaaacatgagtctaaatcactgtacattaaagactttcaaatttgtccagctcataaaaatgttctctgcagtctgtactgttttattgttaagaggttgatgagagactatagccttgttttcttatgatttaagtgtaaaaatatatcacatatcagctaaatgattgcaaatatccctccatccttaaaaacattgcaaagatcagaccgggtacagtgcctcatgcctataatcccagcacttcaggaggccgaggcaggcggatcatgatgtcaggagttcaagatcagcctggccaatatggtgaaaccatgtctctactgaaaatacaaaaattagctgggcgtgctggcgcatgcctgtagtctcagctgctcgggaggctgaggcaggagaatttgttgaacccagaaggcagaggtcgcagtgagcaaagatcgcgccactgcactctagcctaggtgacagagtgagactccatctcaaaaaaaaaaaaaaaaagaagaaaaagaaatgtatttttggctgggtgcagtggctcacacttgtaatcccagcactttgagaggccaaggagggagaatcacttgagctcaggagttcagagaccagcctgggaaacataatgagaccttatctctataaaaaatttttaaaattagctgggcacggtagtgtgcatctgtggtccaagttactcaggagactgagatgagaggattgcttgagtctgaaaggcagaggttacagtgagccaagaacacgcaactgaaccccagcctgggcaacagagtgagaccctgtctcaaaaaaaaaaaaaaatgtggctgggcgcagtggctcatgcctgtaaatcccagaactttgggaggctgaggcggacagatcacttgaggtcaggagttcaagaccagcctgaccaagatggtgaaaccccatctctacaaaaaatacgaaaatcagctgggcgtgatggagtgcacctgtaatccagctacttgggtggctgaggtgggaggatcacttgaacccgggaggcaaaggttgtagtgagctgagatcacaccactgcactccagcctaggcaacagagcaagactcaatctcaaaacaacaacaaccaaaaaaaaaaacgtattttggcactacccaagtatccttccagattttgtttccctatccatactgatcttttaggaggaaggacagagcaacaaagggctggagatgacatgtaagggtcctggtgcacatagtgttgataccctaagttgatcaccagttcctacttcagtaccacctcctctgccacggccatctttcttgacatcatcagtaaatccaatattgaccaggtctgctggggcttcagccttacaagagagaaagaattccactaggttctcaatatttttttttttttcagacagagttttgctcttgttgcccaggctggaatgcaatgccatgatcttggctcaccacaacctctgcctcccaagttcaagcaattctcctgcctcagcctccgaagtagctgggattacaggcatgcaccaccacgcctggctaattttgtatttttagtagagacggggtttctccatgttggttaggttggtctcgaactcccgacctcaggtgatccacccacctcggcctcccaaagtgctgggattacaggtgtgagccactgcacctggccaggttctctatcttttacacattggtttattgcacgcttactacatgccaaacattcctggactccctggggaagaaatggtgagcaaagagacatggttcctgccctcatgaagcttatagtctagtcaatgagaattaaaagcaaactttgggccttccagtccacaggcttcttccttctctctctttccatgcctatgttttcagtacctatgaggttagacactagcacacaaacagttaagagctaactgtaaatacgaatagataggtctacaagaaagtttattaaactttagcagtggtaaactccagatttattcattcatttgacaaaatgaacagacaggaacagggctggggatgcaactgtgacaaaagtccctgccctcatggagctgacattctagtgggggagacgaataatcaacacgatcactaagtgaactatgcaagatgtgagctagagataagtgctacagaggaaaaaaaaaatagcagagaagagggaggaggttgacattttagagaagatagccagggagggcctcacagagaagagaacatttaagtatagacttccaggaagtaagggaggaacgaggcagatatctagagaacacagaataccggaaggagatacaaaggccctgacgttggaatgttcttgggcatttgaagaagcataaagtggccagtgtggctaaggcagagtaaacaaggaggaaggttggggggaatgaagtcagagtgatggggagggaaggtatgggttgtgggaaagactttgcctattattctaagtgaaatatggccaagtgtggtggctcacgtctgtaatgccagcactttgggaggtggagatgggtggatcacttgaggtcaggagttcgagaccagcctggccaacatggtgaaaccccatctctaccaaaaatataaaaaattagctgggtgtggtggcagtcgcctgtaatcccagctactcaggaggctgaggcaggagaattgcttgaacccaggaggcagaggttgcagtgagctgaaattgagccactgcactccagtgtgggtgacagagtgagactctatctcaaagaaaaaaaaaaagaaatgaaaaggcactggaggccaggtgcagtggctcatgtctgtaaccccagcactttgggaggccgagacaggtggatcacttgaggtcaggagttgaagaccgcctggccaacatggtgaaaccctgtctttactaaaaataaaaaaatcagctgggcgaggtggcgtgtgcctgtaattcctgctatttgggaggctgaggcacgagaatcacttgaacccaggaggcaaaggttgcagtgagccaagattgcaccactgcactccagcctggatgggtaggggttgagagaaagggaagaatcaaggaagatatgagtatttttgtcgtagcatagaattaccattaacggtagaataggtagatattttggaaggggtgagagcactttgggacgtgttaagttggtgatgtctatgaaacactcaagtgaagatgtcaagaaggcaggaggatatatgaacctggagctcatataaactgagaagccttaggtaatgctatacatgtagaagcccccaccataaagaaggtattgaaaaacatgtggttggatgaagtcagctcaagagttgggaagaggtccaaagactaagcccttgagcacatctctagtggcatttcatatgtcttttactgctttaaagtccctttctgtattgtttaaatgtatacaatgtgtcatttttcaaaaagctatataattctttggaagagaacaagagtaaaagaatccctatcaggaaaccatcatcagcaaagataaatgtgccccattctctggaatccaacatgatacatccagcaatctgaaagcagagcagtgggaacacaggagatggaacagactttttgcttcatgcctgcactaagcagaagtttggcacccaagtatgaagccatcctttataaagaagtcaccagagacagcttaatcaatcactaaaacaagtagctccctacatggaatgatgtgagatgcattaggggaaaatctctcttgtcctaagacagttcatgaccatcttctggaagcttaattcacccccatgataatgattacaatgaaaaaaaagcaaaagcaaaatttgattacatttgttatgttccaggcattgcatttaagttccttatgtgtattagctaattgagtcatctcaacaaacttatgagttaggaaatattattatccccaacccagaaaactgagttgttgacacttggcctgaggtctcacagttaatatatggtggagcaaggatttgaatatgtatcgtttcactcctgaacccatactcttctttcttttttcttttttttttttttagaaggagttccgctcttgttgcccaggctggagtgcaatggtgtgatctcagctcaccataacctctgcctcctgggttcaagcgattctcctgcctcagcctcccaagtagccggaattacaggcatgcgccaccatgcccagctaatttttttttttttgtatttttattagaggatgggggagaaaagaactaaaaatgtttcacacacttctggatataacacttttaggtaccttcgtttttttgttttctactctattgttaaccacttataagggtctgttaggaatagtatgtgggcagagaaaaagtacaaattttacctgctttacaattcttccagagctactctagaagccacatgactaagtagaaaaaaatctttcagtgcacaataaaaacctcagctttaagtcaattttcccatcttaaaagtacttaccatgggccggacatggtggctcacacctgtaatcccagcactttgggaggccaaggagggtggatcacaaggtcaggggatcaagaccatcctggccaatatggtgaaacctcatctctactaaaaatacaaatattagctgggcatggtggtgcacgcctgtaatcccagctactcgggaggctgaggcaggagaatcacttgaacccgggaggtggaggttgcagtgagccaagatcatgccattgcactccagcctgggggacaagagcaaaattccgtctcaaaaaaaaaaaaaaaaaaaaagtgtaaggatagaaaaaaaatcatacggtaaggttgcaaagagcaaagatctatgggtagcatgaatcttttttttttttttctttttttttgagacagggtctcgctgtcacccaggctgaagttcagtggcaggacctcggctttctgcaacctctgcctcccaggcttaaggtatcctcccacctcagcctcctgagtagctgagactacaggcacgtgccaccacagctggctaatattttaaaaattaatttttggtagagacagggtttaggtttcaccatgttgcccaggctggtctctaactcctgggctcaagcgatccacctgcctggcctcccaaaatgctagggttacaggtgtcagctaccatgctcagccaagaacaaatcttctatttgtgaaattgtgaagaaggaaaaagaaattcatgctagtttgcctgtcgcagctcaaacaaactgcaaaacttttggtcgtagagcgtgataaatgcttagtgaggatggaaaaagccttaattttgggggtgggaaacatgtacagaaacttactcaggtttggtattatctgcagtttcaggcatccaatgggggttttggtagtgttccccacggataagcagggactactgtatattttttttagatgatgtataatttagcaacaaaaaggggccttgcttgtgaatgtataagacagccctattccagagttagagaacttcaaaccaagcagaatatgaggaagaaagtgaacataagaaaaggccgggcgtggtggctcacgcctgtaatctcggcactttgggaggccgaggtgggtggatcacctaaggctaggatttcaagaccagtctggccaacatggcgagaccctgtttctactaaaaatacagcagtgagctgagatcgcaccactgcactccagcctgggctacagagcaagactctgtctcaaaaaaaatccaaactttgaatcaacagttctgattttgtgataagtatttgaattatgtcaagggtgacagtaaatatattcaagaaccagtactacatggcactaaccaatcagaatggacaccctgaatgacaaaaaatgtccaccagcctgaagcaactgctgtggccaggtctctgtgttccattgaatgtcagttttgaattatgtaaatgtggtcatgatgtcagatgttcaaaagtcgaaacttctaaatttcattagcttcctttatattactaagccagttacatttagtcaaatatgtactttcttttttttcttttttttttttcctgagatggaatctcgctctgtcctccaggctggagtgcagtggtatgatctcagctcactgcaacctccaccttccaggttcaagcgattctcctgcctcggccttctgagtagctaggattacaggcatgcaccaccacgcctggctaatttttgtagttttagtagagacggggtttcaccatgttggccaggatggtctctatctcttgacctcgtgatccacctgcctcagcctcccaaagtgctgggattacaggcgtgagccactgcacccggccaatgtgtactttcttaaaaaagaaatcagctcagttttcttggctttagcttttttttttttttttttttttttttttgagacagagtctcactctgttgcccaggctggagtgcaatggcacaatctcggctcactgcaacctgcacctcccgggttcaagcgattctcctgcctcagcctcctgagtagctgggattacaggcgcctgccaccacgtccagctaattttttgtatttttattttatttatttacgtatttatttatttttgagccggagtctcgctctgttgcccaggctggagtgcagtggcacgatctcccctcactgcaagctccgcctcccaggttcatgccattctcctgcctcagcctcccgagtagctgagactacaggcacccgccaccacgcctggctaatttttttgtatttttagtagagatggggtttcaccatgttcgccaggatggtctcgatctcctcacctcgtgatccacctgcctcggcctcccaaagtgctgggattacaggtgtgagccactgcgcccggcccaattttttgtatttttaatagagatggggtttcatcatgttggccaggctggtcttgaactcctgacctcaagtgatcctcccacctcagcctcctaaagtgctgggattacaggcgtgagccaccatgcctggtggcattagcttttttataaagttcaattctctagtttgagacctttatccaagttgctttgcctccaatgcaaaacttatttctatacatttttccgtctgcaccaaattatgtgttctgagttgctcagcttttctgagacttcttcatttagaaaaagtatgtgtcactggggtggtggttcactcttgcaatcccagcactttgggaggctaaggcaggtgggtcacttgaggtcaggagtttgagaccagcatagccaacatggtaaaaccccgtctctactaaaaatacaaaaaaatttgccaggtgtggtaccgagtgcctgtaatcccagctactctggaggctgaggcaggagaatcacttgaacccaggaggcagaggttgcagtgagatgagatcgtgccattgcactccagcctgggcaaaagagtgagactctgtctcaaaaaaaaaaaaaaaagaaaagaaaagaagaaaagaagaagaagaggaagaagaggaagaagaagaagaagaagaagaagaagaagaagaagaagaagaagaagaagaagaagtagaagaagaagaagaagaagaagaagaagaaagaaagaaagaaaaagagaaaagaaaaaataagtgtctccagaaatggtactacttgagagctgacaattccaatctcattgattatattcttggctgtatttagcacacagctgattagatacctgcagcaaatcatcaccaagaaagaaagaaaggcaagattcatcagttatgatgaatttgttttagacgaagaacaactggggccaggtgcggtggctcacacctataatcccagaattttgggaggctgaggtgggtggatcacttgagcccaggagttcaagaccagcctgggcaacatggcaaaaccccatctttacaaaaaaatacaaaaaattagcccagtgtggtggtgtgtgcctgtagtcctggctactttggaggctgagatgggaggatcgcttgaacccaggaggtggaagttgcagtgactcgagatcatgccactgcactccagcctgggcaacagagcaaggcttgtcaaaaacaaaaaacagaaaacaaaaaaaaaaaacctttaattctaaacaaactcactttttaagttttgttttgtttttagttaaagcttatttagtttttataccattgccataataaagtatttatgtttcactttttaaaaagactaataaaaggaaatactttttggttatcccttaacagaaaaaaggattccccaaataatcctacaattccaaacaagtaacactaggaataccctcatatacaattacagcacagacacaccaggcacggtggctcacgcctgtaatcccaactctttgggaggccaaggtgggcagatcgcttgagctcaggagtttgagaccagcctgggcaacatggcaaaaccctgtctctacaaaaaatacaaaatttggcagggcgtgttggcgtgcacctgtggttctagctacttgggaggctgaggtgggaggatcacttgagcctgggaggcggaggttgcagtgagccgagatcgcacaactgcactccagcctgggtgacagagtgagaccctgcctaaaaacaaacaaaaaacaattatggtgcagagagttagaactggtcaaactcagttcaactgaggcaactctacgtgcaattgacaactgcccagattagtatagatatagattcagccagacaagaatctagttccctaaggaaagcatgatattatgaaattcagggccttatgtttccctcttttccttgcttcaagagtagtccatggacaatgctcacaatataatgttaaatcagttttaaaaactaaaattgaaacataaacctatacattaatatacctgtgtctacacacttgtgtatgttacatatagttacatacatagggactgaaaggagagacaccacaattcttttgtctagatctggagataaatgtgattgctttgccctgggagatggtaaccctgctgaatacatctgttggcaggggacaaagtatgtgatggaggtgctgaaagatctcatatgcccaatttgttacagtctgtttgatatccttgagttttggcttacttgcacaacttccgggaaaaaaaaatgcttagaaggcatgggatgattaatactgagaatcaacttgattgaaggatacaaagtattgatgctgggtgtgtctgtgagggtgttgccaaaagagattaacatctgagtcagtgggctggggaaggcagacccacccttgatctggtgggcacagtttaattagctgccagcgaatataaagcaggtagaaaaacgtgaaaaggagagatgggcctagcatcccagcctacatctttctcccgagcaagatgcttcctgccttcaaacatcagactccaagttcttcagttttgggactcggactggctctccttgctcctcagcttgcagacagcctgttgtgggaccttgtgatcatgtaagttaatacttaataaactcccatatataaaaactattagttctgcccctctgagagaactctaatacaaggtagcttaaaggagaatgtgcagaattcattgtggagactacctccattcagtcaagtgccctggggtgctgtaaggaaacttcagcaactggagtcaacagcctgcaggttaattactccctgaagggtttgaagaaaatataactagatcaagatctcttctaaaatgccagtgttcaaaggacatctggagtacctctgagcattctcgggctgactgatacacagctaatctgtggaatccgtgctactggtgttgaccacaccaagcattgtcttctgttctattgaagaagttcatgctcagaaaagaaatggctatgcctttgaatccctcttttagagttttgagaactggcgttggggagatgttctttctcgcctgaataccatggagactagcaagttactgattaaaatatttaagtaaagtattaaagaattgaaataaaggccgggtgcagtggctcacacctgtaatcccagccctttgggaggtcgaggcgagtgggtcacttgaggtcaggagttcaagaccagcctggccaacatggtgaaacctcgtctccactaaaaatacaaaaattaggtcgggcgcagtggctcacgcctgtaatcccactgagggatttgggaggctgaggcaggtggatcacaaggtcaggagattgagaccatcctggcgaacacggtgaaaccctgtgtctactaaaaatacaaaaacaaaattagctgggcacggtggcgggcacctgtagtcccagctactcgggaggctgaggcgggagaatggcatgaacccaggtggcagagcttgcagtgagccgagatggcgccactggactccagcctgggcaacagagtgagactccgtctcaaaaaaaaaaaaaattagccaggcacggtggcatgcacctgtagtaccagctacttgggaggctgaggcaggaggatcacctgaaaccaggaggcgaaggctgcagtgagccgagattgtgccactctactccagcctgggtgacagaacgagactctatcaaaaaaaaaaaaattaaatcaagtgaattggatccaaaaaataaaaaattaaactttttttttttttgagatggagttttcctcttgttacccagtctggagtgcaatggcacagtctcagctcactgcaacctccacctcctaggttcaagtgattctcctgcctcagcctcccttgacctcaggtgacccacccgcctccgcctcccaaagtgctggaattacaggcatgagccactgtacccagcctcaaaaaatgaaacttaaaattaggcaaaccactgatccagagatcaacaaactcaacaccgtcttgcaggagcagtgaatggccttaacattgctgaagctatcaaagtcgtttcagaacccgtcatgtgctgcaacagatgcaggaattctgggaggtaatcaagaaaactcctttacctccctctaatttgcccacaagttccctaatgaagaactttgataccagtcagtgggaggacataaaactagtagttgtgcatacatgttctttgcctcaacacattggcacattcattaacaagattccctggagcttttttttttttcttttttgagatggagtctcactctgtcgcccaggctggagtgcagtggtgcaatctcggctgcagtgcaacctccgcctcccaggttcaagcgattctcctgcctcaccctcccgagtagctgagattacaggcgtgtgccactgtgcctggcctgtttatttattttttgagcctcattctcaaaattttgagactctgcctcctgggttcaagcatttctcctgccttagggtcccgagtagctgcagctacaggtgtctgccaccacgcccagctagtttttgtatttttagtagagatagggttttgccatgttggccaggctggtcttgaactcctggcctcaagcaatctgcctgtctcggcttccaagaaagtgctgggattacaggcgtgaaccaccatgtccagctgtctacaaataattttaaaattagcctggcatggtgatacatacctgtgatcccagctactcatcagactgaggcaggaggatcgtctaagcccaggagatcgaggctgctgtgatcatgccactgcactccagcctgcacaacaaaccaaaactctgtcttaaaaaaaaagaaaagaaaaaaattatattaagaagaaaataaaaaagaaaaacgtgtttgtgtatgtatacagttccatttgatcccagcaacacctgtgtgtttgtattatttgcattttatagctgagagaattgaggctctggtggattaaatggcttgcccatggtcacatgattaggagtaatttgttgaattggaacttgaggccaaactttccggctgcaaattcctatgatttttttttttttaaccacattatgccacagaatgaacaagtggagtcatgttggaaaggtaacaaatgtaacctctcccaggccaatccactgagacaaaaaaagtcgttctactttgtaggccgggtgcggtgtctcacgcctgtaatcccagcactttgggaggccgaggcgggtggatcacgaggtcaggagatcgagaccatcctggctaacacggcgaaaccccatctccactaaaaatacaaaaaattagtcgggtgtggtgatgggcgcctgtagtcccagttacttgggaggctgaggcaggagaatggcgtgaacccgggaggtggagcttgcagtgagccgagattgcaccactgcactccagcctgggcgacagaccaagactccatctcaaaaaacaacaacaacaacaacaactttgtgttatcaattgatgactgagtcctgaggaaatggtcttttcacaagccgggaaaacctgtgagcctccaaattacatatgctgtctgtccgccataccctaacaagtgatgtttaccatctaatcatgaatagacagagttactctgttactgcaaaacatgctgacatgagattacatttggatctgagataagcacaaggcccagtgcttgaaagggggcatgactaaatccaaagtaggaaaatgttctttgcactagacagctcaaggaaaagaaatcatggtaataccagacttgtttcagataaatgctgagccaccgttacaccaataccaatatcagcacacatttattgtgtgcccaggtaatagatctgtgttacaaatagaactctggagaaatagaaggtcaagattattatctcctttcaaaaaaacagtaaacttcagtaagacagggctaatttgttttatatcaaatcacttgggtgcttcgtttaaattttttcatttgtaaaaagagggtaatatttatctggataatatgtgtccccagattgtcaggataaaataaaagaacatgtggacatgcagtttaaaatatatatgtatagtttttttgagaaagtctcactctgtcgtccaggctgcagtggtgcgatcttgcctcccgggttcgagtgattctcctgcctcagcctccagagtagctgggattacgggcatgcgctacaacgcctgactaattttttttttcctatttttagtagagacaggattttaacatgttggcctggctggtcttgaactcctgacctcaaatgatctgcctgcctcagcctcccaaagtgctgggattacaggtttgagccaccgtgcccggcctacagtttaaaatttacaagggctgtttataccatcaatgtcatcctcattgttcatggtcataataatggataccaatgggtttgcataaatctcatgtgttttttggatactttccttaggtctttgttgtctaaataatgcacaaacatcttcaagacctggctaaagaagcccaaaaatcaatttgaaagtctaagcaacggctaccttcctactaatagatgatgataaatcaacagggctgttaactgtagactcagggaactgcagttaattaacatatgcaatatttatttcacctgaacctttctcagaatcagagatcatcagttttttagtttattgaggggttaatgactcatgtgacccataggaatgaggaaagagcaaaaggcaacagaaaacaagttgaacttaagaaaaacaacactcagcactacccctgctcatgggtgtactctgacttgagctgtcacctgatggaaggaatagcattgtgtgtgcgtgtttgaaaaaaggtaaaggagccaggcgcggtggctcacgcctgtaatcccagcactttgggaggccgaggctggcggatcaagaggtcaggagatcaagaccatcgtggctaacacagtgaaaccccgtctctactaaaaatacaaaaaattagccgggcgtggtggcgggcgcctgtagtcccagctactcaggaggctgaggcaggagaatagcgtgaacccgggaggtagagcttgcagtgagccaagatggcaccactgcactccaacttgggtgacagagtgagactccatctcaaaaaaaaaaagaagaaaaaagaaaaaaataaaggagcccttccagagaaatttgcccagagggctcaaacttaatagctatataatttaaaagactgaccagataaaagttctctgcctttgtggagagaagtccagtaatctggacatctggacattggttttttttttgagatggagtctcgctctgtcgaccaggctggagtgcagcggcaagatcttggctcactgcaacctccacctcctgggttcaagagagtctcctgcctcagcctcctgagtagctgggattaccagtgcacaccaccacacccggccaatttttgtatttttagtaggcacgggaatttgccatattggtcaggctggtattgaattcctgaccttgtgatctgccggccttggcctccgaaagtgctgagattacaggcgtgagccaccgtgcccatcctgggcattgttttacatttaaaacttcagaaacttttttaaatttaaactttttattttgagacaatggtagattcacatgtaattcacacgttgtaagaaacaatacagagaaatctggagtaccatatcctctagctttccccaaaggtgtagttgaatatcacaaccaggatctcgatattgatagtcaagatacagaacagattttgcaaacttttttttttttgagatggagtcccacgttgtcacccaggctggagtgcactggtgcaatctcggctcactgcaacctccgcctcccaggttcaagcaattctcctgcctcagcctccagagtagctgggattacaggctctcgccaccacgcctgtctaattttttttattttttatttttttgagatggagtttcgctcgtcgcccaggctggagtgcaatggcacgatgtcagcacactgcaacctccgcctcctgggttcaagcaattctcctgcctcagccacccaagtagctgagattacaggctcccaccaccgcacccagctaatttttgtatttttagtagagatggagtttcaccatgttggccaggctggtgtcaaactcctaacctcaggcgatcccacccacctcagcctcccaaagcgctgggatttcaggcatgagcccccgcgcctggccaatttttgtatttttagttgagacagggtttcaccatgttggccaggctggtcttgaactcctggcctcgagtgatccgcccgcctcagccttccaaagtgctgggattacaggcatgagtcacggtgcccttccagtctttggaaacatttaaaatgagttgatcactatcataattattaccacattctcacaagtcagaaacattcctttaaattccaaaattgctaagtgaggtcttaggcgatgtattgccttgaggactgtgcagtgatctgagaggcagcttgccatgctgcctagaatatttactcacgtttttcccaggagttacaggcgatttataactagttgccaattaactacaaagttaactttgcaggtagagctgaacatttcatcacaggacacaagagctcacaagttaccttgctgagcaagcttcccagagaaagttattagtattacgaatggctccagtttttccacactcaatttattcattcaacaagcctcctgtaaggaacttctggccactcagcaatggcctgaatgcacttgcttctctgtgggccagttccccagatatgactcttacagtgcaaataagggttagctttccttcaatttattccaatggtcattctttctactgtaacctgtaagagttctgcaggaagtttttgacaaaaactggcaagggtctgaggaaatatacaagagatggagatccccctccccagaggaaatagtagtcacttacagagaaattgtaagacctccttttaaataaaatattaatgaattttcaagggaaatcccttttggaatctggcaaggtcacataacattaaaagcaggtggaaatgaggacacagaattgttcagagaagtagctaaaacagaagcttgagaattgcctatctctacatttggatatccagaaaagcttttgaaaagtaacataaggccaggcacagtggctcacccctgtaatcccagctcttttggaggctgaggcggggatcacctgaggtcaggagttctagaccagcctgactaacgtggcgaaacccttcctctattaaaaatacaaaatttagccgggcgcggtggctcacgcctgtaatcccagcactttgggaggctgaggccggtggatcacgaggtcaggagatcgagaccatcctggctaacacggtgaaaccccgtctctactaaaaatacaaaaaattaggcgggcatggtgtcgggtgcctgtagtcccagctactcgggaggctgaggcaggagaatggagtgaacccgggaggcggagctcgcagtgagccgagatcgtgccactgcactccagcctgggcgacagagcgagactccgtctcaaaaaaaaaaaaaaaaaaaaaaaatttagctgggcatggtatcaggcacatgtaatcccagctactcgggaggctgaggcaggagagtcaattgaacctgggaggtagaggctgcagtgagccaagattgggtcactgcactctagcctgggagacagattaagactccatctcaaataaaaaagaaaaaaaatgtaatctagtactaggcaccgatacatttctagagtatcagtataatttccttcttttttttttttttttttgagacagcgtctcgctctgttgcccaggctggagtgcagtggcgcggtctcggctcactgcaacctccacctcctgagttcaagcaattctcctgcctcagcctcccgagtagctgggactacaggcacgtaccaccacgtccggctaattttttgtatttttagtagagatggggtttcactgtgttagtcaggatggtctcgatctcctgacctcgtgatccacccgcctcggcctcccaaagtgctgggattacaggtgtgagccactgcacctggcctagtacaatttcagtgtattcttgggatttgctgttctttttttttaaacagagtctcactctgtcactggggctggagtgcagtggtgcaatctcagctcactgtaacctgtgcctcctgggttcaagccattctcctgcctcagcctcccgagtagccgggattcaggcacctgccacaatgcctggctcatttttgtattttcagtagagagagggtttcaccctgttgcccaggctggtctcgaactcctgacctcgagtgatctgcctgccttggcctcatgaagtgctgggattacaggcatgagccaccgcgcctggctggtttgttgttgtttctgccattggcatccaaagataaagttcctttcctaaaatgacaccttgacatgctcaagtatacaaacaggaagacatgacagtatgaaagacgccacctactcctcttgttatgacacgcatggtttcccaagttaccagtgcttctctctggtttgatctgcattgtcaaaaaagagttggggtagtttcctgagtttcctctccctgtattacaggacaagaaatgtcaccagtgagaactaggtaacacagagagctagtttgcaactcctgactgctcagggagaaaaataaccagcattaacagggttttatttttgttttccttccaacagagcagctcaagctcttccatcacaaaaattcaatctatacacaacaatggaattcagtaggaatccagggaaagggaagaagtggacaaaacagattgaagtttaacttatcattttccaaataccccaaatacctaaaacacatcaaaaacaaaaaaacatttactttatcagtttttgtttgtttgtgtttttgagacagagtctcactttgttgcccaggctggagtgcagtggcacgatctcggctcactgcaacctttgccgcctgggttcaagtgattatcctgcctcagcctctcatgtagctggaattataggcacaggccaccatgcccaactaatttttgtatttttagtacagatggggtttcaccaagctggccaggctagtcttgaactcctgacctcaggtgattcacctgctttggcctcccaaagtgctgggattacaggcgtgagccaccacacccggcctggtttactgaatataaatagcttaaataggggtgttacccagattccagaaaaataatacagatatttggataaattaggtaacttttggttatttttgtgccataaatctaaaaactttattagtttacttatcactaatatacctgtcaaactgttgctatggagctttctaccatcaggatatacaaccaaagaaaaaaagattactcagagtagtaaagagtttgggaatgggatacagcggacatatgacccacccttttgggactgcagtgccaaacccggaaatcacctgtgtttcaccaatcagaacatcctgtttttactttttaatggacatgcttttgtatcatgtacatcattatgttaatggttggtagccataaaactttttttttgcttacatctacctgtgtctactctttcaaatttgtacagaaaacccagctctgagtgtatatcttgatctgggagaaactagctatccttgaatatgcttggatagtccaagggttcctatcttgactattttaatgccagtttagtgagctaagaaatgaactagaaaccagaatgctagttagtgctaaaacggacacactgagtgaccacaggacttccttcttggccaaactgagagagaaggagactgtcatgaacaatattaatattaatgaagcaaaacactcagatgatttagatgacagcagtaacttcactatgttttttcccatttgtgctgtgtgtatgtgtgcgtgtgtgtgtgtgtctgtgtgtgtgtctgtgtggtacttgataattttttatggccctatgtgtccatccaggtgagaaaatataattgagatctaaggcttccctagaaagaatcttagagatcatgcattgtatctggatctcaacttactttttttatttctaagataatattctcctaaatattcaaacaataatataagttgtttctttgccttttgaccaccacccaattccactttccttcccaaaaataaccaatgttaattagttatgtgttctactccttttctgtacagatacacagaaatacatacaaccgacgctgggtgtggttggctcatgactgaaatgtcagcactttgggaggccgaggagggaagatcacttgagcacaggagtctaagaccagcctgggcaacatagcaagaccttgtctctgcaagaaattttaaaaaattagctgggcatggtagtgcatgcctatcatcgcacctaccccagaggctgaggtgggaggactgcttgagcacaggaatttgaggctgcagtgagctaagatggcaccactgcactctaacctgggcgacagggctaaaaaaaaaaaaaaattatatgtacacacacacacacacatacacgcaactgcaatgacatatctttttttttctttttttttttttaagacggagtctcactctattgcccaggctggagtgcagtggcacgatctcggctcactgcaagctctgcctcccgggttcatgccattctcctgcttcagcctcccgagtagctgggagtacaggtgcccgccaccatgcccggctaattttctgtatttttagtagagacggggtttcgccgtgttagccaggatggtctgcgatctcctgacctcgtgatccgccggccttggcctcccaaagtgctgggattgcaggcgtgagccaccgcgcctggcccaattgttatttattgaacagagtttgaagaaactgaaagtctccatttcggtggccaaaaccgcaattacttttgcaccaacctaatactttaaaacaaacaacaacaaaaacacagttgttattcaaacataaattcaactggcgctcacttttgtcttcacttaagttaatcagatgttcatgttactatgaagttgaccagttaatttgtaatgaataattagttaatttgtaatgaataatatttcactgagtagtcaagccctctttccactaaaccaagctgcttctcactgtactaaaccccgggctctctctaaactttcaggtgttccactccttgtcaccttcccctagatcctgagtggggttcactcttagctccctcgggggccacttctcaacacttacagagctcctattgacctggcacggtggctcacgcctgtaatcccagcactttggcaggccgaggtgtggggatcacctgaggtcgggagttcgagaccagcctgaccagcaaggagaaaccctgtctctactaaaaatacaaaaaattagccaggtgtggtggcgcatgcctgtaatcccagctactcgggaggctgagataggagaattgcttgaacctggcaggcggaggttgggtgagccgagatcgtgccattgcactctagcctgggcaacaagagcgaaactgtctccaaaaaaaagaaagaaaagaaaaaaagaagacttcctatctccacctgggtccccaagaggtaagaggtatctccttttctcctgagcctaggtcacctcggggtcccccgaagttccccagaaggggctgcacaagtcaggacaagaagtccaggaaatggggggtcgccgatgaccacgccccggggctctgtttgggaacccccaaaatttactgaggtggaaagattgcggggtcattgtggggtcaggctgagggggccgggcccagccctattcacgtgacccggtcccagggagaggagtttgttcacccaccagagggaacgcccgacgcgaaggcagtgtggcaccctcccttcccggggagtcctgggcgttgctctcccaccccggccgtgacgcaatctctccgcgccgggggcgggacgagcttgacgccatctccgggcgcccggctgtggggggcgctgggtgtggggcggctccggggccggggatggcggcggccgcggttgcggcggctccgggacgagtgagtggatcctgggaagcgctgtgaaatgggctggtgagtgtccctggaagtggtggccgccggggccaggcaggcctggggtcggtgctccggaggaagtggccctcaggagcccgttgctccggcgggccggggcccatgaaccgtggacagacggaggggagaggccgcacctagaccccctcgcgcttctctctggcctgtcctggaaggtggcctcaggccccggcgccccggaggctgtgtgcctgcgagccaaggtgtccgagtctgtggggcgggaagggcccccaaacaaggaagcgtcgcctgcagggcctcgcccctgcccccttggtgaagggtggaccccctactctctaaacgcagaattcccaatttcgagccctacccttgttggatcaaggattgcgggaccactgggagccataaccgtagtctctgacaagcttctccctttctgtcgggcgcacctctcgcccgcagagaatttgggtctccagctgggttcagccccttgattccgacccaagcgtgatgaggagcttggttccgggctctgctagcagcgttggcaactctcctgaacagcctgttagctcggttggggtcacaagctgcgttttccctttgagatgctcagtgaggttctcgagaggcggaggtttcggattcttaagtgtgttttgcgttgtgggaacctggcgcacaggcttggctctttgttttcctttctgcagaccttttgcctctttcggtccctttactagcctgtgtttgctaacttctcggtgacctggaggcaggttttctttaaagttttcgttacagaaagcaaggatcattttgggattgaagtgtgaccccagtttctgttgggaatgaagaagaaagcaagctgcttttcagttattaaagctgctggtggagaaaagagtcattatttatgccactgtgtaataatatgtgtttgtggaattaggaatttgttttcccactgtgttttcctatccttccaccttttgtgtacacctgcaccttgccaatcttaagagagaaatgttgcattcggtttgggttgaggcttagagtgttctataggacttggacaggatagtcagtttctcagagcactcactcatctgtactgccttctctgttttcagaggttaaggctccattctttctcgctttgcgtttctggcaagtgtagattcacatagtgatggtttagtggtagttttgtttcaccagtgttagccagctgaggaccaaggcaatattttcagtttctttcatacctgattcagcacttggtatactgtcactcagaaaattttacatacacacacacatatgctcatttttttttaaccctgaaaatctcttaataagtcttctccttgagtgactcccccctgacctctttttctgccccagaaacataaataattgttctttttcatctactgctgctttttttcatttaaataactccacatttatgttttcataggcccagaataaaggggaaatccatagagttgatttttcctgcttcccattgttcatatgggaacagtgttaaagcttccatttttatttgtgcgtttatctgaaatttggattggagcaaatttaacctttggggaacaggcacaggtagatgttagggaaatgatgttacggaaaaccaatgaaatttgatacatggaaattttttttcagggatgtcttcttacaagttggagcattagaggtgtttttctctctgttcaactgcctgggcactctgggtaaatgtactgtttacctgtggagaagaagatgaggcaaggacgtgtatactctaatgctttggaattacctttcatggtgaccctggggagaattagaggtcaggcagccgcttactccattcctgtttctatcttctaggctcccgagccagccgggaggacacttactacagctgctcagaagcaccactggaaactcaggtaataccggcactttgaattccttgtttcaggaaaatatctgggatgtcacagtggaaaaacagaacagaatgtaatatagaaagctcttttcagatccaaagaactggaacctggttggaagaaataggcagcaaagttcatgtgcactgaagtgttcagaccaaaaagttgctttataacaatggacaaaagcatttgtgaaaggtgacaataagagaaaagggaaagagaactttcttatgaatcatacagatacggggaaaaaaacaggcatgtttagaggaatggaaccagaatttcatggagtggtgcctggagcagacctacagtggagaaggagctattggtaaaagaaagcacaaagaaaaaagaaagggaatgaatagagaaggcaaattgaaggtgatcattgagaagaagccttttgagactagggaaccggaagtgtacgtaaggtcagaagaatttagaattttgttgttctttggtgaagaggagaaacaagttgacagcaaactagtttaatcactttcactatatagaggctgagttaaaatgtattatttcatgggtcaaagatgttaattttcataacctggttagggagcaaagtcttaaaaaaaaaaacaaaacacgagcagacctgagggttttggcacctaggtccttgaggtactgatgagatgaggcaaaggaggaagagagtttttagccaggcttgggatagcagtaggtgagatcataacccaaattaggctacagaaaggaagcaaggatgaggtcatatgttcaggaaagaaggtggcacattcatgtttggtagcaaaaggagaaacttaagaaaaagagccagcaggaggctgggcgctgtggctcacacccgtaatcccagcactttgggaggctgaggtgggcggatcacccaagggcaggcgttcgagactagcctggccaacatggtgaaaccccatctctactaaaaatacaaagttagccaggcgtggtggtgcatgcctgtagtcccagctgcttgggaggctgaggcaggagaattgcttgaacccgggaggcgaggttgcggtgagctgagattgcaccatgtactgtggccagggcaacaagagcaaaactccatgtgttttaaaaaaaaaaaaaaaaaaaaaaaaaagcaaaagagccagcaggaaagaccatgtgttcaaagccccctttgggaagaaggcagaaaagagacaaggtgcttatgagacacatgactaaccgtgaagctgttggtctccctgggcttgtggagcccacaggttatttgtgcattggtgaatgcgtgtccctgtagctctttgtgccttgtgatttccccgactgtttctctcatgtcccaggctggatgagttgggggtagcctccttgtctgcccctttctctttcctccttattttctaacagtcccctttgttacatcttcctccatggcacagttctttctatttcctttgtcttggctcatccctaggttacttttctttgcctctgatttgttccctaatagatgtgggcgccccagccagaagcagagaggggtacagggaagctacagagaagccccttctgatgccccagggagcaagtcgactccttccaggctccaggaacaccacaaagcaatatgaaacctgttcatgaaaggagtcaggaatgccttccaccaaagaaacgagacctccccgtgaccagcgaggatatggggagaactaccagctgctccactaaccacacaccctccagtgatgcttctgaatggtcccgaggggttgtggtggctgggcagagccaggcaggagccagagtcagcctggggggtgatggagctgaggccatcaccggtctgacagtggaccagtatggcatgctgtataaggtggctgtgccgcctgccaccttttcaccaactggactcccatctgtggtgaatatgagtcccttgcccccaacgtttaatgtagcgtcttcactaattcaacatccaggcatccactatcctccactccactatgctcagctcccatccacctcgctgcagttcattgggtctccttatagccttccctatgctgtgccacctaatttcctaccgagtcccctcctatctccttctgccaaccttgccacctctcaccttccacactttgtgccatatgcctcacttctggctgaaggagccactcctcccccacaggctccctccccggcccactcatttaacaaagctccctctgccacctccccatctgggcaattgccacatcattcaagtactcagccgctggaccttgctccaggtcggatgcccatttattatcagatgtccaggctacctgctgggtatactttgcatgaaacccctccagcaggtgccagcccagttcttacccctcaggagagccagtctgctctggaagcagctgctgcaaatggaggacagagaccacgagagcgaaatttagtaagacgggaaagtgaagcccttgactcccccaacagcaagggtgaaggccagggactggtgccagtggtagaatgtgtggtggatggacagttgttttcaggttctcagactccacgggtagaggtagcagcaccagcacaccgggggaccccggacactgaccttgaggtccagcgggtggttggcgctttagcttctcaggactatcgtgtggtggcagctcagaggaaggaggaacccagccccctcaacctatcccatcatacccccgaccatcagggtgaggggcgagggtcagccaggaaccctgcagagctggcagagaaaagtcaggcccgtgggttctaccctcagtcccatcaggaaccagtaaaacatagacctttacccaaagcaatggttgtagccaatggcaacctggtgcccactggaactgactcaggcctgctgcctgtgggctcggagatcctggtagcatcaagtctggacgtgcaggccagagccaccttcccagacaaggagccaacgccgccccccattacctcctctcacttgccttcccatttcatgaaaggcgccatcatccagctggctacgggagagctgaagcgggtggaggacctccagacccaggattttgtgcgcagtgccgaagtgagcggggggctgaagattgactctagcacggtcgtggacattcaggagagccaatggcctggatttgtcatgctgcattttgtggttggtgagcagcagagcaaagtgagcatcgaagtgccccccgagcaccccttctttgtatatggccagggttggtcctcttgcagccctgggcggacgacacaactcttctctctgccctgccatcggctacaggtgggagatgtctgcatctctatcagtttacagagcttgaacagtaactcagtttctcaggccagctgtgctcccccaagccagctgggtcccccccgagaaaggcctgagaggacggtcttgggatccagagagctatgtgacagtgaggggaagagccagccggcaggagagggctcccgtgtggtagagccttcccagcctgagtccggtgctcaggcctgctggccagccccgagcttccaaagatacagcatgcaaggggaggaggcacgggctgcgctgctccgtccctctttcattccacaggaggtaaagctgtccattgaagggcgttccaatgcgggaaaatgaacctcttccccagaccaggactggggctttaccccagagcctcgcctcgccgccgtgagcaggcagaggatttgcacacgccgagcagggaatggctttcttggcagtgagatttgggggaaaggggaggcatgaagtcagcctcccaaggcaggatctgttgttcattaccccatggcatcctttcaggacaaccccagagggtgttgtgatggggagcagcaggcctggggcaaggaaggaagggggtgcacacaggagaagaaacattccaaaatcagggcctccctgttctttcctccccatccctagctcctgcaagagaaagtccaggctttgggagcagatggcagagggagggagtaaagaaagagccaaaaatgatgatccacagcttatagtagcagttaaactgtcagaagttttttttcttttttgtggtagaagggcaggaggccccaaggttggaaataagagggttcccacccagaacccttcttgtgagagatgcgcactttaaagggtgattttgttccagatgtctatggctgggtgtgtgggggaggagcactctcatctgcaggactctgcttgatcctctgcttcatagcccttccccatctctcctcaccattctgcctacaaggcttctagcagcacgggggcccggagggagagccccttcagggttcagagtgaagtactaccttgccagggactcagtcaggggactttgggagaaagacttgatagccaggctgactgggttctaggcaggccctctggaaaggtagctcacctaacaaagctcctccatctcagcatgccagacccactttgaaatctcacagaatcttgctggtaatggtgactttagaactagtagaccctttttcccaggcactgaccccccacctttgtctgtgttgtgcccaagtgcctgcgccacccccaccctcctgctgcgctgaccgctgcatggtgtcgtgacctgggcctcatttgtagctgcactgcctttccttgtctgcaaagttggttttgtccactctgaccaagacctctagtttttggtgggtagggggtctctctggtttccccttcagctataatctctatttttaaaatctcaaaatcatgtcccctccacttccactgccaaacagcttggtgaagaaacaagaagggaactatgccctgggccagggcgaatgcgtggctgggcagtgcccatcatggcattttcacatgtcccatatgcccctcctgtcttattccactgcttctcccagcattctggtgcctccaagccatcccctcccaccaccagctctaagattctaggatagtcttgataacatttcagtacctgaatagatgtcattttgtgttggtatattcctctgcaaaaagtattttcaatcttggttgcattggcaccccccctaccccccaccaatgtcttaatcccacattttcttcacaacttttagcatcagctcagaccgtggggttccactgggtattgggaattaggctcccccactagctttcaggtgggtaagtttttttgtttgttttttgggggtctttagactcttgaaggcaactcagggtattgtccacgcagctctctggttagacttctcccaggctatgatcctggcatgtcctttataaggtatacttggattggccgagacctggcctggcatcaggagtccaaacctctgaggtctgatctctgctctgtcaaggactttcggcaagtctcgtgacctctggctctttcacttcctccccacctgccaaatggggataaataatcttacctacctcctggggggaggggaagttctgagaatggagtcattcttagtgttcaggtgctaaaggttgttctcctgggggaacagagtgactgaaactggcttgtttgctacaagccctaccctccactctttcattccttgaaagcagtttgcctggtcagtcagcttttgggggtccatcaaaggaggttgctgacctgaccgtgagtgcttcagtatctggtttgtgtcagaaccagacgccaactttgtactgcatttgggatcatatctttccccttctctgtcccccattctctgaatgctgctttctctggcttgtttcctacagtgggggcctgtggggttgagtcttgaggaatcccctcaaatgagaaggccttgggagaaggcctcatctctggctgtttcatgagcaactcattcctagagttcattgtttgcatgggtttctcacaagcgtccttcctcataggaaggctcatcaactgaatttagtgacatgtacacagtagatgctcaagcagtgtctgcaaggacacaagctgagctttctccttatggggcaaacctatgtctaaccagatacagaccaattagtttagatcaaatcaccttccacttgggctacttgtgactttccaacctggtaacttccactgaattctggaaagagaaattcttgaggaccctggcaagttgggccctgacctttctgttgctgtctcttgctggtgaagcaataccagcagttcctgtaataccacaatatcgttccatgcatatataacatattaatacttgattttgctgagctgcaaaggtatctgtcataaaatatggtccccaggaaaagaatctctgtgctctaaatctcggtcagagctgtggcctcccccttgcctttaacctctagtttagtcttttcctccaggcatgaaaaatatgactaacctgtggtgtgtccattcttccttataggaatttcctgagtttgcaggagacatgagagcagtttttagcgagtattttagtgggaagttgccaactttttaagaatgagcagttgacaagggccagagcctgtcccttgtcagcagtaggacatttccagctcttaggaatagaaaggaggactgctgactgtctggcgctgtataaaaatgtgtataccaatttgggaataggggaacccagtcatggatggataataagccaagtcttgaatcattcctatcaagattagtatacatgaggaagaggtggcatggggggaaggggctctgggagttcagagctgagtacttgtacctgagggagggcccccagccaatctgggctggtccttctatattcttggtcccagttggtcataacaccaagggctttgccctgcgctgctttgccactgctgctgtccgctcactgtcctgcctgctgtcctctacagctccctatccttccatgtctttggccatgtagattaagtgtaggcgtccggttcattcttacctgtgttaggccatgttattttatagcgaagtcatgttcgatagggatggtatgaaatgctgctggtgggctggtaaatccaaagggataaggcttcagtgctgttgggagccctctggctccaaatgtctgactatcttgagggagaaacaagcaggtttctactagtggtgtcttctgttgtattaacttctttcctttgtggtatcttgtatcctgttttaaaaactaaatgaagggaaccacattagggcccatgccagcatcccagtgaagttcgtccagctccagttaggtggattctggagttcggagagggtttaaagtttggctgaaatagcacctcaagtggggtttagttttatttttacctgcgggcatcatgggcgatttagggggaagcacaggatggtggtgtggtttaaacctgcagcaagcaggcatgttgaagagttgagtgatcacgctggagatgaagggttggacatggattgactgggaaaaggcctgggtccattggagtaaagataacctagtcgattgaattggccatgggaagttaggtcacagtcttataaacaaagtaaataggacagagactaagttttagggagacatcttggcctcctaggctaagtttactaaaccacactgaagctatagtaccttccagatgggcaaaagtgtacactacagttgaggagctgaaccttattaggttggatgtcgatcaggaacctgtttgccctttgctgggaagccttcactctccagctttcctggggtagggaaggtctcccacattatgcaataataaaataagcatctgggtctttgcagctgtcagttgctctttcaactctaggatccatctttggaccagaagcctggtctgtgcctaggatgacactggccccagagatgctagagtcgactgcactctctccttagctgcagaccatgcacagtgcctggggcggaaggaggagaggtgttgcggtttgccctgctgcctccccagcaggaacaatagtcataaatgcacttttcacactaaaggtttctttattagttctccagttaaacctagatccctccctggtagattgcgaactcaaagttttgtgatcccaaagccattccactgcaaatgcccagcagtgaagatggcctcaaattgggttcttgcctgcagtgtgtgtggcagcagcccatgtgcctttacctgttgtcaaacttgcaagcatttatttgtctttatgactgtcatggggactgaggttcttcagagaaagagtgtgagctgatgacacagtggttttacacccaccccctgggcagggagtttgcacgtagttgtgagctgtgagtggttagtgcattgctggtattgctgaaggcagggttgatccctcacttgactgatacttgcattcaagagaatctagattgtgttgggggagggactgactgtactcatggctaacttaaagtattaaaataaggctgtcccctacaaccttcttagtcacacaggatccctgtagccaaaacagtatatgatccagctgcagagagcagactgctctcagcttgcacagcaccttaggcgagggaagaatatacggatagggaatggggtggagaaaggatgggaatgttgtcatccaggtggctttagggtcctaaggagtggagaaggatggcactggggaggtctggatggatctgtgtaggagttccctgtagataaattactgatcccccatctactatccccagtatgtaatggctgaattaatatgtaatcaactgcattgtatctaaagccttagaactagtcaggtgctccctccacccaataccatttcttaccctctaatcctacctgatctttaacaaagcattaataattctaaggataatctctattttgttgtgcttttttgtaactgttttaaataaatcaatttgtactgtatatttgtacttttgtgagatcctttttgctgttttaccattttaagtctctgtacttggctacacacagattgtatttttattgttaatgctcttcttatggatacctgcatttaacttgtggactatgtaaacacaatatctatcaatatctatatatctatatatctatctatataaactactagcttttccttttggtgtttgcgccttcttcctatcccagccttagatggtggccatggggtgggggatagaaacctttgtgggagcagttgtaatggaacacaaatggtggctttatttgtgcggtgagctcaagggagatggcatgagcttgtcctcaagcatggtctttcccctctgttggtgtggatttcagagacccggaagtctacctgaacacttagattctagtggaatcacaaggatctgtaggtgccttcgctgctggccttctccccaattctttactcaggaatactgccagaaattgctggaataagtcagccccaatcatagctactgcctaaaatttagaaagcttgccactagtaatggcatttatggaacacttattatgggctacaaaatatcctaagtgctttgtatgtacggacaagctttttttgctagtattatttccattttgtggatggggaagccaagacatagaggttaagtaacctccccaaagttacacagctagtgtggcagggcacttctgaacccagaggtgcaactcttgagtttgtatgaattcagagtttcttgtgaagattgagatcatctatgtaaagcgcttagaatcatctgtggcacatggtgaggactcagtcattttaaagcatcccaagtaggactccagtatggagctctgggagaaaggcatttgggtcaattaagtaaattaaacagtttttgtttgtttttttttgttgttgtttttttttttttagatagagtctcactgtgttgacaggctggagtgcagtggcacaatctcagctcactgcaacttccacctcccgggttcaagtgattctcgtcttcggcctcccgagtagctgggattgattacaagcacgccaactaagtattttcttttaaatgtatttttcaaaacaaatattttagcctgcttggtgaaagtaccttagtttgttagctgggtgtggtggtgcacacctatagtcccagctacttgggaggctgaggcagggggatcacttgagtccaggagttagaggttatggtgagctatgatcttgtcactgtactccagcctaggtgacagagtgatatcctttctcaaaaaagcaaactccaggcagggttctacgtagctcgcgcctgtaatcccagcactttgggaggccaaggcaggggatcacctgaggtcaggagttcaagaccagcctggccaacatggcgaaaccctgtctctactaaaaatacaaaaagtagccgggtgtggtggcacgtgtctgtaacaccagctactcgggaggctgaggcagaattgcttgaactcgggaggcaggggttgcagtgagccaagatcacgtcattacactccagcctgggcaacagagcgagactccgtctcaaaaaacaaacaaaaaacaaaaaacaaaacccctagtttggcgggggtcagttgacactgttaaacagccttggacctatggaggtcagagaggaatccaagtttccctgttaagatattggaagaagtccgcattcctggcatagttatttttctggctacaatttaactagggcacttccttctggacctcaagatctataattatctaaactgaacacaacctttggtgcaggctaggaaggttctgtgcctgttctgtaccatcacagaaactttttagaaatgacctcagctcttgtctcctccatggtttggcagtcatacaacctgccagagtaatcattttgccctagccttaacctgagctctcttaccaccttaattctggattttcttcagtgagcttattttccttccttgcctctggtgaacaaataaaacacaaataaaatgcaaacatgagtttcttggtgctgtgcaccttaatattgcagctatttctatgagcctattcctagatgcagctgactactgtctagaattgtaaatgttcgacaatattgctgggaaaagttgcacacctagttgaaggtattgcatagtctttagaaaacagcagttatgagaagagacttcttctgagtttggaaaaggtaagctaggtttaaacagcccttgggaccacaggtatcttcattatggttgtgggaataatcatcacagtcaacatcggttctttcttcggtgtcatgctaattcctcggcaacttgtaaaggcccaaataaggacctctgcttggacagcctaagctgaggagcatcctccctaagaaaacggcaagccaccagaagccactgtctgaaaatttccacccaggtttctcctagatcacttcatttgctagaatgacattgagagaaaagcaagaaaggggcagtaaagataaaattaatttatttgacttcacaacttcatgggccacacaggggccccacagtcctagaagcacagcctgtggcagtgggctggggaggccagttctctggactgcctgctcccttgtccagagctgccttgagccaggtccctcctgaccccatcatcctgttcccatatgcaagggctgctcaggtccacctgcaataaacccaggcctgcctctggcagcaaggacagggcctcgtgggtggcagcagcactggtcctcgtggctgtgggtgtgggtgggtgggtaggtaggtgggaaggagggcaggcaggagggtgtggttcagtgcagagagctgctgttctgctcttcaaaggccatcttgcccagaagctggctgtccaactccaccccacttacaggcagctggaagaagttcatttcagctgctaaggctgccatggcagaagggtcctggccaaactgagctcgcaacatcatgtccattttctccagcctcctcttgagccgcttggcctctcgctctcggatgagccgggcctgccgcttttccggggtttcattggcccgcttcagcctcatggcctcccgatcccgctgcagccggcgtgcccgctgctcgtctgtctcctgcatgcgctgcaagcgcttggcttcacggtccctcatgcgcctcacctcccgctcctcgggggtctcattgtcccgccggctcttcttggccgtgcgctctcgttccagccgctgcagccgtacttccaaaggctcattctgtcgacgtagagcccacttgcgtacactgggagtctgggcttccagcagtttacggtaggcagcacagttgttgcacacaagcagaattccagcagggtacactggaggactaaaggcaatatccttcccctcagcactggagggaccctcattgtggactgtgggtagggattccatatttagtacttcaggaagtttctcactggaaaggaaacattttggatggttagtgtttccttctagcaagagtcgggactccagccctgccttattcttttcctatgaggccagtggctccacgctcaccacaaggggtcagtttgaatgcttggtggacctcttctgctgctccatcccttctcttcgcgtgagagttgtctaccaactttttttttttttttttgagacagagtcttgctctgtcgcccaggctggagtacaatggtgcaatctcagctcactgcaacctccgcctcctaggttcaagccattctcctgcctcagcctcctgagtagctgggattacaggcgcacgccaccacgcccggctaatttttgtatttttagtagagacggggtttcaccacattggtcaggctggtctcaaactcctgaccttgtgatccacccgcctcggcctcccaaagtgctgggattacaggcgtgagccactgtgcccggccgggtgtctaccaactctaaaagcccatctggagttaactgagccacctgccacagcaatgcaccagaaatcagacaaacccttggtgttttcactcaagccagaataatgattttgataagagctttgcaggggcagtcctgctgtgggaatggaggctcctggaggtggagacctccttcaggcaaggtgcagaccaccaactcacctccttccctcacactacctgcatgcaaaggcagactctgcactgtacactagacaaacgggacaaggacacaacgttccagtcttcctaggacacgatggagactgcatcctcatgccagggtcctctctaccctataacttctttctccatgctttatcatgagtgttcttggaattgcctacatctctttctagttgaagatattctgatgggaaaataaatgggaattcattttcctttggggctatgtgagggaataggcatatttcctagccttcttacttgtacttccaaggagcatgcatcagctgcctttgcattacctatttctagccttcgctttgacttcagaaagcagaactcacacccagtaatttgctcccagcacaacagggataagtgcccagctgacctgttaaaagtggcatggctggtgaaccgggctccacacacagcacagttagatcgctggtcctccgagtggattaagaggtggcgacccaatgaccccggggagctaagggcccggccacagacaggacacatgtagctcttggcgctcaccactgctgcagtgtgctgtaaaacagagccttgatctgtcagtcttgcgctacctccaggacaatctgcacccacttagaaatgacttttgggaaatgtcccctttctttagtctcagaataaggaacttccaagtattctgtttagcccctagaaaagtcagtctcttacattagaggccctggccatttagaccactgcttagatttcattagcttgagctctgcctacgttctgggacatgtggctgacttaaggaacagtgggagccaggcacagtggctcatgcctgtaatcccaacactttgggaggccgaggcaggtggatcacgaggtcaggagttcaagaccagcctggccaatatggtgaaaccccatctctactaaaaatacaaaaattagcctggtgtgggggcaggtgcctgtagtcccagctacttgggaagctgaggcaagagaatcacttgaacctgagaggtggagttcacagtgagccaagatcacaccactgcactccagcctaggtaatacagcgaaattctgtctcaaaaacaaaacaaaacaaaacaacaacaacagtggggcgccagagccctcttcagagcctaagaggaattc

SEQ ID NO: 56 - DNA, 150573 bp, Homo sapiens
ttcccggcaatgtcatattcaaaatattgggcatgttgctcaagcagtatttccattattggaattctccttttttcctttaaatcttagcctccctgcttgttaatatgttactttactcacaaaataggaagaaaaaaaaacactttagcctcttaagtttaacaaatattttaggggcagctatatacaagaccctgaagttgtcatttttctctctctcactaaaaagtgaagctaaaatgatcttttcttccagcagtggatttttttttttttttttttttttttttttagaaggaaagagatcaccaggtgccgggagactgaggtgggtagatcacgaggtcagaaggtcgaggccatcctggccaacacggtgaaaccccgtctccactaaaatacaaaaatttagccggggtggtggcacgcgcctgtagtcccagttactcaggaggctgaggcaggggaattgcttgaacttgggaggcagagattgtagtgagctgagatcacgccactgcactccagcctggcaaaggagcgagactcccatcaaaaaaaaaaaaaaagaaagaaagagagaaagagatcgagagagagaatgtgacctttacttgacttccaggatgttctttaagccaatgttttcaatatgggttgcaacccattactgggtcatgaagtcaatttactgtgtccagaccaacttttttttttttttttaaatggagggaaagagaacagacaagaacatgacaacagataagagaacacagagtccactgcacatgtaagagtaacaaggagtaagggtcaagtgctatttcataaaacttttgtttcagttatgtaagtatgtatatatgtggaatgtgttgttatataaaaattatttcttaccagtgggttaaaaaaggcagaaagccactgctgtggggcagtttgccactgaagacttgtctcattttttagaaaaaccaattctatggaggctgtatttgatcagacagatccctttttttccatgaaagaaaactgggtcttttactattgagcctatattgatggaaggcttccactgctggcttaactggctgtgtttttgagagggtctcttgggtaatgagtctattatctctcttcttttttggttttctgctttctactctttctacatggactctggaagccattctagttgttggaacaatggtagaagttcccacacaacgtagagacatccacaacatttggttttgtgattgttgtccaagtgttaagaaaactatggtttctgaagaaagtaagactttctaaccaatatgaaatatccaattatttccccccacttcagtgttagcccttatatcaggccttttaatataattacaaaattgctatttatttcagtgtgttgaatttttaaaaatcacccgaacccctaaacctgtctaagttaacgtggttagaattgagacaatggtagcagaacctttcgttctatttcatttctctagaagagactgcattgttgccttttcttcattctaaaatgaagacatctactttatgtatgcttagtactgttttgtcatttgtacttaataatttaagaaaattattctagaatgttctttaggccggtgtttttaatatggattgcaaccctttattgggtcatgaagtcaatttactgtgtacagaccaactttttttttttaaatggagggaaagacagtaggacaagaacatgagaatagaagagagtacagtgttcactgcacatataagagtaaggaggagtaagagtcaagtggtattttttgaaactttcagtggtttcatattttagtgttttttgtgtttcacttttttgttttatcacttaaagttacccaaatatgtaacttaatttgccagccattaagattcattccagtaggatcaatctagacatatgtaaacctgattgtattccaaagtaattgatcagtgtcaagaaatgtttattgagtgcctgttacttgcttggcaaacaggagggaggttccaaatgaagtactgtaagtaaaagatgaggctcctgcttttttttaaaaagggtttatctttcatttattcctttaaacatttatcaggcacttatttaatcagccgtatacagtgctagatcctctgctcaagtgtaattgggaaggtaaaacttaaatgaaacaacaaaaataattaattgccacatgcataatgatatgcattctaaattctgtaggagtttagggtagagagtgagcagagttggctggaataactggaggacagaggaggtagagtttctgaatcttgaggcactttcaggattcagatggaaaggatggagaatgttccagacaatggggagatcttgaaaaatgcttagaggcagggaataccacagagcatgaaagaggcatttctgaggttttatgctgaggaattgtgaaaaataatgttggatatgttggatggggccatatattttaagatgggtaattgtagagttacataaactaaaaaggtatccagtatcctgtggtgcatacagtctactttgggagaagggagggattataaataactaatgaagctatactgtatgtattatgatggaagctagtactgtgctagaagtattataagcaaaaagcttgaatggccatgtcagtggttacctttgagctatattagtactgctctggcttagggcttggcaacatcgctgactcagtgacaaacttcctttttggaagtcctggctcctcacttgccagcatatgacactcccagttcaccaggtcatcctgtcccgaactgcccagttaattgtgaagctataagacagtcctggccagggctcatctccaccgctagctggggatcccaccacatagctagacaggttcctgaatggacttctccttcaggaccagagcatggttgggggtctgtacatgtgcttgccttccaccctgggctcacgaattaatagtggaaatgtcttcaaagcaattattaaaagtaattattgctatgatttcacttttgattctccatttatttcacttctgtctgcttatttatttacctacttgatgtttgtggaggcatgtatcagtcagcttttgcagttatacaaccccaaaatctcagttgcttgtaacagtcacatatttgattattgcagctgaggattaactgtagcccttggtcagttttctctaatattcattcttccctgtttctccacccaggcttctgggtcagctagcttcagactgggttcagctgattagagaaactggcaggaaataatgcaagaggagaaagggagaaaccaagatatttctctttttcccttcttgccttgggtggcttctctagcagagactgtttctctctggctttagttctcactggacaggaccaccatggttcttgtccagtgactctatgtcttcagttcctataacaccatctcctccttttgtctgtccagctaaggggtggtagtggctccctgctgttgtcatctcttccttttgtctctccggcttaggggtggtagtggctccctgctgttgttaaaccttttaccatccccaatatggtttgcagcaatttaatgccttatatagccagttccctctattaaattccttctgttgtaaatacagtcatgcaccacataacaacattatagtgaatgatggatcatatataggatggttgtcccataagttgatgatgatgatgataatgatgatttttattattatttgagacggagtctcactctgttgctcaggctggagtgcagtggcacaatcttggctcactgcaacctccgcttcctgggcgcaagcaattctcctgcctcagcctcccgagtaactgggactacaggcatatgccacgacacccgactaattttttttgtatttttagtagagatggggtttcaccatgttggtcaggctggtctcgaactcctgacctcaagtgatcctcccgctttggcctcccaaagtgctgggattacaggtgtgagccaccatgcccggcccacataagattataatggagctaaaacatttctgttgcctagtgacatcataactattgtaatgttgtactacagttaccttattttttaaatataattttggtgtagcttaggtgtatagtgtttatagagtctacagtagtgtacagtaatgtcctaggccttcacattcactcatcactctctcattgattccttcagagcaacttccagtcctgtaagcgcctttcatggtaagtaccctatataggtataccatttttattttacttattttttgttattttttgagacggaatcttgctctgtcacccaggctggtatgcagtggcatgattttggctcactgcaacctccacctcccgggttcaagcgattctcctgcctcagcctcccaagtagctggtactacaggcacctgccaccatgcccggctaatttttgtatttttagtagagacggggtttcactgtattggccaggctggtctcgaactcctgacctcaggtgatccacttgcctcggccccaaagtgctgggattacaggcatgagccactgggcccagccaccattttttatcttttataccatgtttttactgtactttttctatgtttagatatgtttaaacacacaaatacttaccattgtgttacagttgcatacagtatttggtacagtagcatactatataagtttgtagcctaggagcaataaacaggctatactacgtagactaggtgtgtagtacatgctatgatgtttgcacaaagacgaaaccacctaaaaatgcattttccagaacgtctggttgttaagtgacacatgactatacttgaagacacacgactgtacttgtactggttgttaagtgacacgtgactgtacttggttgttaagtgacacatgactgtatttgatttctttttcctgactagaccctgactgatacactgttccaaaaaaggagtttttcttttgtctttatattgttttcttctatagtgcggcctcacatagaggaataaaaacaacccattttattatcccacaaaatgtctgctaatgaagcagtgtgatgtagtggacagagtattggatttggaatcactgtcacttatagcactgtggtgttgggtaagtcactcattctctccgtgtggagatacttatgattcctgttatacctacatcttcagggttgtctgtgatgatcaaaacaaggaaatgcttataaactatcaagctttattcaagtgatgcacggagcctcaatgatgttgtagaacagtctgccagctggccatattttattttatttatttttatcatttgtagttgtttccaacatagtttctttctcattataaactcagaattggaagatgcaactataattagatagagaaaagttatagaaaatattcatcccatgttggaagatatttatgtatatttaaaaggtattcttcaaatggccaagtacatttgaccactgataataccccaggtatccaaacttttttagttcttcctagtcttactgtagaaccaagatcatgtttcctggagcagcatgagtgtcacagtccctgtcacataggctaacatgggatggatttcaatcatatgagtggaaaattacctaattgccccatctccttaacatctcttattttgaaccttgccttgggagatagcttcattctgattcaaaacagacctacatagatggggtcttctctagtttgccaggatgatcagatctatttcagattaatctagaaataaggatttcataataaaatggctgtgctaagcatactcagaggctcaaagaactaattcctaatattcaggtccaccaagaatggaccaattttccttttgtgatcgcgacataatctggagttaggttcaactttaagggatgtattagaaacagattcctcccaagtcctccataatctgagctagtacctcctccagggtggactctaaagggtgattctcctgttagtgtcacttgagacacagaatcctcatctttagcccaacgaggggagatcagatatcagagatgggcagacatgggttgaaaccccagctctgccactttcttgttgtttgtacaagttacttaacctcttagagcagcaggttctttatcagtgaaatgagggttagggatggatatttcctatagttctacctggcacatagtaggtacacaataaatataatatcgtctttaacgtaatatcatcatgcttatcagacaaaggactttggagtcaggattcaaaactctgcagctgcactaccaaagtttgctgagcctcttagcctttgttaatgtaacttaaccgtgttggagtttttagtattaccattccttataaatatgtttgacaatttttatttttagctagtcatcaaagctcttacaagtcagaatttcagacttgaccaggactatagtttatttactggagtgctaggagagaatgcaaaagtgatggtatattgagtacttttaatttttattgctgtcatatattttaagccgaatttgtttctaaacaacatgaaaagttactattaacatttttgccatttgtgagagacaaatgccgcttgcttactctcagccttttgggtgataaatatatacttgcttctggaaatgacagcagacactttcatatcttaggaaatcatggttttgttagttcatcatctgttgttagttcctgctcctgaagagcaaaccttagaatattgtctttagcaaagacaccagtatggagtaggattttcacattatgaaattttaatgactattagcctaggagctccttgagactcataacttttcattgttgtattcctcagtgcctagcgtagtgtcaggctcatggaggtgcccactaattctttttcttttttcttgtttagctcattggcaagaagaatttaatatttttttccttctctgttttatttttttctttctgaaagagggtctcgctctgtcacccaggatggagtgcagtggcgtgatcatagctcactgtagcctcgacctcctgggctcaagcaatcatcccacctcggccccatcagtagctgcgactacaggtgcttgccaccatgcctggctcatttttgtattttctgtagagacgggattttgccatgttcccaggctggtcttgaactcctgggctcaagtgatcctcttgcctatgcctcccaaagtgctgggattacaggtgtgagccactgtgcccagccactaattctttgtcaaattaaatcttgaaatttgcccttgccttagtcaatctgattttcgctaaatttgccttcatttgactaaggtaaaccttattgtatctatcatgtgtggttgagcactctttagccatatctgttacatagctaaaatgaagcagcctccgtcagttttctgttctacaatttgataaatggattatactcacacgtaggataaggaattggttgtaaatcagataaggggccaaatctcccacttttctgacttcagtatcataatctccaaatatggacttcagccttcaactttgagtcctgcaaaggtatattacctatgcaaaatagattaaatatcagtttttcagaatgcacacatttttttctgctttcttctctcaccctcagaaattcatgccaagatctgccgtctatggttgtgatctgttcctaaaatggccagcgtcatttttcttcacacttctcattctgctgatagacaatttgaggttaaaaatacatagtcattgtgttttcacatttcttaacttctttgtgttacaggaaaggggttctgatccagaccccaagagagggttcttggatctcatgtaagaaagaattcagggcgggtctgcagtgcaaagtgaaagcaagtttattaagaaagtaaatgagtaaaagaatggctactccatagacagagctgccccaagggcagctggttgcccatttttatggtttttttttaaatgatattgctaaacaaggggtggattattcatgcctcccctttttaggccatatagggtaacttcttgacattgccatgacatttgtaaactgtcatggtgctggtgggagtgtagcagtgacaacgaccagaggtcactcttgtggccattttggttttggtggctttgggctggttcctttagggcaaactgttttatcagcaaggtctttatgagctttattttgtgctgacgtcctgtctcatcctgtgacttagaatgccttagctatctgggaatgcagcccagtgggtttcagccttattttacccagctcctgtttaagatggagttgctctggttcacacgcctctgacatttgcatccactgttgtatgtatttcctgacctaatgacaatgaggaccaaactgagaacaccaaaactgtgaccactagatacagaaatcctgccccaggcttgcctgaggacatctttgaaataacactgtgcctgtaaagttatctgtgagtgaatagttctgtttttgtttttcgtgttagtaacttagggttactgttagggtgctgcaaacgtacttttggatcaggcagaaacggggtaaatgaagttaacattgtaaaatactaacttttcaattgcagaggttaatttacaagttgatgttcaattttgttttatttagttttggttgttttcctcaaccgttcatgtatggaaacattctggctctgtccacccaggaacccagaattcttcaccctctgaacccctggatttgtttttaaaataatctgtgcatacctgctgtttgttttgttcttaacttcattgtattatggggctttataaacagaaagatgagttaaaaatataacaaaacaaattgttcaccaaggctgcttttgccctttgtctgtgtgggaattcaccatgatcctcagctgagcagcttttaaaatccagtgagcaccctcttttcttttcttttttctcttttcctttcctttcctttcttttctttcttttctctttcctttcctttcttttcttccttttctctttccttttcttcctttcctttctcttcttccttttctctttccttttcttcctttcctttctctttcacagggtctcactttgtcacccacgctggagcgtagtcacccaggttggagacacaaacatggctcactgcagcttcgacctcctaggctcaagcaattctcccaccttagcctcctaagtagttgggactacaggcacacaccaccacacccagctaattgttttatttttttgtagagtagggtctcctttgtggcccaagctggtctcaaactcctgggctcaagcgatcctcctgccttggtctcccaaagtgctgggattataggtgtgagctaccgaaccctgccccagtgagctcactttattaaaacttgtactgctgccctctcctgttttacagctgattagattaattgaatgtggctaataaattatgatatggcaaactcagaattatctgtgttaattagggacagggatagcctggaaaaatgaattctgcaaatgatgcctttcctcctggatttgtttctgcagatggtcataaaacacagcatgtgaaagcaagttcatgtcttgatccctttctttgtttcccacatgctgtcttgcaggtgacaagaaataaactggaactgcagtattagagaaagaggaacatatttgtctgggctctttggtggataatgattgcagtccccaattcacactagctctttcagatggagtgtgtgaattagttgtttggtgccctttttttgtgctttttttcccatagaaacaagattatactaaatgctaagattttgcaagggcagcccctaaaagcttctttaattcagaatttgaagtatacttacagtgagtactattttcgctattgtatgtataatattttcttcagaatttatcaatgcaaaaataatgagtaagtgaaaactttagtttgtaattttgaaaatcatctcacattaatatacttagcctaacatagctatataattgttttacatgttgctttccatatgtacatgtattttctacatggttgcagacagtgcattttatattttgccacgtttataacatgataacataaatattttcgagatctctatataaccttggtaacaatcaaggatcacttttaatagcttcaaaatattccttcatggtaaataagacacaaagccttcagtggctaccccagcattgggaaataaggggtgggggagaggaggaaagctattttccaggaagtatttctatgcatgcctaagagaagacatatcttttggttgctcactcccaggtattctgctatagaaataaaggtcattgcccttcggggctcaagttcaggctagagatttccaaatgagtcttcggtatcttatgtgtcagtcatttggggtgactgcctgatgatgacctgtttaaaaagcatcttgtaactttgaaaaatattcctgaggaagataggtgctcacagacattcagtgatccttaatgtatttctccagtatttgaaaagaaggcatggtggctcacgcctgtaatcccagcactttgggagaccaaggcgggcagattgcctgaggtcaggagttcaagccattctggccaacatggtgaaaccatgtctcaactaaaaatccaaaaattagccaggcttggtggcacgtgcctgtaattccagctactcaggaggctgaggcacaagaatctcttgaaccctgggggcagaggttgcagtgagccgagattgcaccacggcactccagcctaggtgacagagcaagacgctgtttcaaaaaaaaaaaaaaaaaaaaaaaaaaaaaagaagccaaaccaaggaagtaatagaggacagaatcttttggcaccctataaagttagtagagtgtctttattttaaggtgaatggctacatatatagatgagtgtaattggccatgaaggttatagagtgttgtcaccttcaaacttttgtatcatagaggattgtgcttacaaatcaggaggatgtagtcactggtagtttttcattattgattgggaaaaatatgccatttgtgccaaaatgttgattttttttttactcatcctcttacctgcattactctgttggttgtaactttactcatcagcaatagcttattataattatccttccatcacactggctacagtgagctgtaagtgctgcttaattttcatacacttttgtggcattgatgttggttttgatcaagaaaaggctcttgttaactagattcagaacgctggaagtttgcagttatgtttgtttattttataatctcttaccacttttgttgttgttgttgctgagacagagtcttgctcttgtcgcccaggctggagtgcagtggcttgatctcggctcactgcaacctccgcctcccgggttcgaggaattctcctgcctcagcctccctggtagctgggattacaggcgcccaccaccacacctggctaatttttgtatttttagtagagacacggtttcgccacgttggccaagctgttttcgaactcctgacctcaggtgatccgcccgcctggacttcccaaaatgctgggattacaggcgtgagccaccacgcccggcctgttatcactttttatttagagaaaagtcagtgggataagaggatgagagaaggcagaggcaggcctgcaggagagagtatgattttactacttattattattattattttagagacagggccttgctctgtttcccaggtgggagtgcagtggcacaatcatagctcactgtagccttgaactcctaggctcaaatgatcctcctgcctctgtctcccgagtagctaggactacaggcatgtgccaccatgcccagctaatttttaatttaatttaatttaatttgtagagatgggctctcactatgttgcccaggctgggagagtatgactttaggtttttctctactgcctctagtaatttggtaaagacccttcctcctcccctctctactaaaatgtttatttgtattaattgggtgggaaaattaccaaattttacagttcataccaatataagctgaaatatttctgaacaaagtgacttgggaattttcctggaaagtaaaaatatgtatacagctaaagtttgttttaaccctggttattatctgatacattacatggatagcattctttttaattttttctttttaagaattcattctaaaagggaaaagagatatcatttgtttttagttagttgtactatgtagtgttattacttagttctattagtttatttttttagctttcatttacctctaaatgaatggaaaatacgatacatggtcaatacttggaaagagccaaataatcagtttcactgcatttttggtgcaacatcattggaatgtagttgtaattttttccagtgataattccagtgatttggcaatatggtcttcccatagcaatagcgccttagtacctaaaatcagggatttgcgtgttttttgtttttttttttaacttcagtttttgaatgtcttcagagtattcacctcacccttaaatgaaacagatctgactcagttgtcagaattcaaacaaggaaattctaggtttaggaaataatagaggttcatactcgaggggttttcctgctacaaaggtacactttatcagaaacaatggatgcagcaagagagacgcaactggttttgttttggagcagtttggttcttgagataatgatgaattaatagtggggaaagaaatggaagctcagaggcattctgaactttcattctttaagaaaggttagttcaccagttagcccctttatgaaaagagactttattgaaggtacaacatctgttcactgagaatctctaaaatccacattttgacatcttcgagcttattgctacttctagattgagtaacacttgaaacacatttccttttcaaagtgcaagatttgcaaaagagacttgtcatgaagtcttttggcctggcttaaatggtgagctgaatgctggataatctctgctggctccttaatcagatttaaaattctcagtgtttcctaattgtttctgcatactttacctgagttgtagctgtattattacactttatttgctatttttgtctttcttgacttttggtagttctagcatttagaaaccttttatttatgattcaacacatagttatattttagtagttatcatttgatatatagttatttattttgctcatttatttcccagagatatattaagggttaattagatcattatattttaaccttacaaattaaagcccttcgagactcaaatagagacattgtttaaaactattcttaattgtactatttgtatatctataatgcatgtttatggctcaaagagaaattagtaaattcttcctaatttctgaaattagtttatgagtttgttatattttgttggtatgattagatcttatgggtacagctgtcatatgaagaatgccaagaattgaatttaatttagtaacaaatagaaaattctgaaacagtgtaaagccgttcagcttttttagcaggaagtggtaatgtgtgtcactgttgacatatataaatgccatttaatttgccacttcctattcataggatggaagaaccaaacacgtcagaaaattctagtccatcttcttagtttatcaggtttttttttaagggcaagttatatttgctgaccatttgtcccccttaaaaaatgccccgttttcctctgttgggttgaacaaagctaaaataaacgtatttggctgccagtgatcatttcacactgttgttaaatgttttctaaacttacttttattgtgtttttcctcctaaactttagacttcctaattttcaaacaagaaaacaattttaatataaataaacaaaaatttaaatagttataaatatatccagcaaaataacttatacttggtgaaaatagctttataacttatgcgacgtatatttatgaaagaacaatgccttgacctcttttttttcaatctaagtagcattctttttttttttcttttttgttgagaatagtctcatggcatgccagggctggggagtggtggcgcaatgatcatagctcactgcagcctttaactcctggcctcaagctatccgctcacttcagcctcccaggtagctaggaccacaggcacgtgccaccacatccagctaatttttaatttttttttttttagaggtggggtctcatcatgttgcccaggctggtctccaactcctggcctcaagtgatcctcccacctcagcctccctaaatgctgggattacaggcattagccactgttcccagtctcaatctaagtaacattcttgatttatttctacctttacattttctccaagtcctttattttgagaaaaaaatattttaaagcttcagtttatgactcattttttatttcagtagtccatttttctaattagagatttcaactaattatcctaaaatcagctactctaaaatttcattaatctaaattcaaaccaaaaaaagcataagcaaaatttgattgtcaaagaaagtttcaaaactggcaagaactgtatctttattgttaatcaaaatcttaaggaggtgaatgtagcatttctttaaagtagacttcaatatttgggaaactatttttctatttctggaagatctctgaaatgtaaatatacaaaccacataacccatattcagatagcctgggatcacgtgtttccaaatgtacttttgaaacaaagtcctgtttttttttcctttttaactgtaaaagcacagtatttaacttctgcttcttaaagtgggtcaaaggggatagataacctttgtagaaaaatgtgcagtgctgtgagtaaacccagcattgaaatcttgcattgttatgattcattgaaaggctgaatgacccagaagtctgaattttttttcaaggttctcatgactgcagccaaattagtcttttaaaagaaattcagtgggaacgaggtatagaaaaccttagttgaaggtccctgatgtttttctacccctgatttttctggaccaggcagcagacttccccaggagacccaagatagtactcaaagcaggagagctgtgtgtgttctaagctgcagcacccaccggccaaaatgcatcaagtcacagcttatgctgaaggtcaggagaactagttggccctagagagagagttccgaaggccaagaaaactactctttcccacactccagcaatggtatcctttcacccattcacaaacgcaggggcaacctccctattctcttgaaacagaaaagattatgttattaatatctgttgactgactaatttaactttagtgtaaaagagtcttgtcaatctgtccctttaccatgttcaattatatctaatttgtggaatgaaaagtggcccagtactgctcattccaagttccttttccctgttagatctgttaactatggacttgggccaggttgaaagtttccttctttctgttttgctggccaagcccttcccctcagctgcctccagcgacatcactggttgctgagaaatatctggtaagcagtactctgggtaagagcttgctccttacccctcactggtgccacgtggtgaggtatctgcgagctctgatgccctgtgggttgcgctggacaatgcagaaacctcaaataccaccctgccttctcctcagaggtgcaggaaagagcctcctggcccaaacctcccaccccaagggtggggcagtggctgtccgccttctcccattgaatggaaaatcagaactcctttgttcttcctgccagagtgccactcccaacagtgacccaaatgtgtattcttcacttgtccttggtccaagtcaaaactccttttcctcgaggtggagaagaaaagtccccaaaccccctgcttgaaatcagagtagctagcattccttgccaccccacttccctgctctgcccctcactttctgaacttgatccaatctgaacttgatccagtattagttacctggaaatctgacatgtgaaggcatgcattcattaatggtagtggaaaaatcaaccaaaatttcagagataaaatgtacccctagaagatttagtcagggaaaaagcaggcactaccataccatccttgttcgatataaagaaggactgtaagccattggtgaccaggcatggatggggtgggctaccaagggctcacaggacctctttatactgtattgaataagagcgatagagcctgcttttcccctgactaaatcttctaaggtaccgctcatctctaaaatttggtttggttttttactgccgttaatgaacatacctccatgtatgttttccaggttactaatatttgctttttaaaagaatttcaaaaacttttagacctattaaagtatagctaatataagacattctcatgtccatgtacccaccactcaattttagaaataataaattatagagtcaaagtcccctatgaatccctcctcttccatttctctctagaggtaacattgagtattatccttaatttgttaataatcattcctatccatgttttatactgtaattatacatggatatatatataaaaatatactatatatattttatatatatgaatgataatactgttgttttggcattttaaatatttttttcagaaatatacaaattggtttgactgtatatttctgcaacttgttcttttcacttaccatcatcttttttagattcatctatgttgataaatatggcttttgttcactgctcgagtattcctactctacttgtataccaaggcattctccagttggtggacgtttaagttgttgcctgtgttctatactatgacccttaaagaggaagtttccccaccaagatgtggatgttcttgtacgtctccctttgggaaggtctgatctttaaaagccaaaacttgattttaacctaacctttttttattggtcttcgtgaatctgcgtaaattgctgcatctctcttggcctcagttttcttagccacacagacaggactgaactaaatgatctctaaagtacttctcaagtctataattctatgattctctttcatacttatttccctgcctccttatgttataagcaaccatttagcataagagtcaattcaggaaagcaaaatctgttagagagagtttctaaattcaaaatgaaaatgcctttgagtcattcccttgggaatgttttcttacagtttatatttcctactgtattgactagataaatattaataaggaaagtgggactactttaaaaccatcaaaaaatgagtgttgaggtatatttgagcaacatggaaatacctttggaatcttgccttctaaactcagatgttggattgtgtttccagctgggtgggctgcatgcctcctggtgggtcatggactgctcatgagtcaggatgactcagggtcatcattttgaacatgaattattatattatgtgctgccaaaaaatgatgttctcaaaaagacttttgaaatacaaaaagtcttttaaaaaaaaattgtgggtacatagtagatgtatatatttatgggttacatgagatattttgatacaggcatgcaatgagtaataataatcacatcagggtaaatggagtatccatcacctcaagcatttttatcctttgtgttacaaacagtccaattatacttgtagttattttaaaatgtataattaaattatttttgattatagtcacctattgtcctagcaaatactaggtcttattctaactattttttgtacccattaaccattaccactttcccctaccccccactacccttcccagcctaaccattcttctactctctatctccatgaattcaatcattttaatttttagctcccacaaataaattagaacatgcgaagtttgtctttctgtacctggcttatttcacttaatataatgacctccagttccatccatgttgatgcaaatgacaggatctcattctttttatggctgaatagtactccattgtgtatatgtaccacattttctttgtccattcatctgttgatggatgcttagattgcttccaaatcttggctattgtgaatagtgctgcaataaacatgggagtgcagttatttctttgacatactcatttccttccttttggagcaggattgctgggtcatatgatagctctatatttgattttgtgaggagacttcaaactgttctccatagtggctgtactaatttgcattcccacccacagtgtgcaagggttcccttttctccacatccctgccagtgtttgttattgcctatcttttggataaaagccgttttaaatggggtgagatgatatctcattgtagttttcatttgcatttctctgatgatcactgatgttgaacaccttttcatgtatctgtttgccatttgtatgtcttttgaaaaatgtctgcttaggtcttctgctcattttaaaatcagattataagattttttcctgtagagctgtttgagctccttatatattctgattattaatagcttgtcagatgggtagtttgcaaatattttttcccattctgtgtgttgtctcttcactttgctcattgtttcctttgctgtacagaagctttttaacttgatgtgatcctgtttgttcatttttgcattggttgactgtgcttgcagggtattactgtagaaatatttgcccaatccaatgtcctggagagtttccccaatgttttcttttagtagtttcatagtttgaagtcttaggtttaagtctttaatccattttgatttgatttttgtatatggcaagaggtgggggtctagtttcattcttcggcatacagatacccagttttcccagcaccatttattgaagagactgtcctttcccccaatgtatgtacttggcacctttgtcaaaatgagttcactgtagatatatagatttatctctgggttctctgttctgttccactggtatatgtgtctatttttatgctagtaccatgccattttggttaccatagctctgtagtataatttaaacaaagggctttttgacctgaaggataatgtccttcaaaaactatgttttttgagattgtatagtccttttaaattaaaaaaaaaaaaaagttgctcccttactgccaggatgacctctggttcttgctgctgttggtgtgatagccccctccttctttctagtctccagtcatctggggctaggggataagccaagtctttggagttgtgggctggaggactctcctagcagctgtggtcacagttcagcacagagatgttgtggcagctacttgggctgctcattgtcccctttttctttcttattttctagttcttagctgaacactacatgaaattgccttcagagaagtactacagtttctcattaaatgtaataacattcatgacaggatagtagtgcagctctttcatatagatatgagtatacagtttgtcctttcatatagctatgaatataaaattttattaatgagataggtttgagtattatatagaggatatataataggtatataatatagaggatattatgatttttctcaatagcctttctattctatttttagcagcctatggattctaggagtgacccagctccagggataggacttgattaatctaaatttagagaatggatttagattaatccaatcttggtaattccccgtggcagtgattagttcaggaattcagccttagcctgccagaacatgacattcccatggttataagtccagaaatgagacatgaaggaaaacttgttggaggctttggggaaatgctttctcacttttgagaggaagaggaaaataatctcttttcttctggtattgctgttgtggtcaggaactgctatcagtcaagagtgtgaaattgatactccctggagggcagaacccagggaggtgcagagaaatgagctggagccctagattgagccatctctgaaccccattcaccactggacttgttgtagatgagtcaacaaattgccttaagctagtttgatttggggtttctgctatttgcagctgaaagcatcctgattatattatcattttacagctaattattcttttaatccctggagtagcatcaggaaattatctttgctttaaattttaacatgaatgttaatccactactgatattattgtcaagctaattgtaatgtgtcttcattttcttattggaataagatttctcagcatcctgactattgtaactataatatattaagaaatttccgaagttttttttttttttttttttgagacagagtctcactctgttgcccaggctggaatgcagtggtgcaatctcggctcactgcaacctctacctcctgggttcaagtgattcattttcctgccttagcctccccgctagctgggattacaggcacccaccaccacacccagctaatttttttagtagagtaggggttttgccatgttggccaggctggccaactcctgacctcaggtgatctgcctgccttggcctcccaaagtgctgggattacaggcgtgagccaccgcacctggccaaatttccaaagtttttaaagccatctttacccttagtagtatataatatttacttaaatatgtaagagtacctaccctttaatttagttactgtacacatgtttctgtgcacaacttaactggcaaagagaggatggagtcttcgcatgatctgagagcaattgcagggcactatgttaataaaacccaataacacaggattaaatcactgtgcaaaaaccaggctttgaggcagagctgaggagagaagagagggaactacatgggtggaatggcatcctcagagaaggctgcaaagtgaggtggtcatgcaggagtgcaggaaaggaggtatggggcccactgagagaagcaaaaggcctcatttggagaaactctgaggtttgcagtgtcaggagaatggtgcatctggtgggaaaggctgtatcaccaggctgaagaagttggctccacggcttcttaaatagtgcagtgacattaccacagggattgttgcaagttagtctagaagtgacatgtaggggaattagaccagggagagatgttggcacagtatcctggaaagctattacaaataatccatgcatgaagtgacaagagctgtagggttatagactgaatgtgtaatctcttaggtttatatggaatttcagagttcccagagcacgttcacacacatcgtctaatttatctaattagatcctgtcaacctttttttatggatgaggatatataggttcagagcagtcaagcagcctgttcacaagtttttagtgacagttcagtcattaaactgaactaacctacagttcagtgcttttcaatgaatttttacctcttgtagtgaaattcttacttactaaaactgttgcctattttctaggtccccacttgcttttttttttccatatggtgctaatttgactttgttctgcagccgttgtctgtcagttggcccttgacaacagcataagcaaaagctaaatgccatagttcacagctcttagaaactttgaaaacctttgagtagtgaaaagatggctaagtgtcaccatcttgtagaacttcctcacataactgaaaggtaatgttcctaacaaaaaaaaaaaaaaaaaagcctctgtcagtagaaggtttttgaagtgttttaaatgaatggagagtgaggctttaaggagcctcaaattggcattattgagtgaaggtggtaaagttgcccatgacttctaattacaggcaaaatcaaccttaataagaacaggcgttactactttaataagccagaataaggaaaatattaatctgaacaaatattctggtatacatcgtcgtttatttaaaacgtgaatgaaggttgggcaggctagctcacacctgtaatcccagcactttgagaggctaaggcaggtggatcacatgaggccaggaatttgagaccagcctggtcaacatggtgaaaccccatctctactgaaaataccaaagttaactgggtgtagtggagcacactgtaatcccagctagtcgcgaggctgaggcaggaggcaggagaatcgcttgaacccaagaggcgaaggttgcggtgagccaagatcgcgccactgcactccagcctgcacaacagaaggagacccatctcaaaaaaaataagtgaatgaattattaagtggtaaaatgttggacattggccttttaattaatttattcaggtatacagtaggcattttgaaagtcattgttttttttattttggtaaaaacataatatgtaagttacagtcttaaccatttttcagtgtacagttcagtagttttacaagcctgttcacactgtggtgcaactgatccgtagaactatttcatcttgcaaatctgacactccatacctattaaacaactattcctttccccctccttccagatcctggtaactaccattgtactactttctgtttctatggatttggaaagtcatgaatttttttaaaatgttaatctgaagaaacatgtattgagtacataccaggttttgggcattgttcttgatgccaggcccaaagagaggtaaaggatagaggaggattcctagagggtctttgttacactggatttggtggcatataaaacgtaaatcacaataaaaatcaatgtctattaagtcttaaatgagtgatggaaacagtatattttgtcagatgctagcagtaatatttatgctgagttgctgagttttgtgtcacctttacagaccctgaaatgctgagggaggtgccttagaggagaaaatatgagccagataacttgggaatagtggttatcagattgcattaggttgctgcaaaagtaattgcggtttttgccattcttaatggcaattacttttgcagcaacctaatatttattaataatttatggttgttagtgaggggaaataatggttgagaaggtgttctgctaaattagcttgggtgtgattgttgcctatttcaagacacaagagtatctaaaaaggctccgtgggggaaaagtaccacacagagaaaaaaggaggaaattcggttggtttatgtctatgcattgtataaagctggagctaggaagcagccttttgggtgctttcaatgtttatatgaaaaaatactgtagtaacatagcagttgaatgctccccacctaaataaaactggagttggctgggtggctcacgcctataatcctaacactttgggaggccgaggcgggtggatcacgaggtcggtcaggagattgagaccaccctggccaacatggtgaaaccccgtctccactaaaaatacaaaaaattatctgggcgtgatggtgcatacctgtagtcccagctactcgggaggctgaggcgggagaatcacttgaacctgggaggtggaggttgcagtgagctgagattgctccactgcactccagcctggtgacagagtgagactctgtctcaaaaaacaaaacaaaacaaaactggagttaatgtttaagtcaatttagaggatatgtaatttacgtgttttcctgaaatttcttggaaaccactttaaggggttctatatagcagtggtccccaacctttttgtcaccagggactggtttcatggaagacagtttttcctccagggactggaggtggtggtggtgtgggggtgggggtggtttaggaatgattcaagcacattacatttattatgcacttatattctatttttattacattgtaatatataatgaaattattatacaactcaccaatgtagaatcagcgggagctgtgagcatgttttcctgcaacaagatggtcctatctggggatgatagaagacagtgacagatcatcaggcattagattctcataggagtgcacaacctagatcccccacatgggcagttcacaatagggtttgagcacctatgagaatctaatgccactgctgatctgacaggaggctgaacttaggcagcaatgcaagtaatggggagcagctgtaaatatagatgaagcttctctcacttgcctgccactgaattcctgctgtgcagcccagtactggtctgtggcccagggattgagaaaccctgctggacagaatgcaaaagaatagaaaaatctaaacaaagctgagtagccagatgatgacgatttagcaaattgcaactaagttgtattcactaactggtctcctcagaaagcttattcctgatatatgatagagcttgctgatatttgtcaagggctttgtggttctttgtctttgaaattgataaataagttttgagctaccatagtggggggaaatacgtgagggaagggttgaacttttgaagtgcccgaggccttcaaaaggcatagccctttgaaagccaaaacttttggcttcaggttagaatcatctgggaaactttaaaaattaccagtgcccaggtcccatccttgactaattaagtcacaatctcagaatttggggaagggggcaggcctaatcatgaggattttttttttcaacatttctcagtcatcttagtccattttctgctgctatgacagaatacctgaaactgcatagtttataatgaacagaaatttatttagctcatggttctggaggctgggaactccaagggtatggcatcagcatctggtgaggaccttcatgcttcattatctcatgctggaagactggaaggggaagtgcactcatgcagaagaaaatgtaggaggagcaggactaacttttataaaaacccactctcaagataactaactcactcctgtgataaggacaatccgttcatacaggctccacatgaatcagctgtgaaaggtcccacctcttagtacttagtatctctaaggtcccacaatggcaatctaatttcaacctgagttttggaggggactttcagatcatagtaccaggcaattctagagtacagtcaggcctgaaatccattcttcctgtttcagctctagcaagtaatctgtggggaacatttattaaaatgtgtataaaatacttgctaactgtttaaaatagatatgcaggctttccctcccttactgtcaaataggcaaattttttttccttagtcagttgcagaatctgaagaaaaaagtggaaggagatggaggaatattctttaaagaggtcccatagccttcttttgggaaggattggggttgaggagtagataggaagcattgtttatatgtacttcaggaagtaggaaatatggcatgttctcaatctatctaaattatataactttgcaggatgtgatccatttgtgtcagaataatgaggcatataatacgttgcatttaacacgtgtgggaattctttgctgagtaattagcattcctttctccagcctgtattcagaggaaacataccattcacaccctctctgtgttcacattttccagtgcgttggagagctttttttcaatagaaatctttgtcctcctaatgagacttggattatatctgaagaaacttaacatatctttctttgtttttctggcaggaattgattttaaaattagaacgatagaactagatggaaagaaaattaagcttcagatatggtaagtaaacacacacacagagtttctgctttaattgggaattgaaagtaggaattaaatgtgaattgtaataagttagaggcatcttgtgatagctaaaacatcttttctttatcggaaccaaggggaaataagtaagcactgggaatccttcaaaggtatcttcaccaagagttgggaaggtgagagagggtactaactgttgaagccagaagagatctgatagctcatctttccaaaactataatttttgaggggaggaaactaaattctaaggaacgcaaattacttcttcatcacagttgttgtagttttgaaatctgataagacagagtagtcacgtcgcaggaacccttggcaggaagtacagatctaggttctagccaggatgcctccaaattgagggctttgggccagttatttcccttctcagggtctcaccttttcctcgtttgtaaattggttggattgatggcattggagttcccctccagctatgatattttatgatttatttgcatatttcttattaaatagaaaaatgaagactgagaaaaaaaatcatgtcatagttcagactgctctaagatatttttaccacactttttttctcatacatagcacagtacttctgacaccagatgtcagggggttccccccaccaccaccaggtaattctccagcagatgccaattgggtgtcctataccttttttttaattctttttttaattttctttttctttctgggtgtcctataatttaagtcagttctgatactgtctacctggagatagcatcagatcccacaggttgagggctgggtcccgcagtgtccccacttcagctgccagtcacaagtacaggttaaatatcccttatccaaaatgcttgggaacagaagtgtttccgattttggatattcttggattttggaatatgtgcatatacataatgagatatcttggggatgggacccaagtctaaacacgaaattcatttatgtttcatatacagctggtacacatgaagctgaatataactttatacaatattttaataaattttttttttgagacagagtttcgctcttgttgcccaagctgtggtgcaatggtgtgagctcggctcactgcaacctccacctcccgggttcaagcgattctcctgcctcagcttcctgagtagctgggattacaggcatgcgctaccacgccctgctatttttttgtattttcagtagaaacggggtttctccatgttagccagctggtcttgaactcctgacctcaggtaatccgcccgcctcagcctcccaaagtgctgggattacaggcgtgagccactgcacccggccaataaaattttttaaataaactgtgttgtatgtctacattttgactgtgacccgtcacgtgagctcagttgtgtaatattctactatggcatcatgttggcactcaaaaagttttggatttgggagcattttagattttggattttcagattagggatactcaactgtagtaggttgtcacctctacttctgaccaactggctataaattggggttctgatgacccccctcctctgattcctttaatttactagagcagctcacagaactcagggaaacactttatttatgtttacccatttattataaaggatattgcaaagaatacagatgaacagccagatggaagagatacacagggcaagccatgtgggaaggagtgaggaacttccacacttccttccttgtgggaggggtcatctactctccaagaacatccagcacctccacgtgtctcactctcctgaagctctccaaacccagtcctttgagtttttatggaagcttccttatatagccatgattgattgcatcgtgggccattggtgattaagtcaacctttagcccctctcccttctccagaggtcgaatggtaggactgaaagttccagcccgcttatcacttggttggttctcctggcaaccagcctcctatcctgtggctgaacaggagccccagccaccagttatttcattagcgcacaaaaagaacttaaacactttgttggagattccaagaattttagtatctgtgtgccaagaatcaggagcagagaccaaatatgtttcttattatatgtgttccttactgtatcacactatcacagctactataacaaaaataccatagactgggtgtcttaaacaataaacatttatttctcacagttctggaggctgggaaacccaagatcagggtgccagcagatacagtgtctagtgaaggtttgcttcctggtttgtagacagctgtctcacttgtatcctcacatggcccagagagagatcatctctatggtgtgaagagcactaatccctttcacaacggctccaccctcatgacctaattacctcccaaagttcccctatctaaataccatcacattgaggattaggcttcaacatataaatgttggaggaacacaaactattagtccttaggatgtttcccaactctgatgttgcaatatgcaaggcaaagatcttatgattacccaactctggttcataaactcctgaagaatctgtccaactacagtgaataaatatggttcctccagattgctaggttgaatatttttgacttgaactcagaagctcttcttagattttttttaacctcctagaagctggtttaatttctttcagttcagtgccttgcatggagccatatagatttggagcttttggaaggttgttggtgatgtttgctgatctaatgtgtattgatgacagcagtagacaaaacgtagaattcagagcagcactggctaagaacgaggcagggctaaagagtaaagttatacatattagctgttgccttaggctgtatttcttttttgaactcagaactgggacagaagaagaatatcccccagctcttcttttatagagaaggaaacagggactgagagtggttaggtccactcgagggcatatgtgatgaagctgggataactactcaactgccctggaacatagtgattggcttcctagtggtttccagtgtacttcactggaaaatgttatgaaggttactataggctgccctttccatccattggtattgaacaagatgccaaatattttacagatttaaaaaattacatcttttctcatgatcccctccttgggtttctcagagaaatatggttagtctgctaaaaagtgcttgccttccatttccccatgatttgttagcggtgcagcaaacaagtgccccatgcatctaatgccgatcaaagaaaatgacaggataagatggcttttttgtaaggcctggcccagagctgaacagctgagacctaagatgcttgtctccttcaagagtatgagctgggccgggtgcagtggctcacgcctgtaatgccagcacgttgggaggccgaggcgggtagatcacaaggtcaggagtttgagaccagcctggttaatatggtgaaaccccatctctattaaaaatacaaaaattagcctggcgtggtggtgggcttctgtagtcccagctacttgggaggctgaggcaggagaatcgcttgaacccaggaggcagaggttgcagtgagccaggattgtgccactggaccccagcctgggtgacagagcgagactccatctcaaaaacaaacaaacaaataaataaatacataaagaatatgagctgtttagtggcacagctggggccatagttcctctgagcctgtttcctcatctgcagaacttggatgctggtaacacccccagccagtagcccaccctaatgggctgtggtagacatcacgtgagtgcagtgtgaaagtattttgtaagatatatgtctatgttaaggtgtttattgctttttaacttatgatattcccttgggccttcatcttttattaggatttggtatatactagatttctagtatatttccacaaatgcctctttctctcctgcaattaaattgtcttagtagcacagggaatgaattagttctggctggaagtgggaaatttgagaatattgattttctcaagtatcaaggaaatttaacttcctttataggattgcttctataaatgaaatcagaaactcttatatttttcagaatgcattttaatggtatgccatcagctaaaaagcaaaaatatatgaaagtttatatagttttgacatgttgtttatgtttaaaagtctttgaaaacgttgtcaagatttatgtgttgaactccaggtccccatgaaatcatgggctccatagctgaacaagttcttgaggagatctattttattgtgctctactgagcagaatgtacacagtaataagtccagctcgattgcttgctttatacagaaatcagacattcaggcaagaaagcaaagtgctttaatcattaagcacttacaaaaaggattataactatctcggggagtcgaagaatttagaactattctctattccctcccacgtgtgtttgactaatataacacaccagttcctagcaggatttttctgtgtatttttctgttgctgcttttatcaaggtctgagtttttcacccaggtcattgtgagctcttgacaggctcctgtggccaccaccacctccagcttgcagatgtgcaaagggctccctctgtgtctcattctcctttcctctgtgaccactgcaccctgagcagactagaattacatctcctacagcagggtttctcctcagtgatgctggtgatgacttcaaaaaccactctcctttgtttcatattttagggacacagcgggtcaggaaagattccgaacaatcacgacagcgtactacagaggagccatggtgagtgtgttgtagggttttgtaactcttcaggtagaagtaaagcatgaatgtttgtttgccaagattataggattcaagatggagtctagtatgtagaaaaataaattttctgatggggaaacaagacatttaaaaggttttttgggggccgggcgcggtggctcacacctgtaatcccagcactttgggaggccgaggcgggtggatcatgaggtcaggagatcgagaccatcctggctaacaaggtgaaaccccgtctctactaaaaatacaaaaaattagccgggcgcggtggtgggcgcctgtagtcccagctactcgggaggctgaggcaggagaatggcgtgaacccaggaagaggagcttgcagtgagccgagattgcgccactgcagtccgcagtctggcctgggcaacagagcgagactccgtctcaaaaaaaaaggttttttggttgtgtttagcaactatatactttgccagtggtcttcatcgtaataatcaggtgattaacttatagatgttctagaactcctccacacattctgatgtgattgtatattttcattattcttccttttattaataccttatggcagtcgtagcaaaccacaagccctatgactaagtattcttttcttatactctcttgtcattcagccctgccaccattatctcttacctcaccacctccacaacatccactgctgtggctcatctccctgtcatccccctgaccaccattctgccagctggccggaaagaatctggtgaatcttgactaccaagttatttgctgaatccaggcattttccttgctgtcataacttcatcacttgttatgttctatcctaagatgcttcatctattcagtgcacttttattgctttttggctctgggcagtgtgatgctgggagtgcagtggtgagtaaggcagcttggaagctgccttacttccatgagctgtgcttaaccatgcttagaatgccaggcccagaccacggctttatcgctggtgtttaggcctaagccaagcacaagttggagtcttgaattatgatgaaatctagtatgctcagagtctttgaaggttgaacaactgaggtcatgaaccccaacctggtagattgtagggtaccagctgccgtcattcccaactcattgcttaaaagattcttgtattcctgggagtggtgctaggatgacagagctgaaggggtgatagctgtccccacacctctaggaagatgtggtctgaacccacagatcccctcactgacatgctgcccttcctcctccaccaccacttgctctccagtgttggagtagcatcataactcatccccacaaaaagattagggattcctttttaaggctgaagtgtaccactaaccattttatgtgtatttgttccccacactccaccctataatacttttaagattgtgaagggtcatcattttaataaaaatagctgccagccactttctattttgcttagactggaatcaaagggaaggggcttattatatgtgccaggaagacatttgtttgttgtttgtttgtttcccccaggaaggaattttagggataaaaagaacatcataacagggatgatttggaatagtttacaggtaattctgattagaggcatcttagacacacatgcctttctgttgagcagttttttgcatgctaggaatgatgtgctgacaccatttgcatgctcattttcactggagggtgggcagtggcacttagaatataagagtaaatgtttcacttggatgtctggctctagttcattgtatgaagaaagagggcatggaaatgtattaaataatacatttagatttgaggattgtcttaatttacttactgcctagtctttcctcacattacttcagataattagaaattgttgctattctaaatagtattaccttccacattttgaaggtagagatttctgtctttgttctgctgtatacaatgccagtgtctgacacatagtagaggctcaataaatgctggctgaaggggtgaatcagtgggaaattttagacctagacaccatcttggataaatcttcaggaaatcctgctgtgcctgactcttggatctctcaagtcatccattccagtcggttgccgggcccaccattttcagcaagtggtggttatggcaggtttagtttggctgattcaggtatgtggcatgttgacaagcactatactggagtctgtcaccatggcatttcaaacacatcaacagcattcataggcatagcagtgatcctgatggacatttgggctttggggaaaaacaggaccatatcattacattattaatgtttctcatagaccaacaccatcttctgaattcttaggaagctattcttcttgtagatatatactagatacataaagttttaaccgatacacttgaatttgtatttctaactgattcataatatcagttagcttaaaaacataagaaataggtgaatgatttctgctattgaaactgaagatataaattaataatagctgccatttattgagtccaagctatgtcccaggctctaggtgaagtagtttacaaatatctcagtagatcctcaaaatgatcaagcgtggaagaagtattgtcctcattctgtaaatgaggacatggagactgagaggaataaaataatgtctgcaggatctcccatttaatatgtggtggagcctaagttagaagcctcagactctagcctgcgttcttaacaccacaccatgttcacactttctgtgctaaccagtgaaatgaaacttcatgatgacatggcatataaatgatctgggttgttcatacagtccaaaggatggtagagctagggcagttatttgggtaattttaatattgtaggcagccaaacacattgcatcaggaattatgcagaatccactttgaattgtttttattgtggtaaaatatacataatagaacatttatcattttgaccattttaaaatgtatagttctttactttgactttttttttttttttttgagacggagtttcactcttgttgcccaggctggagtgcaatggcacgatctcggctcactgcaacctccacctcctgggttcaagcgattctcctgcctcagcctccctagtagctgggattataggcatgcatcaccatgctcagctaattttgtatttttaatagagatggggtttccccatgttggccgggctggtctcaaactcctgatctcaggtgatccacctgcctcggcctcccaaagtgctgggattacaggcgtgagccaccatgcccgggctgacctttataaaataaaattatttacatggaaacaattgtaaattgcctttacagcgtgtagccaaagtgaagcatttgtatttgaggctggaagaagggaggatagaggagttgtttgtcatttaaacaataatgtatgtttttctggttgcaaaaaggatacatatactacaggaaactttgaaaatcccaagaaatcatctaaaatcccactactctgagagatatattctgttaacgttttatttcatgtattctttgtctatgtgtatatgtgtgttttatatgatttatatttatttatattttatgtttacttacaaagttggaagccagacctggaaggacttcccctaccatactaaggaaatttaatttaattttgagtataaaggagaggtgctaaaggattttgatcaatgaagtgatagttctagtacccttacggaaagtggattagaggaggctaagaatgaaagcagggaagctggatgtggtggctcatgcccgtaatctcagcagctcgggaggcggaggtgggaggactgcttgagttcaggagtttgaggccagtctgggcaacatagcgagacctcatctctaaaaaaaagaaagaaagaaagaaaaaaaagaatgaaattaatcagggaaatcaattaaagatgatgggaatccaggtaaagactaatttgtgagaatctgaataaggccatgtgtgtggtaggtaagattctggaatatttaggacattgagtctccaggacttagtgactgattggctatagagaagataactcccacatgtgtgcttgggctggctgactgggttgtattactttcaccaaaatggtaatacaaggacaaatagaagattcagaggagacaagacaatcttgttttactttgttgagtttgccgtgatcacaaggggatatctattggccaatgtccagacagtggtctcttgagtaccccagcctagcccttcagcctcagcttgtgccctccgcccattagatctgtgcagccttgccaagctgactttctttcactcaatccagcggtctctggttcaacatcagcaagagatttacaatgtttctgctatttgccaggtacctgggcttcccctcttcaccgcagctcctagccctttgcctagtttaagtctactaagttcccaggctttggctttaatgtcatttcctcagggaagcctcccctgcccactccagcccctcaaccagattgaattacacccctagcatatgagctccccatgcatcttcatagcagttgtcaaaattataattagttgtatagatattggtttattgtctgttgtctttgttagccatctacaagaggaagagaccttttctatcttgttcactgctagtaggatctagtatagtatcaggcacacagtaggtgctcactaaatatttatgtagtagatggacaggtgagtagttctagcacttagtacagaagtgtggtctggggatatagattttgcagtagcatacaggtgttagtttaaacatttggaaggtaaaccttttagaaataccagacatgggctgggcgcggtggctcacacctgtaatcccagcactttaggaggccaagtcgggcggatcacgaggtcaggagatcgaaaccatcctggctaatatggtgaaaccctgtctgtactaaaaatacaaaaaattagctgtgtgtggtggcgggcgcctgtagtcccagctactcgggaggctgaggcaggagaatggcgtgaacccgggaggtggagcttgcagtgagtggagatcatgccactgcactccagcctgggtgacagagcgagactgtgtctcaaaaaaagaaataccagacatggagtctttaaaaatatgatgagaatgcctttcattaaaccagtataacaaatgcattggattttaagtgtctgtgatgtacttagataaatagtgacaacctattttttgatcaacctacataaaaaataattttaaagcagtgtggtctcaatcttagtagaagagtagaaagcaagatagtttctacttggaataaacaagtgcacagtggaagtgattaactcttactctcaatgttatcgctgttttgacttaacactcagctccaattggggctgattgttatcatgtgaggtcaggtagaaagggtgtatcacctttaccacgatcactaattcattaaaggttaacagtgaaaatgttaaaagggtttttatttacatggtgagaccagtggaataagtatttattgatttttgtttctctgtacttttcaaatttattatgaaccctttttaaagggaaaaaatggacaaacaaaaggtttctggagggtaggagtacattgacattatatactataactttaaatatataaagtactaaataaagatatttttcccccttatagggcattatgctggtctatgacatcacaaatgaaaaatcctttgacaatattaaaaattggatcagaaacattgaagaggtatgtgtggaaagagaatggtgacattggagaagagtcctgctgggtgcttgtaaaaggctcctctgtctgcaaggcagctgagctgcttagaagcagggcatgggcaggttgggccctctctctctgaagagctccataaatctctggtgctgccagtctgactactgggggttagggggacagagaagtaacgtcacaagattttaagcttgggccagatatgggaaataatttaatcctagatcacattttacacatgaataactgagaacagaaagaagtgatttgcctgtgctcatacagcctttaaaaagaagagccaggattaaaacatctggttcccagcttctatcccaccatgctgtttggctagcaacaattatctctttaccttggcaactttttgcccttctgacattttctccatcttagatatttgaagattgttttaattccaggataattggtattaagatttttttaatgtctttgtcacttaagaaagaaatctgactctgaaataattttgtacacgtttctataaacttagatgaatttctttttaaaatagtacagaatctagaataccatctccactggttcactcagtaccaagtttttgtccttctttgacctgaatatttggaaattttgtcattagatcaccataagctttatttgtgtttgttccaccttctttccaaacctcgggaagaaggtttgcacaggctctgtgagggctcttgtactgtagctttgcccctcttcccatctttaaacttttctctgaattaggccttgtgtgagtaaaagattatgtcttattaaattcatgtgtttctgacaggttggatttgtctattaagtaacgggtttttctcaggctgtttttatagcatgctattttctccctgcagcatgcctcttccgatgtcgaaagaatgatcctgggtaacaaatgtgatatgaatgacaaaagacaagtgtcaaaagaaagaggggagaaggtaaatgtgaatggaatggataaaggttggaatctactcacattaagcatttcttttcttcatattatttaattattgattttttttaaaatctgtgttttaatccctttaaattggatatcaacaacaaagagatgtaatccatacttgaatggtgtgaattagtattcgagatccagctctctatactgtgtggtcatgactcattcctaaagaatttgctaatgttttctgggagatacaaattggtcctttctcagattcctgcagcttagagttcaggctgtttcttccagatctgtgtgaaaatgcccagttttgaagttaaagtaaacattctttttgaaaaagaagttatagggataggtgaagtttcaacaggaatcattttccaattcatttttttccctaagaatattttactacacattagcgttaggttttatggataaattccttgtaactgatcaagctatggatgtcatttatatgttgtttatgggcatgggcatttctctcttttgtgtcctgtaaagcaaaggaatattttgtgtacatatttacttctgtgacagattctaaattgacttagaagcttcactttttaagtcttggaattttgctttagcctttaaaaaaattatatatgcaaaatgcattttcttttctttttttttttttttgagacaaagtcttgctctgtctcccaggctggagtgcagtggcgtaatctcagttcactgcaacctctgcctcctggcttcaagcaattctcatgcctcagcctccaagaaggtgggattataggcatgtgccaccacacacatatacccggctaatttttgtatttttagtagagacgcggttttgccgtgctggccaggctgctcttgaactcccggcctcaagcaatccacctgcctcggcctcccaaagtgctgggattacaggtgtgaggcaccatgcccagccacattttgtttttcaatctgactgtgaacttttgctgcaaacttttttcccctaaaaacatttacttaattttagcattgtaaatgaactaggaactttttgaggaatatataagagttcgcaatttgtctcaatcaatagaaatcaaagcatgaatactttagtatttaagtttttgttcaattctggactcatttattaaaattaattaaggcctggcgcagtggctcatacctgtcatcccagcactttgggaggccgaggtgggtggatcacgaggtcaggagttcgagaccagcctgaccaacatggtgaaacactgtctctactaaaaatacaaaaattagccgggcatggtggcgtgcgtgcgtctgtagtcccagctactcaggaggctgaggcaggagaatcacttgaacccaggaggcggaggttgcagtgagctgagatagtgccactgtactcctccagcctgggcaacagagcaagactgtgtctcaaaaaaaaaaaaaaagtaattaaaagtaagtatagttttttttttttttatttgagatggagtttcactcttgtcacccaggctggagtgcaattgcacaattttggctcactacaacctctggctccctggttcaagcgattctcctgtctcagcctcccaagtagctgggattatagacgtctgccaccacaccaggctaatttttgtatttttagtacagacggggtttcaccatgctggccaggctggtctcttaactcctgacctcaggtgatctgcctgcctcgacctcccaaagtgctgggattacaggcgtgagccaccacacccggcctaaaagtcaatacagtaactgttggagaattaaactttgggagcagataaaaggagtgaatgaatcccaagataatggtagttttaccagtggagggtcttgactacaagtcagccagattcttggcattttgagcaaagaattggacaaaatgcacacacacaaacaatgaaagaatgaagccaaaaccacaaatttatcgaaatgaaagtacactccacagagtgggagtgggcttgagcaagcagcttgagcactggttacagaattttctggggtttaaataccctctagaaatttcccatgggttacttggtttacactctgtaaatgaagtagtggcccatgaccagtttgattggttgcagaaggtgaccaatcaaaggatgaaatgaagttacaaagttataccctgcgcagacgtctgattggttgtgggaggggaccaatcagaggtactttccatttttaatctgtgagtcagaaaaggggaggaggttgcaaagggagtaacccctgtacttttgttacttgggcatggaaggctggggtttttcttttgatttagttctaggaagtcaatgtgaattggccttaggttccctgcctccagaccctattctgctaccttaggagggtgggtatttatcccatattagagaactaaaagtacaaaaacagaaaaaaagagaagtacttaaattattattattattttatttatttatttattttgagacagagtctcgctctgtcacctggactggagtgcagtggtgcgatctcggcttactccaacctctgcctcctgggttcaagcaattctcctgcctcagcctcccgggtagctgggactacaggcgggtgccaccacgcccggctaattttttgtatttttagtagaggcggggtttcatcatgttagcaaggagggtctcgatctcctgacctcgtgatccgtctgcctcggcctcccaaagtgcgtgagccaccatgcccggccttaaattatgtttgaaatggaagttgtgccatccttcttacgatgattaagttaaattattaaattctgaatacagtagaagaaagcaaagaaatttgagaaccacaggagttctgaaatagataccctacctttgagactttgaaaaacctaagaaatacaaatgcattatgtgttcaagtatcttttgctaaatttaaatatttctgtttacttttcagctagcaattgactatgggattaaattcttggagacaagcgcaaaatccagtgcaaatgtagaagaggtaagaaggaaacgtttggtgactgttacggagcagcaccagtgcttaggggcctgtgttcaaacagctctcagagctttggtattttctgacctaatgaatgccttttgttgacccaactctactttgtacacttttgtgcttctgatttttttttttttgagatggagtctcactctgtcgccaggctggaatgcagtggcatgatctcggctcactgcaacctctgcctcccaggttcaagcgattctcctgcctcagcctcccgagtagctggtactataggtgtgcatcaccacgcccagctaatttttgtatttttagtagaaacggggtttcaccatgttggccaggagggtctcgatctcttgacctcgtgatcccctctccttggcctcccaaagtgctggaattacaggcgtgagccaccatacccagctgcttctgatttttatgtagacgctggttgttgaatttctagcatctagcctccacctggattatattagcttgctcagttaagattcacagaatagattatggaagttcagttttgccctttttttgggcagctggaaatcctggactagaagaccaaccagtatcctgtgctcattcatgtcaccctgtatgcctgcagcagaagagttaaatcacttttaaggctgtactctctcaagggagaattaagctgttagtttattggacacattcctttagcgtacacatttgaggtagattaagcacaataaattgtaacagtggcatttagtggaaataggaaagtgtttatcagggagtagctttaataaattttcattaagttagctgttaaggaaaaccaaaccatctaaagtcttatgagaataggttttcttcaatacctaacgtagatgactggttgatggttgcagaaaaccaccatggcacgtgtatacctaggtaacaaacctgcatgttctatacatgtatcccagaacttaaagtgtaaaaaaaaaaaataataggttttcttcaccaagggaactgttattttttttaaaaaacattttttcaactgatcataaaaataatacgtgtaatttacatgtgatatgtgttaatacatgtaattcttttaataatactgatagtttcataaacatttaatttcctaggttactcattgttcatcataacatgatggttaaaaatcgagacctacatgactttattagccagtggacactgatcagaactttttctttgttttaaataacgtaacagttatttgtttaggttggccgatgggtgttaggaaacaggaagcctctactgatttacttacacaagcttagataagcagaaaaatgcttccctctgcttgatacaaaaggatttcccgccatcagaaataatccaagttaaaaatggacaaaagatctgaatagacatttctcaaaagaagacaaataaatggccaacaggtatatgaaaaaattcccgacatcagtagtgatcagggcaatgcatatcaaaagtacagtgagctatcatctcaccccaattaaaatggcttttatcaaagagataggcaataacaaatgctggaaaggatgtagagaaaggggaaccctcatatactgtgggtaggaatgtaaattagtacagccactatggagaacaataaaaaaactaaaaatagaactaccatatgatccagcagtctcactactgagtatttacccaaaagaaagggaatcagtgtatccacctaagtgtccatcagtggatgaatggataaagaaaatgtggtatgtatacacaatggaatactattcagccataaaaaaagagtgaaatcccataatttgcaacagtatggatagaactccctgaactgggagttgcctgagctgcttattctagcaaggcatacagatggtaacaactttgccagagctttaaatcagtgtggttaggctcataggtgacaagtttgacagtgagacactgacaatgagtaataatagtagttgtcgtattgtttttatttgattggattggaaataatccttttcctgaacagtttttggggatcaggagtgttgggaacaaagaggttgatttaacaataggtttagcatggtgacaaatgaagaatctttaacagttcctggcttcatagaaaaagtgatgatggatttaaaaaatatttggtttgtatcaagagacattatggataaattatcacgaagattaatcagatttgccctgcttctattcgaactgacttccatggtggggaatttagccgagagctccaggaactgttgggattttggagtaagacatggaagattatacatattcagctataagagtgagagcaatttgaaagaaaaagccagaaataaaaagtagagatttttgtgaagacattttagagctatagggtaatacataattatttattcactcattaaaccagatagtcagcatttcctagatcagcactgtgccctgctctagggaagtggggtagcttagacagagcttctgtcctgttcttggtgtactgaagaagttactcgtgactcaacaagggtgttattgtgatattatatcacatgaagaaaatatttgatgaatgaatgatagtttgataacattggaaaatgtttatgatacaatctcaaaagagtaaacacatgcatactatgattacaattattactttcttaatgtaaagctttaaagtggtatatttatattgaaataatgaaaaattctgtatttctgttttaaaataagtcaggcatggtggctcacacctgtagtcccagctacttaggagactgaggtgggaggattgcctgagcccaggagttccaattcagccagggcaacatagcaagaccccatctctgaggcggggggaatatatatatgtgtatatatatatatatacatatatatagtgaatatataataatgaaaatgttttgttttacctataggcattttttacacttgcacgagatataatgacaaaactcaacagaaaaatggtttgtatcacttataatttttatttccattatgctgtctgtttggcatttgatgaaaaggataggtctaattataagatactcaaattaaactcatttttttcctgactcagatactcatttggttgaactctgattcttagttctgtttgtttaggattcttatttctgagctgccactgtttcagtcctttcttctggctctttaagtgatctttaattgaattttgatgagaataatgaaaataataatggcacaaattcgatttttgccataaaattattcagttttcatgtgacaggtatttatatctgcataactacgattttgaagttgctaaagtttgcttaaatttgaaatcattaagacaaccttgaaagtttgttttatcctgagtcctgactataattgcgtaccttatgctactaactcttcttacctctaacagaactgtctatgccagtatcttaacattgtttccatcattacctttgaaactttacactccattggaactagaaatagaagcttcctattgaatacattattgatataaaagctgctatcgtaagggcattttcctcttttcaattcaccatttccaaagaaaaagacaacattggtgcttaactagttcccgttctaataaaatactctagtgaatacacatttcactagaatacacatttcacatggtatggttagttatttttattttttaggtaactgaggtcaaaccatgaaacttttatttccttggtaacttcatcttctattttttagaatgacagcaattcagcaggagcaggtggaccagtgaaaataacagaaaaccgatcaaagaagaccagtttctttcgttgctcgctactttgatgaactctttctgagagactgcagcacacctagagggccctttcctgcttctctgaaagcacaggtcacccagcctcagaatcacacctcccggctgctgctgagagcaccactgaacttagacctctcaacacagtatgccaagtggattccagcctcatggcctagcaaaagaacagactccctttttcaaacatggaagcaatgaagtggagacacatgcaggacctaactcgttttttccttgttttattacctgttgcagaagcggttatctttcttttttactttgcacatcagtgttagcctttccctatttcagcacaatcttagactcatatttgcacacttttgtgtcgtgaagttctagacaaatttgtacatgtggcaatgttaaaagagcatttacagcagaggttaatatactaaaattaaagggtatttggtctggttcatatggtcaaatattactgccttggtagcatttatttaagggctttttcttaaataagaatcattaaagtcattaaaaaaatttactgaaatgcccatcttgtcatcaaaggccacaatttctttatttcttcagattaagagctttgcctcatccccgacctgttttccagagtctgggtagctgaatgaatcactttaaaatgattacctctgcctaatctatagaaactgcatttggaaatcaccataatctcatttttccctggggtttgtatttgctattctttcccatgtttgacttaagtgtaatcactcttaagtaatatttgaacattattatctgtttctatttgtgaacttcttgagctgaaattttacgtgggctgagagatataccatttagggttttagtgcagcatctaactgtgattctgtcaataaggatatgtaatatattttttcttaggttcactccttagctggctggtttagttgtaataccaaattcctaccataatccctgtctacaaaagttaggtttagattttagtttgcggaaaccttccctatatagagacagattaacttgttgatataaatttaatagagctagctcttggtaatggtgaaaataatgagttttggttggttttatttggcagatgtttttagaaataaaagtacttagacctagtgcagcctctaggaaaagtcttgccttttcattagagaaaacaggaccaaggtttcagttttcaaacagctgttgttgattgtgtagaacccagttccatctgttttggttcattgttacagaacttagtccagtcatttgggctaaagccaaccaaaagcttagttgcctttctcaacaaacactggtactggtatacttttgtagatgaaaccatcacaaggtatttagtgttaacttgtgtgccaaattcagatcactatgtcgttgttgctctagccttcagtgtcataacacaggggggataaaacagaggggatgagggaaatgaattctgttaataattattcttcctggtatgcctgttttgcttcacaaaggctactatcatgctggatagataagaacaggagatggcagtggaaagggattgcttgttaccacagagaattctcttcaaattaagatatgtcattagaatgcttggaccagtcaatcttttgtacttatttgaaaatataggaacaatttagcagctgcaaatatgcccaagctatttttaatagatatactaaacttattgttgacaaatttcagcctccttaatttttttttttttggtaattacctataggcttaaaagtcattcgttgctgttctagtataattagtagttccgtgattgaaagtttattgtaattctactatcttcaaattagatacattttcaaaaggaaaagataattttttagaaacatcttaatattcactatttcctgaaaaaatccaagcagttaacgctttctggatggtaacaaagtaccttctaaaagataagtgctatgacaccatgtatgaatgtaattctcttagtaatttacctctgactatttggtgtcttaacgctttggtttatataatctcaggggttgtctgcaaaccaaaactgacatattctgtggttagcttttattacttttttttttaacagaatgctttgctttggttatatttcttctttcttcttttgtcttatatggattaataactagtctccatgaacttcacttgaaagagcctgtaaaagttagatgagtctaaaagtgctctttgaagtagcagcaaattgggagtatatgctctgttatatagaaataaattgtccttgctattttcttacatttagctttgctagattgtatatacattgagctaagaccttaggaaattcactttctgcatgataaaatgacccaataaatattccactttgcttaataatgtacatacagtgcattattttttctatttgtagatgaatttaatgacagataattgtctgttccccgctgaaactgaagaaatctagtttttttgtgaacatttttgtggtcttatggataaggtacatgaagatttttgcagcagtattagtggttcagtggctgcactttattaatcagtgtgttaatttttgacagtgattggactagaccttttcaaatagagtctgagggtatcagacagtgaaaatgtgctgtaactaagtagcatgtaaatcagttgattgtaaaacgtttcgctgggaacttattttagctatattttacttcagacagattatgatacaataatctacctgtgcatcagttagtaggtgctgcagggtttcttactatttacagaaacattttgtgcagtctttgttataaattttcagaagactatactctttactttgaaggtctattttttaattatacctcatttagctaactagtattctaatacctggtagaaaaacagtgagccagcctttaagcatctaacaaaatttagactctttgttttgttttgaactgaagacatcattgggaaaggtaggaaatattagtttaggatagagcatacatgtcatatccagtagcataaaaaaagtattatctccctgtctccattaataaatttagctgtgcaatataggtgcgtttttgcagaagtttctagtaagagattataactccattttacaggttctgaatgctcagagtctatattaaggcttataaagtttttcctgtgatcagtaagtgacacatttaagcagacattcttttcaagttcatgacttagattcctttacaaatttagttctcaatctttaaaaaccacatttcattatgttggttaattattataaattttaagcactcatttctgcaatcaggtttctcagaattttttttttttaaacagaagagacattcctttttccttgttacatccaaggggggcacaggggtgggtggaaaggaatgtctaaaaatgaaatcccttgatatagagggacctagacggacaggatatgctaaaataatttcaaattctagcacaattttagagtagaataagtcatttttttagactaataaaattaatggctgtcatgttcactctgaaaaaaatctaaatgactgaaatgtacagaaataaaaattagcaaacaattattctagggatattttcagattttacttcatttcttgaaatgcgtgtgccatatgcaattgcatttcttgtgccaagaaactaatagaacttatttcactttacctttttttaaaatgtgaatttagttattatagttcaattttatggccttacagatggcttttattttgtttgcagctgacactgcagttcctttcatgcaaaataccataaactgtttgatgaaaatcatgcccctaatggaaactctctagtttttccatataactatcctactgtacatgtttaaacatattttatttttgctccaatggcttaatgtgaaaagctcctgcagataagtggacctgtcatgtggttaatcttgtttaagccaattcattaactgtgtactgatactgatgctatgttttttttaaatggattttattccaggtgaactttttttttataataatgttcgtctaaaataaaaactacataatgaaaatgaaaatgctaatggctctctgaaatggactgcacattttaaaaatatttctgcaaatttgggccagatgcagtggctcacgcctgtggtcccagcactttgggaggctggggtgggtggatcgcttgaggtcgggaattcaaaaccagcctggccggcatggtgagacacccatctgtactacaaaattacaaaatacaaaaattagcccagaatggcagggcatgcctgtggtcctggctgctcaggaggctgaggtgggagaatcgcttggacttgggaggtggaggttgccgtgagctgggatcgggccactgcactccagcctgcacaatggagtgagaccctgtttcacaaaaataaataaataaataaaataaattaaaaatgtttctgcaaatttgacaggtatatgtttcaaaccatggcagacttaagatattttagcaaactttatatctgacgcagagttgtttaaagatctagaaaaatagccagctcccctgttcatcatacttagctcagcatacattgaggttattctgttgtagaacctgtagctttaaattgatcacccttcctttcttagtccttgcaagtttaatttctgttgttttgtttccacttgaaaataatttcttttgtggtttttttttttttttttagacggagccccactctgtcacccaggctggagtgttgtggcgtgatctcgactcactgcaacctctgcctcctaggttcaagcgattctcttacctcagcctcccgagtaactgggattacaggcacacaccaccatgcctggctaattttgtatttttagtagagacagggttttgccatgttgcctaggctggtcttgaactcctgacctcaggcgatctgcctgcctcggcctcccaaagtgctgggattacaggtgtgagccaccatgcccggccttgtggtgttttctgagacaaggtctactctgtcacccaggctggagtgcagtggtgtgatcatggctcactgtggcctctacttcccaggttcaagcgatcctcccacctcagcctcccgagtaggtgggactacaggcactacccaacccagctaatttttttttttttttttggtagagacagggtttcactatgttgcccaggctgatctccaaatcctgggctcaagtgatcctctcacttcggcctcccaaagtactgggattacaggcatgagccactgcacccagacggaaagaaccaacttgatggcaccagcactgtcgatactctcctgctttgtttgcacatattcccagtctcagcctttcccattcatcccacggccatttcaaaccttcactattcttctcaagcttcctacctcttccctgtccctcttcatggactgatctttcacctccctccttccagagaaaagcatcagtcacaaaccacattagcctcctctccctccctaacctacaggccaccttcatccttacctccttcctcttggtctcacaggcattcttaacctaggctcttctctctgccccatatctgaattcatcctcccactgctatcctgcttttcagggaactcacagctctttctcttgtaccttcaaacccctatcctttcttagccctttccttcagcctctgagcatcctcaaccctcctaccctgtggcttgtggtcctctctcacctgctctttttcctcttctttctgttatgcttaaaggcatctgttttcaaagaggtatctatagttactatgctcactttttcattttccatttattccttaacctactctggtttgtcttctaccccccgccctgcccctccccaccacttcgctgacattgtgcttacgacagcctagctgctaaagtagtagacagttttcagttctgttcctagctaacttctcggcagcatttcaccagtatatttctcccccgcccgagaaatgttctttccttggcttctgtgacagtattctcatgattccgacttatgcacaataatttcaccctttttcatggctctttaaatgctcataacttctgcggtaaggctgaataatgcccctccccaccttcccctaccccctcaaggttggtcatgtcttaatccccggaacctctgaatgttactttatatggcaaaaaggactttgcagaggggatcgagttaaggatcatgagatgggagattatcttgatccaagtggacccaatgtaatcctaggggtccttctcatgagaggacaggaagagtcagaagaaagccacgtgatgatggacgcagagggagaaaaggtgctgtgatgctgtgcagagccatgagccaaggaatgtgggcagcctccaggatctggaaaaggattctcccctacagcctccagaaggaaccagcctgctctgacaccttgattttagcccaggtcagacccattttgtacttaaccacctccagaactgtaagactaaatttgtctttacagactgctttatgtcactgagtttgtggtaatttagcacagcagcaatagaaagctaaaacagttttcaaacgtgtatctctagccataaccactttccggagggccagacctcaaagttacctgcctacgggacatcccccttggatctactacagggacatcacacacaacatgtctgaaactcagactcaactctgtcttttccctctccccaagcaaaccccacttccgaagtgggcggtggggcgggggggggggggcagcctgtcctttttccatcataataagtagcaccatcatctgtgtagatccttagtcaacctccagatttcatgggtcctacccctatctacttgtccattattactgccactctttgttgaggccccctcaacttctgcctagatcactgtaatctctccaaatcagtctccccacctctaattttattttcctccaatccagttttcacagtgctgagttttacaggtggcatcttatcctgtccccgctacatataatgctttagtggtactgcctaaccttgggataaaaactcctttgcatggcaaacaaagtcctttgccatccccacatctttctctccagccttaaatctcgtcatgccttaactcatactcttcctttgaacctcatgagtaattgcagttccccagcacatcatatcattttattcctttgcttacattgctccttctgccgacttctgcttctttacttggctggcctccgcttactttcaagactcactgaggggcagggcatggtggctcatgcctataatcccagcactttgggaggccgaggcgggcagatcatttgaggtcaggagttcgagaccagcctggccaacatggtgaaaccccatctctaccaaaaatacaaaaatagccaggcatggtggtgggcgcctgtaatcctagctactgaagaggctgaggcaggagaatcacttgaacccaggaggtggagtttgcagtgagccaagatcatgccactgcacccagcctgggcaacagagcgacactctgtctcaaaaaaaaaaaaaaaaaagactcactgagggtttctctggcaagattttagctacaaccccccctctgcttagaagcctctgtgtatgccccaagtgtcactcaccacatggatttgagttgactatttactttccttctctactagatagactctaggctcctgaagggtgggagttgtgtctttagtttttgtatctaccatacccagtaaggggcttggcacatggtaggtgtttaataaatgaaagaatcgcctggcacagtggctcatgcctgtaatcccaaaactccgggaggctgaggcaggtggatcacttgagctcaggtgttggagaccagcctgggcaacatggaaaaaccctgtctctacaaaaaaatacaaaaattatccaggtgcggtggcacgcacccgtagtcccagctactcaggaggctgaagtgggaggatcgcttgtgcccaggaggttaggctgcagtgagctgtgatagtgccactgcactccagcctgggcgactgaagtgagattctgtgtcaaaataataatacataaatgagagaatcagtacttcagtcatcatcaaaattaacttgcccatgaagtaagtgaagtgtaatttgggagctaagtgtaatttagaagttttgttctccatttactttcagacagtttcactctgtcatccaggctgaagtgcagtggtgcaatcttagctcactgcagcctcgacctcctgggctcaagcaatcctcccaccgcagcctcatgagtagttgggactataggcgtgggccatcacgcctggctaattttttttttttttttttttgagacagagatttgctttgtcgcccaggctggagtgcagtggcacgatcttggctcactgcaacctccaccttccaggttcaaactgttctcctgcctcagcctcctgagtagctgggattacaagcgtgtgccaccagggccggctaacttttttgtttcttggttttgttttttgtttttgtttttgagacggagtctcgctctgttgcccaggccagagtgcagtggcgtgatctcggctcactgccacctccacctcctgggttcaagagattctcctccccagcctccggagtagctgggactacaggtgcctgccaccacgcccagctaattttttgtattttagtagagacgcggtttcaccatgttgcgcaggctggttgcgaactcatgagctcaggcagtccgctcacctcagcctccccaagtgctgggattacaggcgtgaaccaccatgtccagccaatttttgtatttttagtagatgggttttccccatgttggccaggctggtctcaaactcctgacctcaggtgatctgcctgccttagcctcccaaagtgctgggattacaggtatgagtcactgcgcctggcctgatttttgtattttttgtagaaatggggtttcaccatgttgcctaggctggtcttgaagtcctgggctcaagcaatcctcccaccttggccttatatgctctttattctggttcttatcttttaatctttgttaaataccttacaggggtccccagttctggggacatggataggtactgggccacacagcaggaggtgagcggcaggccagtaagcattactgcctgaactctgcctcctgccagatcaatggcggcattagattctcataggagtgtgaaacctatcatgaattgtgcatgtgagggatctaggttttgtgctccttatgagaatctaatgcctgatgatctgaggtggaacagtttcatcctgaaaccatccccatcaccccaacccacagtccatggaaaaattgtcttccacgaaaccagtccctgctaccaaaaaggttggggaccactgccttatactatcttaatctgtgttgtatcttacactatattaatctttattaagtatagaaggatttgcttttaataagatcacccagaatgttgtttaggtattgataaattcagtaaaccttctctcccacttcatgattccaaccctcaagattggtgttccgttattagttccagggatatatgagaatgcaccatagcaaataaaataaataaataataaattaaaataaataaatatacattcgcctaaggtgaaagtagttgggtgatgacatgaaagaaaaacagaaattgctgtggttaagaatagcaactgctaaatacatgaaatgagtttttgttccttatgagtaaatattgcaatgaaattttagggaaatatttcaaataggtagtcacattagtcaataaattatcaaaatgtctcaggcttcaactgaggcagctggatctagcaaaaagaggcctgaactagaaatcaagacttccaggttccaagtgggttctgctgctcagtaatggagtattttctaggcttgttgtatcctctgtttgcttttaaaaaaaattatattggataatctctatgtcctttcctagctctaaaattctaagaaaacactggtaatttctctaacatagatcatttgatactctaccatcattgcaattttctctctgatatctcaatgaaggtatttagttttatggtttataaatttggaatataaattaaatcaacttggcattataaacatggacacttagtataaactaggtagtaattctttatctgatttcttatgaccaatatttgccctcgtttttgtttcttaaggtttcttcctcttgcattgcccttatttatttacttatttacttttgagttggagtctcgctctgtcacccaggctggagtgcagtggcatgatcttggctcactgcaacctctgcctcccgggttcaagcaattctagtgccttcgcctcctgagtagctgggactacaggtgtatgccaccacgcccagttaatttttgcatttttagtagagatggggtttcaccatattggctagactggtctcaaactcctgacctcaagtgatctgcccacctcagcctcccaaagtgctgggattacaggcgtgagccactgtacccagccacttcctcttgcattgcctttaaaaaaatttacttgtgaatattgtgtgcaagctgaagttgaaaaaactctaagagaatgtagttaagactctcatcttgtaccatcaacaaaaccagtgctgcttgaaagctgggtcctagggttgactcttatagggctggtaacttcactccgaccttcagcatcacagcaggatcgaaattgcatcactcgttaccaaggaaactgggtgggtactctgaggatccctccatttcctgtcttccttcagctggtgtcctgtctcctctcctctaaagctaaatttctccattttttcctctttccttttttttcttaccacacattaatgtgagaagattttacagactgccttttacccctatgtctgggtcactgatgacctctgtatggctaaatccagtggacataattcactggtagcttttgttgttgttgttgttgttttgttttttgtttgttttgagatggaggagtctcactctgtggcccaggctggagtacagtggcgcagtcttggctcactgcaacctctgcctcccaggttcaagtgattcttctgtctcagcctcctgagtagctgggattacaggtgtctgccaccacgcccagctaatttttgtatttttagtagaggcagggtttcaccatgttggccaggctggtctcaaactcctgacctcaagtgatccgcctgcctcagcctcccaaagtgctgggattacaggcgtgagccactgtgcatggctacttaacctctcgacagcccttctttctgaaatgttttccccttggcttccacagcaccacattcccccagttttcttgttaccctcttggccactccttttcagtttcttatgaggttcctcttctcctcatacctttaatgttggtgttctgacataggccttgttctggctttactagctatctaggtaattctattctatatactctcacggcttcaggtattctggtctcagctctgatgttcagtccatttctctcctgatcctgtatatgtagttgcctactgaacacctccatttggagtgctacaagtatctcagtctcaaggcatccaaaatgaaggccaggcacggtggctcatgcctgtaatcccagcactttgggaggccgaggtgggcaagtcacttgaggccaggagttcgagactggcctggccaacattgttcacactgtctctactaaaatacgaaaataacccaggcatggtggcgcgtgcctatagtcccagctactctggaggctgaggcaggataattgcttgaactcgggaggcagaggttgcagtgagctgagatcacaccactgcactccagcctgggcgacagagtgagactatgtctccaaaacagtaacaacaaaataacaaaatggtactcattatcgtgtctactttgccatattctctcctcctcctgtctccacagcatccacttaagcccgaaccctctagaagccctcatccttgactcttcccccatctcactctatgtagctcattagtcactaaattctgtttgtacaattcctaaacttctattaaatttgtctgcttccctccagagtcctgctaattccctgaatcaggccactgccatctcatgcctgcgttgcactgaggacctccagtctggaagctcattttccatatctttacaaagcagatctatcactctgaactgttgtctcgacccgagttttgataggtattgtgctgggatctgaccattcaaaatacaatcactggaatctgaagaagtattctgtgggagtgaatggaaatatatatgacttttaaatgggcaaaggtaatgtttttctgtaagaattaaatacctgcagttgtattatttgaaggtgcattttcaggggcgagctgcaaaacatctgtcaggtcccaacatttgtctactggtgtttttttaaatgtggattgccaaaatctttattcatgatggacattatgtaggagtggttaatacttacatagcacttacctgtgtcaggcacactgatcaaaataaccgacgaagtattattcaacataaagaaaaatctaacttggatgtgaatgatcagagaacttaagttttaatttttaaacctttcagaaattgttaatatagatgtttataacttccaccttttaaattatttcacttattgaacagatattagtgaacttctaggtgctgaggaaacaacaaagagcaaagcaaagtccctgtcccccaggagttcgcgttttaacggggaagaaaaataagcaagtgaaatggacgactgtgagaagacggagcagggagatgttactattgcttgtagggtggtcacagaatgcctgcaaaaacaacccttttgaagaattgggaaaaaaataaaaaccatttggctgaaacagccctgagaagggcagcttcttccaccactctttcatcattttaccatctgtgggttatccccggggtcactgctatcccagcctaggttttatacaggatggagtacgaagttcccgcaactatccaaacggtaaaatgtgcttaaaaaaaaaaaaaaacctatttaaaaaggaatcctgcttgttcctgcgctacatttttgtttagtctctttggttgacttggaatctctgcctgttctcggtgcatgcggctcgaaggtgggctagggagcttcccttctcttaaccacctcgcggccggcactggaacccgatcggagtgtatctgtggggctgcggcgatggctggggccctaacgtcgccgaggacgcccgcctcgggagcaggagctgcggcgtggccctggcgcttccggacacccggtagggcggagggcccaacggtggggtccgcgctcaccgccttgagcccgcccctgcgcccggcgccctcagcccacgccccgcccagtcccccaggccctagcgtttacccccacgccccgcctcgccccgcgacccacgtaccccgcctccgagccccgcccccgcccccacgtgccccgcccccgagccccgcccccgtccccgtgcctgcccatgagccgcgccccgccccccgcgtcccgcttagccccccaccccgagccccacccaccgaaccccgcccgcgccgggagcatctcgcgtccccaacgggcccccgggtcggtttccgcggtggccatgactgcggccgtgttcttcggctgcgccttcattgccttcgggcctgcgctcgccctttatgtcttcaccatcgccaccgagccgttgcgtatcatcttcctcatcgccgggtgaggcggtcgcgtcgggaaacccggacgccggggctcccctcccccgctggggttacccgcgaccctcggcgcccccaccgcgcggctcgaccttgttgcgtttcagacgggaggagggttgagagggggagagcggagatccggctccccaaaggcgcctcgccctcttaggaagaagcgcacactgggggtcagggccttttgcctggggctcatgggtggggtttagtgatccgtgaagctactaaagttgtataaaaaaattatggataagttcatatatgcatccttcattttctggagggggagtccctaatttccctcagattctcaaaggcatgtgtaatccccaaagggttaaaaaccattggcgtttaggatagtagtgcgcgacttccgcctattagaatcacctgtggccaggtgctttaaaacatgccgatgcccacccccaccccgatccattgaatcagaatgtctaggggatgggattcgggcttcagaaaaaaaaaaaaaaatttaagctccttttggatggttccgttgtgcagccgaagggtggaaacctgtaaaaacaccgaagcacctgactgtgcgtctccttctgggagcttggtaaataccggactctggtgtcccatcgcagtcatcacctgcctcttacttgcacataccacatcccccctcctctgatgagtctctcttggcaccagactaggccaatgattcccgcttttctgcgtttcttcacctcccacaaacgtattgaaagtgcttcgctgcatgtcattttaaaaataatagagatttgggaagggtctgtaaagcttgctataatcattagaatccccaggggtgctgtaagacctggagggcttggatactgatccagatcagaacacaggttttcaagttgaattttataccagtcactttattaatagagatgtagatatttttctggaaaagatactcatctttgcagatatctgatcagtaaatccataatttcttgtaagttttaagaatatgaaaattgcagtaatcagggttgtgtattttcttgttttggctcatcaatgggcagagcattgattagaaagagtagcaaataaccaagtttctagctagatagtccttggcagatagagtctgcagatgtacttgcaagtagcagggtcattgaaaaaagtaattgttgggaaacctcagccttcctcttggacacgtttgtctcaccaaggaaaatgcaccgttaagaacaactgatcagagtatcactttatgaggactttcttttccttattgaaacgtcaagaaatctcttccttctcaagcaggtttttttttttttcctgcttttaaacattattaatcctgtactgatgttcacttgtaactttttttcccgtatttttcagagctttcttctggttggtgtctctactgatttcgtcccttgtttggttcatggcaagagtcattattgacaacaaagatggaccaacacagaaatatctgctgatctttggagcgtttgtctctgtctatatccaagaaatgttccgatttgcatattataaactcttaaagtaagttaaatacctgccttaccttttttttccccagttagattttagttatgatttggtcatttgaaacgtgaatatagtattgtatctatgccctcctacatagtactaagccaagagattggtacatttccagcctgaaaatcttgagtgttcttttatcttgtggaaatttcttatttccttcctttcttcctttattcaaaaaaatatttcttgagaatcaatcccagacactatcctaggtactggggatacatcagtgattaaaagacagagtctctggcttcatggagcttatattatagtaggaagagacagacaataaatgaatgaacaagaaatacactggtatagtaggtaagtgtcatggagacaaacaagctagggaagcattaaaacaactacagaaatcattccagcttagaatgtatatgttctctttgccaccacctaagttaattctttttttttttttttttgagacagagttttcgctcctgttgcccaggctggagtgcaatggtgcaatctcagctcacggcaacctctgcctcctgggttcaagcgattctcctgcctcagcctcccgagtagctgggattacaggtgtgcaccaccatgcccggctaatttttgtaattttagtagagacagggtttcaccatgttcgccaggctggtttcaaactcctgacctccagtgatccgcccaccttggcctcccaaagtgttaggattacaggcctgagccaccacacccggccaagataaataattcttatggagaccatgccttccattattttgactttagtaggggaaaacaggagttccttttgtggtatttcctgtagttttaaatctataatagaaaatcacattttaaaaaatgccttgggttcccttgttgggccagaaagtaggtcttctctaggactcacgaggacctcacatgaaaccactgatttgaaacacagctggaacttggaaccatatttcctttcaggcagtcatgaaattggctttgattatgtagtaagtcttaatagagtgataaatgtgctgtcttttttcatttgtacaaatgaagtaattaaggctgtccatgaatttcgtggatataaccaagaggaacctcaacaacaactcttttcataggcttctgttaacttgttcttgccaatatgctaggttttctgtatttgttactctttgcttttaataccagatactgaattcccttttcgtaatgaaggaatttaaattaggaattgaaatccaggaagccattgcttagaagcaaaaatcatatcttagaaaagtttcaaaaatgaaattcccattagtacctggaaatattacatgggaataaataaatatcaaaggtaacactgaaatttccatggtaatacaacatccctaacagatggacatctagctgtgtttgaatgtttctggtatgtggcagttactaccattctacaattttaagctttaactgtagaatatcattaaggtaaccacatctacctctgctgggcttggtggctcatgcctgtaaccctgacattttgggaaagcaaggtaggccaattgcttgagctgaggatttcgagactagcctgggcaacatggcaaaaccctgtctctacaacaaatacaaaaattaactgggcatagtggtcccagctcctcgggaggttgaggtgggaggatcacttgaatctaggaggcggaggttgcagtgagccgtgattgcaccactgtgctccattctgggagacagagccagaccctgtctaaaaaaaaaacaaacaagcaaaaacaaaaactcccttctgaccgctgccttactcaagtaccaggtaaatgaagtctctgctgcatggttataattatctccctttcaagaatgaacagtcctcatttcttcacctggacctcaacaggcatggttgtggcttccaaacctttccaaaagaaaggctgtttgttctttttggtcagtggacatgaccctttttgtcagcgcctggtttttgcctgtgctcagaacccagcatggtattctgcagtgcagactaagtagtacccctgactgggcactgtactcttcacagctcagcctcacattgcactgggttttcctgtcagtgacatcattggcccatatgcattttcatgccatgggtctaattttgaaaaaaaaaaaaaaaaacaaaaaaaaacacaatttctaatacagaatttaaagtttaggacttgtatgttctaaaacctgaattatcagcgtgacaaaatgagtatgggctgttcttcactgccttgcatcttcatggtttccacctgaaatggcaacattttcctggcactaacttagggctccaaaggactgtagctgaacatagatccacattattgttcctctttttttttttttaattttaatttttaaaattttctttttacactgaggagcaagtgtccacttttttaatgagggcaggaaaggagtaggaccacatgaggaagaaattaaagctgtcagtctgtaggctcgaatgccaggaagttcagagaagcctctttaggttcctagggaaaccatgtgtgcttttctgaaaggacctttggaaatttgcaaatggtaggacagacttgtactagcaggtacgtttgtttgcatttgcaaaaatcatcttttacgagcctttagaatattcaaaattttcccagcaaatttgagaaatgttaaatgttatgtagatgtattaaaacaatttaagaattattataatgctttatttatgactgacatttatatggatacatttacattgctctcttattctatattgcattcaaatatagggagtttggtttaatcaatactttatctccactgccaaagtaggtcttgaacttttaaatttaaagtgctacctcagacttttgctatcagaatttggtgccaagattaaaatgtggagagtttataccagtttttataaatatatggaattggatcaaaatattcattgcaatctaataataaataatagttttatttcatgagttagaccttaatcacttaatcttactaatcttgttcttacatgaatgaatagtaactttcagcctggcagagccttgcataaagagaaattggcatgtgtggtagccctttctgcagtaatttttttaaaatccaagttatgttgcttaaaatataatcatattttgccaaaaacatacagtttagacaactctatgttgcttgaaactcctgtatgttgcttgaaactcctgtatgttgcctaaaacagacattaggattttttctgtttggatggaaacttttgtaatttaattcaattttgtcttaaaaggttgataccataaatattttgtaattttagaaaatcttccatttatagaaaaaacattaagataaccattgctacaacttttaagcagcgtgtctatttttaaaaattctgaaaatggcgtatttaacttgtattcatactcctttctctctctcacacacacattcgaaaaaggatagaacaaatgagaaagatggtgtgatttagcagtagtttttcaaaatttatatttttgaaatttgaattgtttctttttttgttcttgggaacataataataaatgcaaacaaagaattttccacttcagtaagatggacgtgaacccagaaactgatgatgttttgtactttctcacttcctgatgttgacattgagaactcttagtgctgttagttttcctcccacgtacttccataacgtagaattaggaagcttattaaactttttagtttatttatttaatatatttgtgatagtagtactttgttgtatcaaatagctaaaatctttgattgattcactgattgacacagtctcgctctgtcacccaggctagagtgcagtggcgcaatcatggctcactgcaacttccgcctccggggctcaagcaatcctcccaccctcagcctcctgagtagctaagactataagtgcgtgccaccacacccagctaacttgtatttttttggtagagacataggctccttatgttgcccaggctggtctcaaactcctgagctcaagcgacccgcccacctcagccacccaaaatgctggtattacaggtgtgagccaccatgcccagacaatttatctcttaaattgattatttgtctttttattattgagttgtaagagttctgtagatataagtcctttttcaaatatgatttgcaaatattttctcccatctgtgttgtctcttcactttcttgatagtgtcctttgtagcatcaaagtttttaattttggtgaggttcatctgtttactttttctttagttgcttgtggtttaggtgtatgtatttgagaaaccattacccaacccacggtcatgaagactggcacctatgtattcttctgacagttttatagttttagctctgatagctggacttttcactcatttttagtttttatatatggtgtaaggtaatggtccaccttcattcttttgtatgtgattatctagttgttctgtcaccatttattaaaagaccatctctctttcctcattgaatcatcttgcactcttgttgaaaatcggttgactgtatttacagtttattgctggactgtcaattttattctgttaatctgtgtgtctgcccttacaccagtataagatgatcttgaatattttacttttgtagtaagttttgaaatggagaagtgtaagtcttttaactttgttgttgttttttataaaaactattaacagttgtttattatcattatgaagtattatatactgtacataattgtatgtgctttgctttttttttttttttgagacagggcctctctgttgcccaggctagagtgcagtggtgcaatctcagctcactgcagcctccacctccttggctcaagccatcctcccacctcagcctcccaggtagctgggactatgggcacacaccaccacacccggctcatttttgtattttctgtagagatggggattcaccatgttgcccaacctggtctcaaactcctgcgctcaagtgacttgtttgccttgacttcccaaaatgctgagattataggcgtgggccactgcgcctggccaatatgtgctgtgcttttatatgactggcattgcactaggtttgtttacaccaacatcaccacaaacacggggggtgatgcattatgctacaacattatgacgtcactaggcaatagggattttttagctccattataataatgactaccatcatatgtgcagtccattgttgactgaaatgttgctatgcaacagataactgtattttattttattaacttttacgttcaagggtacacatgcaggtttgttacctgggtaaattgtgatcctctccctcctcccactctagtctcaactaggcctgtttttcccttctttgtgtccacatggatacaagtcttttatttattatcgaggaatttatagaaaacagaaatcttcccacattttttgattctactatattgatatatttgttgacagagatttttactatatatgtgtcccataagctttaattcacttttaacggtatcactatgagaggtaagtttatttttaggaaaattggacattttagttggttactgcttcagagaaagaagatggtcacttaaatttctggctcatgtcctcactaccaaatgcttccagatggagagcaccaaaatggcagattgtttcttttgagtctagaaaagcactcccttcactaggcttatccctattttggttgaattctacattgccttaatttaatgtaatcaatgatatttatatttatgtaaagaataagctgactataatgaatacccataccctgaaatttaaagtaacacaatgcccagaaagtaagtatgttctggttaatttaattgtctattcttagagttaacctgtcttgtttcaacatttgctaaaaaatcatttttaaaatgttttggttcttttgttgccttaataaatatactttatagtaaatataatttaaatattctttgagtcaggatcttacattattgcagagttttctcaccaacaagaattggtaatagtgatgctagtagaattgaccagccacaccagcattcctaacaaatctgcatggcactcatggtaagcttataaattggccacaacagaaggatgcataagatcactctgaagatcacttctttattttattttatttttaatagagacaggatcttgctgtgtggtccaggctggtctcgaactcctggatgcaagtgatcctcctgccttggcctcccaaagtgctgagccaccatgctcggctgaagattattttctcttgagcagtattctgttctttcattcaagggttcatttatgtcctgttctgagggtagcattttattctgcaagatacaacgaaagtatcagatcactttctcccttgaagccttattggtgatataaaacaaatatgtaaaacgttttagaatcagaagatcatatgattaaatactcgtgagagttcagaccatcagtattataggatttaagaataaggagagattagtgattaccaaccattggtaggcagcttctttaacaaatcgctgcctgaagtggactctgaaggatgagtgtagtttaggttctacagagtggaaggtacaagggagggtgacagagccagtatagtcctggtggaagatagaacaaagtgccaacaaagcaggaataaggatacagtactttgggaaggggaaaaaaatcagagtggtagatcccataggatattgaattaaatatttgccgagttcagcaagcagttgaaagtgttgcggtttttatctttttaaattcaattcctgacggcttgtttacttatatttttcttattcttttatgggaatgtcaaaaggtaaaaattagttggcaattttggttgatgttagttcattgaaaatttgctgggtttgtttaaataaattacagatttagagtataacctgatgcaaagcctcagtgagtatctgggtttgaagtgtcttgttggactttcctgatatattgctcttccttttttttttttttttcttcttaattacatgtgtggttttattttagaaaagccagtgaaggtttgaagagtataaacccaggtgagacagcaccctctatgcgactgctggcctatggtaagttagaaccacatggtttcattaaggaaaaaaatcatacttggcataaaagtcatttgcatcttttgtatctttgtagatttcaagtagttgtttattactgccttggcctattggtgtacatatttgcttattatccccgtcttccaggttccttttgtaaatgaaaatgattgcaagtgacccttacctgtatgtccattgtatattaaccaggtttgaaagttagatttttaatgtgtatgtaccctagttaactaagattttctagatgatgaaactgttactttctctgaatcttactttggcttttctaggagtactcttcatattaaagcagttaatatctctgcgtattacactttgagaattatgtttaagattggatctaggttccccacttgggctcaggaatacacagttcccctttacactcaatttcagttctaagccatcaaacttaactctgtagactctgttatcataaagtaagccggagttttggtgttgtatcctctgtctcacctatttcttctgtgcctttctagacccttttctcccctttttcattactctgctgcattctgccattcatttcctttcctcttcccgcttccctctctgattcatcatttagccaagcacatgcctctccagagccagctgtccactgcttcaggaagaacataagcaccctttcccctccaacacactttgtattaactagtccttggaaatttgacttgaaatcttggcaggaaaagagttaacagtgtttttcttcctgtttagtttctggcttgggctttggaatcatgagtggagtattttcctttgtgaataccctatctgactccttggggccaggcacagtgggcattcatggagattctcctcaattcttcctttattcaggtatgtgtctcatagctgtcaacattcaggcttctagtctaaatgatcattcttattggggttcactggcttaggaatttcagtggattggaatttatgttatgtcttttaaaggcgaaatactctgaggcactgtgaagtaaaagacttaggaaaataaaaattctggttagagtgttttagaattttggagtggaatttagcttgcgtaaaattttattttgctgtactgacaatgttgctatatagttgaaatgttagaagtgaatttttaaaggccatgtgctctttttggtttttatgattttatgttatcttcagtagaagccctaatctataattgtcattgtggtgccttttgtgggaataggcagtaaaatttaatctgaaattgagaggaaaaatgggataatagatgagttgatcatttcatccaaatgatgcagctaaaaggaccaactcatttcaaattgctttttcgtccacgagctaaaaattgtcatcatgatgcagtgatcacaaatttgagagttggtagcgtacataattaacatagatttcttctaagttccacaagaagactcttttaaaaatagggggagaacacccactgtatttttagtcgtttccacaacagttatgccattgaaataactgagttcacatcatgatttgtatcttcttttaataacatctatgctaaagctcctcagggagcttatcctctaataagggaataagagaaaaaaaagtgaataagcatttcagtaacactttaaggtaataatggaaaagatataaagaggtatgaccaatttttaaaaatttctgcagtagtttagaggcatgttgaatgtcatagtgatccccaagcccagtggacactcattcaccattcgcagtagaccctttgtttccatttcagttcaggccttgacatctcctctctggcttaccatcatctgccctcaactggttagtctttccttgacacactattcatgtgaatcctgtatgcaactacctaactaatcttccctgctgcaaaaatggtttggcttttcagggcctagaggagagagtcaaggccctttaaatctggctgcaagttagaggacaagaaagtgtgttaatgggtcatacttatttaatggtgcttccaacatagcaaattatctttcttttgaacatttcatcattggcatatttctggcaaatgtgttaatgattgattatactgagtgttaggtctttaaaacaaatgtaatattagtaaagtctgttagaacccgatgaaaattaataaaacataatcgtaaggggtgttagtgctacagtttgttttctgttttcatatacagttaacacggctctctctccctgctacagttttcttttgatatacaggttttgccagcttttttcactagatggtgctaattccctttagtgacctaggctgttttcatacgatgtttaaaatgattcttttggtagtaaaagaaaaatttgataccaatttggggattgtatttgtaatttctaggaattaaaggaaaaattcaatattcagtaagctatcttaatgtctttagctaagttagcatggcagactggctatgttataaatttgtatctatagaatgaaagaacagtgttgttttatcatttgcaagtttcttactgttataacatcattctttgaagcataaactttgaattataaatttaagaaattaatttgtattacatttaaaaataagatccccaaatttatatttattgtatttatgttatttataactacttgtaattaccatttatttagacacaactcatttttgccaggtaaatccataactttatatgtttagtatactccattacaaatgcctaaataataatcagaataaataaggaatgtagggtcactaattacagattaagcatttttaatccaaaaatccaaaatccaaaaatgctccaacatccaaaacttccttcaccgacatgacgccacaagtaggaaatttcacacctgaccttgtgtgatgggtcacagtcagaacaagaaaaaactgtttcatgcacaaaattattaaaaatattgtgtaaaattaccttcagtctgtgtgtatcagatatatatgaaatgcaaatgaatttcatgttttggccaggtgtggtggctcatgcctgtaatcccaacactttgggaagccaaggcaggagaatcacttgagctcaggagtttgagaccagcctgggcaatatagtgagaccttgtctctactaaaaattaaaaaattcagctgggtatggtggtgcccacccatggtcccagctactcaggaggccgaggtgggagaatcattgagcccgggaggttgagactgcagtgagctgtgatcgtcccactgcaatccagcctgagtaacagagggatactctgtttcaagagaaaaaaaaaaaagaatttcatgtttaaacttgagtcttatcccctaaatatctcattttatatatatagatgcacaaatatttcaaaatttgaaacacttctggtcccaaacatttcagataagggatattcagcctgtagtatatatctgtctatattagtatgtgttaataagatccatactatatgatacctgtgtgtacataggctcttatgttacaaacaggcatagtttataaataatgtttatgtataggttacttcttttttatttgtggttatgttgtaggctagcattaaattttactagaatcattaccatttcttggtaattttgtatagagacaaaagtatgggaattggaatcctaggttcgaatcttatcctggctcattaatttagtattttgggcaagtccatttgattattgaatcactcattccatacataattattaaatgtttttagtctaaaggagttataccaagctatgaaaatagagcccagttaccattcataacttccattcatagtggggaataaagacaaacagctaattacaataaagcatgatcaatgctacagtgaaatgaggaagagccatggggcacaaaggacaggctgtaacccatgctcccaggccacagtaccttggctttgcagcatttatcacaggcgtcattaagtaatggtatagttatttgttgaatgtctttttctccagttgggtgctaagccatgcaagtgcaaggacgacatctgtattgttcactgctctgtcctcggcatcttgtggagtcctttatttctagatggcactcaataaataacttacagaaaaatgaaagccaggcacagcttatggaggaagtgccataacgagtagagatttacttaaagggtgaataatagctaggcaggcaaagaaaggagttgtcagagaaagatgttcgaggcagagggaagaggcctctttcctccaggcctggaggtaagagcagtattgttcacagggcaaaggaagtcttgtccttccatctaatcttcaatttcctgatctttcaggaagggcagaaataacgcctagctcagagttgttgagaattaaatgaaattaatttagagaatatgtatttaagtgcttataagctctaaactggcctaagaatattattaaggtggagaatttagcgcttgagatgagaaaacagaattcagagagaagataatttttctagtattatatagaatctgggtttttcattccgaattacctcccttatgctttagaagaaaaaatgtctttagctagtacctagtaaaaaagaacagctgatcattttattttaaaaaattccccagaccatttcacttctattatattttctagacagtgcacttaaaacctaggcaagcttttaaactttttagccactaaacgtttcacaagggaaaaccaatatgggtcagaccacatatggagtgttgtattgttccaagcattgtgatttaacaggaatactgaagaagtaaaattcatatagaaagaatgttgtcagtatgatagaagatctagaagccatggcctgtgggatatgactgaagaaagaaaaatactgagcttgaagaaaataaaagaggaatgtgggagattatttttgtcccaatttgtcatttcctgtaataagtctcatggtggctggaatgttcttttctaccctttgactttgagctcagtcatgtggcttgaattggccaattagtggttatgatgtaagttagaggcttaaaaagtatttgcatgattggaccttccttcttggactctggtgccatgagaagaagataccttgggaagttaatggccacttagcctggacccttgaatgaatatacccagagccacacagagcccaccccaggagcttgcagcagagttttccagctgatcccagcctttatcagcaatgcacagtcagcctttagacctgtgagcatgagaataaatttttgttactgtaacccaatacattttttatctttcattcacttttctattcgtaatattttaagaataatctctacagtgtggcagtttgttaaagtttagactcgactgaaagctctttgtaagcaagactatctcaatacctacatttccaaattccaaagtagtagagaaagtataacatctcctaatgatacagaaaaaatgatcaacaatagattgtaacctgcagttcttatccttttatgatttcattagaatcttaatttcttgtaataagttgtcacaactaactgctactgtttatgatacagtgatactctatacgctgtatatatcatcgaatttgtatttttcattatctgttttctctttctctttttttctaagagataaggtcttgctctgtcactctgtcactggaatgcagtgttaatgatcttagctctctataaccttgaactcctgggctcaagtgatcctcccactcagcctcccaagtagctaggaccacaggcatgtgctgctatgcccagctaatttttgtattttttgtggagatgggggtctccttatgttgcccgggctagtcccaaactcctggcctcaagcaatcctcctgcctcagcctcccaaagtgctgggattatagggtgtgagccaccacgcctggcttgttttctttatatcaatagtgtaagcctttctttccagctgctcaaataactgagaatagaaaattgtactttttggaatgcactttcattaaatggatatgacctatcatagtctctagtagcttgtgatacattatgaaatgcacacatcacaggcatcagtcttcaggcagtgtgtaagcaggcagctcagtgtattgcttcacagtctctagctgaaagaatgacatgggctgcggctgtaagacttgatggctcttctaggtatgtttcaggccacactgaatcactgatgtctctttcctcacacggatgaatggctaggctctgctgactacctttcggcgcagttgaatgacttgcacttctccattctctatagaccttgtttcttctcatgggtaaaattgtccttattttcgtcagccactgctgcctttatttttagttatttattttattttattttacttttctttttttttttactgagaccgagtcttactctgttgcccaggctggagtgcagtggtgcggtctcggctcactgcaagctctgcctctcgggttcatgccattctcctgcctcaccctccccagtagctgggactacaggcgcctgccaccacgcctggctaattttttgtatttttagtagagatgggggtttcaccatgtaggccaggctgttcttgaactcctgacctcaggtgatctgcctgcctcagccgcccagattgctgggattacaggcgtaagccaccgcacctggcctgtttttttgtgtgtttttcttcttcttcttcttttttttttttttcttgagacagagtcttgctctgttgcccaggctggagtgcagtggcacgatcttggctcactgcaacctccgccttccaggttcaagcgattctcctgcctcagccttctgagtagctgggattacaggagtgcgccaccctgcgcagctgatttttgtatttttaggagagacagggcttcgctatgttggtcaggtttttctcgaactcctgacctcgtcatctgcccgctttggccttccaaagtgtggcctatttgtttatgttttgagacagggtcttgctctgtcacctaggctggagtggagtggtgtgatcatggctcactgcatccttgacctctgagactcaaacaatcctgccacttcagcctcaagtagctgggaccacaggcacatgccactaaactcagctaatttttttttttttcctgtagagatggggtctcactatgttgtccaggctggtcttgaactcctgggctcaagtgattctcctgcctcaacctcctgaaatgctgtacctagccactgctgcttttaattttcggtgttttgggggttttgtttctttttcttcagtgaatttcacagacatttttttttttgtagccacagtgagcaggataccatattacaggttactgtcctgtagatatgattgcatgagacaaaagtcccatttttaaaacatcatccagtatggtatcactcttcactcagccccataggaatacatattttattaattacatctaatatttatcatttgaaagggaaaaaaaatcccactatttccaactttattgctcagtctagccccgccccccggcaacctctcagcttgatcccatgcagctccatggccatgttgggaatttggcctgggaatcccagcatttatcaacctcctccatgcccacttcttaccaaagatgttcttcagtgctgggaccacttgtaccagttcacttttccccctttccacagctctgctaaagacagtcgtaaggttcacgtcagggttcctgcattgccccacttcccacttttaggggaatggttcatactgtaacatgtttcacttactgtgcagtgttccaacactatttcctggaaacaaacttatttgcataaatgtttggaaatctcttgtttctttggaggaattaatcagctttgaggtttactttaatgggtggatttattggattttactgccttttatagttattcgaaaccctcaccaaagacttatacttgaatatttttcgtgagatcaaagtcctttgtttcgggtggtaagctacattttcatctctagtgaggctttctccctacattcagtggacaacaattttaaatactgctgacttcttatcagaaattctggaaggcagtggaacaaggtctttaaaatggtgcactcctgcacccttcctcatctcagttaatggaattccatccttccaggtgctcagttatttcttagaatatttcctgattcttccctttttctcccataacttacatccattccaactgtaaaccttacctgcaatttccatctaaatcttcatccaaggtcttatgggcttagctttgctttataaatggcatagatcaggtttgagagcttgtttggagcaaacatttaaagaaatggtaaatctgattttgctgaaactattctaggctagagacaaacatagaaattaattagttttgtgaagtcagtgaagcattaatagaaagtaatagaatcccgagaacctgtatccattgcccgctgcctgaaggcaggtcccccattaggggattgtactccaggctgccttgggcctcatgatcccaatggcagctctagccagtgagtttaggcctgttttttgttttgttttgttttgcagcatttttgtgacagtagctggttgctgcagggagtttcaaatgttttttaatgtgctacatatagaaaaaaagagttgacttgtggttcttcaaagagccttctcaggatcagtgagcaggagttagagcagggtttctcaacctcaccactattgacacctggggccagatgattcttggttgggggctgacatgtgtgttatggggtgtttaacagcacccctggcctctgtccactagatgccagaagcacccctgtcccccagttgtgataacccaaaatgtctacagacattgacatattccctctatgggccaaatcatcccagctgaaaatcactactgagttaaaagaaggcagatttgggttcggtttgagaaggaactttctcatagtggccatttaatgaaatgaaattggaagtattttggaccatgtgggttatcttcattgtgtagaggacgggatcagacaacttctagcaaacctcccaatgctgactccacagtgatgagctaatttgaggagagtgtttcataattcttcagcattttctagggggactttaaacattaaaataatgtcttagagaaggttatttgattagcaatctatatctatattacagtaaatcaggccgcagaattctcttacattctttaaaacaaaaatgttaagttaaatccccattagagaaagtcattttcaaaagcattcattcagctctggggcccgactcccacttgtgccagctgactgggggatctctcaagagtctggagagtttctacggccaggatggatggaggagtgtctcctgcttcatggaaccctgaaacccctgacctttctactacttagaaaaagaagccaaaagcccattgatcttcacatcctgcctctgggcagctgcggctgagctttggccttgggaagtcctcctttgtctgtggctgccaccacccagcagcagcctttggcttgctctgacttagttagagataccctgcccgtgttaggggaagctaggtgatggcagtttctgtgctggcaggaagccagtattagacgcaattgctgtcttaggccattagctttgcaaggacagaaaaataggcatcgggaatgagggaaaggaacacgtgtgaaaatgaaggtgcttatgaatctgtgtgttagagcatttggggtatattcaggaagggtgaaggagccaaatagtaaatgttgtttctttttttttttttttttgagacggagtcttgctctgtcgcccaggctggaatgcagtggtgccatcttggctcactgcaacctctgcctcctgggttcgagcgattctcctgcctcagcctcccgagtagctgggactacaggtgtgtgccaccatgcctggctaattttttgtattttttaggagagatggggtttcaccatgtaggccaggatggtcttgatctcctgacctggtgatcttcctgccttggcctcccaggcgtgagccaccccgcccggctgtaaatgttgtttcttgaagataacactgaaacgttttgcttagaaataggttagaaatattcactaccaagatactttgacttagaagtttattagaagaggaagtccattatcgactagacagttacagtcgtcacaaactgatatacagtacttgttagaattattccgctttctgattaatgtattacaacatataaaaattatggaagctccttttattaatctgggttataaactaacgttgatattcttatggttaacttagggaagtttttttggcttaagaatattagaacaggctgggcattatggctcaagcctgtgattccagcactttgggaagctgaggtgggcagattgcctgaactcccaggagtttgagaccagcctgggcaacatgacaaaaccctgtctccacttaaaacagaaaaaaattagtcgggcctggtggtgcacacctgtagtcccagctactcaggaggctgaggtgggagaattacctgagccccaggaggtggaggctatagtgagccatgatcgcaccattgcactccagtctgggtgacagagttgagaacctgtctcagaaaagaaaaaaaagaatattagaacaaagcaaatttgggggttagatttactgaaggacttttagaattttatatttaggaacattaactgagaaaggtttagtaattaaaaggttgtactctagagatactattagcaaattttcattactagctggaatttgttccttttactaatgagaagggtttaaataggatgtatgtagctgtagccacgtgtgtgtggcagaatgatgcagatatccgggtctgtttctgttggacctcttaaccaactgcagagggaggaaagagtaaatcccggcattctaacatagcacgtcgtgatagtgaaggctgtgatgaccatcaaagccacccggaaacgagagctgactgcataaatgagccgagtatgaacatagcacggtattttaatacatgtccaagggatctcttctagatattgtgttaataaaatggtaaactgaaaggatggggaaaggttctatgagactgtgtttcatgtgttgtaatagtcccagtggctagaaagtgcctggcccatgctggccactgcagacatacttgttatgtgggttgatgaaagaggggaggaagaaaataaatgtaagagtaatacaaagtcagaggaagaaataatctacaagaatgaagagaaatgcatttttgtttttattttttatttatttttttgagacagggtctagctctgtcacccaggctggagtgcagtggtgtgatgatggctcgtgtagcctcaacctccctggcctcaggtaatcctcccacgtcagcctcctgagtagctgaaactacagctgcacactgccacgcctggctaatttttgtatttgttgtagagacagggttttcttatgttgcctaagctggtttcgaactcctgggctcaagtggtccacccacctcagcctcccaggtgctgggattataggagtaagccactgtgcctggccaggaatgcatttttaagacatagtcaagtacccaggagacttggatataaatggtcattgctggctgctgtctcactttctcacctgatagtacaactcactgagaactctggcttatttgtctttgaatctgtagaccatagcacacggtagctaccacatattaaaaagatatggattgccaagcactgtttttccttgtaacagccctatgtggtattatccccattttaaaaataaaggaaatggaagctcagagagtttaaatagcttgtccaaagccacgcagtggagctgggattctaactcagaaccatctgactctaaagataatatatataatcttcaggccaggctgtctaggtgctcagtagattgtgttgaatgtaaaaaaaaaaaaaaaggaggagggtaggtgttaggaaataatttacggaggagaggtggcatttgaactggattgtaaataaaagtaagattcggatgtggtgaaatggagaggggtggtgctgaggggcagagtcttcagacaaaagggataatctatttaaaaagaaaaaagaaaaccagaggtatagacagagtgaagaagagttctggttttcttccataggatgcagttgaagatagtagagaacatggtgtcaaggtaattggggtgtagattgtagaggtccttgaatgctagtctgaggtgtatggacttgactttggaggcaaagtcaatccatcagacttcttagtaagaaggaccaagaaatatggacctagaatttggaagaaagtcagggctaatgatgtcttgaggatgcttgcctaaaactcacagtaatgctcttttggacaagaggagactgaaactcctgtaaatgagagaatttttgttgttttgtttttgttttgttttgtttttgagatggagtcttgctctgtcacccaggctggagtgcagtggcactatctcggctcactgcaagctccgcctcccaggttcacgccattctcctgcctcagcctcccgagcagctgggactacaggtgccctccaccacgcccggctaattttttgtatttttagtacagacggggttttaccgtgttagccaggatggtctcgatctcctgacctcgtgatactcctgcctcggcctcccaaagtgctgggattacaggtgtgagccatcgcgcccagcccctgagagcatttttaaatgaactgtaggccttgactataggagcataattgtgtctcagtgtccctggtaaacacttctttccccactcagtattggtcgcaaagaaagaacatccaattggaaaaggcaatcgggttttattccctggccagaaaacggagaaggtgagctcttgtgctaaatgtactttctccccaagcagtagaaggcatagggggactaggtgtggggcgggaaaggaatgtgagcatgtatgggatgggactccagacgtgaaggtgctatccatgaacatatgccttcatatattatatgtgcatgaaatggcagggattttctttcaggggagggagttttagcattgtaaagatatgctgatgatctaaatgcaaataggagtcacctattccagtttgtgctggttttgcgaggtcttcctctggtatctggtcaggggtcaagaagctctggtgccatctcgagccatctggtttctttaagcagctgtgcctattgataaaggaactaaagaaaaacagttaaaaaaaaacaaaaacaagaactaaggacctttcccggttatttcatcagggctgccctggtaacatcaatattcagaaagaatggcaaacataagctgccaaacagatgacaccttaatggtgtcattgctttctcttgacatttgattgtcatctagattctgaaaaacccttagaaaatgaacaccttatgatttctttaaaaaatcagtgtttccatttgtgtcagtttctgtcttgatcttttctgacacaaaaactttaaaacttaaactgcactcctgggcatcttcagcggtctcagctccccgccgtcaccaagcatctctctccagggaggcctccttttccggggtcatcaccggggttaaaatacatcactttagcttcatctgccatagcgtcaaaactttggaaactgtttctcttctaatttagttaaaatatctaccaccgtttactgaaataattacacgtttacaccagatataacagctttctttcatcacaacagttacgtcttttagttttgcatgttttagaattcatatcaatgaaataatacgcattttttcacgatacggttttcttttctacataacattagattcttgagataatttatatcgtagaccatatagtattccattgtgtgaatagagcaggatttatttatccattctggtaatgatggacatatttcattattacagacagtgctgacttaaacttatatatgctccttgtgcagatgtgtacgtttctctagagcaatggctctgaaacttgaccgtgcctcagaatcacctggagggctgtttaaacacggattgctgggctcccaccccattgtttctgattcaggaagtgcggggtgggtccccataatttggagttctaacaagttcccaggtgcagtgatctattaatttcagaactaattgcttcagagtctagctctagctgcagaattgctggagtgaaatagagaatgcaaattcctctttaatttgtaatgctagactgttttcctatcagcagtatgaaagagagttgtcagacttgaatttttgccagtctggtgggtgttaatgatttcttattatgtggctgaaagaggaaatctagatgcctttttattttccatgttaacctttgcagaatatatagggcttgcccactttaaataaagactgttaaccagtacacaagatacacagacaacatacacacagaggtagtgttccccagaaaaaacctggtggtgctgatcaaattcagtgccagttgcctaagaagcattgtagataattactgtgattttaaatatttttcttttctttcttcttcttcttttttttttttgctctgttgccgaggctggagtacagtggcatgatctcagctcactgcaacttccgcctcccgggttcaagtaattctcctgcctgagcctcccgaatagttgggattacaggcatgtgcctcccgaatagttgggattacaggcatgtgccaccatgcctggctaatttttgtatttttagtagagctggggtttcaccatgttggccagctggtctcaaactcctgactcaagtgatctgcctgcctcggcctcccaaagtgctgggattacaggcatgagccagagcgcctggccatgattttaatatttttccattgctctttttcaaaaggatccgaggaaaaattccactttagtgaggagccttgtttaaacagaagatactccttttcattgaagtctctctttactcgtgcagaaggctcactgggaaaaagctggctggacatcacagtaattttattgtattcctcagggaagctgcctgaaagccagatcttaggcgaccttttattgaacaggtttacattctagacaagaagctgtggcagtcagtcccctgttccgcagtgttgctttttgagtgtgtcaaggccctgtttctgtcaggtggtgttaaactctcttgctgaggtgtggtggacaccccgagagcccgtgcacagtgccagggtcctcagtggttctgatacctgtaggagtgacactaatggtcggctctctttcagctttcatgacgctggtcattatcttgctgcatgtattctggggcattgtattttttgatggctgtgagaagaaaaagtggggcatcctccttatcgttctcctgacccacctgctggtgtcagcccaggtgagtgttgccgccatgctcagactgtattctggaactcaagtctatgtatctaaaatggtaaattctactctagatgaaatacacgctcatgagaacatgaggaaattcagaaaagctatttaagtgaatgaatgagtcatgtaagtcttaccacaaaaagaccaccactattaattttttggtgtgtcttattgaaatatttttttccctgctgtttatttgcagtgatttgtctctctctaacctaggtcagtttggaaaactgttcattctctgtgacagctgcgtggaaaagttgcgtattccagactcggcaccatgactggaccttattcctagctctcgtataacacatgtgtccttggctagcatattttatttaatatagtttttatctctctctctctgtttctaattagagtatgataatcaaggatggggccttatcttcaatcttcgtatcctcaattcatggcacatagtaggtggccagtaaatgttggtgtatattgaatagttgatactattctttttaatgattaaaaggaaagaacctaggaagtttgaaaagtatataccaaaatgttcatagtagttctctgtcagtggcagatttcagagaatgattacataattgttttattaaaataacacacctacagaaaagcacacaaatcagaaatgtacatcttgatgaattttcacagtgtgaacacacctgtgtaactagcacctagatgaaaatcaaaacattctcagcccccaggagcctccctgttcgaccagtcactgcccccactgagggtgaccatgacgctggcttcaacaccacagcttggtgctgccttttggtatttctgtcaacagagtcacacaacgtttgctcttgtgtctggctcctattgctcagcatgtttgtgggattcatcttcacatcactatagatggctcactcattgctgtatagtattctaccatgtgtctataccataatttacccatttgacagcagagaggcattgatgttgtttctagtttgagatggagtcttgccctgttgcccaggctggagtgcggtggcacgatcacggctcattgcagcctcgacctcctgggctcaagtgattctcccaccacacccttccaagtagctgggactatgggcatgcgccgtcatgcctggctaacttttaaatttttttgtagagatgagctctatgttgctccggctggcttcgaactcctgggctcaagcgatcctcctctctcagcccctcaaagtgttgggattacaggcatgagccaccacccctggctttctcattcttatctattgtgaatggtactgctgtgaacgttctaatgtatatctcttggtgaacacacacacacacacacaacacacacacacacacacacacacacacacacacttcttttgggtatacgcctaggagtgggactgctgggtcatggggtgtacatgtgtcgactgttcataccactcaattttcagagtgatggtatcaccttacactctgccatcagtttacaagttgtggttcgtccacctcctcactgcattctctttattgttagtcgtcctgctggctatgtcatggtatcataaatacataaattgataaattatagtaaaagttttcatttacgtttccctgatgattaataggttgagccccatgttgtgtggctccgttgacagaaataccaaaaggcagcaccaggctgtggtgttgaagccagcgtcatggtcaccctcagtgggggcagggactggtggaacagggaggctcctgggggctgagaatgttttgattttcatctaggtgctagttacacaggtgtgttcatgctgggaaaataaggttgagcaagtcttcagatgtttattggccattcggataattctttttgaagtgcctgttcaaatcttatgcctattttctttttgatttttaggagttctttatgttttctgtaaaagaaaaaatcttttgtcagatgtatgtattgcagataacttctgtggcatggtttgtctttacattctcttaatgtctttcggtgaacaaaagttcttaattttatatagtctgatcagtttttctctttatggtttcactttttgagctttttaataaatattaacctagctgaattttaagttttaaaatttgttctatttttctcatttttgggttgtaattttctacaacaatcatgtattgcttttgtaattgtttaaaagaggaaaaatgttttttaaagaagagaagaacaatacaaaacagtgcagcactctgtaaaatgagttaaaattcagtggatttgaggtatagaattattgtgaagaataatctagaaaatgctcaatgcctgccatgcccacggaggcctcttgagaagagcagtctttctgcataaggtgctacctgtaaaatctaccactttcttcaggccttctttgacagccctaaggagatcaccttgtttttacccatcctagcctcatcgcaattataattatgctgtcctagcattcatcacaatttgtgactaattgtttcttcattcattacctgcctcccttactagtacagaacctccattaggatagaaactttggtctcaccaaggtgtacacagtacctctcagcattccattagtgttctttaaatgaatacacttttggaacccacagcaattgtgcaactgaaaaagactattccctcatgttcccttgagtactaaggattcatactaaagtaatttggagttgtctcactttcttgcaaattctaagaaccaatttaacacagaaatgaatagaaactagttacacgacatgcatcttgtattgtatattccattaggttctgcctaatgactgccttctagggttaccatctgaatacagcaaaacacgggacccacagtatctgctgaccagcttagttctacatgcctcagggccttaacgcatgacacacatcatacgtttggtgaaacacacccaagttcttgaaagtattccatgcttccctttatctttggttattccacatgtttaataagcttgctgttattacccaagctgatttatttttcttttgcagaccttcataagttcttattatggaataaacctggcgtcagcatttataatcctggtgctcatgggcacctgggcattcttagctgcgggaggcagctgccgaagcctgaaactctgcctgctctgccaagacaagaactttcttctttacaaccagcgctccagataacctcagggaaccagcacttcccaaaccgcagactacatctttagaggaagcacaactgtgcctttttctgaaaatccctttttctggtggaattgagaaagaaataaaactatgcagatatgcgttccattcacttggctttcacacaactgctctccgaaaggggtgctcagtggtgtgcgtcctggctgcacgagaatcacctgggacagtgtaaagccgactgattctgggctccaccttccagagctaattggcctgggcacgtggtgagttttaaaagcttcccaggtgattctgatgtgcagccatgttgagacccactggtttggtatccaaataggagcttcctgagaacaccttaagtggatgagaatctggtctttagctgtctcctaactcaactcgtgctgagcaagtaagtatctgaatgtcaaatcctggttatcttttatcttcctaagttctgaagtcacaaaaggctaaagggctatcacccctgctcactgtttgcgtgtacttcaccatcttaggagaacacggtaggttgggcttctaaatgcaataataaattacgctgactgtggtaacttagccaaagtaagatactgattaagccgtatttttctgaagtgcttccattccaggttttgctttctgaggcattacattgtttttgagtatagattacattttattaactaaaaatgattgttttgtgacttccttgggaaggtattttaaaatcaggaatttttatgcaatgtctataagcctgtttaaagctttccatgggctctgccccaaggccgttggctgcagcgttcaccatctgagtgccagttgctggactagttgaggtgaagtgcattgttttctctctgagcagctgtgcggggagctgagtgatgtgccctgggacaggcttcactggagctggtggaagtataaccagaagcacaaggaaatgagccaaaagggtgtcattgacacttttcatttgctcctgtgatactaacaacactttcacccaaatggcttaatgtaatattggaaatagatcttaaactgccaaatctcacactattgcataatccatatgctctttagatctagtcagtgtctctgggttttggtagcagatacagcgttccctttacaggaatacccaaggtgttctttcagcttccagacaggtcctttgatttcctttataaagggaaaattctggcaaatcgtgcctttactattagaaattgttcccagttgatgtcttttggggagctggtggcatgaaatgcaaatgacctatacattaaagtgatgtctcagtgaataccatacatgcagtagaacattcagaagagaggagcagcaatcctgaggggctgggggagtgacagtggcaggacggatgggcgggtttgacagattgtggtgggaagaagaatgatcatgtttaaagctaacatagccagtgttttgggctagccacacatcattccagagaccaaaaccttactcatgaactagacctttatcgatatcagtgaacccccatgtttaaaatattagaatgtttagagataaaatagagataatagagataaaagaagaggagggcttctatcaatgctgtaaacagtctgataagcgactgtggttattcccctaaagtttacttcagcactaacactagtgcttccgctggagtttgcagttttccagctttatacaggattttcctttgactggaagagtcaaggatatagagactcaacagtgacatttattgtacaacatcaaggggaataggatactcatcaaactgggattattcttatcaaaacatggtcttctttgaataagaaaaatacatagttggttattatggacttaaaactgtgttaaatggatattctgataaaatatttgctgctctgtagagtgtggaaagtctgagaatattagctttactcatcttgagctttgaggatgttctctgtacgccgatggtttcatattaactaaaaaagctgggtattgtaaaatctcatttataaaaactcagatgagaagaaaattttctttgatggtgagactgttgtcttagttcaggaaattatttaataatcctttgttacctgtgaatgaaggaactttgtaattctgatttatcgtaaaacatgagcctttccagagtcagcttagacactgttgtcgcaaatagccatgctttgccttatgccaaggaggcccagagggagggcctagtcttcctctgttgctgtacatatattgaaatgcttttttttttttattttgcatttgttatctataatgagctttctgagccctgatattatgtgagacaaacaggagttattgatgttatacactcccttccattcaggattttctgcttggagggaaatatgttgaccttagagaattgtgaatattgttgcaattcttgaatatattaccatgtgaataatagagactgtgttgctctctagtataagctatatttatttttgattcatttgaattactagttataactggagaaattttgttacctctatcctggcttgcctgactggctgtataatagcagcagcctcttttagagcatcttaatgaaaacatggatgaaaggaattaatgatgatatctgcagactgcgtagaaaatggcttttgttcccagcgttaacattttcttctcaatcacatttcaatgtttgtggagagtggcagattcacaccagaaacactaggtgttcatatccatagcatggatgcagaataagcagttgggagagaagcttcttcctacctggtactcctcccattcacctcagcccagccccagacaggcgttagcattcagtgtgggccctcaggcagccctgaagcctggctgggtcatcagatgggggcagcctgtgacgggcaccagcggcctgattccagggaagagttcctggagggtgttggctgtttttgttagctcagtttttttctgggctccaccattcctaactccaggtagacaagatagatgtcacacacaacaattttaaagtattttgcttagtgcattttgtttatgattgcagtgtttgtttcttatttaataggctttttacttcattctattaaattttagtgtttagaagaggcgggtactgtcactgtgtaaaatatgtaatattttatatgttataccatgtcatatatacttgcaatatcagaccttgcattcaatatacaatgcaattgactctttgcagacctgcatttttcagtgaacaataaaaagattgtctggcactcctcatttcctgtgtttcctgttctgtggaatggtgtatccttcagtatgttactaccgtgttttgtctccttatgaaacttggatgtacattctgttgtttatgactgatcagttcagagacttttttcaaagagaaattctttatctgatttaaaactcctaaggcttatttcatatctgtgtgtttaggagtagtttggttcagagcatttccttgaggtatcttaaaccaagccgggggaatcctcaaagatcctggaagcttgctttgcaaaatctcctaattgtaaaatggtgaatttaaagaatgtttgtataatagtggctaaggattggagtccggtgaagaggagagtacaatttagcttttacctggtgattctgagtagcctatagagtccttttctctttctttcccttggtgaggagacagtgcagctaaagggttgagcttggcccttgccatcagacaggatacataggggattatgatacgatactcaaaaccatttgatgcttgttcactctggcttgaaatgaggctgttgcaggctatgttgatgacgttattggatgaaacgttctcaggtcccaagggctctttgcttctaacctgtaaaccagtggaagaggtgggcattcctcaggtatcagcccagattcctgtacaatttcattggcccttaaacactgaattttggttctaatttaattgttacttgtttggcatttagttggaatggagatttccctatgaccagcctcaacacatgagaaacctctaatggaaagaagtgcatattttactttcacctctttgaaaatgctgaatagaaggaacctctggacaggttgtggtcccagtctcaatagaagaattagatacattgtaaggtgaccataatagattatgagtcccaagcagatcctggctttaatgctcaattaatttataagtggtacttgttgcctcagtgtggatcgctgtaaatccttctagctactagtaaaattacacattttttagagcttgcacaaaatcagatgaagtttacagtgcttattcagggcttaccatgcacagaatactgcttaggcacttcaaaaggatggaaaagaacgagatggtggggatctttgtccttggaaaacatataatctaactgcacagattaaaacacctaagtattattttaaggcaactacaaaatgcactacaaattatggaataatatagaatagcttgactactaagatgatgcttaatttagaagtggatgaagggcactgggtagtggatatagataggtgatagctgaggactgaaccctgggggcagtcaattgaaaggttggaaaggagagaagaaggaaggaaaaccaaaggagtgcagtggcttgacagccagtggggaaaggatgtcaaatgctgctggataatgggtaagaagaggagagagaattgattgttttgtatggagagatggaacttgctggtgatcttgataaaaacaagatggaaatcagagtgaacacctgaatagaatggattgtacggaacaggagatgaggaagtagacacagcattgagaacacaggtattgtagagcagtgggatgatgaacctaaggaggatgtgggggaaagagagtttttttttctttttttccttatgatgtagactgtaactgtaactgcatgtttatgttaagataagaatgactccatagaaaggaaaaaatgacgtaggagagggataggatagttgccaaagcaaagacctgaaagagggaatagagagggaaattcttttatttatttattttgatttttttttttttgagacagaatctcgctctgtcaccaagctggggtgcagtggcatgatctcagctcactgcaacctctgccttccaggttcaagcgattctcctgcctcagcctcccgagtagctgggactacaggtgcgcaccaccatgcccacctaatttttgtatttgtagtagagacggggtttcaccacgttggccaggctggtcttgaactcttggcctcaagtgatctgcccacctcagcctcccaaagtgctgggattacaggcatgagtactgtgcctggccaagagagggaaattcttaacgttaaatgcttatattaggtaaggaaaaatattcaaaatcaatgacctaagcctctacttaagaaactcgataaagaagagcaaactaaagctaatataaggagaagaaatgaaatcataaaagaacaggaaccaaataaatagcagtaaaacaatggggaaaaatgaaacaaaaatctggttctttgaaaaaaaccaataaagctggtaaagctctggccagatggaaaaaagagaaggcacaagtatcagtaatgacaggagacgtcactataggccctacattattaaattaataaaggatagtatggataactttaatgccaataaattttaaaacgtaaatggacaaattccttttttaaaaaaacccacaaaattcactcgagaggccgaggtgggtggatcacctgaggtcaggagtttgaaaccagcctggccaacatagtgaaaccccatctctactaaaaatacaaaaaataaaccaggcgtggtgatgggcacctgtaatcccagctacttgggaggttgaggcagaagaatcacttgaacccagaaggcggaggttgcggtgagctgagataacaccattgcactgcagcctgggcaacaagagtgaaactccgtctcaaaaaaaaaaaaaaaaaaagaaaagaaaatctgcatatccttctatgtctgcagactttgttttttcttgcctcttaatatgccttgtaattatttgttgaaagctagacatcgcctcttgggtaataggaactgaattttaaaagccttgagtgtaaattttatgttaatctaggtaggagttggattatatttaatgtttgctgtggctgttagtgccagaggcttcgaattcctctggtggtcttgtttttgtctccccttttgactgtggagttccctcagtgccccttttcagagaaagcctgtgtcttgcaactcgttcagctgtaatccactgtaaattaacactagagccctgttggtatggcagtgcgatgtggaggaggggacatgtataataataaaattataataataaaatctaaatctcagtattttcatgggcctgaatccctgggctgagagtttcttaactttttcccccttagataagacaggaagctagaaggtggctggagaagaaaggtaactttccccagctgggttacggctttggtaaagtctttttccttggagagaggcttttgttgtggaaaacactctggatgtattttacaatgaagacagtatttctcacccttacactagtccatactcagactccagcaatttgtcaacattagcatttaagtgttactaccagtttatggctccagcagcttgcactccaggtaagcaaatctcagctgtgactctggattcacctctctctccagattttggagtggtggtttaccctgagacctcagttctctgatgggttcaaaagaattgttgatttttccatttgcttagctttttcttgtaaggatgggagtgatggcttccaagctctttatatgttagagctaactggacatcctctgtatctattaaatacgttgaatttgtagtttttataaagaaaacaattattaaaatgtacatgtttataggcaatatagaatcactattacacataactttttgttctgtaacaactaaacaaaatgtcatgattgaaatttcaattctccatattaaatggctatatacacactatgaaagaatacctggtatgccaatatttaaattttttgataatttatcaaagggataactgaacttgtgtcctgttaatttacctaatctagatcggattgataacagtgccactcgcagggaataaagttgtgtgaaatgtttctgtttatcctactagataccaacatatatcacaaatctgcactcatggatatgaatgtagagtttcagaacaggcccgggtatatatgggaatttcatttatggtaaaattggcattttaagtcagtggggaaagcatatgttattcaataaatgggtctgtttgatcatttatttgattatatttgggaaaaaaaagcaaagctaagtttttactttcacttatttaaacatattaaagattcaaatgcaaaaaataaaaccataaaagaatcttttaaaattagaatagttttatagtctaaaggaggagagcttttctctacatttcacttaggctacaaactacaaagaggaaagaaaacagatttgactacatacaactttaaaactgcagtgcaaaagacattctaaacaaagaagacggggagaaatatttttgacatatatagaattgtcacctataatatataaaaagcttctataattaaaaaaattaatgatacagtaaaaagagatcaaagcatataaacagataattcacagaaaaaatgcaaacagtcaataaacataaaacaaaatgctaaaccacgaataataaaagcaaaacaagaaaataattttggactatcagattatcaagggtgaaaaggattgataataacaaggattgttgagcatatggtagaaacgacatattatgaaaaaggatattagtacaaccctcgggtggtaatttagcagaatctgttacatttatgcagttttgagatgtgcatattttgaaccagcaaattcctcttctaggaatttgtcccatagaaatggtgtgtcagaggaaaaagaccacaaactcacagttttttctattctctgaacaagcaagcaatcagttctgctgcagacaccggctgggtgtcctctaattcaattccaacactgtctgcctggagatagcatcagatcccacaggttcagggctcagtccccaaaaccacgctcccttcagacaccagttgcatatccaggcctcctgaacttcagactgaccaacttcaagttggggttcccacaaccctgctttggggttcaattaatttgctggagtggctcacagaactcagggaaacacatttgctggtttattataaagtgtattataaaggatacagatgcagagattcataaggcgaggtgtggtggaagcgagatacagatgcagagattcataaggcgaggtgtggtggaagcgacacagagctttcatgtcctctctggtgtgccaccctccaagaacctccacacggtccactattgagaagcttcccaaactctgtcctcttgaatcttttatggagacttcattacataggcatgattgattaaacctttggccattggctgtcaacttaatcttgagcctcctctccttccgagaggttaggggtagtaatcaaagacccaaccctgtaatcctgccatgggctttctggagaccagccccatcctgaagctgcctagggactgctagctttcagtcagtcatcatgtacaaaaagacatctctttggagattctaaggttttaggaattgtttgccaggaaacagagatgaagatcaaatatatatttcacagtatcacagaaatacatccaagtacacatggatcttgtaatagtcttgtaacagtaaggaatttgcagcaagtgcctatcaatagggcattgcatcaagcagcaggacattgtatagccactgaaaagaatgaggatatccaggatgtgctagaaaacaaaagcaagaataaaagataattctttcatccaacaagtatttcttatgccagacattgtgctagatactgaaaatttaagaatgaaaataggcatgatgctgggccttgtacagcatataatatagaatcctattaatacattttattaaaaatttaaaaatgagtataaaaatacatatgaatatacataatgtctggaaaataaattgttagctaaagataattgtttagcctaacactaaattgttaaaagtgactattttgggagctaggattatggggggactttctgctttatacacaattatttgcatttttcaaaaaaataggcatgcattatttatgtaatcagacaaaaccataatctaagcactttcatgatttctctttgtccttggtagaaagtggatattattcaaggtcttttgtaatctgatcccaaccacttttttctgtctcccacctgtaaaccaaagaaaaagaccgaggcaagcctcaattgagaggtttattttgtcaaggtcgaggatgcacctaggaaaaaggaacacaaatcacaggaagtctgtgatccatgctttttccaaagagggttttaggacttcaatatttaaagggaaagaagagaccataggggaaagaggaaagaaagaaaagggaggaggggggctgggcacagtcacgcccgcaatcccagcactttgggaggccgaggcgggcagatcacgaggtcaggagatcgagaccatcctggctaataacggtgaaagcccatctctactaaaaatacaaaaaattagctgggcgtggtgggcacgcacctgtagtcccagctactcgggaggctgaggcaggagaatcgcttgaacccgggaagtggaggttgcagtgagccgagatcgcaccactgcactctagcctgagtgacagagtgagactccatctcaaaaaaaaaaaaaaaaaaaaaaaaaaaaaaggaaagtagataaaaaaggcaagaggttacattatctcaagactttgattaggctttgattcgtgctcactaagtctgcattttactcatgaaaggagggggtagaggaacagtcaattatgcattcatcttgtgctccgagaatctgcatttttctgtaagataaacaccgagtagaggaagcagtcaaatatgcatttgtctcaggtgagtgaagggatgacttctgtctttctcccatacctgtgaagatatgctgttaatttacattgtcgggggaaatccaacagaattgtttcagggtaaatatcttggggcctacaaggaatttccttgtaagcaaattatgtggaggggggctcttcctggggagggacttggccctctatttttgcagctagctatttagaaacaaaatggaaggcagtttttgcatgactcagttcccaaactgaacttttccctttggcacagtaagtttggggtcccaagatttttattttccttgcacacaccattcccaaccctcctttctcagacattctcaaacacatccgtgaggtctcctctactgagatgcacgttgactctcaacctccacattttagttcttgtttttagctccaaccagaaaatgtcctattcctccttcaagatcctgctcaaatgtcacttcctttgggaagtctttcctgattaggcccagaaaagcaaataaccttttccactgtgatctctttacactttcctttaaaatcaaggaacaatttacatacaataaaacgcacagattcaaagtgtacagctggatgaattttaccaaatgtgtacacttgtgtaagctccaccccaatcaagatataaaacatttccttccctgctggttccgtctcccttccagatcatccacaggggcaaccgctagttcccacttctattgccatagatcagtttcatttgttgttgtgggttttttttgttttttattttttttttaaacggagcctttgtcacccacgctggagtgcagtggcacaatctcagctcactgcaacctctgcctcccaggttcaggtgattccttggcctcagcctaccaaatagctgggactacaggcatgcgccaccacacccggctaatttttgtatttttagtagagatggggtttcaccatgttggccaggctggtctcaaactcctgacctcaggtgatccgcccgccttgacctcctaaagtgctgagattacaggcatgagccactgcgcctggccagtttcacttgtttttgaacttcatatacgtagagtaacacaaaatgtactcttttgtgtctggcgtctttcactcaacataattttctgagatatcctctatatttttgtatatatcaagaatttgctatttttattgctgaatagcattctattttacagagatactataatttggttagtcactcttcttttgatggacacatagcattctgtacatactgctcttctgtacagcggggctggcaatttctgtttgtgtttcgggaaaagctctctcaaactgtgtttttcctctgctctcataccaccacagtaatatcaacgcagaagaagacttccatgaccagaggtgtaggttttttcaccacacaccaagcagcagacgcgggctgggtgccctccaattccaacatgatctacctggagatagtgtcagatcccacagggtgggagttcagtcacctgagtctatctaacctgccccctttgtttcttctctctctctctttctttcttttgatggagtcttgctctgttgcccaggctggagtgcagtggcacaacctcagctcatggcaacctccacctcccgggttcaagcaattctgcctcagcctcctgagtagctgggactacaggcgcccaccaccacgcccggctaatttttgtatttttagtagagatgggatttcaccatctttcccaggctggtctcaaactcctgatctcaggtcatccgcccgcctgggcctcccaaagtgctgggattacaggcgtgagccaccgtgcccagcccctgccccctttttttctttcctcttttccagtaattcagtcgttgtatctaaattatgcttgaatcccgaccacttaatctgtgtttagcagacaggagtagttcattaaatctttacttttgaataaggaggtatgagaaaaagttagttggaagttagtttgaataatagaagggggttaatccagattttgtccattgattaaaaaggagtgataagctcctgggctgcactgcttagtggctgtgtgctcctccatggaaaggatgtaccatattcaggaacacttttcaaatggttatgtgttgagtggttgaggggagacactagatgcatgagatctgttgttggatatccaggtagcttcggaaactagtttcagcatatgaaggaactggttatgttacctatgtcactagaaagttctttgcttcttccagagaaagccatttgactatgtcatcatcaacaaagttgctatataggtctcagtctgcccttgaccccatgggccctgtgttttgttgtcttcattgctggtcattaaaagttaatatttgaaatgagtgaacccaagcagaaataatgactttgacttacaatactgagaggtcatagccaaccatgcgaatagagcatgctcctttctggcctcccacccacagggcgagtccaagggaagtatggactcgccctatgggtgggagcccaggaaggtgcattagaccagcctttgctgagcttcttctctagagggaccaggaggaggtaagctctcagtggaaattccaggatgggactgagtatcgtttggctgtgtgtgggatggaggtggtggtgggagggacttctttttttttttttttttttaacagattttttgaggtataattgacataagataaatggcacatatttaaaatataacattagaatcatgttcacatatgtggagaaaccatcactgcaatcaagataatgaacatatggatcaccttaaccatttcttatacacttttgtaatccctccattccccaccccacctcatccctaggtgaggcaatctgctttctgtcattagcactgatctgctttctgtcattagactgtacagcattaagaaatttgtattaaatggaatacagtcatgtgccacataacattttagtcaatgatgtatggcatatacaacagtgttcccatagattataatgaagctgaaaaattcctattgcctagttacatcatagccatcgtaaaatcctagtgcagtgcgttactcagatgtttgtggtgatgctgatgtaaacaaacctaccacactgccagttatataaaagtatatagcatatacaattatgttatatactataaatgtatatgctgtacaattatatagcataattgtatatgctatatacttttatatgctaaaacgactctgttatggtttatgaatttactacactgtactttttattggtattttagagtgtattcctacttagaaaaaaaaagttaaccctaaaacagcctcacgcaggtccttcaggaggtattccagaaggcgttgctattcatagatgacagctccgtgcatgttattgtccctgaagaccttccagtgggacaagatgtggaggtggaagacagtgatactgatgatcctgaccctgtgtaggcctaggctaatatgcatatttgtgtcttagttttaaacaaaaaagtttaaaaaaaaatttaaaggcttatagaaaaaggatataaagacagaaaataacttgtacggctgtacagtatgtttgtttaaagctaggtgctattataagagtccaaaagttaaaaaaattgaaagtttatgaagtaaaaatgttagagtaaatttattattgaagaaagaaaagttttcaatcaatgtgtagcataagtgtacagcattttttagagtctacagtagtgtatagtaatgtcctaggcctcatactccctccactcactcactcacccagagcaacttccagtcctgcaagctccattcatggtggaccatttttaatctttataacatttttactgtaatttttctatgtttagatacaccaataccattgtgttacaatggcctatagtattcagtacagtaacatgttgtacagctttgtagcctaggagcaataggctgtaccatctagcctaggtgtgtagcaggctgtactatgcaggtttgttcacacgacgatgaaatctaatgatgaatttcccagaatgtatccctgttgttaagggatacattgttaagcggtgtgtgactatatgtatatatatatatatatatatatgcactatatagagagacacactattttgtgtgtgtctctgtgagtgtgtgtgtgtgtgtgtgtttattccttctctccagttcagccttaggaaaagggaaagcttgtgaacgtgtcctcgggaacttggtttgctgaattaacaggtgaaggtaacatctcaagagctcagtagacccttctgcccaaatgcagttggcagtccttggtcaggcttcacctgagtggaggccagggattagagctaccaagcagattgcaggtgggaggttgtggttgactttttggaagtcattagtacaaatgcttttagtgcctttagcccctggggttttacaaggtcaccgcgtgattgggataagcacggtaaactctacgaccagaaggtgtttccatgccacgtgattgggataagcacggtaaactctaagaccagaaggtgtttccatgccacgtgattgggataagcacggtaaactctacaaccagaaggtgtttccatgccacgtgattgggataagcacggtaaactctaagaccagaaggtgtttccatgccacgtgattgggataagcacggtaaactctaagaccagaaggtgtttccatgccacgtgattgggataagcacggtaaactctaagaccagaaggtgtttccatgccacgtgattgggataagcacggtaaactctacaaccagaaggtgtttccatgccacgtgattgggataagcacggtaaactctaagaccagaaggtgtttccatgccacgtgattgggataagcacggtaaactctacaaccagaaggtgtttccatgtcactggggctgtggagtgtggccctagcactgtcactaaaaatccgagggctgtgggagctctgggagcttggcttagccagagccacctcctctttcccacttggaggctaggggcaatcctgcgcctgaccctgggttgtgcaatggagtgaaggggacttagggcggtcaagagccagaggcattgccgaattcctgggtggcttgcagtcatcatgatacgctgacctggttgcaatcatttttatggtgaattattcaatacagcaaagtaatctggcccttatctctgcccagtcattctataatgaagaggcacggggtggagcccggggacaccctcggtggcattgtcgggccacatacctttcccctcacatcctgcgacagctgaatccgagcccgaggaccacgtgcggggcggtctccagtgtggatggcagcccggctggaacgcactggcaggtggtccctgtgccccagaggccccgtttccttccggaagcgaggctgcaactgctccagatacccagcaggaaggccacgtgacaacgggaggggcactcctgtgtgtgtaggggcgagggggtggcggtgccagggtcctgcagttcaccaggtgcccacgtgcctgccacccgagcgccattcactcccgaccgcggggacctggggcacagccgggcccactgcggcgaggcgaggagatgtggggagaggaagagcggcgtccacgatgtgctcatttaggcttgattttcctcctgccctcctgtctccctccctggcttcacccacaaggctttcttctcgggctgatttctgtgggagctctctaggcagaaccctcagtctctgaaagtcgggttcgtcgtccgggtctgcgcagggcatggatcttgagcgcttggaatgtgacttaactgagaaacgctactttattttaataagtttacatctaaaagccgatcattgattccattatttggaaaacaacttctaagtgtgtttggagcaactcggatattggaatcttttaaactgtaaattttatgaaatctaaataacgaccaaatatctacaaggaaaatctagcatctgaatcgagtgtgctgtcagtgtaaaacacacaccagatttcaaagatttactgcagaaaaaaacacatgaaaatactggttacatgtggaaatgatagtattttagatctgttggattatctaaaattaaatttaaattaatgtcactggtttttttttttttacctttttctagtgtggctaccggaaagtttaaatttcatacgtgtctcatgttatattttattacatttctctcggcctgtgtgctctagatggttgatttggctggattgagatgaggtgatggccatcctaaaggagggcctgagttccctctgccgacctatggctctcactgctatgcctccctgatcattcagccagtggatgtggaattcagggagatgagagatgctcatttcctgctccaggagtgctctccccagtggggtgggagcaagtccaaggagtgagtgcttcgtgggaactctggcttcccggctgtcttcatgcctgtgcgtggccatgacacctggcaggatgccagagcagggagagcagaagcatcctgtgttctagcagagtacagaccatcagaaatgtttcaattccaaagctgggccaggtactgtcacccactggagccaaagtacccttgaacagttcacctctctcaggcttagggtgattatagtgaaaattggatgcttttctaaataaggcaaacaatgatggtacctattttataacctttactggactgcctctttttgccccagtcagaatgtgaagtctggatttagacaaaagattatttggacgggtgatagtatgttttgcaaaaagaattcaaaataaggtaacaggcaaccaagaggggctgcccacctactaggtttaatactctcaggagtaaagagacataggacctgttccctgtatcatgtccccttggttgggaacacctccctcttttccatccatctgttcaaatctgagctatttgttcaaggtgcagctccgatcccacctcctccagggtctttatttaattcctctaggcttcccagcaccattaagcagcttcgcgacctgcagccacacatgccataggcctccatcctcaggaaagtgattgagtctatcagcttattttcctttggagccaggttctaagaagtggatgcgagtgacattattattctgattagttacctatccccataacagggagctacagagtgctttgcaaatagtaatgctttaacctcgcctccaaaaaaaaaaaaagaacagcctgatgtgaaaaacatttataatttcttgtagttacagtgtgtatcttcattataatcattcttacaataaatacagaagtgctaaacagaccattatcacagtggcctgtgggctgaggcacaggaactgaggggtgctgcagacaccagtgcttctccagggctggccaggacaccttcagagaggctagtgaagaggagaggaatgtagggtgaatttgaaatgtgattaatagagtcaatgcagcacatgctagaaacagatacagagttttttgttgttttttaactattttaccagatgatactaactaaacaaacagaacaaagaaagagattcaagatctcacatgagtgagaatccagggccttcccctctggccctggccccagcctgggccttgtttttgctatttccacctaggcatctgccatgcagcagagttaggagcgtgtgggcggctgctgagactcacacaccacagtactggcatccttcaggggcagctggcatcagtggaatgagtgcggatccgaagaaaggtttcccagttccaaagctggacccacaggaatcctgtgaggatttgcaaagacattgatagtgttggttcttggagcatctttctgcctcccgggctttgtctggtctcagcctcggggctgcaatccagggctgtgctgagcagcaagaggagaggagaaatgccactgtcttgcacctcccagtaagtctcccttttcatgaacagcccttgtgccaggtacaatggtctctctgttctctcacaaaactcatccacaaaagatatacagagtcttttgacagacagtcccactgctctggagtcctttatgttcatttctgattgacaattttggaccaaggccaagaggccccctaattcatgttgcttcgtcatgagggttgtccttgtcatctgatgatgcatgaggcatgctaatggcaaggccgggatgccaccccaggcttcgaggctgttagaggtcttgagtgcacacacacacacaaacacacagagagacacacacacatttgagctcccattaggtcacttgtaactttgcctagcaaaacaggctcccaagacataaggcttgccatcgttgtgaaaagttgtgatggtacagaataatttttttttttttttttttgagatggagtctcgctctgtcacccaggctagagtgcagtggcatgaccttggcttactgcaacctccgcctcctgggttcaagcgattccagaagagagaattcttagagtcagagggaggagtagaaggaaaaagatatttaaaaagctatgcttcaagaggacatttcatgctgtcaaaatgagactgtgaatcagaaagttctcggggaactgcaaggtgctctcaactaggggtcggttccttctcagtcatggcactgactcatctccacagggttctcacctgcgggaggaaaatggaggagttgcgcctgtcagaaactgtctgtgtgattcggggaagaatatggagtatcttagtagcattccattattacttgcccctaaatacatgatgccagccccctgcacagataacctcctgcttttatagcttgaaatatatttgatctaaaccacgatttgacatcttcagagagagagaagtagataaaagtctccattccaggttggcagtagggatcctgcagaagtggctgaaatgaaatttggcctacagagaataagttctacagtcattttgtttctgcctatttcctccagattcaaaggcagattgggtcatctcggaactcatgtctcctccaggacacagcaacaacacattttcaaggaacagcctcattatttgtaaaatctgtagagtataaaacataactgctccactgacaggaggttggatttggacttaatattgtattattctgtccttacattatggcttgataaacagaatgtgattccaattctgattccaaagtgagactctcccagatcatccatgtcttctcattctctttgtccctctagctctctctcccttctcatccccaccaagaagtggaacttgaacctgccattccctaaggtctgtgcagtgtctgtgatccagaggacaggactgtgaaagtgtccctaatatatcacaatgtatatctcttgttttctttttctctctacaacttgatccttcctgtccccatttgtccccgagttgtaaggtgcagattaaaggttttgtcatagcagaaggaaatcagagggagatgccccgtctccagaggaaagaagttgagtttcccaagcaaaacctaagcagagagtgcacattcttgtctgaaagcttggagaagcagcagaatttccaggacacttgaaagcacgctctggcaaagccccggatgaaagtgttttccaaccattaatggcccaccagcatggcttggtttgtgattccagaattcagaccacttcacaatctcacacagttacagcaagcagctttgaattcctgctgcttggtctgagagtgcatcccatccatcgatcggatggctctggggtggccatggtcccaaggcaaggaggcacccagcagaggatccctgaggcctggcatgtttgcagattgagctacagagaacaccttgaggtgtcgcaagtgtccagagagccgaagtgtgtagggtccaaagcaaggtccttcctggatgtgcccgggagctccggggacctcaagcgtgggcctcagtctccatcttggtggctggcttgtaaatgactcccttgttatcaccttttttgatactagaacagaaagaacacataactcttgttagagaggagagcgagcgagccagagagcagcctgactcaggtatggaatgaggccgtttttaaaagttggattcctctctttgggacctttccccaattctgttggtcttgggagggagtgtcaccaaataaagctttaacaaaaacagaacttgttcgttttccaactgttctctttcacacctaacagtagtagacctatattttgaaagaggtctcgttgtcacccccctcttcaaacctctgattccataacagggttcccagaaacctttttatttttcataccccccccaaataaattaggttttaggaaaagccaaatgtcacaataaaaacatggacaaagggcatgaagagttaatgtgagtgagagatcaggttttccttcatctttctttttgaattcatagaccaaaaagcatatgtaaagatcttgataagaagacagcctggctgcttaacttcaggcacaagccccaagtcaagagactcgtccaaggccatgcaatagcagcaagcaaggcacacacgcttccaaatctgagcacagtgacccctgaaccctttgaacgaccagggtcacatgtgcgtctcatgcaaaggaggccagggcacgggtgctttggggacggccctcctagggtaagtggtggtccaggtgactgcggctcttcatgccacaaagctgccttcccaggcagactaatcatcatggacacatagctgtccattcccattttggacccaaaccagctcacctcttccttctgaaaagccaaatggacaccaccaccacaatacagatgccaagaatgccagccagggccagtgagaggatgatgcctggtgaagaggtagagggcacacattacattccttccttcccctccatcttagcccatggcccccgggtgtgaaatcatggcccagctgcataatcatccacagaaaggaataatttccccatccctgttctcagattctggtctttggcttagtgggactggctggagtattttgaggtggccgtttgcaaattctagtggttttccagcagatgctctcaaacttacacaagggtcatctgaagagcttgtttaaaatgtagggttttttttttttttttagcccaacccccagagattcaaagtcaatctgtttggtgcagggcccgggaatctgcattttgccaaatacttacagctgatactgatgcacgtggtccaagaaccacactttgataagccctgggctacacaaataagaacttactctgtctttgcctgctggatttaaggcccattggctgtctccatcagttttgcccccaagttccattgcacagtcctaagcagtcccagatgaccagtagtccattgccaaggtcatgcggcctgtcagctgacctccacaatgggctctggtatgttttcagcaacagcctcccaccatgaccaaaagaaagtcttagataggttctttgaatacacacatgctgtagagtgattggatctttcattagaggaacatttgattggcagttcatctttgaatcacagagcgacttgagggtaagacccatagcaaggagagggccaggagccagagcaatagtacagagaagcagagaggacgggcttggatcacaccaagaatcacagtgatcacccagctgcagcatgcacggctggctgcccagccacatacccagactcagtcctgccgcagtacagacttgcacttaaaaggggagaggaaaagacgaggttactctagagtcaaaccacactggatttgagcagcgtgttgagagacgctctaccatttgtttggtcttaggctgacagacctctagggatgtccacccttggctcagggattgcctgatgaagtacaggaaattgcccatctagggaattcatactgcaatccctccttccgatgctccttttttttttttttttgagatggaatctcgctctgccgcccaggctggaatgcagtggtgcgatcttggctcacttcaacctccgcctcctgggttcaagcaattctctgcctcagtctcccaagtagctgggattacaagcacctgccaccacacccagctaatttttggatttttagtagagacagggtttcaccatcttggccaggctggtcttgaactcctgacctcattatccacctgccttggccttccaaagtgttgggattataggcgtgagcccctgcgcccggccccgatgctcctttatcacaacagtttcctggctagggcaagacttcacttgagtttttgtttgtttgtttgtttgtgttttttttgagacagagtctcgctctgtcacacatgctggagtgcagtggcacaatcttggctcactgcaacctccacctcctgggttcaagcaattctcatgcctcagcctcccgagcagctgggactgcaggcgtgcaccacaacgcttggctaatttttgtatttttagtagagatggggttttgccatgttgaccaggctggtctcgaactcctgatctcaagtgatccacctgcctcggcctcccaaactatggggattacaggtgtgagccacggcgcccagccaagatttcagtttttaatacaacatggccaaagaggaaagatgaagaaaggtagggatcaaagcctgcttgggcaggctcctgtccatgtccctggtacctgcctcacttcctaagcaaggaatccatcaccagacttctcccccagcccatcagcttgtcatcatggtttggttctatttttgctttgtccctcctggacaaacgccttcaccacatcagccccacttctctgctccatggaaccagggtattacggcttcaaccagcaagttactgttgaggataaataaggtgagagagaagtcctcagtgtggctgaacccgtgcccagctacctaagtctcacagtcagcctactagccacctcctggggggaaaatcacatgagaatccattgtcttgagtgagcagaggatcccagtcatgaagtctcccctgaaaaccctcagcctgttttttccaaggttcccacagccattccccattctcctaatcaggtcctttgtctaaagaaagtgtagatttacaggtacccttctgtctggtggttttctcatctcaatggaaacttctagcatgtgtgtgtgtcttggaggaagaaggggtatttgttctaactcacactgggagccacagttgtacagatggtggccacccagcctgacacagaagatcctgtgcccatagaacccacagtggtggctgaggccctgggagagccctggtcaagtgtaagatgccagcagggggccaaggactctcccttggggcccttaacagcctggggaaccagatctgaggctgcagggtgaggttttgctcactgccccttctcctgtcgtatggcccaagtctagctgattccccaggagccatcagccgtgtgcttttccgattgtctttttctgcaatctcacattgaacctgcagagcctccctggtccaaggctgggccctgggggttcctggtctggcttccccaggtggcaccgggctgctgtgagggttagcagagcaggcagggagaagagctgtccccaaggacagggaagcctattctccctactctgctcaccaccaccagctgctcatgacctcccaagtggcagagtggctccactggccagactccctgccccaggcctcttcgtgtaacctgaacacaaggaccagcctgtggcttggggaggtactgaggacatgagtctccacctggagggagcttccagtgtttgtacagcacaagctctgtttcctgcagggcctgtggcctctgcacagtggaacttggtattagggttggttgtttcttttttaaatgtaaccagagaccatggtccctggaatcttaaaaaaacaaacataataaacctagccatggtttttcttcccaaccctttgatgaaatacactctcgttctttgttcctgaagctccagatgcttgtggtgccaaaccagttctcgccacctgaagactattactaggaagccttaccacctggctaagccatccaggctggatggtttctaaagtcatctctttcacagtcacctcaaacattctgagagtcacacaggccccagaccactgagcagcccagtctgtggctggtgggggtacccttcatgcctggtcttggggagctgagcaaagtctatggagagcaaggccccagcaagggtggggcttttctcagggcacatgccctgcgtggtggcttctctggagggagagtctggcttcccccggttattacgcggggttcctgttggaggtcctgtaagcaacagcatagttgaacccagtgctgtgacctgggatctttgctccttgaggaccacttgtcaaggcctaaatggactctccttggaaacaacgaaatgagaccaaacaggcatgaagacaaagaaaggcccagagactgggacagatacttttcagccaagactttgatacagcaaaaacgaagcagcttgactgagccaacatcataagctgttaaggaagaggaatgccggcgagggtgtcacccgatagttccaccacctcaggaagcccagggcaggaaggtgttgttggaatgctgtccctgccaatcgagacagcaccaaccatcatggaggctcagcttctttgcagaaatgggcttgagtcccattggaggcagatgccaaaacatctgttatctgatgggagagagaaagtcagcgagactttcgggacacagggagaactgtcagggcaaccagagaactagaacctgagtgcgaagccaaagcctgtttcccagcagagcctcggctgggtgagagcgaagcctctaggcactgtagagaacaggcatcaaagatggtacagggaggggcagaactagagaaattcactttcaggttaaagaaatggtttgtttctgaataggaaagaagggaggcgattcccacggaagaacaatgggacagacagtagaaatggagacaggctaggtcacagaggtggcccacgagaggcatcgagtggcagcccaacagaaggagctctggggctggctggtaagagggtgcacaccatgaggacgtgggagagccgcctgttcacaaagtgctcgggtatgactcagggcgagcagagagacggcagtgtgacacacacaaggaaaccacacagatatagaagaactcgatggtcacacaccttgcccaggaaggtacagacacccggagaaggtcggtgagctgcttgccacaagggccttgctacctgttctggcaggcccaggagctgcgtcttccaccggcatcttgctggactgagggatgctggttaagggcttttgaggtcttctgaagcctcaagcataaacacagaagagtccagcacgaggaacaagcacctcactttcacatctggaggttcctggaacaacagtctagtattttctagctctatttacgattctgtttgactgtggactataatccttttcaagtattattttaaagtacacactgtttacatagatggcatgttacgtagcgatatccttagccgtctccagccttgtaaaagaggtcagagagtttagatttatcaggggtttgatagtttaaatacacaaaatctgttaggaaggtaaaaagccccttattattacacctaataaaaaatcagagagtcaagaaactgcaaatccagtgctatcttcagatgatgctttgccaagacaaggaagatgccctcaccacagagtggagccatcttcagaggacatatttaactgcggagttttccttatgaacgctatgcaacccaaaacaagaattgctacaaagaaatctgccaacaagatagtaccagattacatgggggaactggttttatacagctatgatgggactgagggctttgcctgtagattacaggaatgcagcccctgcagacagcacgttgctctgaagggcctaaatcccagagcctcaggggcaggttacaatgctggcacttggtgcttggcactctaagctgtcttcactgtccctggggaaagaatgggtggtgggacgggggcctttgatccctatcaagccagagctacagaaggcacaacagcatctctaggcaacttcctcccagaccttcaaaactgacagctaagttctgatcgttaatctctcttaaacaaatggttgatttttaacattgttagcaaatggagaccacagaaaaacaagacaataaaacgaaaaggtgacaactggccaggcttatgtgtaaatcattctgcagagaagacactgaggaggggagggaactggagatgggtcagggacattctttcaacaagcttatattgagcaccaggcaccatgccaggcataaaaatgagtaacacgtcagtcatccctggccttaaggagcttgtagtatgtgtataatatgtacgtattgttctttttctattcgtctttgctgtgtggtaataattactctatggtgtgtcaagtaacataacagagatggagacgtggttctggctgcactgagggagattaagtcacctttagagggatggggaggacttccaggaggacgtgattagagttgggtcttgaaagaattttccagatggaggagggagggggcatcccagacatcaagtgtgtgtacttgaaagcatctgccctacagttttgggggctgaggctaagagggcagggatggggctgtggggagatgatgtggaaggatcggctagggccccatcaccaagggtgggtccagccgtctgcccagccccttttcccattgtctttcctgaacatagtctgccctgtgccacgggctgtgtttaagagcaagatgacacccaccatggggttttctgtcccccatagcgcataactcggactgtgctcgggaaacatgtggtgtgtgaaaggcactaggacctcacttcttagcaccttggaccaatgctcctgactgttcggcctctgacccagaccagcgactgaaggtggaaatgatgctggctaatcatttggatcctttgggagaatcgatgatattctttcagctaatagctttttcttattaatggaaactttaagaaatacaaggtcaataatgataacacatgcattctagcctcaaaaaattagataattagccatcttagccatgtctgatttccttctccctccttttaaggtttcataaaattgcccaggtctaggcttaagcagatcctaattgcaggactatagatttgcccttgcggtttgctgcctggcacccttgtctgagtgtgccatagctgctctggtgggtgacatgcagttgcttagagcaagcccactaatgatgtgattatagaaacttcttggcttccttttgtccctcaagtttccatggccctgacatgttgagcacagggctagatggtgttagcatttttgtctgatgggctcttgcttcattacccagcatctgggcccagtgttggtgccactggctaggaggaggtgaactcaaaggaaccaagaaccaggccaaagccctaagcctgagcccctgtgatgtccccctgcctctgccgtctttcccctttcccactaagagcacctgacttgaaacccgaactggcctgaggacgtgtcccctcccaggggcccaccttgaggacgagtcttgctttctccttcagctcaaatcttccaactgccacttggaagaggcactttttttttttttttttttttttttttttttcagatggagtatcactctgtcgcccaggctggagtgcactggtgcaatcttggctcactgcaacctctgccttctgggttcaagtgattctcctgcctcagcctccacagtagatgggactactggcatgcaccaccatgcctggctgatttttttttttttaagtagagagggggtttcaccatgttggccaggctggtctcgaactcccaacctcaggtgatccacctgccttggcctcccaaaatgctgggattacaggcatgagccacacccagccaatggaagaggcactttttaagaatggaaaaaagtgcctgacatgactttcacttttccataaagagtggacgttttaactaaaggcaacaagaaacataacatacaagagagaaaaactcatacaaaagggagagagaaaaagaataaaggggggatcctgaagaagttgctacttcagaggcatctgcacccctgataaaggatttgtacactcctaagggtgcacagttctctctcacgctacgtctcttggtcttacccaatcatataaaaaagaatctatacttgaattctaaaggaagatggggaacaaggtctctcttgggttggtttgttctgcctcagtaacttcagccttactgtttcagggataaccatcatcacactgaaatgttcatgccataaaacaatgaagaccagggcatgtgatataaaactccagactcctatgacatcagtgaaaacaatgagttctgggccgcagaaaccctggggcagtggttttccatcaggggaaaacttgcccctcctgcctgcacagagttggcaatgtctggaaacagttttgcctgttaaaactggggaggggcaactggcatctactgggtagagaccaacggtgctgccaatgctacaacacacaggacaccccccactgtaagaattatcctgcctaagttgtcagtagtgctaaggttgagaaactctgcccccaggctaaggtgtagctggactataaacctcttaaggacagaaatcaggtcctgtaccccttttctaagcacagttgaggaaaatagcagggttaagttaaatgattcggtccaaattgtcccaacctggctaaacttcagatccttccccaaagtccatgtactttctctcatagggaatttttttttaatttttaaattttaattatttaagagacagggtctcactctgtcacccaagctggagtgcagtggtgtgatcatggctcactgcagcctcaaactcttgggctaatgtgatcctcccacctcagcctcccaaagtgctgggattacaagcatgagccaccacacccggccatcctagatgattttttaaacatcacttttctcctggcagaattttctgactctgtagttcttgttaacttccagagaaagccctgagtaagccagaccctaattacaaacatgcctcagtggatgaggctacaatttgagtccaaactgctcaaggttcacactgacaaagtctcacaccgtaaacctgaaacatcatgttacagtctgaggcctgctccgagctgggtaagaaaggcctcgtgaatgcagccccctgggcagatgaggtttgggccttcacccctttgggactgcctcctcattgctccttgggaagcagccgcacttgctgcctgtgtctttgggaagtgaaagggaggggaggagaattctggccaagcttctataatcagcctccagatggacaggttttccttggactgccacagagtctcactcagaggagaaagctggtcccaacctgggcttgtggaagcaccagctctgggcaaaccgtggaggaagagcagtggcaacgctgcatttgggctttgatcttgacgtcctaagctgggagatggtctccagacttctgcttagaggcccctcaagctcccctatccagactgggagaatctactgaagcgcttggctaaaaacctgcctacgctgccccactacaagcagctgcttagacacaagccggtctaagaagatggctaattatccccaatgccatagtccatcgttacaagcgggggttacttttggatgtcagagtcaagctcctgcccggtttcttctgatcctctgtaactgccctcaaacactgtccctgcaatgtaaagtcaggattggcagttgttagtgtccacttaaccatcacaacatattagcaccgaaaggacatgagatcacctaatccaacctggctttttttttttttttttttttttttgagacagagtctcactctgtcacccaggctggagtgcagtggcatgatcttggctcactgcaacctccacctcccgggttcaagcgattctcctgcctcagcttcctgagtagctgggattacctggcattttgtggctgaggaaaccaaggcctgaagaagggacacgatttgtccacagcctgcagccaggaggaagcaaagccaggccttgaacctaggcctcctgactgtaaggagaatatgtgccaccccttccctgggtgtgcataggtgagctcagagaacagagccggcaatggggtcctgggatcgcgagcaaaattctatctgatctatgtgggcaaagttcctaatctcctggcagagtttttatgtttttggttttaagagttgaagtagttccatttaacccttggatactacattctccacttagaagaatgagaaaagacagcgttgtatccataacagatacattccatgcactcagttcatttcctagaaaagaaactgttagttatcatcacatggattttgaattttcaggaaggctactgttcacagattctgttttccaactgagaaactgaggaaagagggaaatgatcttaattagttgtacctggagaggagaaaacacaaaagacaaattcttgggcagttcttcatgaaaagacagagaatgatgtaatcctgaccgtaaggatgggtcagtttctaaagcttcctggaaagggccttcaaatacagtctccatatgttcaactaagtttaggaggtgatcgttataacctcatataataagaaaggaacccaaaaaagtgcaccaggtgagacgaggagagcagattctgacaagtgggttaacgggtttcttttgtttttgttttttggtttttttttgagacggagtctcgccctgtcacccaggctagagtgcagtggtgtgatctcggctcattgcaacctctgcctcctgggttcaagcgattctcctgcctcagcctcttgagtagctgggattacaggcatgtgccaccacgcccggctaatttttgtatttttagtagagacgtggtttcaccatgttggtccggctggtctcgaaatcctgacctcatgatccacccacctcggcctcccaaaggaggcaagacaccgtgcccggctaatttttgtatttttagtagagatggggtttcaccatgttggtcaggctggacttgaactcctgacctcaggtgatccgcttgccttggcctcccaaagtgctgggattgcaggtgagaacgggttatctttaaatatgaacgccaggcccggtttggtccacacgtgatgctggggatgaaatggaactgcacagaccagccatgaagattcccaagctgggaagcagtcgagaatctacagtaagaaagtgagcttgaaagtgaactcagaggtctgaagaggggtgtgggccccaaaagtgctccctcacccctttcccctgatgcccagtttccagcagtgttgatgtaggcactgagcaaggaaaacggttaatgttctactggggagttattggttacagctgtgaaagggagacccgagcccttgtagcattaggaagaaaccaagctattaagttttgttcaattgggaacttatgtgcttgtgcttatgcaagctccaaggaggttagacaaaaatgcagtgcacaagggtgcttccttgcctaacaggccctgctacattagacatggttgtgggttacactcactgttttacatctaacataggaacattcttgctcatttggtggtggtgcatgaatcacctggccaggcctaagataggctggctgcagcctttgatgccaagaaagcctagggagggaagttagaagtctgatctcatggaaagggtcctatcctgtgtcttagagaagggatcattgtctggaacagagaagtccccagggaattctctcttacccatctgtgcaagactcccaggcttaaagagtgctctggtccatgtgcctgggggcctcggctttttgcttctctgcaaagactcactgaaggggggaccccagtgagccccacacctagtctcacaaggcgcctggttcccgtggcagccagggagctctcagccaacttcttgagggcatcagtgccagagctgcattcacagaagatcccaatgtcttggcaccacactcccgcaccccctccccccagcactgcctctcctcaccttgggagaaggaggtgtataccagcctctcatcgaacttctggacctgccggaagttgttgatcatttctctgggggaagggtcgtccatgtgtgtgcagtacagggctgtctccaaagccagcagctgagggcaagagcagaaatagcccgcaggcagaatgacctcctcacctgatcccctgggaagaggctagctctccgctcttgcacctgggagaagcctctggaaccagcttctgtggggccgggtgggagatattagaaagcagagggaaagccacagaactgcttccctccacagtgggtgagtgggagctgggcagcgctgggtttatcttcccagcacccgagacttcagggaaaggcagtgctgttagtttccaattatacctggaatctgccctgcgtggagggaaacctggggtgatggagtgctccttaacctccacagagactgagttcctctcatgaacttaaattagaggccagctctcaaccagagggtcgcagggcttgttctgatggtcatatcagaaggaataaaggagggagttaagagtttcacaggccatctgattgcgggttccatggcattttcatgcacctgcatagattatataaccctttcccaaggcagtttctgaggtaggatgttgctgcttccccacatgtttcatccatctcttggttcatcatgtcctcattcctgtccacccacctgctgccatttaccaggtgactcagagcagaagcttactgtaaagaggagcagctgtgaggctgccctggacgcatgaagctggcgtggggctgtgagccagggtgtagtgctggccccagccccgtctcctggggagccatttttcttctcatgaatttaggctgtggaggacaggtatgagcagtgacatggaactcagatgacctaactttgggtctcagctttgtcactaacccgcgggtgatcccacagacttctactcttctctctcatctcctatcaaataagaagctttagaggtgatggctaaggattttgttccccagtttgcactagaccttgagcttcttgggggcagggaccctcacttagtcattgctgcaatcccatctcttaaatgatttcatctgatcctgtctttattctgccctgtaaaggaaccaggctctctcctgcctgggaagtgaataccacccagccactgaggatatattagcaaatgcagatttagagctcttttttttaaaaaagaactaggagacatctattcatttgcctagcttgacttcttttgaagctcagcctggaatttctgcggtgctttcagacacctgtgatatttggagaggttttgaagagctgccaatgaaactaaatgaggaaatcaagtcattgattgtgatatggaggatgatggggactgaggtgccgcgtggactctggctgagtctggcacgacagttacctgctcctgggaaatttgcacggggtttcggaaaactgtccagagcacagtggggttgcaagggggtgtggtcagggacccccggtagcggtaatattcagcggtcctctccggaagcagctcttcaatgttgaatcccgggacgaatgcttcctggcctagagagacatgttgcagaggtgatagtgtcagcctccctccgtagggcataagtgcagctgaacagagcgactgagcctagaaacatgaactagcccctttcagggtcatctaaccccaggacctggttgcaacattgttcaacaacctgctgctcttaacctggtgaacacagacagcacctgccccttgtgtttgcttttcttaaagtcacacagggctgactacctccttctccagcagagagtgaatatgcatgcaaggacccctcacctttgtactttacatgttgaaggtgactgaagatcttgtcataggacggattgaaggagcccatctgcaacagagacagggcaggttaaactgggacagaacaggataggctgagccaggattgacgattgctatcagaagggcaaagctgtgggtatgttgccaccactgcctgaaggatccactttactggacaattatgatggatcactaggctcttgggagttagtgtaatggtcctgcctcttgcatctcaggacgtcctgttttcagcttaaggagttgggcttgaatgtcctggggcatagggtaccgtgtgtgctcttgatgatccagatatgagcctgaaggctttgactaacatccatgtcacacagaacttaaggagctctgagttcacaaaagccacgtcagacaaatgagcatgttgggaaatgaggtacatacagcctcattaggaaaaaaaaacatgcaagccaatcagaagacattcctctatcttgggataaaaaaagaattcattccagggtacatatagagcaggggtgcccagcccccaggctgtggaccagtaccggtctgtggcctgttaggaactgggccgcacagcaggaggtgagcagcgggcaagcaagcattacagcctgagctccgccccctgtcaaatcagcagaggcctcccattctcataggagcacaagccctattgtgaactgcgcatgcaagggatctaggctgtgtattccttacggaatctaactaatgcttgatgatctgaggtggaacagtttcatcccaaaaccatctccctccctggtccatggtccgtggaaaaattgtcttctatgaaactggtccctggtgccaaaaaggttggggaccactgatctagaggtcccttggatctagaggagcttggatggcaggagttgtatcaagagttcaggcatctgatggggcagatggagtttgatgatccctttccagcacaggtcctccccaactgggcaattccatgccttatgcaacagggctagatgttggggcccgtttttccaacggaccaaagaacattccccatttctgctgcccaggcacagaaagtgctgcctccaggccaagagagaaggtgcactacaggaggataccccctgctctggagttgacacggagtcgatacaggaacagctgattatcaacaggtatgcatggaacaaaaggtggaatcccaatctcatccctgcttcaaatttcacctaagaaccttttaaatatctcttacctcaatgagaacagccaggacagcgaggccttctgacttgttgctggcagtgctggcgtcaggataaaggtctgagttataatggacaatgtgcagctgcagtgggggagaagccacccattaggagataagcgactcatgggagcctgtcgcttctgcagaagacttgactccaactgtgaggacagaaccccagccccctcagccccccagactaggttaggtctctcagaccctccccttattttgccaaggataaggacatgtgcccaaggtggtcagggcatggcttgttttgatacattttagagacataatacatcaatcaatacgtacaagatacactggtttgatctggaagggcaggaaaactcaaattggaggcttccaggacataggtagatttaacttttttctgactggcaatcggttgagagttatcatcaatagaaaggaatgtctgggttccaataaggggttgtagagaccaagattttatcatgcagaggaagaatacaagtagcaggcttcagagagaatagactgtaaatatttctgatcagacctaaggtctgtgttgatgttaatgaatgtgggcttttcctaaattccaaaagggaggagggtataatgggtcatgtccaactccctcttcccatcatggcctgaactagttttcatgttaactttggaatgcccttggtcaagaggagaggtccattcagatggcaggtgggtggggtggggggcttagaatttatttttggtttacacaacccatgcatttttgctggttctttgtccttgagactatgacatattgagattttaactctatttcttttctcttttcattcatccttttccatctcatgtgtttataaatacagttcaacatatgttattgaatacagcttaattttcccatttcgaactttaagtggctccttctaacttaaaaaaaattatatatcaaattatttcttcttttaagtggtcctctattaaggatttcttcagagctcctacttcaccatcttcccctcaaaggacttagtctgccacactgcccacaccatctcggcctggcatcactttgagaaacagagctgaattctatatgattaaaacccctgaggtcctaagcccctatttccttttacagctgacctttgagcttgtggtttgtctgtacttttcttattgtgctcagaggaagtgaagactaatccaagcataaaggagctccctgttgaggagattaagatagaaagaatctttttttttttttttttttttaatggagtttcgctcttgttgcccaggctggagtgcaatggcgtgatcttggctcaccgcaacctccgcctcccaggttcaagcgattcccctgcctcagcctcccgagtagctaggattacaggcatgtgccaccaagcccggctaattttgcatttttagtagagatggggtttcaccatgttggtcaggctggtctcgaactcctgacctccggtgatccacccgtctcagcctcccaaagtgctgggattataggtgtgagccaacatgccccaccagaatcttcttatatgaactccatcccaaagaaccactacacttccaaggtccttccttagaggacccactttagggacaccctgatgccttttctctagtattggcatttatggtccatcttaaccagactcttggtctgatgctgtgacttaatagcagaaaatacaagaagtagaaatattttaaaacacataaaccctgccaatctacaccctaacctcctttgtgaaaggaaaataaatctcgagacccccaaatcactaagccaaagagaaaagtcaagctgggagctgcctcccattctattcctaaataagacggctacaaagataaaaaagcaacacacctcacattttgcccactaggaaattcactgtgggccgcaaggtctttaccctaaaacagttctgttgaatttcaccgtgacaatgtaaatggataacttatcttcatgggttcaggacaaaggatagaactcaaagtcatccctctgctcacctgagacaaatgcatttctaattgcttcctctgcccatgtctgttttattttgtaagaatgcagattcgctgagctagatgaatgcacaagtgactattcctctacccctctctcacatgtgaacggctgatcaaaaactcagaagaatgcgacctcttgcctcttacctccccacaccttttaaacatttctccctctttccccagtgtctgccctttcccctttaaatattgaagccctcaaaatcatctttgtagaaaggcacagacttgtctccctgtctcccgggcatgtgtccttaaccttggcaaaataaacttctaaatggattgagtctcagacactttttggtttacaccttctttattccccatgggggaagcagaagtctcaacactgcaattagcctggaggaaatttcagttcttgagcttcagggaagggccgctctgaaatatgtgaacctccagtggtaccatcctattgaaccagatcctatcccttccatgcttgcaagtagacctatgattagtctgaaacattaagcagttcagcagttatgactggaggggaatggtctctatttaccacggactcccctggctgatcagtcagcagcatttatctgcttgtatttccctgtaaatattcagagccacacccccagttcagggctattggagtgccaaaatggagcatctcaaccccctccttgccccaccccatcctgcaattgcataggacaaatgctctgcccgtcttctaattttcttttggcatttcggagtagcttctcaaggcaacatgacacgatgctgtgctggctgacatcttgtccctagtgagtctgcttgccgtgatgccctgcacattagactgccaggtacccctagacttgtggccaggtagaagggtggccctagacccatgtccccatgttctaaacacaacccatgcccagagagggaaagatagcatcaaaatgatgcaaacagcatgacatatgaagaaaggctgagaagtttgggggagcagtgagcccagtgtgagtcagcaggagatttttatctgcacagataggaaggcaatgtctaaaagaagggcatgtatgtcccactgggccaccctgggaatactgcctccccagcagcatcactcagtaaaagacacagggacaaacttagcatgttcaggagaagaaagggaccaggacagtgcagatgagctacaggctagtggagtggctgcgccccttgtgccagggccagaggtggggcagagagcctgaaggcagcctgtcccatgctctggtgttatctgcacagcagccaggtcgagaaggtgccacaccacccactgcagagcagcctctgccagactggcagccctacttacctcggcggcgaagtgctgtccgctgacggtgtgctcagagccgtgcgggtcattcgggttcccccagtgcaggtgcagctgcgtggcactgtagcgagactggaggccctggatgtgcatgtccgagggcaggttcagcttcactgcggggagtggaggagcagccttcagagccccggccagctgtgcactgccagagagcagtcaggtaggcaatgctccctccacccctgctgccaccccctggagcccagagagaggcaggtggatggagtgaggtgcggagcagagatgcagcctaaaggtcagacacctgggctctttccctgagaatgttcccttttccccaaagcaactccagtggcaccagcaccttcttggttcaccttggaaagtgatgccagaaacgctaacactagaccaacggatgggtgtttatttacatattgatggatcagacacctttagtgaagtaccttccaagctttagaattatatagcaacagcaacgataactgctatttatgaagcatttacttcactctgtatgccagaccccaacgtacataatctccagtcttcacggtatccatcaatatgtccatttccagatggaagctcaaggagactaaaattctcacctagattctcatggctcgtaagcagtcaagccagagttcaaatccaggttggtctgactccaaagcctgggcaccccccgccaaactgtgtggttccttgaatcgtttatggtccagaattcactccagctgcacagccaatgaactacagtgctcaggccggtctcctgccccatcctgagagatgtgcttcttctgggaagtgcggccctggcaggatcctcagagcccagagcctccagcatcccctggagagagtgctcctggaatctctcaaagacacccccgccccgccccacccctcctcctggatgcttccacggaacacctccctgccagatggaaaaggacaggcctggcagctgagggagactcagacatacccctcaggtctccaaggcctctccctcacctgaatggccattgttggtcaggagaaactgcttgttggcagacagattgtagccttggaactcgaggggcgtgaggctggcgtcatactggaggatgtcactgtgcaggtctatgggggactgcagcaggcccccacacgacgggtacttcttggaccagctattctccccatcaggacctggacacagagatccatgctcaagatttagagtttctcacaaagggattttccttatcttctaattctctgttcaatacaattactccttttctcctcttttctgaatccccggaggtaaatcttcaaggctcagagtcttggcctccagaatcaggtccagcaaccactcaggaccacctgctcttaagtgatgtggggaaagaaggactagggctgcacaggccagagccagaaggccaccgaactctgctttattttgtacattgttcctgtttgacacacacgtcaagacctgttgactttcagcaattcagcatctgcttagccagtacctattatgagccaggaattactctgggtcttggggctgccaggttgaatacaatagagcccctgctcatccaagctggcattctagcggggaagaatttagcaaatctgcggggccaccccaggtgggaaaaattagtgtcttactgaccacagtgccaagtattatcttggtgcaaaaataattgcggtttttgccattcctttcaggcaaaaaccacaactgcttttgcaccaacctaaataggtctttgtggctgctggctttgcaagtatgaccttcctgaagagaaacccctgaggacattgactcttgatacccacatttagagtaactatagaacccaatctgatagggatgattgacaaatgttaaataattataggcctggaatcacagagtgaagtgcagagtttaagctggaaaaaaatatgaccacactataaactaattattacaatataattgacacactatcagtgaagaggaacagactttaaaaaaagaaattcctccagggctcaagcttcttgctaactaccagatagcagttcctcccctggaaatgaaaataaacatgctatgtgcagatgaactttcctactcccacagggaaaaagtctttaaagaatgtaaatctatgtttaaaagattatctccacggtaattaaacagactttcaggccaaggtttctccagaaaagcaaagaattggcatgtcatggctcgttagggtagacccagggtgtcctgtgggctctatcagagctggggatcaagctttgccatctgggggtccgttcatcagtatttcaacacaaggaaggtgggtaaatagagaaaaggggaaaggaacaccacctcttctgggaattcttctgtagacccctgcactgtttcacaagggtgtaaatgttatattggccccacagaatcccaaccccctacatcgtgctctctaactaggggaccgtatctgagagtgggaagaatccgaagtgatacttggtacccaggttcatttcaaatgctatgaggcgttggtcccaggcttagttagttcttacttctaggtccggacacacacatcggaaccctactgatttttcaggctgtcaaccttaggctatgcattttcagaaatgttacagcatgacggaattgcagaatctccagtccaacctttcactggacaccagtcttctcacttgggcatggcagagtctccgctgagctctactattcttattttcaaggcctcaaaataactcaactacaccaagatggtgactagggaagagggaggctggaggatatcaaagcaggcactccagggccaaactggagtaagacaattattcagctgggggccaaaccgaatgctttaggggcagcggggagcagaatgaagcaaccgtgaggcctcatgtagaaccccagggtcaggaagagacacagcacagggtaagactccctaagtgaggctgccagccttttctgtgctcacaatactgcctgggcccacagccagcagggcggaagctgccagccaggcatgaatgcaaaaaactcaggaagtaaagagatgcatcattgagaagctttctctttgcacacatgactaaagggaactggattagaagggttttcttttcccacagtggaggttcaaaaaggtttcatcaagagggcattttactgatagctaaacgagagcctcgtgaagatagggacccctcatcttcgtctctgtgaacccatattataagtagggtcacgtgcccccatgggcatttaggaaacattttcccaaagagtgaaaaagaacagagggcttgggaaaatgtgacttggggaatgtttcctttttctcttgctctaaatacgctttattggaagttaggaccaaataaggtatttggggggcaggaaagactaaggatattaaaggcagtagagttggtgttggcaaaacctgtcttggaaagagaagcagctatgttggaccaggggagtccagagaatgagattccagcatcagctgtcccaacacttcagtgggttatgttccctgctggagcctccattgcccttcgtgcaaatggtgggggtggtgggcgtagtggtggggatgggatgtgtgtggaagctatgttctggaaggttccttctggctcttaagctctgatatttattaagaatactaggactaagcaccttctccatctgtcaggcaaatttgaatgagtcagaaaggttgctcatgtcaaggcagctactgggcatgtgacaaggtgcccaggggaaccagcttcgggaatgagggcacagggcaccggtgctccaggactggctgggatcagacagccatctgcatcaggaacctgccctggtcctggctgccatccacagcggagttcgtccttgggcaccagtcacaggtctgtaggtcagcaaggtcaagaaagccttgtcttcgcctcctcctcctcctcctcattgttattatattgtagtagctttgatccttataactctataaccttacggggtaagcaaggcagaattgcaccattttatgggtgaaaaatagagatttaagagatttgccggaagtttgactttggctaagtaacagttactttgcttgggtcacaggacttatgtgtccttcagtatttatccaggagattttgtgcacctggaatttcctggcttccccacgctgtccttgaagacaaggaccacggctcatccatcgctgcacttcccacagtgcctggcacagagtgggccctcacatgtttactaagctgaactctcaacacctgtttcatgcttgttcctttcccagggaacgtgcacccaccttaattccctcatgtatttcttctcctcaaaaaagaggaggaaaaatgagatcacttgctcaggttcaaaatgtaccctcctagctttctagcttacctgtgtgcaaatggtttctgtttgggggcactaattgaaaaagaaatctgatttctgccctgtagcctgggagacggcctgccaaggaagttcatagggccctcccccagcatgtaatggctagtgggtgtccccgccttgcatagctggggacactgtcagagcagcctcctgtctttgtggcatgtgagagatagaggtgccatgagggtgggcaccgggacaaccaatatcagaggtgacaacagcaggcctttctgttccctgagctgtgacatgtgactgcacagtgctggccttatgctggccgctacaccctgggctaccattttccaactcagtgtcagctttcacactcatgccaagtgctccactgccagaaatcctccactgggagtgactctcctaaaagaagcatttatttccagctaaaactttgcctttgctcttctgagttttgacttcgcctctccagttggttggactcctcccatgatcgtgatacaggaggatcacgtgtctttcacagtttgtttttctaaataaagccaaggcattatttctttcctgtctatgtgtttttcctgctctaggcaaaacagaagtggtcagaattcctgtttcgaaaggtaacaagagattaacatggcacagctcaaaatgcctctcgtgatttctgattgggaattttgaggcccagggtgtaggacctgcattatccaaggaccagaatgtttttacagaaaatttcaaatgtatacaatgtagagagaggagtggaatgaaccccatgtcacccagcttggacagtttacaattcagaaacagtcctgcctcatctatgctaagcccattctccccttatctacctggataactggaaacaaatccagatatatttcatctgtatatatttcatatgtttctctaaaacataagggctcttaaaaccacagtaccatgaccacacctagagagttaagaattaataccttaagattaccgaatccaattagaattcaaatttttccaaataggtcataaatttttaacagtttgtaaatttcagggttcacatacagtccatatattttttgcaatattgcaattagaggatgtgttatggcctagattacagcttgatggtggaatgcctcatcagagaacacctgggccccgctcctccaaggctcaacatctcagagccagcttggtctatcctttgcccttagtgggtcatggactcccatgcttccatgggttaggccctcgccatgtcacactgcaaaggcttcccacaggcaaccagccccagccttccttgttacactgccaggctggctctcctgcagtaaccagatcaatcttgtcatagcctggcttgggtggcaccaccccaccacccatccgtacactccctttctccctagcatgccctgccccaccccaacaagacaaagcacagcctagctgtttttcatggccttgaagtgccccaacctgtcaaagtcttcaaaggcccccacatcccgccccagcctgccccatgcttcagccagctccctgagcctaagaacaggctatgccaacccaccttcacaaatgccgttatgaaaaaatctgctcaaatgccctcttctttcctctgcacctttccaaatttcgtccactcttcaaagtccagctcaggtcctgccaaagctaccccagtgctttctagtccctgacttgaacttctcggccagcctactcgggttgtgcacactagcaagcagtgatgattgttagcctgcctcacctgtgactgttagagccagactagtacagaaacttattacagactagagctcagaatatgagtttcaaagacctttggaagaccagaactttatgtcatatccctacttatgtctgaacacatccttgaatggatgtggagggtttttttaagctcatttcagaaatttagccataaagggatgagagaagggtgtatgcgtggtggttatggtaaggtgagggtaatgtgaaagattttgttttttgtttctgtttttgtttttgagactgagtcttgctctgtcaccaaggctggagtgcagtggtgcaatctcagctcactgcaacctccgcctcccaggttcaagcaattcttctgcctcagcctcccaagtagctgggattacaggtgcgtgcctccacgcccagctaattttttatatttttagtcgacatggggtttcgccatgttggccaggctggtctcagactcctgacctaaagcgatccacctgccttggcctcccaaagtgctgggaatacaggcgcgagccaccgcacccagcctgtgtttttgttttttatgaagaggcttgagcaaactgctatgcagacggcaaaagagaccagagaaggaaggttggagacagaagaaagaggggctcactgatgaaaggtagccatgagaagacagtggggggatccaggcaccagagtcaacattaattctgccccatgacacttcttggaggtcatactctgaggtggacccccctgtgtctgtgtcagtgctcactgcaggcagcttcctggagaacctgcctgggcccaagctccagggtacatctctttgggccggctaccaacacgcagtcagatcaaaacttgccccaaaggataccactgtagtggcaaagtttacacattctagatgatgacacgccctttttcaacaaataggcacaatttcaggacaatgatagcttttggttagtccctcaaagtttgttttgtaaggaggtctgaccataatgaaaggcatgtgtatctatatgaaaatgatcaaaaattatgtaccaaatttgaatacacatttaataagatggattgtatttgcaataaaaaacgagtactcaaatgttgaatgaaggagaaaaatctctaaatgctctccttcttggagtgcaatttaattttggagttaatgcattcatttcttcaacaaatgtgtctagtatgtgtcaggcactgtactaggtgctgaagatgcaatggagaacaaaacagctctagtctctgaccttgcggcactcacagaccagtgtaagagactgataataaataacaagtaaaccaatgcacaaggaaataattgcaatctgcaatgagcgctgcaaaggaattaaacgagggctgcaacagaaaaatggagggatccctgtcaagcagatgatgcaggcaggcttcccagaggaggcgccgttaaagctgagatttaaaggacaagtagaaccaaccatgagtgaaacgtgaggaatggcgttcactagagagggcccagcaagctcagaggccccgctgcagtggagaggctggtatattctagggatgtgtgatgcattgactcagaaagagtctgggatccatccggcctccctttgccaggtctgggtcctgccctgtgccaaggctgagctaggatcatttgacacctgcttgtgtacattcctccatctgttagaaaggtcttcctgttgggaggctagtacctgcctctctctgggggtcatccaacagtcccgctcttgtggctagagccacagagaacacagctaagccacaggactcagaggggaccgcagacttcatgtcccctctaaatccatctggaaaccagacatcctcaggatggtgtctgcatgtaaaagccatttttttaaagagatggggtcttgctatattgcccaggctggtctcagactcctgggctgaaatgatcctcctgcctcagcctcccaaagtgctgggattatagatgtgagccactgcacccagcctagaagctacattttaaaaacatgtttaaaatatatttataggtcctgcagttcacttctgaagctgattaaaatatctatgtcttctcataaaaacccagtgggttcagccagtcagtagtgtggttcccacagcatcaccttggtaagaggttgacccaccgcacagaaggccacaacctgctgaattctacctgttttcctgctgggtaggcggagaggcacagtcataaaccccaatgtcctgcccagaaggaaaggaggtgaccaaggacatgggttaataattgatggatgaggtcttatgatgttattatgtacaaacagagggcgaggaatcaaactagcgttagagttttcctttgtcagtatcaccactgaatcagaggtggtcccgggacagtgagggagggctagaaggggagggttacttgttatgaataaagctcaaagctggacttgccatagcaggccaactctttttcttggattttacattatagatcaataaaaataaacacattttctaaagatgctttaatccatactttgcatcaaacttttgtctaatttttgtttgggtcagctggagacggagggttgagacttgggcttggtaaatccccccaaatctccccttggggaggcaggaggatcagttgagcccaggagtttgagacaagcctgggcaacatagcaagaccccatctctaaacaacaaaaaaagtggcttctacatgcagacaccatcctgaggatgtctgatttccagatggatttagaggggacatgaaggctgctgttccctctgagtcttgtggcttagctgtgttctctgtggctctagtcacaggggcaggactgatggatgtattaacacagagagagatgggaatcatttcccatccagccatggtggtgggggccaggagtgcaggctggaggccagaagaggtgaaccataaggctggggctgccagctcagccctccacccaccctcaggaagtccttctcctccaccccgccaataatccccgtctaatattgctgggtgggggatgaggcggggacaaaaaggctccgcagtcatttacacactggtgtcaaggcctgcatcaggttccttctggagatgaggtttattacagggaggcgggtggggtttccaggctgccaaaggtaaagggtgacgatctgtttgcttttgcttctccatttctaacctcctcttaggttctcatgacctgtgaccttagagtatgttcatcgtggagaggctctgcccacctctctctggacttttctgtgtctgctcccacccctccttttcgttccagcagcgctgagctgcttgcatcctgcagacacaccaagctgcttcacatctccctgaaacaccctcccctcgctggggcagggcaaagggtttccccctcttctgtgctcctatacagcctttgcatttctcttccttgcagcagccacactgatcaaagcaatattgtctgcctttccaccccagtagtccagtggttctcaaagcgtggctccagacaagcattatcatcaccgcctaggaactcattcaaaatgcagagtctcgggccccaccccaggcctaccgaaccggacactctgggggtggcgcccagcatctgccgttggacaaggctgccaggcgatgctgctgcgggctgaggctgagaagcgctgcactagactgtcagctcgctttctgcatgcgtgtacacctggctcctgctgcagagcctggcacactgaagtgttcaacaaacagctcttgaactaagcaacaaacaacagcaaaccactaagttaaacaaactgctgacatgctaacaacctaacccctatcatgaaaactagccaggcctgagccccccatcagtgctcaccacatgttatcctccttcatcttccttggcccattcatgtgaggaatcgtgctagatgtgaaagtgttaagtccacagccctgtagccaccgccctcgcaagacatcctgctctgtctttcttaaacataatattcaaatagggggctccaggctcaggcaacgactggtaaccatctctgaacagaaaggactacagataccgtctttttcatgcactgttatatgcataacatttacatgattaaatatggtgtttgaagtaatttttattcagtgttgaccatcagaaacatggtcatgtttctaaccatgttttcatggcttaatctctttttaaaaattgtcggccgggcacggtggctcacgcctgtaatcccagcactttgggaggccaaggagggcagatcacctgaggccaggagttggagaccagcctggccaacatggtgaaaccccgtctgtactaaaaatacaaaaaatagctgggcatggtggcatacgcctgtagtcccagctactcgggaggctgaggcaggagaatcgcttaaatccaggagatggaggttgccgtaagctgagactgcgccactgcactccggcctgggtgacagagcatctcaaataaaaaattaaaaattgtagtaaaatatacataacagagctttttcattatctcaaacatttattgttggtgggaacatcaaatagtttggcggtgccttaaaacgttaagatagaattaccatataataccagcaattcttttttttttttgagacagagtctctcgctctgttgcccaagctggaatgcagtagcgtgatctcgctcactgcaacctctgcctcctgggttcaagcgattctcgtgcctcagcctctcacgtagctgggattacagatgcacatcaccacacccagctaatttttgtatttttaatagaaatggggtttcaccagtctcgatctcctgacttcaagtgatccacccaccttggcctcccaaagtgctgggattacaggtgtgagccaacacgcctggcctgatccagtaattctaatcctagatatagatcccaaagtattaaaagcagggattcaaagagatacctgtacacctgtgttcatagcagcattatttatattagtcaaaaggtggaaataagtcaattgtccatcaacagatgcatggataaacaaaatgtggcacagacatacaatggaatattgtttagccgtaaaaaggctgatctcattttaatgtaccatttcttttccaagaatctaacccaccagatgcttgagaggagctgggataggtctttttattttcacggcaccctttatggaaccaaacgtatggcagatgctcaatgaatactcactggttgagaaaaactctgtagtttacttggcctagacttgaatagtggttgccagaacttgagtgcacaatcagaatctcctagagggcttgttcccacacagactgctgggccacaccctcagagtttctgattcagtacttcacggacggagccctagcatctgcatttctaacacattcccaggtgatgctgctgctgctgggtccaggaaccacatttggagaatccccagcccagagccatatttctcaaccatggctacatagtggaatctccaagagctcctgattttgctcccagccccagtccctgagatcaggattaattggtcttggtgttgaggtgggaggtgctttaaaaaactgctcacatgattctcatgggcagccaaagtagggaagagctgctgtgaaaccctcatcacactgaaggccttgtggttcttgtgagcagagtcagggcctttttctctctggtctcagggtgaagttgctttctttctttcttttttttttaaattaattttttgttgtggtaaaatacatagagcataaaactaccattagtaaaatttagtatattcacgatgttgtgcaaccattacccctacttagatccagaacatttcaatattccaaaggaaacctcatacctgtgaagcagtcacctcccactctccctgctctcagcaccgggcaaccactaatctgctctctgcctccatggatttgcctcttccggatagttcatataaacagaatcatacaatatgtggtcaattgcaggtggcttctttcatctggcataatgtttccaaggttcatccatgttgtagcattccttcctatgcaataaaaagggccttcatgcctttttatgatggcataatatcccattctatggatatatcacaatttggttattcattcataggactgcattttattgtagtttaaatatttgactctagttaaattgctatggattctcttgtgtaaaatagttattgaccgaaataaaatgttggtgtttctcctgtttgagttttagaaaataagctgtgcagagtgctgcaaggcagctggaaggaaaggaagatggagaaaatacagcctggtttccagaaaatgagggcctggggtcaacaaggctattatttgtgacaagctcttgagtgaaaagagaaaacttcaaatgatcatgatcataaagccatattccacacagggtgatgtagcaatgttccccggcactcacgggaaaccagtgggagagcgaatactgtgggcagaggctgcttttgtgacaggctcctttcctggcagagagagacttgaaaatgtcacaggtgcttttcatcactggtacagctgtctcccctggctgacaaaaaaatgctccctctccccatccgccttcccagcactcatctttgtgaagagtgtgaagcggtaggtgagaagccatgacttgatttggcatttagacagcaggccgggggaaatcggggtatctaatttgaatgtgaccttgaactaactctgagctgtggacatccaatgtttacttcctcaggcgagtacccctttttgcccctgacctgattactcttgtctcctcggccgagcatcttcaaagaactgtgtgcatacccgcatctgtgtctttacttcccattcagacctccctgctcttccacgcccatgtcccactgagtccacacagactcttcggccctcgcacttcatgcagcccttgaccctggtggcactaaccccccactcctgatttctgaaccctctgtttctggggacactgctttgttgaattgtcctcccgtttccctgccctttctcagatctctgtggccacttgcccctcaatgtcagctgtcacggtggttttgttgttggccccttctccttcttacagacacactcccctggggtgaagctgtcccctcccatggcttcaacaccagctctgcccctgcccagttttcctctgagctccagaccacctgcctgctggctaccccctttggataatccatgggatcctaaaaccagatgtggctggaaggggactcaggctagcaaatcatttttaaaaataaccaaactcaccatcttttcctcccccttcctccctccaaagctccccccaaccctctatgtcagctggtaataccagccaccacaccaaatgcctggcgatcacaactgactcgttcctctcctctccttcaaccctcacttccagccatcacctagaatcaccagttgttaacattttgcacacttgctttctctcacaccctctactgtgtatatgtaccttaaccctaaccatatatatgtacacacacacacacatacacacacacaaatatatatacacatgcaacctcactcccgtcatgagaaaccctcagacaaataaaaatcgagggacattctctaagatctatatgctatatgctacaaggtccgttctacatgcttcagaaatgtcaagggcataaaaggtctaaagagataccacagataaatgctatctggattgaatcctggatcagaaaaaaaatgctatcaaggatagtatgaagtttgttttaaacttgaccgccactctcccaactggcacagcccttgttcagaccacttgccccacagctgtacccctcattggccgtgtttctccaggctcaccctccagctctccactctccacaacagtgcacaccagatccagacagttctctgctgaaagttcttcagtggctccttgagataaatatcaagctctgtcatgtagcacacaagaccttcacaatcccactcacttctccaggctttgctttccccactcatcacctgtccaaaagtgtggagggtcagagcttttatcctgcttgcaagttaacaagttagtctgccagtttcatggatatcggcagaagacatgagatgcctgggtcagagacaagggacagtttaatactcacagcagtagccagagtaacgtttgcacctgtttccccagccccagttccacagaatgatatgtggaccaagtgacactggcatatgcaaactgctcagcatcattggctgaggaactcaaggcttgggaaacctcattcttttaaagggggcggctagcaaacctgtccaacatttacctctgaaaggagacgtgatctttattatgctgacagcaaataaatcactctttgccctgcagggagatattgtcactatcatctaagactgtttgttacataaacgtcctttaaaagcaagtctggaacaaaacctgtctagtgtctctgttcacagatatgctgaaacatgaaagacccatggagaactgtctcccaacactacccctcaaacattaggctactgagtctctaattgtgccacgtgctctcgcctgctttttagggcctctgttgcctgcaatgggatgccatcctcatccctaaaacactcaccacccatgcacataaatactcacatattctccttgccctgctaactcctgtgtgtttccagaattagctcctcaggcaagcctttgctgacagacgcacatgcccccgaattgaggttatttgtcccctctgtgttccacaacaccagcacacgtcatcatagcacttagtgtgcttcattgtaattacctgcttatatgtctacctccccctcacctaccagcccattgaaggtaagggctctgtctctggttccctgtgaccagcccacaaagggattcattaaagactggaggggagaataagcgaatcggtgaataaactattattttaaagctgtcaacagtttcttcctgacacttgaggtggcatcggatgtaaatacagtgaagctggaaagctagcatggggccaggggtggggggattcataagcatcttccacactctggggcaggccgtctctgggctgtggaaggtagctctttgatagaccctcttacctacacagatgtgaggcagggagctgcccagtggaagtgtagcccccaacggagcagtccagatgctgctgcttcgaggtgagatgctctgtttaatgatacaataatacaaactggaggcatctttagcagtttgtgcctttgcaaagaacactgtttttcaaaggatgaagttaagccatcctagaccgggttgctgttgccccacctgtgatgttattttagactaagccagtgattttcaactggggcgattttgcccttcaggggacattggcaatgtctgaagacattttcagctgtcacaacttgggggggtgctactagcatctagtgggcagaggccagggaatctgctaaggatcctgcaatgtgcaggacagtcctgcacaacagagagttatcctgcccaaaatatccacagggaagagactggaaggtcgagactggactattgtaattgtcccctcagggccgtgaggaaagaggaaccagagcatgccccacagcggaggttgatcttgatggagttggctgctctccctgtcagtcgttctctggggcaggaaagagtggtgggagaacacagtcaggagggactccagtccatgggacacagcatgatggcagcacctcctggcattgaggaggcaggaagagatcaccaccctcagggagcactgatcacacaaacagctgtgttagatgttccttttaggttgtcattgtctaagcattcatcataggacctcattcaaattttgttaaactcaagaactagtgaggcttctttcccttttctttgtttaagctaccatttaatgagcactttctatgtgccaggcatcattctatatcaggggttggctaactttttctgcaaaaggccagagagtaagtttttgaagctttgcgggccctgtggtttctgtcactaccagctctgctattgtagcccaaaagcagtcacagagaatatgcaaacaaatgaatgtagctgtgttccaaagaaatttatttataaaacaggtgttgggctggacttgacccatgggccacagtttgtcaactgccattctgtaagcttaacatgtgttaattactgcaatctgaataacaatgctatgatatagacactgtgttccttttaatagacaaaggaacccaggcacagaaggattgactaatatgaccaaagtcacactgccagtgagtagcaagcctgagctctgaaccatgacagttcacatcttccacgacagcagcttctcaatgctctttggagggaccagagcccaggcagtagcaacggctatgaggtggtgagacgtgaccagcagataagccctgggcaatggtccagagctggagggagtggagaactagccatttgtgactttgtgaacaatccctggggagtctggaaattacccaaagaggggatctgataaaagacagaaacttcctgaagttccccaggatgaagcctgaactaaagtgaagattggccgctggacgttgacctgatgctggctcaatgtttcacgtaacagctttcacaataaggatgttctttctgatatcttacctatagcactcttgctattatttaaagttttcctttatagtaaaaaaaccacgaaaacaaaaatcttttgctttttcatagttcttcttaaacctgaagaccttcatcctggctacttctgtctcttctctagagatgcgtgaagtatagtgggaaggtcgagggctttggaggcattcgaccaacctgccaatcacagctctgccaccgactagctatgtgacctagggcacatttctttgcttctctgggcttcacttacaaaatggaagtggcagtacctatctcaccgggtgctgtgctgtgaggaatcactgcgtaagagccatgtctagacaaggtagactcttacgcacgctgggtcccaggccctcctgagttgatttgtctcagttctttctttttttcttaggggctggtttccaaccttttagagcaacttctctctttcacttcaccaaaaacaaatctaaggtttcctacatgtctccttttacttctaatgagatgcacatggtgatgtggcatttcctttcaggccagtttcacctctgaaatccgaccatcccagatcaatgtcaccttctctctggtgccttccctgagtcccagagccaaaaattaatagagaaataacccattctttcctcaatcatcaacaagtgtttcctgagcacctcccctgggccaggctatgtgcatctatctgcctatgcagctgctgtggagacgctgacccctaagctgtgcagacacaccctccttctagataactcttcttgagggtaaaaatggctccttggtcaccctctgttcctcttggaagtcctagaacactgctgtgcatgcagcaggctcaagctcaaaagccaccattgattaaacaattcagcagtgataatttgacaagtgataatcagcctttgcaggaaagccaacacctgattattaacccaagaagtacccatgccatcatgggacagttatgtggcaggaaacagttgatgcctataattcttaactttttaccagggcataacaagttttctgacagggcatctgtgcagatgcagtctgaccaagggatgggtcgctccctgcttcatccttgctgatgtacaagttaagcattccactaaaaggcttatcaagagtgggagacttggccggatgcggtggctcacgcctgtaatcctggcactttgggaggccgaggagggcggatcacctgaggtcgggagttcgagaccagcctgaccaacatggagaaaccccatctctactaaaaatacaaaattagccgggcgtggtggcgcatgcctgtaatcccaggtactcaggaggctaaggtaggagaatcgcttgaaccctggaggcggaggttgcagtgagcagagatcgtgccagcctgggcaacaagagtaaaactctgtctcaaaaaaaaagtgggggggcggtgaggagacttggctaggtgcgatggctcacaatcttagagcactttgggaggccaaggcaggtagatcacttgagcccaggagtttgagacccacctgggcaacacagtgaaacagtgaaaccccgtcactagaaaaaaaaaaaaaaaaaaaaaaacagtgggactcttaggaaactgccacaaggagtctctttaagatttcacctaagcacggttccaagcagggagctataaatgcacatgtgagtaactcagaaaccagctgagaggctgggtcccagttaaactgtacaggagatgcagctgggagtatgtgtgagtacagacacatctaaaaacacaaatacgcagatgaacacagattgggggatgtgggcgctcctcttcaatcagtctttgcagcctgggctcttgcctcgcagtgtgccgttctcatatgatatctgctcactgaatcacggcttgctgcccaggccctgcagccctggcccatcgtccaggcacatttctggcatatgcctcttcactgtgcatggcctgtcctctgtgttccctcttccaatgtggtcctgtccagtgctaatcaccgcactccctccactgcccaacctcttccaaagatgtgttcctgagggcactgtttcaagattgttcctggaggaactcctgcacctctttcagccctgtgctgctgacagcaatgactggattctattttgtcttcctagcaactgcactggtgtgtgtgtgtttgtttgtttgtgttgcgacagggtctctctctgttgctggggctgagtgcagtggcacaatcacagttcactgcagcctcaacctcctagactcaagtgatcctcccacctcagcctcccagagttctgggattacaggcataagccacctcatccggacacactggtctttgatccacatttcccatgagcatgtcacaacgaacagtgtaaaatatttatttatgtcaataggtattaagtctattgtgttttctttaactgctaagcctttgatcctgatggggggaagaaaagcaagtgaacttggcataattcctggcaaatctacactatttactcttcaaaaaaaatccctgcatttcctcaacggcatgaggtgtagtgcagggcacacagtgcctggcataaaacgagcatccaccaatggactgggaaagagcaccgggagggagttaagaggcccaagttctgactctgctcctcaggctgctggagccacctgacagttttgagctttcctggcttcagttgtaaacaggggcagggtttggtgacatgagcttcccctcccctgcctggggcccacctaagcaataacggctgtctgggcacctatttgaatactttgtgaagcccagcagagacgggctttcagccacaatcaggctgctccaggcaattgcaatgttgggtatctacatttctggcccaattatatcaaaaggtcaggacccccatttctcctcccttggtccagatcctctccctttcccctacatccctctggtctcccttcctctggggtttcacactcaatccattctccaccctgcagctgggatgattctcctaaaatgctaatcccagtttgtcagtgttctacttagaaggtccagcagtgggccaggtccagtggctcatgactataatctcagcactttgggagggcaaggcggggagatcacttgaggtcaggagtttgagaccagcctggccaacatggtgacacccccatctctactaaaaatacaaaaaattagctgggcgtgatggcgtgtgcctgtagtcccagctacttgggaggctgaggcatgagaattgctggaaactgggaggcagtggttgcagtgaactgagattgcacccctgcactccagcctgggtgacagagcgagactatctcaaaaaaaaaaaaaaaaaaaaagcatgtcctgcagttccctgctgtgtctagaacgaggtcctggctctttggcctggctcagctcttcacactctggccccaagccccttccctcatcactgaggtcctcaggaatctccagaacatagcagcttccttctttgcacaggctgtccctttgtcccagaggccctccatcccctgccctttgcctggcttgctcttatgtgtccttcaggtctcatcttggacatcacctcccccaggaagccttctttaatcctttcctccaaaatactgagtgaggtctctctcctctgtactgtaaggccccgcttaattgctctgtcctccagattcttagtctcataatggtagggaccaagccttgtcaaccatttcctgagtaccaatacttatccgtttctttagtccaatatttggcacttagtcttcactcagtgaatatttgtggaatgaatgtgaaccatttatctcaggcaagttgaaaactttggttggtttttacatctgcctttgattaataacaagtgggaaattttaaactacttcattactatataaatatgtttaaaaactgtttaaatcatggtacccatgtggtgggggaaggcagaataaaacagtggtgaaaatgtagggtaccactagactaaggctctttctagatgaaaatccagaaatctgttacaaggttttggctcaggatcaggaaataagatccccaagctagaagggtaacactaaggtggcttatttatttattttattttattttttgagatggactcttgctttgtcgcccagactggagtgcagtggtatgatcttggctcactgcagcctctgcctcctaggttccagcgattctcctgcctcagcttcccaagtagctgagactaccgcacatgccacaatgcctggctaatttttgtatttttagtagagatagggtttcaccatgttggccaggctggtctcaaactcctgacctcaagtgatccacccgcctcggcctcccaaggtgctgggattacagctgtgagccaccgcacccagccagcatggcttctttagatttgcaggtcatagaagaatagacatttgctcaagttggagacatcaattttcctctgggcttcctggtgaccaaagccaaaagagtcaacagtaaacactgcctcatacttgcttcaaaactttcttccacgacattgagagttccatcttttctcctttctccatttctgatagagtttccagaaaagtggtgtgccaatgaggagccaccctgggaaggcaccaggccccacttgccaatgccagcatgaccttacataaggaaatctcactgtcatcattacctaggagactttgcagagccctgtgtcctagaaggagggggcagcatgtgccacttgccctgaatctgcaggtatctttctgagaactggatgggttgcatccatttcacaccatagctgacctagtcacgagttaataattgcaaaattgtttaaaagttaaaatgagctaagtgatctacgtatttggagttacaccagctctgagtcaatgtttatagactcaaggaggtggcagctagtatttgtttcttcctggttggcataaattgaacgcttgtcaggtaattggaaagttttctccttaaatgaatacttacataaactaaaaaaactagtgcctaaattactttgtttttacatacttgtgagaacgacccaacatcaccaaaaagtatacgtgaactgtgaattaactgcaagttggaaaaagctatagttcaagatctcacatgattccccatcatacttacgtgctgtgtcagaccaggtgcataatggccgttatttttataccgttttgcctccactgttttcagtattgttgaaattaatcgtttcagcccctttctgtgtgttcttagcatctaacatggtgcttctctgtattcgtggaatagctatcctatttcattgcttctcaatgcaactgataacaagatatatcccaatttcagagatgctaaaatgtggggaaagtggacatcttaggaccaataaaataggacctttgactgtagcaggtgctatctctctttcttggcctggtggtgtggcccctggaagagactggccatggtgcctgcgctccaccgtggtgcctgcacccttcgcccagcagttgcccctgcgaaggaagagagtaacaggccaggaaggaggcccctgctccttctaagactgcaggatcccgaggaaacattctctgacctattctcttcctcaaggagaaccaggacttcctccctcctgcccgcagccaccttcccactcatgctttgaattcagcctttttacttgaaagatttattttgagcaggttcacagggcagcacactggctcctcttcttaaggggatgcgttgccaaaagctctggccagctcttgcagaagccatgccctgccctcacctgaatgcccggggctcaagaccagcaggtagcagaatggtcaagtcggagcacagccagaggcctgaaaggccctggcaggacagccccacagctcgtccttcctcctcacctgccagcccgctgcacctgcggttccaaggcttgatgctgccccagtgggaaaagggcgctgcatgaggctaggctggtgtcaatcccaaatagctcagccccaagtttcttcctaggctcaggcctccactcctgaaccccaaactaggctcagcccccatgggctagacagggaaccagagaatttgcctatttgcctgctctctgggagacttcaggggcttggctgaggaggccatggttatggaaccagatatctggttcctggatgccaggaaagcaccagggagatgagacctgacttcaccttggtctgaagaaccaggctagaaaggacattctggcctgtgaggcccttgggacgagagcttgcagtccttgtgttttttaaattcctttcttactcaaaaaggaaataccctttgtttattgaaaatataaaaggagtatttcctggctgtaaaaactcacaattcagaaaagtgtgaagaagcagaacccttcctaacaaaaatagagctctcatgcgtttggtgctgtaga

SEQ ID NO: 57 - DNA, 149241 bp, Homo sapiens
aaaccccacaggctgtctcagtgggccttcaggcaggccaggcagagcagaaaaagacaaacaactaccttcagtgggttcccgaggcccagtgactggtcaattgggtacagccatgccgacaaacccatgcccatggaaggcagagtccctctcttctgcccagagcttgacaccatgccaccagtcatggaaggacaaactccaaactgtctgctcaccttgcagccctcctccttccacccaaaccacctcccggagctgaccgtccacccacccccaactccctggggactctcaaacagccttctcacttgtcaccttggctgtgcttttcttttgcccaggaaggaagacaattggcctaatggttctttgtgctggatgtgtcaccagagcagaggctgccagagcccctgcaagctcccctcttcatcctgcctcccagcgccccacccactgcctcaggcccagctcagacatctcgtcctccctcccccaaacagaggtggtgaggggcaggggcagtcacatgggcgctgctgccagaggtcctgaggccaaaccacagccttcagatgagtgtcagggtggaagcaagcgatgggggctgtggccagcccatccttctttggtttccttttgaacaaagaaaggaaacaaagaccccatcacaaaagtaacctgcaacttgagttgagggaaaatgtctggagtcacctgccctggatgtaccttcctgggcacaacttgccatttgtccccagtgcccattgggaaacccccccccactcgcccagccccaggctccactgcgtaaaaggaaggtcggaaggtggagcatcttttaggtattcattcaacgaacttcaccaggcacccaccgtgggcacccctgtgctaagtgctggctgtacatactgatgtggaaagcatgtgggcttggacaggctgtccctcagtagcggggtggctaaacaagccacttaacctgcgagaactcagtttctgggttggcaaaatgggaatagtatagacctcagagggcgactattgggattagatgagatgtgtaaagcatttagacagagctcagaacatggtaggcagtgatggcggcaatgactgtattagtccattttgcattgctataaaggaatacctgaggctgggtaatttataaagaaaagtggtgtgattggctcatagttctgcatcattctgcaggctatacgagaagcatgggtccaggatctgctcctggtgaggacctcaaagagcttctgctcatggaggaaggcgaaggggagctggcatgtcacggagtgagaggggagcaagagagaggggaggagatgccaggttattttttttttaacaaccagctctcatgaaaactcgctcgttactctggtggatggcaccaagccattcatgagggatctgcccccgtgacctgaacacttcccaccagcccccacttccaatatcggggatcacaattcaacatgagatttgtaggggacaaacacccaaactctatcagacacaaagctccttccctcagggagatcacaggatactatggaagcactgcttggacttgagtttagctgggggctcctagaggagtgactgagctgggcttcaccaggcatagcagtccacgtaggcatagcagtccacgtatgcgtacttggcatccaggtgtctttgcagtgactcagggaccgtggctgctttgcccttggaggtccctggtctcatcctgagggagacagcacttggggatctccgcctgctcctctgggcctcagctggaaatgacactgaccatcctgctctccgtccctggatcaggactcgccacgtggccccgcatcattgcagaggggctgggaaatgcggggaagcacatggatactcgaccagcagtaaatgtgcaccactcagagggtggagccagggggcttccaggctgggggagctgggacaagaggcagaagggcatctgggagccatcagtcctccgggtgccttcagggtgatggcaaggaaggcgggggggcgctgcttggtggcaaggatgagacagtgggtcgggctgggctgggccgggctggagagctctggctacaatgaaatgaaggcagcggagcgtataggacacagagaccttttgggaggctgttgcagagatctacacatgggggatggactcctgaactggggctatggcaacacagcaggggaggaagaggaagggccttaagctatcaacagtggaatccagcttgggacggggcaattcccagactcctcacttgggcgactgtcattcactgagcttgcgatcagggagactagggcagctttggggaaagatgatgggcttcttgatggattgccccaacaggcagcaggatacagcattagagggctcagagagacctgggccagagtcatcaacctgctgaacaccaggtgccctggccacctcccctcacaccctgcaaagcacccaccacccttctgcctctgacccctgctgggcactgctcagcagccagtccccaaagaacaaaggggagcctgacagattaaaaagccccgtgtgttatcctggcaacagaagctcggaagccagtgatcaattcccagtctgaacataagtaatcccaggacaggcaggggtgggccggagggggcagacatgaaggtgctcgttatggccagtggaaggatgcttttaacacagagatggccagggcacatcacataaatatcatgctttgcaattgtggaggtaattgaaacatgattaacccccctggtctttggtcgttgggatttggaatccaatatattatgaacactctgttctgaaactggctctgtcggcctctcctctgcagacaggagctgttctcataagcatcataaaaagcttcgtgcattattgaacagtggaggtagttttcctgtgccctgaagtcctttgccattttctctgttgcattctggcatttatttcaaacgctcctttcaagtcaacacagacccacccgttcagcctccaggaaggagccccctcagccccaaacacaagccctcgcctctcacttctgggaagaatcaggttatctggaggtgaatcagaggctagctctttacaaatcaagcagcgtctacattacattctagccatttcacagatgggtaaacagaagtgcagaggagttaagtcatttgcctagttcgctaagcaaaaccaaaatagggtgaaaatggaaaccgaaaaacctgttctgacttaggtaaatcatggccacaccctgtgctctgcagagggaaaacacaagctctactggacaagtgaggatgaagctacccctgaataatcccagtggaaagtggcaggcttgggaaatagagtcgtgcttgctggagcctctctgcctcaccgagaggcctgagtgccttttattaaacagaggactattcaacaataaatatttctcacacaaggccggagaagttaccacacttggctccctcccagcctggctgagtcagcagggaatttgccaaggtgcggaaaccttgtgttctgtgattttggtgtgttgatattttttaaatactgagctggaaagcctgaggactgcaaaacacacacggatgcaccaaccccatgggttctgatcctgagaaacatgggttaggctcctagggtgctgggaagctacagcggggaatgggtgggtggacggatgctacgggggatttgggaaggggtcaaaagcaatgctgtctctcaaatacaagtttccttttctatagaatggttcgaataaggtgtagacccagggatgctgtgagattaagattttcgaagttaaggggctttagcagggagagcgctggactcggatttcaatccttcctgatacagttatgacttatcggctgtgagtccctgggtaagaggtttcccctttctgagcttattgtttcacttataaaatggggcattaatatttcctacacgaacctttaagagataggtaccagggcccaaagaactgcatgaatataagtgcgtttgcacagagatacttacggcatgattatttttggtgtgttgctactgcagcactttgcctggggcaggtcctgttcagccttgggaccttgtttatttgtattaggctttttgatgagactggggagagctccttcactaggacttcacagaaaagaactcgtctgtctttcccttcacataattaatattccaaataagaattacacagccatttctattaatatttgattctttgcctcttcaactatcggcttagttttctgactgagatgaaagaagaaataattgtttttacagccactcctactgaggaggcagctgtagaccctgatcgcagccagggaagtaacaactttgtttggcctgaggacaagaggtgggatgacggtgttagcctcagtggttcctgtggggagagagaagcccccctcggctgcttttgaggcagatcctgaaggaatcggcttctgagttctgagtgccttggaggcatggggaaggcctgctggaaggctggttcagatgtgctccctgctgggaagagattggtgctccactcccaggacttatagaagcccagcctgggggaggcagataattagcagatggggccagagggtgactttcagcttcgactccaacacagcccctgttgggcacctgcaggaggcagacaagtacctggctcggaggacgactgggcacggcctcctcatcttggtaaagacaatggggcttcccactctggaaggacagaagccagccctacacatggtgcagtgcctgggggcctctgtggtccaggagatgtccttctccactccttcacttctcagaggctgggctcctgcctcctggaaaattgccaccacccggggcccaaccagaggccagatatccccagaggcatggggatagtgagggggtagcccctgatcagagtctccacctggactgaattcttagaattttatgttgccccagcatccattttgaatataaatttaactttctcagaccagaggtagagcttggacccacctgacagtttccacttctctggctcctcccagttcctcaatgtgtttgatccagacctctgccttataccaggcctcctggtgaccatgtcccccaccacctatgggacagctgggtacagcctactcgattcaccccactgacgtccagactgcatggactgagcagatatgccgcagcgaccccctctctaccacagcaaccccatggaacgtgtgcctgcttgctctaaacccaccagctataactcccatgggaaacctgcttagataaggccctggaccccagtaaaggttctggcccatgggtccccccggccctgctcccgacgtgctggtggagcctgtgtgccccagacagctccctgctgcccgctggccctgaggcatgctgccctcttctctctgggacctgtaagtaataacacctggttctgttatttcatgtgttttgctgagttacctcctctgtgtctcacttgactgacacacccaaatctaccttcccttttgctcagtgctgtcctagagagtggctgtcctggtaggaataaactggacacaagtcaggcaagagtcacaagggcatctgccagcacaaaggacagggacacctggtcatgggtcagacacttaggcctcaatcaagccgttccccagggcaaagaagcatcccatgaaaggtacacaaccacctcccctgcagcgctgtcagggcagggctagagcttatagctgctctcctaggagagacctgaaggccacattaggggacaatataacaccagccttggagcctttgcaaactctgttccaaagcgagaagtcattgtgatgccatgtttagaggcaggtggccccaggcagcagggacaccatcaaaggtggtgtccaccatcaaaggtggtgtccactgtgagttgtgccccatctgtaggccctgctccacctctgttttgtcctagtctcagctccatcacccctctaccccctcccgtgatagagcctggcctggcttgggaataaaaggagaaaacaggaaatagcaaaccgccccaaggattgtaattgtgacactgtcatctgaaaatgtttgcagtccttgttggcatatgctgctggagcaaaaacatgcaaatctggagcaaggtgacaggtggcccttaggatcctggaggagacccctgggttccagtttggttctagtctgctggggtgggattctcagacagcatctggcccatttctgggttggatggtactctgaacagggcactgattcaagggccaatgagtcccatcccaactcctgcaaagctgtgtgcattttgccaactgcatgagcttgtagacggggcagtgtcctctcagtcctactcaaacccttgcaggctcagcttagctggagcacctggaagccattggtgcagagccacagactcagccgctggtgtttatcaccccagaggttgcaaagtgatggcctgtgggactctcctgcaatctgatggcattggttctcactgtgttgtacaattattttttctgatttagttgcccatccaagatttattttttaaattgggctatttcacaataatgttcaaatttcagactcccgtcctccatccagcgggagctgagacatagctgcttccttggatgggctggtgtgctccaccgtgctgaagacccgttccctgttggccacctcaggtcctctcattcatttcccagcccccctcgcctgggtaggtcaggactgcccaaccatgctctacactatctaagagaagccagaacagggcaggtggcaggctgcggtgtctttgcctgagctaacaggcatgccctagtatagtgccgggcacaaggtcactgtgggatgagcattctcttgccctgtcccttgcagtgaggtcagaagaacactcactgcccctagaccctgtgctctttgagggggatcagcttctactcccatccttcccctgtggcttcagcacagccagtagtttgctgtatccttgctcagcccctgtccttggagactggggtgggctggagacctggactcagagaggccaagaggccaggagggctggcttcaccagggaccagaaggcccaaagcccaactctggatggagggaccagctgtgaagctggcctccctcagggtttcagggatgtggcccacaggtgtaggcccctgagctgtgtctgggctcagaacacgacacctcaacctcctcaaatgctcaggacataagaggcttagcagacaacaaagtagtaccctcttagacctggggatggcgggaggggcagggttttcactggatgctggaaccagggtatggagggcccttgggccctttcccagagcaagcttggggcagagggtggggagcatgaacagtgcttccaggtcttgagtcttaagggcagggggattgcaagtgggacccagagaagaaggtccagtcctgaggtgggaggaggggcctcagaggccatctctgagcccaagcttcccttgccggagtagtttctccctggctgcttctggtgctctctccatcctctggcccctctcccacctgcattcctcttccccctgcacacatgcagtgtgcccagacagggctcacccagaccacaggggatcctaggcgatgcaaacatctagcactaaagacagcacggccacagactaagaagggcattttgttatcagctttcttaaaatcagaaagataaaaataaaactgatgcatgttcttaaaaactgatccctgtgagaaagcctgctggaccctgggccctaaactctggcactcactcatattcctgttaacaaggaaaaaggactcattagtacctagctggagttgagtaacctttgttttcttttcattgtatttactttgtgattttttttatggtaaatgatggtggtttttcctttgtgatgaagacaaaaattgtcatttaaaatgcatttttaaaacccttttttaatgaatgtttccaaatatagaccagaaatagggatgaatgccagcatgccaccagccagcctcaatgaccttggctggtctcattttttgacacccccagctcatcccacagcccattattgaagcaactcccagccaccatagaactccacctgtgtatatttcagtgtcaactgcttctgtgtgactatatcaaaagaacatggtgagtcagtcattgcacagggagtccctgtgtaaagcaaatccctgagcatggcctggagtgatgtggctgggaacacttgcctgggctggcttctcactgagtgcacaagaacttgcacctgatggggggcagccacctgccccagccctgacgtgcacatggcacctggttcttccctgtctgtagcctttcagaccgtgggcctcccaagggtgggtgggagtcctggaggctcatgtgtgatgtccctggagcctgctcagaaaatatttcctgaagaagtgggacaagctagctggttggaactcctaacacaaagggtgaggtaggccgaattttaaatgacccctgggatggttaatttttgtgtcaacttggctgggccatggggtgcccagatatctggtcaaacatttttttctgggcctgtctgttggggtatgtattagtccattctcacgctgctaataaagacattaccagagactgggtaatctaaaaagaaaaaaggtttaatggactcacagttcagcatggctggggaggcctcaggaaacttacaatcatggtggaaggggaagcaaacatgcccttcttcacatggtgacaaaaaggagaaatgctgagtgaaggttggggaaagccccttataaaaccatcagatttcatgagaactcactcactatcatgagaacagtaccagggtaacggcccctgtgattcaatcacctcccaccaggttcctcccagaacacatggggattatgggaactacaattcaagatgagatttgtgtagggacacagccaaaccacatcagagtgttttgggatgaaattaatatttgcattggtagacggagcaaagcagactgccctccccagggagggcgggtctcctctaattcaataagggccttaatagaacatagggctgagtaagaaagagtcctctctctctctgccccactgtctttcacctgggatgccggccccctcctgccttcagagtcggactcaggcagagacttgtgggccaggactccttagcttttatgatcatgtgagccagtttcttatagtgcacaaatacctacatgtgtgcatttacacatacatccttattggttctgtttctctggagaattgtgaccttttcccccatcacctttacctgtgccctggtgtcatgctcgtgaatatgttgggttacgtaagaaacgagactctacaaatgtaattaaggttactaatcagttgactttagcagagggggttattttcgaattatcctcggtgggcttaatggaatcacatgagcccttaaaagctggcagaaaaggagggcagaggggtttgaagagtgagaaagacttgaaatgctgttgctgtttggaaggtggagagggccacatagaaggaatgggggtggcctctaagcatagagagtgcacctatgttggcacccagcaaggaaatggggaccttagttttatcagcagctaagacttggatccctccccaggaccggtaggtttgagcctagcctgaccgacaccttcccttcattcttgtgagacccagagcagagactccaccagaattctggtctacaggctgtgagattaaaaaaaaaaaggatgttgctttaagtcatgaagttctggtaatttcttactcagcaacagaaggtcgattcagagagggaggaaatccctttctgttcacttctcacaatgagtgataccgattttgggtgacccttgacaggggacagtcccagaagagaatcctcttccacatttcatgtcacggggagggatgtgaggctcagagggggtcacagcaaaggaggagtggagctgaggtcagagctggagtctgggtgcttgcagcccatgtcccaagtgctcaggtgagcctagcacgggtctggtgggggtggggcacacccctgaacaggtgctcacaccactccccgcccccagctctcacccacacccacagccatacccacagcaggcttcaattttgtctaagcaactcctaagagccaacccccatctaagagcagggagtccctggaagcagacaccagtgttctgtggtggcattgtcacaggactcatcttttcagaaccactctgtctattgcccctgagccactttgggaagccatgtggatggagctgatgggtgtccaggagccagggagggagacgggcccagggaagaggcaggaccacagctgcacagcctggcaatgtggactcggacctggctaaccttgttggtgcaggggaggcgctaaggatgggcatcaaaggtgtttagtcatggggctgacaggatcagatctgtgttttgggaagacccaggctgtgtaagtagaaagaaccagttagcagatgtcgggagaggaggcagggaaagtagcaggaagaggctattgtgacagcaccgagggatacacgagaccggtccaaaccagcagctctcaaaggtcaatgcgcgctgagggagcttgttaaatccacaggtgcccaggtgccaccccagacactctgattcagatgactggccccaccccactgtaatagaatctctggtactggggcctaggcatctgcattttgaaaactgtccgggtacttccaagatgagccaggcttgggaagaggacggtggctcactgaactggggtaaaggagcagcagtaaagatgtcatggagacttctcccacaggcgccacctgagaaggtgcacagtggacactcacagagcccggggtggtgggggtgaagcaggtctgggttggagctggcagcaaagctgggctagggaggagtgcccgtcgtgatgcactgctcgccgcgtctgcctgtgggtgttcatttctattatcctcctaagcaccgctttgtaacatttcactgcattaaatgctcaaccaggaagatgaaatttatttagaaggctgaggtatttcacatctagggcaggcgacgctgctctaaatttaccaagtcaacagctcatttttgctgttgaatgggttgtagatcttatgacagaagcaagtaagtgagaacgctaccagctgtaaactttatcttattggcgaaatgtctattatgcagctaaaaacatctacttaataggtgctgtccttcaacagttggtagcaacagagtcttacgtggtgataacaatgacattatgtctcttttatcacctgtaggttctttgtattgtcaattactggctgcgtattccttccggcctcagaggctgtaggataaacaggttgcaccattatgatgatgtggtcatccctggaggcactgggggtctgcatctgattttccttcggaggcttctgcctgtattttaggatccccagtcttcatcaggacatagtgaaaatcatatgaagctaacgaagtctgacggatgagtaagtgctaatcaagccaggtgattccaactgggtcattcgtaaacatttacaggctctgagctaggggaggggcatgcagagacatacaggactccgttcctctggaatagagttctgaaatcttaaagctgcagcagcacttttggaacaagcgaaccgcccctcagggggaccctgtaagagcagacggcgctcgtgaatatacaagtctggacattggtttaaaacaagccccattccttttttcactgaaggtttgatgcagagccgaagtctgctgttctaaggaaccactagttgttattgtcctaaatccggtagaggttttggatggggtgtaggaaattttcacaagaacccaaatttcacgtggatttgtgatggattagcataccaaaatgggcttaaagtgcacttaatggatgcattactgcagaagggagccgcctaaccagagcattgctaaatttatgaaattgaaatgcacttcaggttattgagcagtctaaatttgtcaaagtcacagagtgggaggcaggtcgttactggtggcagaggtggcagaaatctgaagccaaggctgccaaaatgaatttgaagtcctccgcaatgaccccaagggctccctcacacccaggtgcagcccttttcagtggcaggagcaggacctggggctcctgagcctcagtgtttactgagcccctcctagcatgcaggaggcagagagtgacaaggtgtgtccgttctttgccctgccccacagcgcttccctaatgggtctgcccactatgaatttgaattcatgggcactggtgcacactcatggaataggcatggccttttgtctttgagtgtttggtttgtaagcctcagtctcccggcctgaaaaatagggataagtaatactggcctcataggcatgggaaagtgcttagcacagtgcttgtcacaaggtgggactttgaaggtccctttcttcaggagggggctgagtcttagtgaccttagtggttcccacattcagccctgtgagtggcacacagcaggtgttcagagagtgtctgctgaatgaatgaatgaatgagtgagtgagtgaatgtgattttaaggattgtggcaagtccctgacattccaggttgctggtgtccttgtagcatctcttacagaatctttattcaagttatacttattcatggattcaacctcattacgtaattgcatgttaacaaacattcaattatgtgactatcatgggtaaaactacttgcaataataatgattactaataagaactactattttcaactcttactgtgtcctaggaattgtgctgagtatttttaaaatactttgtcttcagtcttgacactagcccactgaggccatgtatcagccagctacagccacaacaatgctgtgtaacaaaacactttgcaacattcagtggcttgcaacaataagcattttccctgccttgctcatgttctgtaggttgcctaaagcagctctgagtcctgctgtatgtggagtgacatggctccagacagcgaatcaagttcaggtttcttccttgtgtgttcattctgaagcctctctggaagaggcagcaacatgttcgtctcatggtggaccaccagagcagaggaaagcaggtctggccctgcaagcacattccaagcctctgatccagttatattccccattatctcattgtctaaagcaagtccaaagtcaaggaatggggaagtacagtccctgcactggaaggctgtgacaaggatgcagacgtgtgataaccaccacgggagagtgaggagttgggatcaacagctcaattgactgctcgtaggtgctaccagaagcctcaaactgaggcatggaaagaagtgacttgcccagggttgctcagctagtgggtggcagaagtagaatttgaacccaggcaatttaaatccacagttgtgggggcctagagtgcacacacgggaagcggggatttattttctgaaagtatctgcatttttttttcttttttctttttttgagagggtgtctcactctgtcacccaggctggggtgcagtggtgtgatctcggctcacggcaacctctgcctcccgggaatctacgggcttgcgccaccacgcctagctaatttttgtatttttagtggagacggggtttcaccatgttggccaggcttgtctcgaactcctgaccttaagtgatccacccgcctcggcctcccaaagtgttgtgattacaggcgtgagctaccgtgcttggccggtatctgcatttttttcagccgtgacttgctaataccatgttggtatcaacctctcttgcagttacacatttatttgtctatccttccacccatccacagggacctggcatttgggtgttctttcaattctctgcagtaacaggctcaagtgcaattcttgggtaattttttgaaattaaggttgaaaggaaaaaaatcaccttctagttaatctcaggcacgtgtataaatacctttggaaagtccctggtggaattcatatcaaagcggcaccgtgatttttacttaaaaacaattttgctccatgtcaaccgtggtttctgacacctgaatttgaaagtgatctgggtgggcccagcgccatctccataacggagttatgtgtttacttggagggaggagaggaaaggcattattccctggcagtatgtgtggccctggaataatgttccacacacccttacagaaggggatttcctccttgctgtttccacagacccttccctgtgtttgtttaaacccgttgcacactggtctgacagctgcctggcccagggccttccttgcagacgcatgtacaaccaaccctctttaacagcaacctgctctgtgtcccctgatgcaattactcgagtatataaacctcactgaaaggcaggcttttcttgggagctaataaataagccccaaagccacaacgtgtgtgagaccttgaaaaatggcatcatcatctattgggaattgtgaaccctgcaaaaagcagctcgttgtattttcagaaataggtttttgtttaaaaaaaaaataaagaacaaaaatcactaagtggagtctatatggaaaaagcaatctagtctgagattctaaggcaagtctctttgctgcattcatctttcttcgcagattttatgtaagaggcattatttgcaggaaaacaagacaggattttaaagaactcccctctcatcccggtttcccatctgcagttataatcctctgatggtgacctctgcattagttgccatgggtgctgagcagaagtttatgacctcagggtggactgtagcttcaggggggcgagatgaagcctccggcaataaagagataatggggagaagccactgtcaggaatgacccttcggtggcatgtagtctacagttaacggagcactttcatttccacttctggttgcttcgaggaagagggtgctggactctggccacggggacacaggccggcaagagactgcagattctttttgtcccttggacctcagtttcctgagaggctgggcttggtgctccaagcgccctctgagcgaatctgccagaatttcatgtgtcttttctttaactgatggcatcttcagcccagagtcagtggagtcggccactggtgccgctttcttgccctcgggctgtccaggtggttccctggggcagccgactccaggccactgcggcaggccgtggcgatcggggtcctgcagagctttacctcccccgcggaagcaaaacacgccgggccaaagagccgggccagccttcccgggatgcaaaaatacaacagagggcgccgaactcaccagcgctgtggccttgaatattaatgtacgggctggctccagaccgccaagttccttaaagatgtctctggcggccgggcgcggtggcttacgcctgtaatcccagcactttgggttgggggggcggacggatcatctgaggtcgggagttcgagaccagcctgaccaacatggagaaaccccgtctgtactaaaaatataaaattagcctattttgcgtggtggcgcatgcctgtaatcccggctactcgggaggctgaggcaggagactctcttgaacccgggaggctgaggcaggagactctcttgaacccgggaggcggaagttgcagtgagccgagatcgcgccattgcattccagcctgggcaacaagagcgaaactctgtctttaaaaaaaagaagtatctggcaaggtgtcactgccagatttcaggggtttcgatgtgcttttatttggaatcaccgcaacacacaagcagtgttgactcggagggggagggggcaggggccaaacccaccgctcggcgcacacgccttgatctcacattccagactggagctgatgtgtgtcagcgcgacatggggcggggggagggttctcctcggatgtttcattcgccgtctgcacgtcactcccaaacttttcctcccagcgctcggggagtcaggttgacgcgccctggatgcggggctagaggctcggggctgggcgcgctcccgcggagccggagccgcagaggctcccgggctggactcaggcttctcaggtacaagttaggtgccagacgccgaggtggggtcggcgaggagcggcggtaggaggtctggccctgggctcggggctccggcgcccctccgcgggttcgggccaggcagcgccggcggcggccggggctgggcgtagggagtccgggccggcggaggcggcgcgcagcctcactccccgcggcgctcccggcgcggtggtggcggtggcggtggcggcggcggcccaggcagacaatgaacttgcgagctcgacgagccgaggcaggtttgggccccgggctccttggcccggcctccccgaggcttcagcgatccccagcgggaggagtcccttcgccattggtcctggccgcgctccgggcgccctgcgcgcttgaggaccccgcgggaagggttacccagcggcgacacacgccccctccctcgcagagaggacgcggccggagcgaggggacaggggaccgagcagtggcgtggtggcgccgtggatagccggaggccggcggggggcgcaagccgcgtggaacgcaccggcgggctgtccgggagaaggagcccagtagtcggaatcggggcgcccctgcaccgcccagctctgggagccgcaggcgggggaccgaccgacggacagaccagtgctttcacggtgtgagcgcgcgtcgtttggcggtaggggacggggattccccccagccttgcgctccgcccccacacccctatcgcactttggggaagtttccaggcgcggcccggggcaggtaagtgggcatccgccactctctccccggttgcgagctcggatgcgcttccagaaccctggctctagccttgcggcggttccgggcggggaggccagagctctcccgcgcctaagcccgtgggacccggttcagggaagggggatggcgggggcgggcctgggaagagataggggagcggctgagccccgagcggtgtgaacttttgctccccgccccctcctccttcctcctccccgccccgcccccactgctgtcccctccctgcgccccgccgcgtctcgggaggcggcgtgactcgggagttgccggcgcttcccggcggtggcggcgtctctggccggccttggtgcggcgagccgagcgaggcagctctgagccgcgcggtgaggccagaggcggggagccggggctgcggggcggcgaagctggggagccggatggcagcggccggggcgcggaggcgacgctggcggtggagatgtaatgcgagtctgttgggttgtgtgtgccgggagataggacgcggtggctgtgggtggctgggtggcgggctgtggcgcaattggccccctgggatggcaggatagaggcgccggggcgaagggaaccttgcctttgggaaaatgaatgaagagccgtggaagcaccttcccgactcctccaggcaaccgatgggccggcgtgcgcgcgagtgtgtgcgtgttgaggcttcggagccgcccgggtcctgggcacagctgcttgacctccccgtcgctgtccgggtgcccacgttcccgcccgccctgcgcccggggccggccggcgcggctgggacggcgggtatagaggaggaaggctggggctgggttgccggctgctggcggctggaggtccgcgcccagtgtagggaagtcttcgaaggaggctgccaggctggaggctgggaccagctcctgggggcgggggcccttcttcgtctgcctgcgtgcgcggagccgctgtgacagctgggcgccttcgccttgttcacgttggttaagttaattgtaccgagttctcgggaatgaagtgtggctccgggatgccccgcagagggatgtgacaagccggtcagtgaggctgagcaaaggggctaaccttgcctctgggcgccctagcagtgcccccagcccctctttatcagctgcaattcctgagtgttgtgggatgcctcggtgggttagggtagccacccagcgttggggcagaaaggcctcggagggcatctgcacccccgaggggccctgaagtaaactgaggcctagagatttgcccagcgtttctcctggaccctccttggaccttcctggaccattatccatcccccgctttcctgcttctcctcccaggaccggcaaccttgcaaaatcaggaaccctcccttccagaacatggcacttactaattttacaaactgaatgttgaactaggatctcttgattgatacataaagacatacatagatcatatatgattttattcaaagtagtataggaataaaaatgccttctaagtaggtaggtttttgcaaacaagtttttctcccccaagttcctgagaaactgtcagaagattttctttcttgccacctcctagatgggcacacagagctggtgaggtaaagtggcttgttatggccttcctgtgggcacataggtgagctggaggtggagctgcaggtctgggcttccctccaaagtccagctccggaggagagccagctcaggagccctctgcagaagtccaaccctgtctttgcggctctctcctctgggctttggatgattgcagtgagctggcttgtaggtgaagcatgcaggggtaattcatccaggatattgtccaggggggtggcaggcaggtcggcccacagtggtcacatgtgtgccttgcttttcttggatgatcaaagctcgccatgtctgagccactgtcctggccagggacccagcacggtcaccgtggctgctgtgagggctgcagtttccttccacacctttgtcatccctggttgctgctgcccctggccaggaaaagtgagatatcagaaacatttgatttttcacatgcctggaagagagaagattaattcctgcatcaagaagaagtgtttggggaaaggttggtaacgtgggaagcggattctacttatttggcgtcttgagaaacagcagacaagaaattccaagttaactagctgggccccaggagtctgcagtaggggaagctgtagattagtgctggactgtggtagtccaagccatttcgagttcggctggaaggtcccctgctagtggagggggctggggagaagagggagaccccagggctgtcctgaacaggtgagcacatgcccatctacaggggacagactagactcagctccagccagttggggggaaaacagtgtcaacaggtcttgtgaattttcgagaggattctccagcctgggtatttaaatgtgggctcaaattctagaagtatggtagagggttaggggtgagtgcccttccaggaggtctgaagcttgccatctggcccggtgcttatctattgggaagggtgtcactgcatcagagagcagggcacaggagccacacccattgtgggcccagggactaagaactgatggctgcccatcatgcctgcggccaggtccctaggctggaggtgaggcgggcagagctccttcatgtactcgtgtgccatgtgttcattcagcagctgttgaatgaattgccatgatgtagaaagtcatctgcatgaaccttttcatataattcctttcaccaaatagatcctacagctgagcctctgggatgatttggcggggctaggacagacagggtcccagccctcatgggatggggacaagcggaattggctgtgtagacagacaaatggtccagaagctgccataagagcccagaagggtggtgatgcaaagcaaggcttgggagcaggggtcagggagtggagggtggactcgggggagtgtgaggagtctccttttcaggtgtggacattgaatttcagagcagtgggtgggaggcacccaccccctgaacaggggatgctcaggtatgatattaagttgggagtgacttgcccaaggtcacatagccagtaagtggaaagtcagggggtctctgatctccagctcttggccagctccttcatctccactgtactgggctgaggcctcttagaaactcccagaggtgtggacactccctgtaattggcagctgtcatttttcccatctacacgttcaggccctgtccccgttcctagggcctcagcaggcccaggattgcagagatgccatttggagcatatttgtatgaaagaagagtcgtctaaattctaaaagcagagactgtttttaaaagtggtagctgacttgggagtgtcattgatctgagcaatcagccagcggacttctctttagcagcttgtgatttggaagtgactcagtcactggtgagaatcacgcagcctccctccccttctggtctgtaaaggggatgctcaggtatgagattaagttacttcaaagggtcactctgttccagtgctgtgaatgaggagatcatgtttgcacttagctggctaagtgttgggaggctgagtgtttccactgctcaaggcatttcttcattggcctgcagtatgagggtctgatttctttactgagatagtttctcctttcaaataaagcactgggacaaaatgatttatgtgtagacctgtgtctccacagcaggagatggaccataaatggaacagttatctaattagtgtgtccagtctaggtgtctagttaggagtgtccaggaagaaggagaaaggttttgtgtccatttgggccaacatagattttttaaattgtaactatgggagttggggaggaagacagttcatcgcaagacctatcacgtgctgcgtccctataggtttgaagctggccctctgctagacaggtcacacaggtatatccctttgtgtcctttaaagggctgggaagctgttggagatgacacacaccaagctctcagccatccggatgtgcaggaggagggattgggaatgacggtagaggcaggagggaaataagggggtgaggggagaagaacaactgtggctccagaaggaggaggcggcgtgaatcagcaagtggttaagttgtggggaggtggcaagtgggaagcagtttctcatcttcgctgatttccaaagggatggagaggaaaggaggctgtctgcagcaggacctgcagcgtttctgccctgcaaccctgggccaggtgcatgggggcagagagccagcgctcagcacagagcacagcactcagatcagtgggcgaggcggagctcgtgcaagtcagagttatgtaacgccgttgacaggcaccttatggggcttggcaaagtgcagcaggagcccggggtagcgactttgagattggagtgttccgggaagacttcgccccctggcttgagggcgggtgtcttttcagagttaatacctgccagtgcttggcacagtgcctggcatccagtaagtgctcagtaaacactggctcgggtgatattcttcagccccggagctcctaaccgtgcatgtctccatatttgattccagtatattctacctcaaaggatataggcaggagcccctgcaagccttggctccagctaggtttccttagggtggtggcttcactctctggactctgtctcctcatctgtgcgaggagaacactggtaaacagctacccttcaagacccttcagctgaccttgcagccaggctgtggagcagctccgctgtgcccatatttgatgcaattaaccagagagaggagaccgcgtggctctaggtggaactgtgctggtgtagctcgcttgtgaatgttacatctcaccccactctcagcttaaaagagcccagagggggcctggagggcgggggggtgggggctcctggcttcggcaggctctccctgatgcctattttacatttctagaacttatcgtggcccaggcctcttagatctctgaagaaagtaaggctggcagatcctcaaaagcagagggtatcattataatggaaacttggacactttccagaattgcatttgtggtaaaaatattgaaacagacagtccaggcacccaggtgcctggaaaataccccaacatgggcaaataattagatacaggccaggcacaattatgtttttctgacaataggctggaactcggtggcttagcattttctcttgaaacagaatacgcccctgccggacccttttgctccctgtggtcaaaaagatagtggtgtggccagcaagggggagggcatacaaggagaagtggcgatcccatccctcccagggtggccctggatctatctcagggaggttctgtcctgcttttgcttttctgtgtccctgtaggtagctgtcccgagggactgggcccgtggcacctttgctaggaggccagagcctgcatttcagagtctaagaggtcgagagaggtgtaagatgtattatcttacccttccacgaaagtggtctgggcagctgtgttcccttttgtaacccctggcagctcactcatgctgatggcggtaagttcacctgtaccttcacgtttcttgtcagccaaatatttggcgcccgtgacacggaagctcttttagcccaggtgttagatcgcataggcactgggtggggcagggcaggtagtgggttgagcctgggatccacgctgactcaggttcaagttcatgcagtgctgcttcgtcccattactgtggctctgaacaagtggcttagcttgcatctcggtttccccatctgtaaaatggggttaatgatctctacctggttgggtggcttgagtatttgaaatagtacaattcagggttcaggggagctccccacatggaatcacttttttctgggtgaggtctaaacctatggagagatagaggaggaggaggaggaggaggaggaggaggaaggcaggtggaaatccacatgcgatggctgttcccgactgcagctgttgttggagaatgtggctgaaccagtgggcaaggaagtggggaacaggggcagtcaggcagacccgcccaccccattgcctgcggagctggaggagcctctcccagcagggcgaagggcctccttaccatggggaaaggcagggctgggctgtcatgtccacgccctccttccatattcctgggatggtgtagaaaccaccacgtatagacaacaggaaagttacacaggggagcttcctcctcatggaaggaaacatctggggtggcggagaacagtcgccctgtggcaaggaatatgatgtgctgggctccgtgcccggcccacggttggagggtggtcaatggcatctgttaggtacgtacttggtagaagtggccacagtgtgtcaaatcggtgttgttgtctgctgtaggaaataatctggctttaaattcaagaacatctctttcctacttgttggcagagcatgattgaggtaatggtgatccatggatctcaaggtcacattctaagttgaacgcaattcacagggagctgaggtagtggttgactcctagcctgggcctggagaagcttctctgcctcctctctcttggtcccagccccccacagggcctgtgcttttaccagacctggttctgtgtttgcaacgagacgcctggccagccgggcctggacctggctacacttgggtcccccggccactggagagggggagcccccacatttgcctacttcatcatcgagccccccacccccactgccttcaggaagcgtttgccagtcattcttgctatctgctccccgtacctcccttccccagccaggtgtggatccttcctcctctgagcttctgcagttttcctctgttgtatttctcaaccttgaccctgtcccacactgtgctgggctccagtttcctgggtgcagtctgctctcccagcctgatgaggctctcttcaggaggagggtgtctggggctcacggtacatccatgtagctggactctcacttagtggccagtgactgccatgtgctgcattaacgcgtcaattaaaaatgattcttccaaaggctaggttctcctggaggttttatgtgaacactgagtttgatagtgtggcacaggagagctcacacttgtcactcaatttcccaaggagtcgagagtctaatggaataaccttggatttcctggcattaggttttggggctattaaaacatagtgaccacagttttttgtgtcttgagagccttaggggaaaatgttatggaaatttggttgttgtttcaggaatataagcggagccgtctactcaggcgagaaatgtggaggctgctggtgtttcttatagctggtataaatagcttggcttcaagttccatgctcctttgtttggaatgtaaatatttgcattaaaaatataaagtatgtcctggcatgtatttttagggactataatttccaaaccccaaatcagactatgggtctactgaggattaattttctctgctttgtgaacctgtgtatgtaaagagtcttccaaatgtacacaccaaaccctgtttgctttgtgcatggaaggaaccgccaggattacaagaaagcagggttgccccggggagtgtgggccgagggcttgtgtttctctccacacacttctgatggttctgcctggtagctgcagcggctcagggcggtggggtggaggagttttggccgagatcttgtgggtatcatcaggggcctggcttctctgttgttggtttcctggacatccaggtggggatttggctgcagctggctgacctctgtgtcacgtaaccagacgcttgactttggagttgcagttgctctaggaagatgttcgggagttttagtgccctttctgtggtctggtggagggagcaggaggttctcatgtccggttcagaggtgaactgtgaaggcctctgtgtggtgtcttcctccactggattcctgggggctgtttagctttaatttttctatgaaggacaacctggatgattggttaatcccttactgtgggtgggatgtcatctctggtctggcctcggcctgttctcggtagtggggggcttgatgggcagcaggagctgggcaggccatttgcccctggtatgggggagcttgttcctaaggctctctgggcagccttcaatggtcaccttctggcccaaaggctctaacggagaaggttgggccatggaggtcagctggcctgcaggggaggaccgaatgcaggtgggcccccaactggcaacctccctcttgtctcatcacaggatgaagggcagatgagaagacagccaggagggtcctgggccctcagctgtgactccccgagaggcaggtaccaagggcttcctttgtccttgcttcccagccagcgcgtggcccctgcccttgggagggtcagctcctcctccgtcccactgaacactgatgcctcaggactggactccttggggcagcagagacccttccgtctttccttccctagctctgccttgcaaaggtgcagcctcctgagcctcagagtgtctgacatctctctgcctaggcaccctctctgaaacattgtgtgggcttagaaaccgtgagccttgggaaggaccatcttcctctgagctctgggcgtgttgaactgcggaggcttaccacttcctcgcctgtggtcatctccagcctgacccatggtggcgtgatcctctctcatcatccgtcacagtttttaataaagaaaatatgttccagaaaggccgagtccccatgccgcatcaggtcagtgatccaagtgcattatagtgaaagtcagaggaaatagctgcttttaggacacgctgaacttgcctaagaaagttattagtgggaataaatgagggggaagaaagcatgctccgactaacgagaacagtatcagcctgacattttgtgtcgtcctaactttgaaaagctatttatacccacttgctagcagtttctatgagaaattagatatgaggagatgtacagaagagaagagtgggagctgggtgactgtgagctcctcctcagaaacatcttccaggcaaaaaaaaggaaaagaaaaaatcatttgctcacctatcgacaatagaaaatccagggatcttttgcattgtataaaatttggctcagagaagaaaaatgatgtattgaaaagaagatgaagcttcagttgccatttgagtggtggaaaataaatttgctttcggcccttaaaatggaaataagtcgatagaaaaatgcaggcctgcccccttttgagtcagcagtttttttggttgatgaaagggtgagaagacgtgctcactggaagtcacccgctggatcacttaggaagccgcagaagtgccgaaggacatgcatgtgtatctttcaaagttctcaactgatttattaaaaaaaatcataaagcagacttttgaaaaacctgttcaatctattcttctttaacagctttactgaaatgtaatgcacacaccataaaattcacccaaagtatacaattccatgttttttagtatattgacagatacgtgcaaccactaccacagctaattttagaactttttttaatctcaaaaagacatcttgtacaccttagctatcacccctttatctccccattcccctacatgtacccttcagccttgagcaaccacaaatctacttcttgtctctgtccagcccaattcctctattgtggactttcgtatgagcagaatcacatagaatgaggtcttttgtgactggcttcttttactctgtgtaactgtcatggttcatccatgctgtggcatgcgtcagcacttccttccttttcatggctgaataatattccatcgcagggatagaccacagtttcatggatccatttgtccattgatagacatttgggtggtctccacctttggctcttatgaatgaggcggccataaacgtttgtgtacaagcttctttgggtgtggacatgtgtttccgtttctagggttatgttttatgagacgttttcactttcttctaataataagattcattttttaaacaacactctttccctggccctagaaaaggctttgttcttagatgggatcccgatccccctgtcagtgatcctggctgagatactgaattgtctgaattttagagctggaaaggccttcgggcgaacgtggttcagcccctttttatagatggggaagctgagggccagagaggccacacataaagagacaggattgaataccggtttttggagttacaatccaattactccaaaagttctccctaaactcttactaaaaccccaggttgccttcttgactggcctggggcagcagattaaggtgggttgggtgaacagatggtggttagcttgccctcttttatgtgattatgggtcaaggttttcagtcatccaatgtactcttgcctgttttcctttcacccatctgtctgtccatccaatgtccatctgatgtccgaggcccagaacatctccccatccaccagcggccgaataagaacagcaccttgtggcgccagcatctttctagttctttctcccctgcggtgatgggcggcccggctgcttatccggggaataattaaattaggaaccaattcagagaatgaaattttatctgatttggccaagcccgtaataagcaaggggctgtaattgtgactccaggatacattaggaagttgttttttcaagggtacgctgggtgaaagcattgaaagaaatatgtggagaccaggccgggagatctccctgggccaggtttcttgcatggcctgggggtgtggtcccacagggcggctgtgtcctcaggctggtccttccagcgtttatgtttccaggcaccatttagctctgatgaggtagataaaagtgttttgtggctggagtgttctctgtgcttaggaaagttctgttaaaatccttatggatatctatctcattgttatcactgatattctaaagcacctttacaactgtaataagaagtaaacttggcagaaactctgtggctataaatcaggggtgccgctttgcaacccccacggagcttattgaaagaaatgcacatactttggtcctacatcagctgttacatcaagtctccggggatggatgctgggcatttgtgtgtgtgtgcacgcgtgtgtgtgtgcatgcgtgcatgtgtgtgcatgcgtgcatgtgtgtgcatgcatggacctggattcgttaagctctttagctaagaaacgctgagggaacttagcagtgattgtaatcattcttctaatgagaatttccagttctcctatggcaaagataagggacagataattagcacagtggtctcaggaatgagcctcatttgtcctcaatctgtgatgagactttgtgactgtctttgagtttcatgttcagattccctgattgtaactaacacacattgttcatcacttggtagcagtggtggaattttagatctgtttttctcttggggaaggaccccattctcatccccacagtggcccaggctggaggcccaggagtctcctttgacagatagctggtcagtgcagaattgcttcctttgtgtctctgccactggaaggttatctgttccttcagaacaggaaatgtgtcttattcaacgtggcatccccagggcctagtccatgggaaagaatgattgggccgatggacagacagatgggtgaaaggaaaacaggcaagagtatagtgaataattgaaaactttgacccatagtgcagggatggtgagtgtctttcagatcgtctgtttatagctggggaaacggaggcctgcagaagtcagtgacttgccctaatccttcagctttgatcaagaagaacattggggagcctggcccttcaatgtcttcaactcttctgactcaggctctgcacatcctcttgagagtcaccctccagtgaaaagaactctttattgaggccctgctgtgtaccccatgctgttctaggagctggggatctagcagtgagttagacacacagggtcccagtgctcacagagggcatatcctcatggagagagacaggcagcagacaaggtcgcaaatatcagagaatagacaggcataagggccatgtgctggagtgaccagctggtgtgcgggaaaggcctttccacaaaggtgacatctccgttgattcttgaatgttcagagggtgctgctgtctgatgcttggaaggagggaacagtcagtgccaggaccccaaggggagaacctgttgatgggatgggattcatttatgctcgggagaaagagacttggtttattggacgcctgggttgattttcttctcttctgcatcctctgcactgacatttgcagctctgccttctccccgtcccgtctctgggtgaagaacacctgtccgatgctcgctggcctgcagctgctgcagagtttcagaaaacagggctagcaaaaaacaaagcaaaaccccaacatccctgtcctctcactaagggcttggctggggaggcagagttatttttatgtaagcacatgcttgagggggtacgtcttggggtgggcagctgaaaccacactcataaaaacaagaccgaaataggactgtgaattcccaaaggtgaacacaggccgttaacttgaatttggtgacagttccatgcagcctaggtcctggagcgggaaccctttggagggggatgaggcatggaaaactgtttgctgatttggcctcttctttaagcattgctttccggccctggctgtgacagagacctggcccttgctcaggatttgagccccctcaaggggaagttcttcctccctcctggtgctgcctccagctgtttctgtctcctcgtcagtaagaacctctgtttcttgagggccctcctgttggttgtcctcttgttgcagccacctccctacctgcgagggagtgggccccaggctgcctctccatcccaggtcctgctgttaacctgggtaaccgtggtctccatggggcagcactctggcctcccaggtcctgcatcaggacaccctgaaccttgtctactcctggactgctccataccacatggagtccgtccttgttaatgacgtgttaatgccaggctttcttgtggaaaccacacccaagacaccagctggtcaacctgacacacagtagggcctcaacggattgtgtcatcagttattttcataaactttaaatctctttctggtctccccagacatccttaagagtgatcctttgtcacattgcaaagttttcccaataaatattggtcagtagttgtgacagtaatatacatctccattttatgttgttgactaatttttaaatggtggacaaaacataaatttttctacattttaataaatggaaagataaaagaaatttttttttctgagtagtttggtttagaatcattccagttgttcattcagcatctcttcccaagtcacatgagtcctacaccaggcagctgtggctgtattgacatgctgaatgcttgctcagagtccccataatctcttggcactcctatatgctgcctcatacttttattttaattttttattttgaaataatttcagactcacaagaagatgcaaaaatagtagactccctgtgtacccttcactcagcttcccacagggagaacatcttatgcaaccctcagacatgatcaaagccaggaaactgacactggtacaatagcattaactgagctgcagaccttatttttcttattaaacctagggatctacagcattttagaagcattttagaatttcataagctttagcattgttgtttgtcttttagaggatgtttcaatcccttccaattgacaatcagttaaaattcgtttccgtaagttcaacaaatactggaggatgaatttcacaggttccacgggtccacatggcgctctatgggtgcatcgtctctgatgggtgcacagaggtgaccttctacctcagatctgagagattctgagacataaagaaccttagacagtagtttggtttataggacagaccaggggagctggagttctgataatggaaaccaggctgcattgagtatttagtatgctttaggttttatctactttatttcatttcatacactcagcaacctttgaggtagatacagttaacatccccattttacagatgtaagaactgagttcagaggagttcaccctgcccacattcctgcagctggatggtagagttgggcgtggaatataggcagtgtgaagtcagagactgcttgttcttaaccttgccgggctccctccttggctcaggcctgcacagtgactgctgtgtgccctggggctgtcctgacttctctgagtctctgtttctttacctgcaatgcaagaggcttgtgtgagatctgccgtgtcccttccatttctgagtgcaggtggttttattggtgaaaacaattctacccgtagagctagaaacacccaagcaacatccaaatgaaatttgtaccttgccccttgtaggtgcttttaaggttggtagaatttctgcagcctagtttggtttgatgggagcctcaattccaattgaattatgctctggtgtattttaattaaaccatctacaagctgattttataaagaggcagaatccccatgtagtgagctgtgcctgcctccctctgtgctcaactctggagccgagtgaggctcgtaataaccagaggactgtgcgagctgctcaggctcggcctcatgggcagcattaattgtgagatgccaccggaacgagatgcgagggcattatcagcatatacttaattgattttgcattctccacaaaggaaggttaaaattaagcttgtttgtaaatggtgtttaaactgcacaggcttggggatgagttgcagaaactaacagagcagggcactggttggagggcctaattttctctttaggtggtggacagagcacatcactcaactaaggtaaagattttcccatttaaaggggctgaaagagtgtaagcctcggctcgtaaatttgacagacaaggcctccgcttgagtgcctcagggatggtctggactctggggatgaatgtgtaatcacattagcgtgatgagttaaagggccccatatttttaaatcctcaggcagagctgcattagagaagatgctgttcgagatcagacttatgataaacaggctcatggaaacagcctttgctatcctcattcctggtatagaatgtaagattctgattgtcattctgacatgccccaggaaaggtctctgctcaaacccaagatgagctttaaacctgaggtggaatgccgttctctaagtatctgttctttggctctaacatataccaggaatgagaacagcactctgggtgtgttctcactctcctttaatcctgataagaaaacattttaagtatctccagatccatctatataatttgcaagacgcagtgcaacatgaaatgcatattaaaaattattaagaattggccgggcgcggtggctcacgcctgtaatcccaacactttgggaggctgaggcaggtggatcacgaggtcaggagattgagaccatcctggctaacacggtgaaaccctgtctctactaaaaatacaaaaaagtagccgggcgtggtggcaggcgcctgtagtcccagctcctcgggaggctgaggcaggagaatggtgtgaacccggaaggcggagcttgcagtgagccgagatcgcaccactgcactccagcctgggcgacagagcgagactccgtctcaaaaaaaaaaaaaaaaattaagaatttaaaaatagggaaagcagaacaatacattctgtatagggtgtttctgagcaaagggccctgtgtgattgaccatgggtccacgcccttggagttggctctgggatcttgtaggatgctgatcctagaccaatgtgatttatagcaacttgtgtgaattgtgaactccccgggggcacgggctgcagctgaatcaccttggtgtgctgggaggggtctggctggaggcctgacctaagcacacgcttaggaaatgcccgttgagctgaatcaactaactcatggagccatcagcctggtctgctggggaaatttcatgtgactttctcagtctccacgcatcgggaatctgggacagtctaccgctaggctcttcagaacagacagggacaaggaccaacattctctaatgaaactcactgacttgacagctcagctttgagaagagaaaacctgaatacaaaacccatctacattatgtgtgtgtataagcctcaagtcctggtgatttttcactgtaaaatggaaaagattgacacacagtggctctccagtacctctgtgtggttaatgtgtgtgtctgtcgtgactctgtggctcagtcccaagagaggggcagcccatctcccctggcttttcatccctgatgtcctccctgtgagctctgctcctcccagtggagtaaaatgctcctggagacagtctaggattttaggggccactgtaggtcatccttgtcattctggatcccggagaatgccaccttgcaaagttgaggggggcatagtgcatcttggtaaggaaataaaatcccgcccaggaagcatctctccctggagcaagaggcttggaagggcccgggactcctttgtgctgactctttgttccttccctgcaggctggcccagactcagagttgccctttcccctttgccagtggagagggagagaggagcatccagggccagctgccaaagacaggggaggttctaaccaaggaaagcccggacttttcaggttttaaattggaagagggcttcttgaatgagcattaaagttacttttttattggaagggagtgtagggggtggatgctgtgctcagcatacatcaggagagagctgcccaagtcagatctcttccgagcagcgtcttgggggagagactgtgcaccaccgctagattttcctccctttgtcctcggtttgtacagaggtcactggagatgtgagctcaaagggagccgggacgctgtgctctcctctcattgtcacaagtcgatgggcctgaataggctgtgacacttgaagaaagaaagaaaccatcctttatacctcctggctggggagagacagcagggcaggaagcctgcagtgctggaggccaaagctactcccatggagcctcagatgtgtggagggaggtctgtgctgttcctgggtgtctgggattgtaccctccccaccgtggggatgcacagcctgttcttaacttattcagcaaataacaaacagcacctccatgttcaagcaaaagctggctttatttattttccccattaagctatccacagtcattgttttcactttcaaaagcaaaataataggaaaaaacttcacagtatttgtattacctgatgtaggagtctgagagaacttgaataataagtctggcttagaagtattaggggaaaaatcttgatacacaaaagagaaacagaaacatgaaaagaggaatgtgctgaaacagtcctccctgcaaaacatcattaactccgcgggggctgggagcctgtctgtcttgtccacacactgcaccccactgcctagcacagccgcattcaaaaggaaagtcagccctggctgctgggaggcagtggcgagtgagacatgcccaggtcctgtcctcatggaggttagagtctaggaggtgaatgaggtggaaacacttaggcaaaggatcatttaatttcagttgtgatgagctggggacaggaacgggaagtggtctatgagcaagtttgctgatgccgtgagcccagtctggcagaggcgcggggtgcattggagagctccaggtcataatggaggaagctgcgcggagggagaggaggcagagactgcagacgtggcgaaggtgttgggtgtgcagggggatgttatgtaagtccccagtgaggtgcctggacccagagttctcattttaaggcttagaatgtgctagaatccttgtttctagagactggattgatgatcacaactgggcgatgctcccaactaggcccccgcccctacctgccacctgaattgtgccctttgcagttgggtggcacactgtttagtgtctcctgctcactgcctccagggttccagggacttgctgattttctgtctctactgagagatttgagaaattcttgaagcaacttgccaagtagaaactgtctaatggcatcagtgcaagggttcggtgtctttcccagccggggggcactggccctgcagaaatgaagtggaaagatcttgggagggagagcaagctaccttccctgggggtgcagcaggcgtgacttgagcttgcgctaatcacacccacttctgtcctgagaaagtcttctatggaaagaggctaaaaagactatgtggaaaatatctcttttaaagcccccatttgagacctctcccctgccctgtgtgtgcctagcccgtaggttgctgccaaggtgagcaggcccgggatgtggctggggaagatctacagcctcctggccgagtccacccaggaggagccatttaagaccctggaaacccatcagacctggcaactggaggtcattagccgtctgactgagaggcgggtcgtaaaataagccctaagtggttacgagctctgttaaccattttaaaatgcacaaacagaggagctttggtttggcgcctctgaaaggaaatgggcgtcgtctgatgggagaacattcgccttcatggtcaaggcgcaaggaccagcctgcattggctcattcatgcgcctgtcgaatggttgctgtgccctttgcctcttccttggtttctgatggggcagaaacttaccaccatgtatctagctttctttttttggtgaacttttaaggaattggagtataaccttcatgcattaaagagcatctatcctaagtgtgctgcttgatggattttcacaaacagaactcacctatgcaaccagtacctagatcaggtatacagacagcaccccaggacccctgggctctgttctggtcattaaccacctctcagcacccatgcaagggaaattgctatcctgacttccgcggcctgggtttttggcctgttttgtgctgtctctaactggaatcctgtgtggttctcctttatatctgggttcttttgctcagtactacatctgtgagattcttccctggtgaagcttgtccattttcgcagctgaattgtatttgtccgttctactgtgggtagacactgtgtgatttccagtttttggccctacaaatagtacaatgaacattctagttgatgtcttttgatcagcatatggatgcctttctgttgggcacgtagctaggattggaattgtggtctttgggagtgagtacgcccaagcttcagtagataatgccagtgttccaaacaattgtactcatttaccgttcccatcagcagcgtatgagtctctggaaagatgaaataagagcctggaaaaaatgtaaggtgagactgactcccttttgtcctctgcccaagttcccaaaaagaagagaccctgggggataacagctggccctttttgcattgaatgggtgcactggaagagataaggcttctgggatgccccagaaagatgcacctgtccctcctggggttctgcccacgtggtcacgtttcactggaagccagtctgtttctgaacttgcggatggggttggttggtctctgagaagagcccagaattcagcattttagtctccatgctttgggtgtctgcatgcaatgaagcaaagcctccaggctcatctttgagatgaaagtggctggcctggtggctggcctggtagctggcctgggttttctcttgggagggcttgagagctgccaccatttaatggctcagtcaagaaaggtttttatttgtagatcagtccagtctcagaaccaaatggttctgcacccaccccctggacttccaacccagtgttctaggtggagaaagagctttccctgtgccaaaagctgttgtttggtgtgatgaggggtccagagcagtgggaagaggcagctgacatttactgagcctcctgcatgctcaggagaactccgaatgcaggtgtgctggtctccccaaccacacaggaagtggaagaagagaggactctgcactgtccctgagcagcagagccccagctggggtgtgtgtcctgccctggctctgtcaaatttgtaactcacaacagtggcagtggctggctaaaggagacttggaaggaaggaaaacctgtgcccgggttattgcccggctgtcttccctaccccaagtagattcagtaaatcgggggcagggcttggaagctgttggtaacaaatgccttaggtgagttttactcaatttggggaagcagtgacttcccagacccttttgatgagaggctgggtaaggagaggaatggaggaaataagaaacagatctcacgctccaggagcgcctggcctgagcagcctcgtgcaggaagctctctgaggagctggacaagctctgtgtctgctgctccacagggtcatgcttgaaatgtgactaggacggccgaagaatggaaattttacatctcatttacttttaactaatttaaatttaaaagcagatacttaattcagttattagaaaacttttaagaatgtttggaacagcttgggtccataactccttttccgactctaagtcttatgaaatctagatacagctcaggtacttcagatgaaaatgtagcatccaaattgagatggacctaagtgtaaaatacacactggaatttgaagacttagtatgaaaaaaatgcaaatttttaattaataacttttatactgactacatgttgaagtggttattttgcgtctattcgagttgaactacatgaaaattaacctcacctggaacatttaacctaggtatgggctcacactctgtttttgttgggcagtgctgctctgaggcactttcttgctggaatttgactcagagtgctagggagttggaggagaggagagaagccccagctgtggccccttgtttggctcacgtgggagcagggtttcaggctgatggcacacctggccctatagatggccacaaggccacctgtgatgggtctgttgggctctggctggcctgtccatctccttgggtactttgcccaaagagggaaactgcccgttccctccaggtagtgcctttagaaaacgagaatcttctctaacgctctgggctaggaagagagagctgagcacgtctcaccctgggctgcactgcatctcacacaagtgggacatggcctgctgctggtcagggtgagaactctgcctttaagttagaatcagatcaaatcaaatcaaattgaattctttaccccagtggggtagagagcaccgccaaatactaagctacaggaatgtggcccagaaagcaaattaggttttatttctgcctcctgcctttgccccgctgtttctggaagagaccccatagacagtgccgtgaagggcagcctacggagtctgtggcaggcagggactcgcaggtgagcctggtagtgggtcggcgggttctcatccatggtgctcagcccgtctgaggtcatctgccctcttcttcattggattctggaagcctccccaccagcctgcgagatgcagctgaacagggacttgttttgtttactgctgcatcccagggctctacacttgagcctgacatagagtagggctttaataatctttattgagggccgggcacaatggctcactcctgaatcccagcactttaggaggccccggccagacagatcacgaggtcaagagatcaagaccatcctggccaacgtggtgaaaccccgtttctatttaaaaaaaaaatcagctgagcatggtggtgtgcacctttagtcccagccactcaggaggctgaggcagaagaatctcttgaacctgggaggcagaggttgcagtgagccgagatcgagccactgcactccagcctggtgacagagcgagactcagtgtcaaaacaaaaacaaaacaaaacaaaaaaactttactgaatgggttcatttggaggatgccccttaaatctgatggtcaaatatggccttcatgttgaccttcctgaagtgacatccccgtaggtgggcatatgcatttcccttgggagagattcccagaggggcctctggcttgggattggctaggaacctcagacctacattgtgtttttactctagatctgtaagtgcagatttttcttttttttccagaaactgtttcttggacaacacagcaactactttccattgcaaagaaaaatcctgtcctttgtgtgctctctacaaagcactcacacagccaggctatatcatttgttcctgacaacgtgctgggggggacatcaccattttctgcatgtccccaggaaatgggcgggaccacttgtccaaagtcctacagctaaagggaggcacagtgacaccttagattcaggggaactcccatcttggggtgacttctttgccctcagtatattccacatgtcatggaacctaatggataaatctggtttggtcaggcctggagcgcagaactgttaaaggcaggcaatgagagaaaaatctgcgtccttcctcgagggatgagctggctgactgggaaggtccaggctcaggctggcctctgcccaggtgtcctatggcaggggctcatggaggagcactgttcctgttttctgggtcccctgctctgcctcacctgtttaaagtcagtgactcaaatttttaaaactgtgaaaccgtaaactgtccatccctgttcagccttccccaggccacgggccctgcacgtgtcactgcttgttcatggttctcccctgtgttgcctttgaggctcactcatcttgatgactcagagacttgccagagaccctggactccccgtcccaaattccccgagcctggccccgatgattcttgcaatgttactctgttcatggtgcctctgccccatttccatctgtgccatatcaccaatagttggggggggggtcccccaaacaacagggactaacttgaactttgcaagactcttgaatttcctggctatatttattatctgtatggcactgatttgtactagagctgagcctgcagaagtcagttgaacccatcctctctatattcaggaggactacaggatgtaggaactcaaacgggatgttgatctgtgggagtttgcaactttgcctagcagcacagacctgcctccttgggagaggcctctggggagggatgctaagccgatggatgtctgtgcagagacaagggactgtccttttcacctgagaggccattctcatcctgcctagtcctgtctgattcacatctgaccccagcttagcccagacagagacatgctaaagcatgttctgatactttctagcttcgattatctccttgtatgctttctttgtatacttagggcccaaaataccataaggtggaacattctaaagtaaaaatgatcccctttttattgtttgaaaatttgtgtttcttattaaaatagaacattttacagttattcacaagataaggtcttactttaaaaatcactattttcctctgtctttctgacttctttttttaattcaagaacagggatattaaggcaggtgatgaaagcagaatttttaataagagcatagtgatgcttttcacaacggacttagaagacattaaaatatatgtgttttgatctttttctggatttgaatatgaaggactagttattgcaacagacagcaaagtaattcatttcggatgcatttcagcaagccagccctctaggagacgctggaataaaatgtggaagtgtgtgacacagaccagactggacatgtacccggcccatcagctaaaaagccaaagagcaggtggaaacaggaataacagtgacagtgatggttaccatgatgaggagcactgccaacgattcctgaacttcccaggtgccctgtccttgcttggtgcttcccatggattatctcagtcttccctgtggctccattagactacatattgtcacatcatccccatttttcagataaggaactgaggtgggctaagtgtcaggccgtggagccaggatgagaactccagctgtctagataacccatgtcctggtaactgccactctgctcccgagtggtcagcatgtaaaccactgcagcgtggggactgacttcaccatccccttggctctgcctctgaccccccgagcaggtgagagctcgagccagctattccgggaattaggcatatactcattttttgcttcagttatttcactaattaaggcaaagtttctggtagtttgacattacgtatctggataattgcctcaatgtatcattttcactttgcacccgcagacacaacctttaatgaaacttgaaaacccaactctccttgggggaaatgatactcacttctgtttctaggccaggcgcagtggctcccgcctgtaatcccagcactctgggaggccgaggccagcggatcacgagatcaggtgttcgagaccagcctggccaacatggtgaaaccccgtctctactaaaaatacaaaaattagcggggcatggtggtggtcgcctgtaatcccagctatttgggaggctgaggcaggagaatcgcttgaacccaggaggcggaggttgcagtgagctgagatcatgccactacactccaggctgggtgacagagcaacactccgtctcaaaaaaaccaaaaacacaaaaaccatctgtttctaaatctgtttctgaaagtagttgagggcgcagacttccacttataagcttaattgcccaacatgcagaagaagtctccaacttccctgtttatcaggcttgaaagtcagccttggtttggggcagatggcctgctcctggtccttatctgggagatgagaggttccgacagtgtgatctctcaagtgcctcagtttggatctgagcttctgttctagcggcttccatgcccaactggattgcatatcttaggaagcaggacagaagtgcacctgcactgattactgagcaaattggtctgaataagtgcagtagatgccagagatttccacgaatgatgtgaatgtgatcactggccagaaaatatccatggacgataaatatctgggcttcatgctctgaaaaatgttcctaatctcttctttgtgatccccaaagagatttttaagggagtttggaagtctgccacttgcagaagtcctggtgttcccagcactaagtgcaggatgtggagtctggggtgcgactgtcttgtcactcagatggggctgcatgcccggcacagtgctaagtgcagccagttactctggaatgtgcaaatggcccctctgccccagctgcagagcgccttgcgggtggctcaggtcctagtggggataggaagaatgggacaaaaggaggaggctaagcccaaggcatgtgctgtcaccaaaagtgctggcttcatctcagaaagctgtggctgggttgggcttggttgctcaggggaacagggagacgcagcccaggaaatgagctgtggctgggctggagcccacctccccaggagggaggtgcatggcagcccaggtggggtgcccccatcctaagatgaaaggtctccacctcttgcttaaattgtaaggtgaacgcttttggccatttctaaggaaaagcacctttgggatttgttcatcatccttcatttttgctcaaggttttgggtgtgaaaacctcagaaaaactaagtcaaccaaagactttccagcgatgtcatcgactgtgttgtcatccaaaggggaaaataatcccagcttatgaatatttagaaagaagataattgcaaattgctttgtgaccgtgtaaactcgtttttttttttctttcccccagccagttacataagaggaggtgtgggtcagtcccagaaatagatgcagaagcagtgacagaacacgtcttggcggtggtggagagagacagccctgggttcgagtcccagactcgcagtgtgttagctaaagaagtttgagaaacatccgtctctttctttccatttcagcctcctcccccttcccctagctggtcgacgctcaaagctctcctagcccaacactctgtaacttgaggaataatgttttaaacccccaaatctagtcctcccataaaacccagtgaatctctcaaattgattaaatggaggcactcattttattagataggtaactggtattttgccttttctgaagggtagaagaggggaaaaagtgactgaggggaccaaataagaaaaaaaagacaaaaagacagaagaattcgggtttttagttgattccgaatactcgatgcttttgaaacgtttccaagtttcctttacgggaaaggaatgcaaatgatccaaaagggaggagggatttttttcccccttcttttttgtcctgagctcagtacctgggattttgcggcatgtgctgaaaaattatatcttctgggtgcagaaatttgcctgaaagggttatacgaaactgagaatgggtcaaaacaaaacaaaacggaaaaaacaagacttctggccacaggtaagaatcatataatttactgagacatatcattttggcatgttttgttaagggtgaaagctaatttggaagaggcaggaaggggctcttgaggttggtgggaatgagctgccgtaatggggcccgcagaatcacccttgtgtctgctcccagcaggactggcgggggaggggcagggagtagctctctgtgggtgtcgggaaccccagggccagtgaagcctggggccaacccccagcagtcccacagcagggttgggtgacaacaatttgcctgaaagtcatggagaaacaggttttcagtgacatagagactaagcctagaggcagaattgtaaaacctaccaagttttattacttatttactttttttcttctttttgagatacggtcttgctctgtcacccaggctgcagtgtaagtggcatgatcatggctcactgcagcctggatctcctggttcaagagatcccccgacctcagcctcccaagtagctgggactgtaggcaccaccactatgcctggctaatttttaaattttttgtagagatggggttttgccttgttgcccaggctggtcttgaactcctgggctcaagccatcctcccacctcggcctcccaacatgttggaattacaggcaagagccaccgcgctcagcccaaattttaaatttaacccccgcccccaacatgtattgggcattctgtctttatgactgggctatgtttttatgtgtgttgcctgcctacctttagaattttcttcaggacttttttttgtaaaagcgaacaaaagaagagactcttttgccttcacagagctgataggactgtcagctggttaaggcggatgctagtcagacaagcacacacaaaaaacggaagtgggaagggttggaggatcagggcagggccagtgtggtctggggtttcagggaaggggtccttgcctgagatctgaagggtgagcaagagcgaatgcatctagcagggccagtggtgttggggaaaatgggatctggctaaggaggctgggagaggcagagatggacacacagagacagcgagataaaggccgccagcaggagtgggggctcgggggtggggttggggggatgcagtgctgcaagggggattgaatgttcccaggtacagcccagcaacgaagaggggctcagggcttgggggacctgcccaaagtcacagagtgggtatggttgtttcatgatctcgtggtgtctcccgggccgcaagccccacagcgccagggctgtgcctacgctgcgcaccctgaatccccatggactcccagtcaggggcttgcgttctgctccgtggccactgctgtacctttgcaaggatggggaaggccttggggatggggaggccatcacacaggcactttgactgcatcaagcgaaattcttacttaatctgaaatgacttcaggtctgaaaactgtgtgctttgatcaaatatttacttttccgaaacagaaaccagagcaggtcttgattgtaccagtcagcttgaaccagtcagctacaatgacttttcgtaagtctatttttttttttgagatttcgttttagcccaggaggaaatctgctatctgcaagaaagtcctggccttcataatgaggcctgaattctttccagatcttatgagaaagattccactcttctgtgattaattcagagaggttactaatttctcataccatagatcgtttgctttgtgggagatgactgtgcctcagccaagatccacttattattttttgaacaagttttttttattatcatgtttacatagcactgaggacacaaaacaacgctggaagctcagctgtctgattcatacgctgtattgctgactctcacttctcccttcccctctctactctacctctctgcaaaagaaggctttccttccagagctggcagctgcccctgcttcttgacaggatgagcaagacagcggtggtttaagcaaggtcttcgctgtgctccggagagatgtgggtattctgggggaacatgcctttgttataatatttattgaatgttcacttttccagctctgaatactgaaacttagtgagattttttttttcgagccatgccccatcaacacttttaggttgtctctaatggaaaagagaaaagaaaaagattcatttttgatggactgggcatatccaagttcagtgtcttgggtgataggtctataaataaatacttgtttgacctattttacagaggttggaaatctagattctagatctgagtggagttatcagaaactaggtctgttatctaaaaagctagaggaaattgacaaggagaaggagggtctgaaatgaccttttttttttgagacggagtgtcactctgtccccccaggctggagtgcagtggtgcgatctcagctcactgcaacctccacctcctgagttcaagcgattctcctgcctcggcctcccgagtagctgggattacaggtgcctgccaccacgcccggctaatttttgtatttttagtagagatggggtttcaccatgttggtcaggctggtctcaaactgctgatctcaggtgatccacccgcctcggcctcctaaagtgctgggattacaggcatgagccactgcgcccagcctgaaatgaccattttttaattagtttcttgtctggatctctctctctttgcctcctggtgtcttggtgggaccagcgttttcatggccacatcagggtggagaagggctctctcccagcctctccaaagcagttttattcagacattgctggtctgcatgcagctttagccaagccccccaactcttgaaaatgggaaactgcttgatgagtgaatgtgaaagtacatgtccccatcctccatgaggtgagaggtcttcagcttgcgtttaagtccagccctgcctcttacttgcagtgtgatttagggccagccacttcactgtcagagcctcgggctcccttcatcctttttaaaagtattcggccactgattccggctcggctgggtctttatacaccaggccaaagtccttactgttgagctgagatcctgtttgcagaaacgggagggaggaaagaaaaagaaatgaggctgctggtggtggtggttgccgtttgttgagcagttggagttggcaggcactatgggcatatttttgtggggattttcccgtctaatctccacgcctgtccatggggtcggtactgccgttaatctccctgctacagatcagcgaagggaggcaccgaagtgcaaagcagtttgcccgagggcacacagccggtaaggggttgatacaaaccagatggcacgtgtggatgttcacctgcctctgggttttggcttttcatctttcctccccgccatgtttctctttccacaagggtatgtgcccgttcctatgtgcccagcagctgtatgggatgagatcctaggctgcctctgtcaaacgctctttgggcattggtgaacattcataaaacagcatcctctggggtcacattgtcccttttgctcttggacctggagttcctttggtctgtgcgtgtgtgtaaagatgcatgcccactccagggaattctgtggtctgcttggggttttccattgcagtggcagagaagacaagggaaaatgtccttcccggctgcactcccaggcctgtcatttggagttgaatggtaatagaagggttttttttttttttttaatgatttatagtatgtctggaggaaagatgttattaattcaaagataacttgagaaaggaggggacacagtgcagcttggacagagcttcccactggtgctttgcgcagtctttagcccacctctgccttgccttatgtggtcctatggcctcatttcaattccctatttcacctgatctgacgagggaggcaaggagtgcatgcattttcaacagataaagaaactgaggctcagagacgtgtcttactggacgtgaactcacgtcctggaggcctaggcccagtccgttttctatttgccacaccattttttgtgcaacatttattattttttctttattatctttgtagttacaaaagtgatgcttgctctatgtaagtaaaattggaagcaagatggaatgtgtaaacagaaagcatagccccccaaatgctacccacaatcaacaatgggaaactgtgtggggagtgtattagtccgttttcacgctgctgataaagacgtgcccaagactgggaagaataaggggtttaattagacttacagttccacctggctggggaggacccagaatcatggtgggaggcaaaaggcacttcttacatggctgcggcaagagaaaatgagacagaagcaaaagcggaaacccccgataaacccatcagatctcgtgcttatttactatcacgagaatagcacgggaaaaaccggcccccatgagtcaattacctcctcctgggtccctcccacaacacgtgggaattctgggagctacaattcaagttgagatttgggtgggcacacagtcaaaccatatcagggagtgaatgtgaatgtgcatgtcccatcctccatgaagtgagaggcagtttgggcttcagcttgtgtttaaatccagttctgccatttacttacagtgtgatttagggcaagccacgtcaccccacccagagccaccgttttcttatctgcacaatggggcgattacacctacctttagcgttgtctaaaagtcagaaagagatgagaggaagcaggttcccagcttgatgcctgccataaaatggcagctcatcctggttcctttccctttctccctacaccagtgcttctcaaactttcctcttcgtactcaaaggtgaaagacagtgagagctccctggggtttcccaggctggccccgacagcttgcagccagcaaggcaagctggatctctgcaaattttgtgtcagttagtatatacgtggatataacttcatttgaaaacaatgttttcaatgtttgaaatttcgaatattttaaacatggaagcttcagtttgtcttacagcttcatacagctcctggctaacctctgcacactggaggtagaggggctggcacacctccacatgcccacatgcccctgggggaagcacacctttgcacactcctggtggggttggcacacctccacatacccctgggggtctggcacaactccacacatccctgggggcctggcacacctccacacacccctggggggctggcacacctccacacacccctggtggggctggcacacctccacacacccctggtggggctggcacacctccacacacccctggggggcctggcacaccttcgcacattcgggggggacacacctttgcacattcctggaggatcctggcacaacacgtttctgggggggcagacacacctctgcacactcactcctgggggaggtacacttctgcacactcctgggggcggggctggcacatcaaacactcctggggaagaccagcacacacgggggagggttggaacacctgtgcacacactgcatgggtgctggcacacctgtgcacacactgaatgggggctggcacacctgtgcatacactgcatgggggctggcacacctctgcacactcctgaggtccctacagccaagctgggttggtactggagctgttctcctcacctcttggcaggcttagtaagggctgggtctgtctgggggcagaaaatgaatgtcagctgacttcaggtgaccccctggagaaactccactcgcctggctctaaaaccctccagaggacctcgccatttatttgggttgcttggtctttccatcagaaagaaataaattccaatgaagggttttcaggccgttcttctcattgaagggttaaccagattcttattttgctcatctttggaaataaaacaatgtttagaactacccggatcagcaaggccatctggtggggagtgtgcagctgctcccctttcagtcgcgccgcctgtaatggattcattctagggtgcatcgtgcatctgcagaatcatgatttgcagttggttttgaacgtgtgagctatgtgtccatgcgagacctttctcctctgcccgtcctgaaggacatctgggccgggcatcttccactgtcctgcagccttttcactcttcgtgaagtcaggtcaaagtgggcaaggggactctggggacctgagagtggacagagtcaccctgctccttctgtccttaatctgtagtctctgtgcattatactctgggctgctgcttttcattcatttctctatctgtgtcaaggaaaaattgttggacagcaactagaatgtaccactcatctttgtagtctaaatacaccacagccagaatgacccctattctgaaaatgggtcactttttcctggtaattgaggtttgatgttgcaggtgtttgagccccaaaaacgtgcaaaaagaataattataacatgtattaaacatcctgggctcctgagatcactgcacccatggaacaatgctgagccttccacattgactttgagatgaagagaatgagggtctaaatggtgaaggggtttgcctactgtcatgtggctggttaaaccgtgtggccggtgttcagcctaggccttgagtctccagttcatccctaggccagctcgctgtcctgtattctgtaagtcatttgggggaggaagtgtatagcattacattctctgggccacagtttccccacctgtaaaatgtaagtagtaattgtactgtcctcttagattatgacatttaaatagaataatccatatcaaccccagcctggtgtctggacacaaggaagccctcaacacatgttagctggtgtcactgttgttgtgactcagcaataagaactctgttctggatatttgctggatatttgccatgctttctggagcttgttccctgactctttaatttaaaagtatttattgagcacttactctgtgctattcaggattgagcactactgaccctggccttttatgaatcttgtagtccagcctcgcctccttacaagggagacgggtggccggtgggctgagtgatggctgaccgtgctccactgtgagccttgagttctgagcaggttcccctacagctgccaataacagcttcgttcgcctgctgcaggagaaaggtcacaggctttgcagccacacagaccagcggttggattttggccccaccactggtgagtcctgtgactcagggttatgtgtttaaccctgctgtgcctcagtttcccatacatgactcggggaatctcagtgctgacctcagagagtgccttcaagaagggacctagcatgatcctctgcaagtggcagacactggactatcaggcatttccttcttcttttgccgccaaccctaaactgactccgtgtgctgctgaaatgctttgcagctatatgactgtcctcgctttgttccctagagccattttggtagacgcgcttctcggcacaccctgtaagctcctcttgagtggcctctgccttattggaaaaccggagtcagtagatatacaagcatgagaaaatctagtccctacactggtgtgatttactactggaaataataaaatgagcactctgaaatagtttttctctccacttggtttcagaaaaaattattgattgtgtcacaaagacctttagagtcttttgtgcacattgaaatcattgggggggagaactgcagcatgaacatatttgaagtctctggtccaccctgccccttcgctgagaaaacctgattattttgtgcatttcagagagactgggacatctgctgtgtttggcccatatctcgggtggttgcacaagggaggtggagctgattaccctattagagagcaagctatcacagaataggaaaaagaccccattctccctcctgcctgccacggccagaggccctggttcactgaatcactgctgttgttaccacgcttgtttggcttcctggagcagagctagttcttctgcagattctctggggctgggtgggcttcacggctgtccttgaaatgggatatacagtcccgaatgtgggcatttttctggagcctctggagtctttgttctggcgttagatgggatgttcccagaggacccaggctgttcatttatttgtctgtacgaacggacacgctgcagcccaggcctgtacgactggacacgctgcggtctttgtctttggagccccagcaaatgcaagccctgcacatagtaggtgtttaaataaagaggtgcaaaagtgcgtgggccactaatctggagaaaaccctgtgtctcttttggattaattatctggctaataaagcaagcgctgcgccggctagtcaacgctcactgcaaaatcactggcctctgagcagccctgaaagacataacagatgaagataatgagtttgtattaaggagaaattaacttcagatcatacacccatgagtgttatggccaaaaggggtagtcccaaatccatatcttatatacggagaaacagaggccctgagagatgaagtgatgctcagggtgaccagccaggttagtgatcaggacaccaagtagctccctgccttgctgggaaggtccctcctttgctgctctgaagttttaaaatgcaaattatcatggaagccaccacctgggccgcagcgtgtccggtcatacaggcaggcctgggtcaaagtgtgtccggtcgtacaggcctgggcctcagagtgtccggtcgtacgggcccaggctgcaatgtgtccggtcgtacaggcctgggccgcagagtgtccggtcgtacaggcagggctgggtcaaagtgtgtccggtcgtataggcctgggccgtggagtgtccggttgtacgggcctgggccgcggagtgtccggtcgtacgggcctgggccgcagcgtgtccaactgcacacagcccaggcttctttgatgtgcggggacaaaataggagttgggggctgcgcaccggggcctgcctcctgtgcatggggccagttccattcctgtccattgtctcagctgcaaaggtaactgacaagggacagccccgcctctccttcctcccctgcccctgcccgcctttctttctgtccttccttcccctgtccccacacttggcaccaggccagcctctacacatctccgttcccccatcccttgtctctgtcctggagctgtacctgtctcctagcacactttcctggctgcaggagacaagcctgagtgatgaatagagtctgaattgagacaggttaagactcaatgccccaggccgacagggcattcaaaggagattgaaggaggtaggggagtttcatcccatcagctgcctcctgggatgcttccctcaccttcctgtcctgtgtctctgggtgagactgcaaatctgtattctcggaagggattcctcaaaagattggaagggggaagggcaccaagggcctggagaagccgctggactgtctgaggccaggcctgggtggtggggtagaggttaggatgggctccctcttgagggatggtggaagactgagtgtcaggctcctgaggcctcttgacccatctttctataatgggctgcatgtccttggggaagtacagaccacactggccttggtttctcctctataaaaggcaggctggatgcaggtacccgcaggtttgtactggcaagctgatgatttgctggagcccacctgggttttgccctgggtctgagtgtacccaccatcattgttgaggggttccgggtgtttcttactgtgaatgactgcagtagaatcctcagggatcccaggagcttcactgtcttgcatttcccatctgtacagcagtggctggtttaccctggatctttggggatgggtgcgtttctggaaagttggcccttgttgttgagcactgaaacaagttctggatgagcatggtcatttggaggggggtgagcttttccagaattttccccacagctgcgccaggctcgccagagctacgggccctggtgacaggggtgcccgaatgatcctggccagctcagctttttagtaccttgttctactgtagaacttgggtgttacttcctgcatctgtgtggccacctgccttttccagggcatcccctcagataagtggcagacaggaaaattggacaccggtgtctggaattataatatatgcacactgaaagcaagtaaccctggagtgaggacccaagggtctctccagtaataatgcaaggaatccgggtcatttaccgagaggcaggggagccagagatcacctccaaccccctccttgtgagctcttacgtgggctcctgaactgcatctagaagccaacttgacaccaggcagacaaacaaaagggaagcaaacacactttgttagttttacctggacctaggaatcttcacgagagagtgaagtttgaaggagtggccaaagcaagatgtttttagaccttttagacaaagaacaatccatttcagaagagacagaacagaagggacctggtggagtaatatacatttctaggggagtctctgggagatctatgggatgtgtaacggcagtggaagagaagggttactttgtgaagtgtatttatcctgggtcattgcagccccaagttcccaggctgtgctgaggagggccattttcttggcctggcaggggaagggtactcctcccagaggagtctatggcttggagtatgcaggaagagacaggtcagctggccctttctgaaactataatttctccaatgttttcgactcaaaataatcaacatatcaatttggcatgttttgggatggctcatccttccacggtgtgcggggtactagactctgggttaagcattttgtgtatgtgacctcatttcttcctcacatccacagtaggagactgagatcattttattcccattttacagatgaggaaacctagtcacagaatggttaaattcgttgcctgagatcatagagcagttacagacttgattcgggttgaaatgcaggtctgcccaactcccaagcctggcataatgtcttattttcgactgcttggaaaccatttttcctacatcccatctttctaccaagttgagaatcagtgagctcaggacgcaggggaggcgctggctgcatattgtagagatctgatcttggggaaatgcctgtttattatggatatggcttatggactaaaacaatagcattgaatgtacgttgtatgcatgtaaggtagttgtgattaaccaaaaccaatgttgatgacgaacttaacagagagtcaagtgtgctttaaaaataagcttaaaaaactgcctgggttttgtatgcacagattttgggccagccaggaagatccctcaggttgtggtttgagaatacctgttttagacaaagcacgggtgatgtgtcccagtcatcaggaaggatgaaatctggcaaggaaaccgtaaggatcagattacaggaagggcttgctcagggagaggaaggaagcaaggaagaaattagtaactgaaaagaggcaaggaggaaggcctcttcatcaggaggtgggggagtgtggggcagtggataactaaaacaaaacagctgtggttgtcataaacacattttgtcagaaaataacctggtgtgttattttctgatgtttcagccattgtgtcttgattcaggaacagctcccttccgagtttctttttgtttgtttgttggtttttgagagagggtctcactctgttgcacaggctggagtgcagtggtgtgatcacaactcaccgtagcctcaacctccccaggctcaagcaatcctcccacctcagccttccaagtagctgggactacaggtgtgcaccaccacacccagctaatttttgtattttttgtggagacagggttttgccatgttgcccaagctggtctagatgaccctgggcttgagtcatccgcctgcctagtgctgggatgacaggtgtgagccactgcgcccagcctcccctctgagtttccatcattacattggcctatcggctgctggtggtagccaacctctgggaggcagaggttgcagtgagtagagatcacaccactgcgctccagcctgagcaacagagtgagactctgtcttgaaaaaaaaaaaagaaaagaaaaatcaaccctttattatgtctctggtgtctttaggaattggctgggatccagcgggtattggctgctctgggtgggctcagccaggtggccctgctccacctgtctccccctcctcctggccaagcaagtgtgcaagaggacaaatgagtacacaggacatgtcttagggcctggcacgtgccagctttaagcccacttctgcctcattctgctggccaaagtgagccacccaactcaaaccgaagggtggagaaatacgtcactcctgtagctgaaggccctccaaagtggcaaagaatgtgaacatgggaagaagaaaaaattgagaccaataatgcaatctatggtaaagagtaataaatgactatcaaattcccattgtgggccaggactgtgcatctgtaataccagctaacatttattgagcactgactatgggccagagactctttttttttggcagactcttgatctgttgcccaagctggagtgcagtggtgccatcttggctcactgcaacctctgcctcctggattcaaatgattctcctgtctcagcctcctgagtagtgtggattacaggtgtgcgccaccaatcctgacaaattttttatttttagtagagattgggtttcatcatgttggtcaggctggtgtcgaactcctgaccttgtgatttgcccgcctcagactcccaaagtgctaggattacaggcatgagccaccgcgcccggccgggctagacactcttttaagcaccttacatgaatgagttcactgaatgcttacagcactgccatgatacaggtcctgtgattattcctaagtcgtatccaaagaaatggggagaagagacgtttaatatcttgttcaagatcaaacctgggcaacctggctccagcactcgggctcttaactccagtgctgtacgtgatctgttgctagcggggacttcttttgaaaaatacagaggcccagaaaccttaagtgatttgtccaaggccgctgggtggacatggacttggaatcctaatccatgtgactgctgtgtcctctccgctgtgctatgggccagtgaatgttgacggagtggtgtggctttattctgcttattgactgggatgtgatcaaaactgtcgaagtccagatagaagactgaatctgatgatttataatttgtacagaactcttcagtcttgttggctttcttctcagtctcagcaacaaccttctatcttagagctacatgtgaaaaatgttccttctcctacttgttgatgaatagtccttgaaaaaatatatttccatatatatagcctagagaggaatgtcagcagttacacatactaatcagaagaaggctttgtgttttagtaaaggttaattaagacccattgaattttttttccttaaaacataaaagaaaaataatgtaattagctatttttttccctctctgtccccagagggcaaatgtaaatgttctacctaaatgaagctatttgtttaaatccatccagatttcttctgaagtttcatacatctttcttctgctatatcagcttatagctacaataatttaataagtttttcctagggtgaaattggatgccctttatcgatcttacactgagggggcattcaattacttaatctaaagtggtatttctgggtctctcaattacaattttgttataaatggcttgctaatgatgcttgggtgcataggttaatagggggtgtccaagcaagggctgggtaattgaacactttctattttgggacccgttatctgatttctctcctggtgccaggttcccacagtgatggtctgcagccatcaggctcagaattgagcccaggtgggaagcaatctcactgaaatgtatacctgaatcctttggtttaatacatgaacggaagtgccaagggccccgtcttgtctgagtcgaccggcaccaaatgtggacattccagacaggtgaagtgcagggggcatacatgactcctttctgaaggaagaaccacttgagtgttaggtttctgaatgactgttcttgggataatttgtggcctacggaaaaggccagatacagaacgtaacagcaatccattttcctttcaataccaccccattaattggatttttcttccctgagttatgttctttaatagttatacatagtaaactattctatacatattttactatgtatatttactatacatagtaaaaattcttttgaggccaggcgtggtgcctcatgcctgtaatcccagcactttgggaggccaaggcgggctggatcacttgaggccaagagttcgagactagcctggccaacatggtgaaactccgtctctattaaaaatgcaaaaattagccgggcgcagtgatgcatgcctgtaatctcagtactcgggaggctgagacaggagaatcgcttgaacccaggaggcggaggttgcagtgagccaagatcgtgctgctacactccagcctgggccacagagtgagattccatctcaaaacaaaaaaaagaatatgtagtatgccttccttcttgcactcgagcaaatcccacccctgactttggccttcaagactctacagagcctggtccctgcctcctctcccatcaggtttccacccccaccagcctgtgccccagggcctaccctgccagtagccctcatgggctgggactccccacagcgtctctctacggggcctttgcttcccctggtctccacgtgactggcttccttcttgttcaggtttctcctccaacgtcccctctgaaatcaggtcttccctgtcaccctgtgtatcatacctcccacttctttaaggcagtagctccaacccaggggtgattatgcaccccagggggcactgacaatgcctggagacatttttggttgtgacatgtcaggggaaggggtgctatggcatccagtgggtgggggccagggtgctgctaagcatcctactgtgcgcgggacagccctgacaacaaagcatgggccagccctaggacggcacaaagaattccaaaaccctgttccaatggttgtattgctctctcccccttttctttattcttttctgcatagcctttatctagcagcatctgtgattatcttattcatttgggacttctttatagcttgtgccctgcagcccctacccctggtgggacagaagctccacttgggaacaggcctcctctctgggtcagccctgcaccactcgcgcccgtcaggggaggtcttgtctggaagccgccgggctctagggccttcacttacaagggactcacctggtcttcagattgcttgtccatcttactgagtatttgacatactatacagtggctatcgattttggtaaaaacttgtaaatgtaagacagttttatgtttttttctcagagaggcccccacccccacgcccaccgcagcccaggggtattttccaacaccagcaaatcctccaactccagaacctaactgattatcttaccattcaattcaagtctgcccctaccagaggcagcctcagactctaccggtttgagggctcggtctcaccagactgccccacttcagatgccagtcccaagtattgggtccccaggttacccgcacatctgtccaaattggctaaaaaggcaagagtgtcccacaacctcctcaggttcagtaattcactagaatgactcacagaactcaggagagtgcttgactcatcatcagtctattatagcatagaatgcagaaacagccagcagatgagacgcatggggcgaggtatggtggaggagggtgtgtggagcttccatgccctcttcctccactccaccctcccagcacctcgaaggatccaccaacctggaagctgcctgagccctgtggtttaagggttttgatggcggttccattacaaaggcctgattggttaaatcatcagccactggtgattgacttaatctgcagcccttattccctacccggagtttggggggtttgttgaaagctgctcactgaggcttggtctttctggtgaccagcctccatcctggagctatcctggcccgcaaagtgtcaccgcatcaggatacactcaggtatggctgaaaggggcttgtcatgaatgacgaaaggtgcttctctcaccccatcattcagaaaaattccaaggattttagcacctgtgtaccagtacccgaggatagagaccaaatactcatctcttatttccacatcacatccctcatcttgtattggcttttggtctccccctacctggacatgcgcaacactcagctgttcttcaaaaggtatttgttgaacaaatgaatgaatgaatgaaagaatgctaggagctgagaaaacactgtatctgagtgttttgctaaggctcttgcagcatctcgaattgcctcctcaggtctttctgtttaggaagcgggactcgcagaggccgggctggttggtgggggcagctgccccgcagacatgctctgtggacccggtccgggcaccccatcttccctcctctctgttgagactgtcggctgctcatgtttttactttgcttgaaatgagctgcccctgcccttgtttaggaatgttttgcccattcgtttgggtccagattatgtacattcctatcttggagcttcaaagtccgtgttttgtttgctttttaaagaatctaattcgattttctgcagcagaaagacaggagggtgcgaattccctccccgctgagctgctggttggagtctcatttttaaccccggcttggccctgtcttggacatgtgaaaaaatgttttcttggctttaatgatggagtttccaagtaggggatcttgcccttttgtttctttagtttggaagaattgtttgtagcaagcgatgggtcaggggtggttgagcaagtttgaagcagaggttgatccttgaggtttctgacatgtccctccagctgccctcagggataagagatgggggtagggcctgagatgtctggcctggcttcccagaactggccccttctgcatccccgccccagcgcctctgcaggactcaggtctcagcctctactgaccagcctttctcaaactggctccttgataccctagtgagattccttggccaattaggtacttccaactttgtgtattatattcctctcttgtggattcacagggcttattagcatatcaaaggccctgaaaagttcagctgtaaagaattctgtgtaattttgtccattccacattttctccaaataatttaagcacagaacactcaccaacggcaagcagaacattttgtgggaggaagacattttgggaaacacagcttggctgtttcttggccaccatattttgagaaaacatgaagttttcagtccaaggggcatgaacatttcttctgttgagttctgattgtttaatccttcagccagtacatggcgatcttgatgcgcggttagttaatgctgcctctatggagacagtgagggttgtttgaggggtggcgtgggtagagttggagatgagtctaccactcttgggtaattttcaattgctaaagaataatcatgtggtataggatctctcatctttgattccatttcaaatgtttttggcattcactgacaatgaaaaatcatcatcataatagttgatgatgctattattatcaatgctgtctaccttttatggtatgctaaatatgtggcaggcattattcaaactgtttacatgtagtagctaatttagcacctgttaaggtgtccttattatcctaattttactattgaggaaaccaaagctcagagaggttatgtggcttgctcagggtcacacagccaattagtggtgatctaccactgctagaaactgagtaggtctccttttatgcttatccatggctctttctacgacatctacaaagaagtgtcatttgggcaacaatatattttataaccacaggattctattaatgggtttttaagaatcatatcttgctcgagatgatgaaagtgaaaaattatgtcaggttctgaagctctgtgtcactcgagggaatcctatacattggatttaattgcttaataacttaaagtcaagtagttttttaatatgatacattctactgaaggagagactcatttcattgtttctaaattttcattaacttttgcttcctaatctgataataaaggttaactctaagaaagagactgctgatgccagtgagagggaaaaaacacattttctctgcctgctccctttctaaccatcctccttagtattcttgagatttttcattgactgaaaagcactgatatttcaatccatccctcaaatttgtagtcattgactgtgcatgactctgagaatgatcacaacatcctgggattcagagatcctgtacctgagaagtatcaaggcagagggattaggggagatgtagactatgcacaatgtgagacgtttgatgtggcgctggtggtgctgggattggggccatgtttggtggcagaaattgagccccaaagccagctgcaagaacctgaaacctcttcctttatgctcgcgattttctatgacttgcttagaaccaggctggcttggctggacttagaggtggaaaagagagtgagcatctgtctctccttggaggatgagctttgggttattgctattaccacacaatgtaataaagcttcttgtctttctgtgtaggaaatctggcattttttaaagtttgcgccccacaaagaggaaatattccaaaggtactcaggatgtaaaaggggagatcttcacagatgcctccgtggatggcatggcaatccatccatcaatgagaagaccatgatttcttttaattttctgtgtgtttccacattccccagtgagaattcttccacctttttttgtgccatgggaaaaacctgaagggcaggcagagctgctcccgaacttgtgaccttctctgaggttgcagcggctcttgtagaacatgactctgggacatcacttccttttgttttctttcggagctgaaccaaagaatgtgcaccctctttctctagtgctgtggtgtctgcttatttttgtatttgtgctttccatccatcttctgtgatcacaaggcattcttaaggttttctagcacgacttgcggacatccagactcgtggggggcccacccatggctcggtaagccagcagcccagggcactggcactaccatgaggcactgcattaattgctgcatacagctgttacccgacggcgcacacaagcagcaggtcaactgccaagggggcccccatcacggtcaccaggcgtgccccacgtgcaaaggagaaaacaaaattctgtttcgtgtggacagtaagcagatgaacttgcttgctgttctcgaagtgaggactgaagggaacgaaaactggggtgggtttttgcgcttcaaaaaggggaagcgatgtagcctcgtttttggactgataataatgaccttggtaatggcttcttacatcctttctggggcccaccaagagcttctgatctcatcacctttccattacggaggcttccccagcaaccccagcttgatggacagcgaaaacccaagtgacacaaaggagcatcaccaccaatcctctgtaaataatatttcatacatgaaggactatccaagcattaaattaattatcaacagcatcacaactaggattgagttcacgaccagacagctcccagacttagaagaccttaagaagcaggagttgcatgtgagtagctttgtgctaatcttgactgattggttgatttttagaaatgagtgcttttctttctatcaccatctttgggaacacagaaggaaaatgactaaaaaatgtcttagatgtagcaaggatcatttgacagccttatggatttgaatgcactgagagagtgctgtttgcttacgctatggagtgccaggaagggaatctgctgtcctgaacgctgggctaggcatgttcaagggccgctggctctcattattgcattccaggacttcttgcttgatatgtggtcgtggtagttaacagttgcttttgcagatcaccatcatttgggattttaaagttgcgttaaatttgattttctgcttctattctacattttaatctctaacggcaatttaaatatacaactagtaaaaagattctgcttaattaccgtgtgtgcgtgtgtgttgtgtaagtgtcagaaaggtaaattatggtagaatggattttaattaaacttttatctttattctctccaagttttttttttttttttttttttttttttttttgtggggcggcgggggagaggaaagcacagtcattgaccgtctaccaagttttgctttatttgttaatcattgtcaaatattagttcaaatttgaacacggtcgtcagtctcagggcaggttcccattgcggttagattgtgtctttgctcattttcccctcctctgtgtctctcctcctctgtttccttgcagatgttttcagtcatccccaacaaattccttccaaacagtaagagcccctgttggtacgaggagttctcggggcagaacaccaccgacccctacctcaccaactcctacgtgctctactccaagcgcttccgctccaccttcgacgccctgcgcaaggccttctggggccacctggcgcacgcgcacgggaagcacttccgcctgcgctgcctgccgcacttctacatcatagggcagcccaagtgcgggaccacagacctctatgaccgcctgcggctgcaccctgaggtcaagttctccgccatcaaggagccacactggtggacccggaagcgctttggtgagtgctgggtcccagggctcctgtctggtctcgttccttcattcgttcattcctcccgcaacgttagcgctggggttggggggcgagggcggcagaaagagatggcacaattcccttgttaggaggctgttcccaggcaaagacccagcagggtctggaactcggttcccagccatgcagtgagcattgattgccagctgtgtgcaggacacggggacgagtcagaactggcagctcttcttgttccgaaagcccgggcacatgacccgagcagtcagcagtaagtgccagtggccagtaagggccagcaagaagggcgtgatccgggctcttggctcccagctctgtgctattccctgctctgtgccgctcccagctctgtgccgctcccaagctctgtgccgctcccaagctctgtgccgtttcctgctctgtgccggtcctctgctctgtgccgttcctctgctctgtgccgttccctgctctgtgccgctccctgctctgtgttgttcccctgctctgtgctgttccttggctctgtgctgctccctgctctgtgctgctccctgctctgtgctgttcctctgctctgtgctgctccctgctctgtgctgctccctgctctgtgctgttcccctgctctgtgctgttcccctgctctgtgctgttcccctgctctgtgctgttcctctgctctgtgctgttctcagctatgtgctgttccagctgcagtcactgcacctgggggagactgagttgcttcaggcctcagcttctctgacctgccccatctgccttatgggttccatatgataaccacatggagatcattctggaggccttgctctcagccctttgccgcaggcttaccatgaccactgcccatccctctctgctccagcttaaccccatgcaccctgcggtcctcagatcactgtttcctctctgtaaccttttccttgtgccaggagaggtttggtcactggagctgaggggtgatacgtgcctattgtcaaccagagtcctggcaggccacgagggtgttttccagtaatggactcaggttgactagaagggaatcttcaaagttttccctagaccaactcttaatgtgtttcctgacaaacgtttgctttcatccttttgatgttcgtcctacagtgagctaaagtgtaaatgtttcttttgtggtttagcagccgccactgtaggagccagggtttcacatccctatgcatttgctggacgtgtctgaacacactcccttgctgtagggtgctcccccgaggctcacagtgatttccccttaatgaaaaccagctttctaccggcaggaaaggaggaagaacagaggcgggcctctggaatctagtcttcaatgtcaccttgaacctcttgttactttggccacggatgttctctttccaatttccattgacttcaggagttgtggtgttgggaagtggatttttaaatgtttgcaagtgaaatttatttatttttcaggcagggggtgaatttaagctgtatgtggccgatgccagaatccatgtctgtctagagtatgatcagttccccttactgtttggacaaagggcagggtatttgattgaacagggggaggagagagaacatcaggcaggtgctggctgggccccatgaggaaggcatcatggagtttataggatactgcccttctctctcctgtgggcagccctcggtcctctctccctgtttgacacaacacatgcatcctgggtgtcatcgctgcccagccacttacgagtcccacctgtgcacaagttaaccagccccagactttgtccctccaagcagacatgtttctagctcttgagtaggtgttccagcctttaatctgccactgtctagcttagtggtggtatcttccagcccttgaagcatgcatggattgaagtgggtagccaggccgcatagacccccacccccatccccagcagccctttctgaagcttacctgggctgagcctcttgctgctgtcgccaggccctttaggcctttccatctctctttggttgctgtctgggaggccatcgctccagcagtagcaactttgtcctcagtatctcctgcttcttggttctcataggaatcgtccgcctaagagatgggctgcgagaccgctatcccgtggaagattatctggacctctttgacctggccgcacaccagatccatcaaggactgcaggccagctctgcaaaggagcagagcaagatgaatacaatcattatcggtaaggcgtctgtgtcactctggcagggctagcaccctccctggggtcctggctctggctccaggcctagcccagctctgcttcacctccagaacatttacatggtggcagcaaacttcttttgagcctccacttctccacctggctgtcactcttaccactacataaaatgttcacatcacttgaacattactataaagtggaaatgttgactttctaattctttggagacttaaggacagctgatggctttcttgagaagttgccatttctttgtttttaagaaattaagcagggatattgacttcttttcctgatgtactgatctgataagtttggatgggggaattataagtgcagttaactggttagtcatcgatttgctgcttggggcttttgtaatccctggccactgggaccatataagacggaggcagcttctcctgaaatagactcagctctgacacatcgcctataactaattgctgtttaaaaagcctagcccctgtcaacctcatgcctttgggcattcaaagtgaggttgattaataataatttgttttaaatattcacaagaatattttataagtaaacatacatatttactctttaaaatttattttttattgtataatttaaggtgtacagcatactgtgatgtttcgatggaaatagagacagtgaaatgattgctacagtaaagcaaattaacatagccatgtttttttcacagttacctttgtgtgtggggaggggggcgtgtgtgtggtaaaagcacctgaaatatactgtcttggaaaatttccagcatgcaatacaggattaataggattaataactacagtgcacatgctctaccttagatctctagacttgttatttgcctgacataattctttttattggattcagcttagaaggcgtttatccactgatgccttctaaaagagaaattgagtcacgttttgcttaaattgtttaccttagatagtgatctattttttaattttcctagatctgttatatttgcaatctccaaattaaataaatctattagcaactaagaggaattataatcagcccttcgaaagatgactttttaacttaagactctcctgtccaaggggacagacttatgtgcctaagtcctgacttaactcttttttttcttttaaactcaaagaaattaagtcactgggagtcacctccagtatgatttggctgttatctagttttttgcaaacttgggagtccaaactccccaaatctcaagtctgacttacatttcattgtgactcctataccatatgcctctgggaaaatcacatgttcttatgaaagagatgaaaatatgtattctccggccaggaaacagagactaagataatgaatgaaaaaggaaagcctcagtttggtctcctaattttgcttgctccaagattttaaaaagaatgaaaaataaaatcactgtgctgatatttacttaaagcagagtttggtgagttctatggtagtcttgtggtgtgacaagtatctagccctgcttgggccagcggccagctctgtgccttgcggccgttcatttttcctgttcctggactctgtctgcacctctgcaaagtgggattgttggaccaggtcagttctagactccttccagctctgaaatgtgactcagctctgccccagcgcttcctctttgttagattcggggcagaaacagcaggatctttcatcatcttgggcccctaggtcagagaggacctttcttctgctgtctttttgacagctagagtcacacaagaggttcaggattcaagtggcctgaacgtgatggctgaacttgaggccggagctttagacatgttgaaagtctcctgcctctactcccaggtacccatcgtggtactctttgtttcttgaattgccatcgtcccccttatgtcttaaggtccgagagaggaggggccgtgctttcctcccctgatctgtccctggtgccaagcacaatgctgagcacggattagacactaagttaatgcttcctggatggacgaaggatggatggtggctggatggaaggaagacagtcaggtggatggacaaacgcctccatggctctaaaaccagttcatttttgagatctgacagaatttgtgccaatttagctagagagttcacttgtcctttatattcttattcattgtgagtagaattttcaagggacttctgattgactcgttttttctgtatcctagggtattatctctttaaaaaaagaaagaacaaaaggccagaacagagctgttcacctggatgtgattacgcatccgacagaaatgataggggcctgcagggatatgatacacttgtcactgaccaaagagactcagtcatctggctcagtctctccccagataagtaactttcagatgtgtcctgtggtccttggcaaactgtcaggaaatcaagtgtagagctgattgatgaatttcctttttcctaaacacacacatatacacacacacatacacgcacacacactgtctctcctcaaaccctcaggaaatttggcttcatcctctgagagagtctgtgctgttggaatgcctgcctgtgtcttggcatcacctctgtgctgggacgtgtgtttgccatttacatccttcactcgtgaggaccatgatgaaatgtgaaactggctgggacccagttcccgttcacccaggctgcactgagtaggcgccagctgcgtgcagagcagtcgcctcgcaggagacagggcgtgtgagccctgtggcaaagcccctctctcttttagtcttagagtatgctctgtgatgaacagttacagcttcaaggaaggaaatcacactcaaattcctcataagggttagtgttcccaccctcctcctttctcctgacgctttggaaggaaatcatctagtaccagctccaggctcctggtctgctagaccagttctcggctcctcccggctctgaaatgtggctcagctctgccccagctctttctctttgttagatcctgggcagaaatgtcaaggcctttcatcatcttgggcccccagttcagagagaactccatctattattactagaaccatctactgtatagaacatatattggaatactatacaggaaaaccattttcaaaaccacctataatttcccacctagataactgctgtttatgttttggcgtgtttttctgacagactgcattctcagtgggcccttaaaatgccacagagctgtgcactgtgagcaaagttaaatactgtgaaactgggggcccaggtgctagggaaggtttcatttttgctccccttggaaagaggagctcaggggtgggggcactcagtgttgcatggatcgcctggacttccagacagaagtttttggggtggaggtggggtgtggctgtggcaggggggggcatccaaccttctctctttggagtcccagatgcccgcaaaggctgacagcttggcctctcccgctgcttaagaggaaggcatcggggccaggtgtggcctctggcacctagagccactccgtgggagcctgaatcacacccctgctcacttggagtgttttctgtttccaggggaggccagtgcctccacgatgtgggataataatgcctggacgttcttctacgacaacagcacggatggcgagccaccgtttctgacgcaggacttcatccacgcctttcagccaaatgccagactgattgtcatgctcagggaccctgtggagaggtgagcagtttctgtgtgttgtatttggggtgagaagaggaacttttgaagaacagtgttcccctctcatgacaaataagattttgtctcctttagaaaaaattaaacaggtcgggtacagtggctcatgcctgtaatcccagcactttgggaggccggggtgggtggatcgcctgaggtcaggagttcaagaccagcctggccaacatggtgaaaccccatctctactaaaaatacaaaaattaccagatgtggtggcacactcctatagtcccagctactcgggaggctgaggcaggagaatcgcttgaatccaggaggcggaggctgcagtgggccaagatggtgcaactgcactccagcctgggtgtcagagtgagactccatctcaaaaaaaaaaataaaataaaataaaaacaaacaaaaataaacggaacttgcaacgttactgctgtttcttacgtaagtgttattcttgaggctgtccccactgagttgacacatgttgcagatggttttcttaaccattctgatcctggtctgtgtgacttcagccccagcaggcctgaccaggggcacaggacggttccttggtactgtcaaggcgagggaaacacccttagaatcaggggtgtaagcttctccacgtggtttaactcctagaattctgtgtctctccacgtggttgatgcctttatccttgtctgcgttgaatgtacagtttccagctttccttgagagaccaaaaggaagaacaatgctgagcagagcagctttgctttaagatcaagggtttcccagtgtgggtgaggccagggtagtgggatattgaacagccactatggggcggcctggctggcactgggcactgcttgcatcatttatgcctgtgtgaatgcagaatctcagggctgccaggacctgaaaattatttggtccagtgctccctccaatacttccacatcagagctaagggggcacctgtctaatccgaggccctctgagtcagggaattctccgcgcaagatggccagtgtagcttaggacagctgtgttcctattttgagaccaggtctgttttggggaaacatccactcattggtcctctttcttctccatagagtcagacagaccaagtctaatccttccaaaacaggagaggctggcgatatttaaagacagggaccacagccctttgtgtcttattttcctttgggccaactacatcttcttatggattgaattgtgccccccaaaaagataagctgaagttgtctcccccagtgtgtatgactgtgaccttatttggaaataggatctttctttgcagatgcactccggttaaaatgaggtcatactggatcagggtagaccctcacccaccctaagacacagggagcatgcctcttgacgaggctggagtgatgctgccaccagccaaggggtgccaaggagtgccggcagccaccagaagccaggagaggagtggaacagattctcccctggcatcccagaggaaccacctctgccccacacctgggtttcagactccagcttccaggacactgagggaagaaagtcctgtcattacgcaccacgagttcgtggtgatttgtcctggcagccccgggaaactgacccctgggaccccttcttcaggtggcataccttcctggccccacgtatttgccaattataacaataaggcgtgtttgttgtggaaattttggaacatatattggaaaactgttttcaaactattaatttctcacctagataactactatttatgttttggtgtattttcttccagacttttctatgcaaataagtgtgtgtgtgtgtgtgtgtgcacatgggtgtgacaggacagtcttatgtcctgcttctttcactttgcattgttgccccccagaaacatgctttaaagtctgctctggtcacacttctgagctgatgtccctcttgtggagtctgcatggctcccgctgctctgagtatgacctggtcagggagaggctggatctgccctccctcagccccagcgctctgagcctgagctcttggtggctgtcccggtgccatgccttctagcaggtgccaggtgtggtttcgctccctgctctctgcatctcccagcccaggacttcttccactctgttctgaggcaggcactgacttgccgtcccttgccatgtcccacctgctggttcccgtgttttggaggcagaaatcggccctgctgagtggtctccctccatccagcagggctgacgcacactagccgagctctcatggtgacataactgtcacctcgagctgacccctcgccgcccccggaggtgtttgcatagctgctctgcctccctccccgacacggcccccagctgaagggcgcaagtgctcggtgtgctcatcaaatgttttcctgtcgctgctgcttagttcctcattctgagaaaggtcagaccacgccttaacctcaggggccgagagtgcacacagcagccttgtgtactgtctgggcacagagaggtgggggcccatctgtcgggactgggtttggtgtgtgtcagccctgctctgggccctgggagactggagctcccagtggggacgtgggcatggctgtggttggttgcagttctgcagagtaggaggtgaggagagtggggctccagagtggggagatccagaaggaactgacctggagaagactgatgccagactgggttttgaaggatgaataagagtttgctgtgtaaacaaggcaggaaggtgggttaagatgaagccttccaggcagagaggaggacaggtgcaaaggaaaacaccacatgttctcctgtttagggtggagccaaggtccctgttaggggttggagccagggtccgtgttaggggatgaaaccatgggccctgttaggggatgaagccagggtccctgttaggggtggaaccagggtccctgttagggggcggagccagggtccctgttaggggatgaagccagggtacctatcaggggtagagccggggtccctgttagggggtggaaccagggtccctgttagggggtagagccagggtccctattaggggtggagccagggtctctgttagggggcggagccagggtccctgttagggagtggagccagggtccctgttaggggtggagccagggtccctgttagtgggtggagccggggtacctatcaggggtagagccagggtccctgttaggggtggagccagggtccctgttaggggatgaagccagggtccctgttagggggtagagccagggtccccgttaggggtggaaccagggtccccgttagggggcggagccggggtccccgttagggggcggagccggggtccctgttagggggcggagccggggtccctgttaggggtggagccggcgtccctgttagggggtggagccggggtacctatcaggggtagagccagggtccctgttagggggtagagccagggtccctattagggggtagagccagggtccctattagggggtagagccagggtccctgttaggggtggagccagggtccctgttaggggatgaagccagggtacctatcaggggtagagccagggtccctgttagggagtagagccagggtccctgttaggggtagaaccagggtccccgttagggggcggagccggggtccccgttaggggcggagccggcgtccctgttagggggtggagccggcgtccctgttagggggtggagccggggtccctgttagggggtggagccggggtccctgttagggggtggagccggggtccctgttagggggtagagccggggtccctgttaggggtggagccagggtacctatcaggggtgaagccagggtccctgttagggggtggagccagggtccctgttaggggatgaagccagggtccctgttaggggatgaagccagggtccctgttaggggtggagccagggtccctgagtatgtttctttcttcctggagttctggtcccacctctgaggataccaacaccacaaaggtgagtgctggaacagaagacagcagcaccgtgcaggtgcaagcggctcagcaaggagcaagacctgccaaactcttctctcttaccccagcctgagtctgccagctagaaggaggctcacagttcacagcatggtccccccaagtagtcaccgtgttttcttcttttaataacaaatactctatgtatcctaggaactgaatgtgaaagcttcttgcctccctggtcctcagcctaacagaaatagttggtcaattcaaacacatattcagcccctgccacaggctgggtgctgtgctgggcactgagcatacgtgccctggtgaacaacagtggcgacccagtgcctaccccctggtagctggtgctttatcagagaagtgggcggcggcttcgtcatggctcatgtcctggtgctgaggggaagggcaggatgccagggcagcagcgtgtgttaggacgctgacccaggccttgcattgcctgctgtactaattagtactgctgcggaaaaagtttgccaaaacttagcagcttcaaacagtttctgggggtcaggaacctgggtgcagctttactgggtcctctacttaaggtctctcatgaggctgtgacctagctgtcatcaggctgggggtcgtcaatatgcttgactgcagaaggacctgctcccaagcgcacatggttgtgggcagaattcagcacctcaagagctgttggaatgagggcttcacatctttgctggcttttggcgagaggctaccctccatacctcaccacagggcctctccggtatggctgcaggctttatccaagccagcaagctagagcgtctgctagcagattagaagtcacgattttttctaacctagtcatgagtgtgaaatcccatcgtcattgccatattctgttggttagaagtgagtcatgaggtctagccacactcagtgggaagacactacagggtgtgaataccaagaaccggggatcactgaggaccgtcctaggagtcagccacctcccgttctgcacctgatcctcaggaaactggggcctgggctttgcagccgggagagtagcttccagcttgatcccagctctagtggcagaggaagtgtgtttatgtgcatattttctgtgtaagttactgacatagcagctgtttcatttcttcttaaacatttataaaaataagtaacaataggaatttcttctttttcgaagcccatgacccatggcctgtctgaaatggttggcgcgtttcccatctcagccagaaaggatgataaatactgtgtgtttaggtcactcttgaagaaacaaacactctgagcccaagttccatcagtctaacgggatcctgggccattagccctgttctgtgaccttgcacttctggaagcaggagattttgggggttgctggctgcaagttggattggtccaagttgttcttttccttctataaattggcttggagaggggaaataccacttttatttttagttttaggttcacattcagcctaattgatccaaagtagagggtttgaaaatgttggaattttaagcaaagtcaaatcacttttaaatttccagagaaggagtcaagtggcaagtccattttttttttttttttctggaggagaacagaggaataatggaaacaagtggatgggatggttcatatggccaaagaagccagccaagaattcatgttccagtttcctctctgtaagagatcatgacaatttaaaactagcttgatgcattcctatgctaaattggcccagttaattaaaaagaagccaccaattgcaagcagaatttttctttatttaatcccattcgtaagtggtaaagactattcttttcaaatgcatctcacattagcctcctgcctcttcatttgtgagacagttgatagtgtttgtctcttaattcagaggcagttatagcccccgttaaatgtgaaaaatgcgtggaaggtgctggcacctccaacctagttgcattcctcctttattcaagggacatttggagtggggtcatgtaccatctgttaaggattttaccgtgtctatgtttggggtttgattctgtgtgtagtcttaatgcaatgcccagaaacaacccaccacaggaatggttcattttcccattctgtgatgatgagtccaaagggaaggagaactcagcttggcgaagaattcaaactcgattttgacccaaacccctggagtcttggaacctggctagttcttttcttcatctgcttatataaactgattttttaaacaacccgttggactggtcaaatgattcagttatgacgataaactaggaaaggaagcaggcttttaatgaaatggattctgttataggcagtcactcatggggacacagaggaatagcagggctgaacatttgggcaggaatcctggtttcatcagtttcactctgtctgcagagtgtgtgagggggcctcagggtggtgcacagctttcacccgctgagtgtctgggaggtgtaccggggtcatggtggcaggaacacaggcattggaaccccagccctgtcacttactgctctgtaaactgggacaagaaacttaacctctctgtgccttattttctcatcggtaaaatgggggaagatagtcctacctccagggtagtgagagttaaatgacttaatatttgtagtaacgtgtttaaacagtgcttgacaaatggaaaatatgtaactattattattattaggtatcagttattactaataataacaataaactgatcactcatttactcactccccagagttgcaaaccacataaccaagttttggtcaacagtggaccccatatatgatggtggccccgtaaagttataatcccgtgttttcattgtgccttttctatgcttcaatacataaattctaactcttatgttacaactgctcacaggattcctgcggtacaggctgacagcataggagcagtaggctgtacctcgccacctaggtgtgtagggggctgtgccatctgggtttctgtgaacactctatgacattcacataatgacatcacctactgatgcatttctcagaacatatatatccctgctgttaagtgacgcctggctgtatttattgaacacccttgatgtgctagatgcaagctgtacataggagaggaaaatccatcccgtttgctctcatggagcctctgtctagttgagggagtagggccaggcttcatgtaaatgactgagctggggcagcccctcagagctatctctgggtgaggcttctcccatccacccatcattggacaggaccacctgtggaggcttaaccttggttgctgctggtggtctcttcagctgaggctcgttcccaggagggactgggctgtgagttattagcaggatggctccccagttttgcaaagctctgtaaataggaaggacccggtatttgtggatgcctaagcctggatgcacctcattcacctacttccacatcagagggagcaggatgcccgccctagggcaaaagccagcacacacagaagggagctgagccggattcatgccttcgaaccgcagcggaactttgacttgagaatctctcttgctattcaggcagcaccggaagcccctctccaaacagctcaacttcccccagcccctagaagcactgattgaaagccctggatgtgttctcaatcagaagagagcctggcactgggaatgtcatgcgatgttttctctagaacagatttgcacaaggattaaaacgcaggctgttcctagcactgagggattcattattgatttaaaccatctcaaagggaaattaggagaacgcctctgtggagaagagacggaatgaggagaaagccgtggggatgtagaggttgcagcaatagccacggatcgatttctctttctcacctctccctccagctctcactctttcctttcctctaagattttggaagattaagaattacaagggtccttgtgaggactactgtagtgcggtgtctttattgaagctgcctattgattcctggtgggttcaggcattttgcttcccagaagctgcctgttgacacaccttgatatgggccctggaagcggcacgaggtcactttaataggactgagctgttgagccacctgaggtcaagggggttggcctcgatcacagagcggggagggagagctggcagcgcccaggccagaaggacagctcgggtctttgtgaaggggttctctgaagactgttcaggagggactgcctggtgaggcgccacatcttgttattggtgggagaaaaaccaccaagctgaaaactcccaagtgctgaacactgtttatgttttggggaaatgtttgtgaagtccttggcagtcctgtgtattcccacatgattgtttggaaaggacggttccgagcaggaggaacactatagggaaaaagagctccgttgtgtctgtatctgcagagatcctaaggtgagatgtgtgcccgctgggctgggatcagggagggcacttagaaacgaccctggggcagccacagttcagggacctgtctcacccggagttctgggctgcttagtgaggttgacgctgttgaaggagggggtggcagcacatgtcacatactggccccgccccggtgtgcagtggccattgccctgcagtgaggggcccacaccctgcgcctggctttataaccaggggtagcccgccaatcctcagtgcaccccagttttcttgcttgtagaaacatctgccatgagagtcactggtgaatcacgagaaggtgctttgtaaaccacgccaggctcggagatgtcagggatgcttggtgtcgcctctgagaagtgctgcctcccagtctgtgaacagttaccggggccctgtgattggatgctctggaaggaacaaagaggggctgggaaccccactcgtgcacaaggaacctagggcctggtaggaaatagaatggccccaacaaacagggcacctgccattcatttgggcgtttttaggaccaaacatggatgtttgtaactggcagaaaatgagcctcaccagtgtcacccctgtgttcagtctaaggtgaccttggacattccctccagatcagctggcctggccagtcctgtctcatccagcctcctgatgagacagtcacagtttgtgattcagtggaacaaaagggctccgtctcagctacattaaatggcctttttttcctggtaggaaaaaaatatataatcattattgatggcaccatatcacaggctgggaattattgatcagtgatttaaattcggatgccagcaaatggagaataacaaggccaggtgccctggctccctctcattacaaccctcacgtggccacagcactgcaagatgttgttgagggtgaattggaggacatgagtgtgtccccatctcgggtcctcctgcctgaggaaatggggccgttccggtaactgtcattgaggagccagctggggggttggggggtgtttgaggagcacggggaggtggggccagcgtcaccggggtgagccagcccagggatggtcacctgctcccagccgcctgcaacttcagcaccagcttgggatcttttctcaaaggtggccctctgagaagtcccatacgtggagcagtaactggaggacatgtcagagctcaaggccaccaagcgcctgcccttgtctgagctgaagctgagattgaagcttgtgcgtttgggtgccttttgagctgggtgatctcagtgacttctgacatgagtccctgtgggaactgctgtgttagaaccagcagtcgctcatcagggtgatgaaaacatcttgggactggggagtggtggtgttcacacagctgtgtggtgtatactaaaaactggcgaattgttcacattaaatgggtggatgctacggtacgtggatcatttctcaatataaaaacgatatgaacaaaaatacaaaaggaggaggaacccactatggggagaggttttcccaaactagtggccttggagccaggtcctgcagagttctccacatagaggccaggccgatgaacaaccacatcatcacttaggaacaggaaccatcaaactctaatgagctattgcgatcaccaaggaatattagcttttccaagagatacaagatcccgcagtgtgttccggcttcatgatagatgcctgaattcccttttgctgttgctgtcacttttctagatgccggatgtgatgttccgtaaacacatttgctgttcccgaccgtggcattggagttcctcacgtttatcctaagtgtttatttgccactctattacatttgtaattgtttatcagtctcctgtgacttattaagtagttctggagaagaattgactttctcttccaaatcaccgtgcacctaaaataataaaaacacctaaacaaacaaaacccgaaaactatcagtgcagacggccagcacccactctagtcagccgtggattcgtctccttgcctaagctcggagggcaggggccacatccagctgggtgaggcgctttggggtcaggcaggcctgggtttgtttgggtcccagccctgccctggagcttcctgggctgcgtgaccatgggcaaactccttaacctctctagtgtcagccttctcccccagtaaaatggggtggcccacatctcattatggggttgtgaagatagacgcagagcatgcatgcagcaccctgtacagggcatggtggtggtggccctccctaccccccagcatccacatcaggagtggaaactgagaacattgcaggtactaaacccggaaagcaatcacacagagccctggcgggaggagcagcagcagctcctgctttaatagtgatcaactcaccaacctctgctcgctggctcagaacagcacgctgtaagtgtccctgaatgaatccagcagtggtcttggctgtaagtgtccctgaatgaatccagcagtggtcttggctgtaatcatccagattttacatagtagggccttgccactgctggcctctcctttgtcccttggggagagacatggtcactttcagaggcactggattgatggagccctatgccccctaacatacatttcccatcccaccgctcctccaggggtcccaggacccctgcactgcacaggaaaggggctgagcagtaccccatgagcacgggcccagtgtgaggggccgcgccgacagccttctaaaataaccgcagcacagaaggcctggaatgcatttggacttatatttggaattgtcgttggaaacagtcctggccaaatgtaatacccatctgttcgggatggtttgagagtaagaaaatgaggtggctcagctggagggggctgggcagccctgaaactcagggctgggagggtatgatgtcccctggcccccacgctatcctggagccctccttccctccagcctaggctgctcctgccttctaggaccatcccctcgtgttagcctgccctgactggaggtatttccccttgcctgcaaccaggctttcttcccgaaccttctgcccgctggtcagtccttcaggagttcgggactgggctccttcctgctgagtttttgcatctccagggagagcagccaggtttggtgcccagcactgaaagcaagcatccgctgaggccgtgagctgcctgtcgcctggctccaccctcccacattcctcatgccgtgcccctgttaatgcatcctggggttgcatccgtgcccctgcagttctgtgatgattgatcgtgagctgtgtgttttccattacattggtctccttcccccacttcctcatgggatagtggattttgaagactaaaaggtagacatttcagtttgtttctgtacgtttcatcttgttccacagtgtgcctgtctggccttttgacgtccagtggatacttgttcttgatatgtttgctgttctcagcattttctgagtggctttaacctatccgagtggctttcccccacccaagattattaactcactcttttcccctggagagtagtcaagggggaaatgatagctttgttacttgaagacaatcttaggaagcattcgcttaattcttggggagaacccaaagagtgctcccccgtctcagtgctcccctgtctgagtgctcccctgaagggaagtgctcctgtccgcatttgccttccttcatgcttccttctgggaaatgtggccacatgaccccagtcctcccctaccctcagggccactgttccagggtctcagggtggcagagaagtattggcaaaaataactccttggagtaattggtcttccttagaattggggtttaaaatctgtctggtttcctagggcagtcataataaatcaccacaaacttggcttcttaaaacaacagaaatgtagtctcttatgattctggaggccagaagtcctaaatcaagatgtctgcagggttggttccctctggtggccctaagggataaaagccgtcccctgctcccagctcttggtggcctccagcagtccttggcgttccttggctcatagacgccgcactccaggctctgtctccgtctttctgtggtgctgtctgtcctctcctctttttataaggacacctgccattggatttgggaccaccgtaaatccaggaggatctcgtcttaagatcctacacttaatgacatctgcaaagaccctatttccaagaaaggtcacattcacaggggctgggcttcagacttggacataattctttggtgtccactatccatccaactacggaatccagatggtggccatggcttgtggtgaatctagtccctgttcagatgtctgtgacacagcaggatgccagggacccagcatagtttctcgcagtggggttcgaggggctcccaaagcccactgccagttctctgagcagatccaaagtacccagaggtgactgagaggccaaaggagtctcttttcatccagccgaggaaggagcgtggcctggctctcaaaggctgtacatgtgactcacaggaagtgaggtagtgagttcactttaacccacctcaaacagatgaaaatcagccgtttcacctgctaggggtgggcttgcctggttggaacagtaggtatgtcccagtttttcctagggattacttcttgatctctgaagaattgtatggaatcagcagattcctcatgaagtgactttgtatttaaaatcaagacaagcttaggtgcttttgttttatttatgagccaaatatctgcaagaaatgttattaccacaaagaaaattctcagtatggaaaccttcagccagtgtttgggtttgtgtgaggtaatttatgtgatggaattccagttccaccaaacaatttgggtagttctgtgggcatctttggtaaaaactgggcttcgaatacttatttaacgtgggattttatgacagtttcagaagcatctgttacttttcattgacgtagtttcttgggctgagccatattattgacaggactcataggaaatgtgtgagccaggaagggtacccctcagaccaattgccacctggcacccctcagtgcacacagccaaaccttgcttgaaggttcacgcgtgtctgattttggcacttattgaccagccatttaggtcatagtaaccatgagcgaccctatggcgacagatgccgtgtttcagttttgatgtgtcttctaattctgaagaaggaaaatagcacaggtgatgttggggacaccagtaataagctgatgtggtgttgtcttggggaatattctcaggcgagtgtggatctggggaaatctactcagtggccaccgagcccctttgctgactgtctctttggacagtttggctggccaggctgtggtagatggaacactcctgttccggtgggtgttttgattctaggaactctgtgggtagatctcaaactgctcaagacttccaagaggtgtcctctgtggacattggccgtggatgaattctagagggctgtgtcagaggcacccgatgtgccaaggtgggctacggaggtggatagcttctgggcctgtccctaagaaatgctgctcctcatatcatgacctcaattagaggggagggcagtggagaaggcgcatttgcaacagaccctgctataagggagcacagtttttgcagggtagtatgtggctgaaggtctgggagcgtttggaagtatggatggcggctgggcgtggtggctcacgcccgtaatcccagcactttgggaggctgaggtgggtggatcacctgaggtctggagttcgagaccagcctggccaacacagtgaaaccctgtccctactaaaaatacaaaaaatcagctgggtgtgatggcaggcgcctataattccagctactcaggaggctgaagcaggagaattgcttgaacccgggaggcggaggttgcagtgagccgagattgcgccattccactccaacctgggcaacaaaagcgaaactccgcttcaaaaaaaaaaaaaacgaagacggaaatatggatgtcagatacctggatgcatgggtgcagaatgagagtcacagaattgccttccctggaaagaggggaagccaggttggagaagttgaaggaatagaaagtatagagctttgaggagagagaagtgtgaccctgtggagccacgtaggccatgtttttcataagcccagtttcacccttggcccagagatgcaggtgtgtgtgcaagaagagagtgggacatatggcaggaaggttgaaaacagacaaaaagggctgcaaggagagatagaggagaaaaaagagtaggaaactcacaccctgaatgttctgttgaagataaaaacacctcttttttttttttttgagagaggttctcactcccattgcccaggctggagtgcaatggcatgatcacggctcactgcagcctcaacttcctgggctcaggtcattctcccacctcagtctccagaatagctggactacaggcacgcaccaccacgcctggctaattttttgtatttttagtagagacaaggtttcactatgttgcctgggctggacttgaactcctaggttcaagtgatcctcccacctcggcctcctaaagtgctgggattacaggcatgagccactgtgcctggccctgacatttattaaaatggcaatgcaggccttcttcaggaccattgtggtaggtatagggactgccatgacagtttttcagtagaggagagagactccgaatacaactaggaaaagtagggattttaaagccgaggcaggtggatcagttgaggcaggagttcaggaccagcctggccaacatggtgaaaccccatctctacgaaaaatacaaaaaaattagccaggtttggtgggcaggcgcctgtagtcccaactactcgggaggctgaagcaggagaatcgcttgaacccaggaggcggacgttgcagtgagctgagatcacgccactgtactccagcctgggggacagagtgaaactctgtctcaaaaaaaaaaaaaaaaaaaaaaagaaatgccaaggagcagggcgagggggttggtggctagaaaattactaaggggaaacatcaagggggaaggggtggggattctggctaaaccaacccgatgggattcttgctggagacaggccaggtggccaggcatctcctgggggtggtggactaggaacctgatcagataagaagggtggtcagttaaccaagggtgggggattctggctaaaccagcatagcagtgtcaacaaacaatattttgacaaatttagtttagagatctcactggtgtttattagcacggtccatgaacagggcagcatcccattcctgtaatacgaaggtgctcctgtgggcccagccaggttctggctttataggcagaaacgggctgaagaagcaaaaacaggcaacggagagtggattgttcatttcagagtgactttccttctagggttaaagcaaaggggacgtctgactggttgctgtgtatcccctggttttttggaaactggcccattccgagttcagttcaattacgtggcacctagcacagatgactctgttctggcctgtgggggcctattgcagaagctcagtccagaacagtagcctctcatacattttatttaacagcaggattcttgctaaaatagggtggtgcagagatggacctggaggtaaaaaagttaaggtctagttgggaggaggatacagaggagcctgaagtgggtcaaggaagacgatcagttcccgtgcggcagcattctgccatacgtgtgtgtggtgtctaggaacagatctgtgtccacgggtaaacgtgtaagtctgcaggtattcctgtgcatatgtgggggtgcttttacatcgtgttaaaaacaaggtccctaccaacctagaaagatacatctcatcatttttttttcaatgtcaggaatgcgtatgcaaagtagtgggaatttcatgcggaattgtaatattgtgagagcaacagatgctcttatttttgttcccttcagtagaggagagaggaatgagaaggtgcataaaattttcatggcttctctttgctagtgtaccatttttgtaatctggtattgtttgaagctccctgttactgtgaaaacagaggctgcctgagatgatagaacaagcaacaccataaaagcggctggtggtttgtgtggggccagtatagacatgtctgggtctggaagagcttaggtggccacgagaagggcgggagctcggagggatgagggaggtggctcatctgcaagggaaagaagaagggtggttgtgcttcaatcaggaaaactagataatgtaattgtacactgattttcattgtcgcccaaatggtgtgattgcatgttcatgggtggtaaaaatatgcatttattttattcacaggttgtactcagactatctctactttgcaagttcgaataaatccgcggacgacttccatgagaaagtgacagaagcactgcagctgtttgaaaattgcatgcttgattattcactgcgcgcctgcgtctacaacaacaccctcaacaacgccatgcctgtgtgtaccccccccccccgtaccccccgagctggcccctggcagaaggagctggtttgttgttattatgcaagcggcattgtgggtttgcgtttcagcataggaacagagagaagcgttttaatgtgcaaatgctgttccccattattcatggatgtaaaagctgaaaactgatgggctcttggtctggctcctgccttcctccctgctggtcacctgccacctccccctcctccctcagcaggaggatgagggtgcctttaggaagattaccatttagcaagacacccagcaattagaatcggcagacatgaggacacccaactctcaaattgtcttaagagcattctcttgagcggtggattgttttgttggtttaaaaaactacccatcaatgattttcaatgcttctttgacagagtctcaattgaaaaacattttctgttgattcctcaatcgtatctcttgttcttccttcagaactatgtctgtaaatttctagcctttttgaatgcaaaaagctgttattggtgaattcagcaccttttagccccgggatagttttccatgctgggctccctgggctggctgtgtacttcaacagcagggcttatgcagcgagcattgccgctgcgtgttccagagtggctttacaagccttgctctgctcagcgtctcgcatagcaaggcaccaacaggcctgctgtggagtcttggaagcccccaggtggtgggacttcaggccaagaggctctgccccctctttcttactacagaggccgtgggatctgggaggcagcatgcaggggcagcaggtgggattccaggctgccctgttggactttgtagtttggcaaggaagatgccacagggacacaggtaaccccagagcctgctctggtgccaggtaggaggagtacactttggaaccagccattggtgtgggtcaggtttccagcttggccatttgctggctctgtgactctaggcagttgtctcagcctttctgagactcagttgctttgtcatacaatggggtaataatgctgctgtaccaggctgttgtgatgggtctgtcttgcattcctgcgttcattcttgccactatgtcccctgcatgacgctgggtcctggggccacagcaatgccaggacaggtgtggtccttgccttcctgtgcagctggcggggagagaagatggaggctgggcagggagctctggccaccagagaaccacctgagaacggggcttcaggcaggttcttaggagagggaatgtctgtgctgaggcctgaaggagagttggccagggaactgagagcagcgtgtgcagaggcccagtggtcagcaccacctaccatacagaacgcagccagccgcctggtgtgggagatggggggcactgaggcagggggcttgggtgcgtggcacatggggccgcaccacctggtctagcctcagaagaagtctagacatcaccctgagagagatgggacccctcagagggttttaagcagaagatagtgtaggagtggaaaaggaatatctcactactgtgttcatggctgaggcacctataataaaagactaacgcgagaaagcacacatacttgtttaacgtaaatttcatgtaacccgggagggagccttcataaggaaacggagacccggagaaacgggaaacctgtgcgtgtttgtgcttgggtttgatgaagagagcagtcggggagagggccatgattgtcaaagggggaatgactcaatggctctgtggccaccgtcacaggggacacagggtctcggagaaactctatttgtgtgtggcttgaccagcacagcttgtcgacccggcttcgtgacccagaaccactctcagctgtgactcttggccctggacccctacggagtgagtctgagagagcaggcagggcagcccacccggtcctcaaggcagctccctgagggcggtctcagggctggggctggcaggaggaaaggggcgctggcatgacgcctcaaggtggggttgtggtttcttccagcactgatcatgatgctgagcagagaggggtgcccagtgtgctgacagacacgaatcaagttgcagctgtgactcaggccaggcccatttcgtgccacatctacactttcctggtgcaggtggctcttccatcctgcaggcctcgcatggaggaccttcagtcctggcataaacagtaatagcagcagctcagagccagggctattatgggtcaaatgccgaggttggcacacaaatcggggaacgtgctcgcggactgggtttccccatcatcctaccatgcctgattcaatccacccacgagtccttttccctctttttcccagtatttctagagagctccactgttctaccctctgctattgccctgattcagccactggccctttcattgtaacctccacctgcacagcttccctctctctgggagacagcccctccccagaccccttctcaccttgatccgttgcaccaggcatctttctaagatgctgaactgccatcactattgatggggttcaaggcacactgcccccaaatataacagcttggcatttgagaaaacagcagaagcagaaaggccattcttgcctccctgtcccctcctcctctgaagctggccataaaatgctcagagcagaggtgccctccctgtacatcctaatctctgaagatccgggggcacagaggcgaatctgaacagacaggcctggctgtgtctcccccagtgcatgaccatgagataatttccctttacagggattcgtggctccgagctcacttctttggctggcactcatgctctcacttaatcagccaatatttataaatgcaaagcaaagagaggaaattccccagcattattaaatgatataattggaatcctaaacaactgtaattacaaacaaaatgtgtgacatcgtcaggagactgtctccaggtgaatttaaagcatggctgggggatttgcctactttagtgtgggaagcaagggtgcacctttgtcccctgagggtcagggggtgcaggacccctccaggaatgaatcttgagggaaaagtccaaggaaaatccaagaggaaccaaataggagtgttgtcccatctttgataggggcctcctttcagggaaggaagagcttggtgcacggccttcaaggcttgtctgaggccagcaccctgactgagggagggatgaggaggaggaaggcattggtggttcccggccccagccggccaggtgacccagtttgcctggctcccttctctgcccaagtgcctcctggtagacaagagccaccaggtggagcctgccgaggaggctgtgtgtgctggtcagagtacggatgggaagtgatggattcagccagtgtagactcagcaccaacctggcactacaccttaacacaggccctcccatgcctggggcttactactgggaaaactgaggctcagggaggcagccttcctctggagtcacagccagtaagcagaggatctaggacccaaatctaggccttttaacccagcttcccctagatgtgtgtttggcttcaacatttccccaaccatctgatcttcagtggttgctactctgcacccacagcgtggcaggccctggtccaagagagaaggtgcaggacggtgctgtgaccagttgtgtgcttggaatgaggcctgtgtctccacctgggcgtttctaccacattgtgccttttgaaactttctcctcttggtgatcctgcgtgactctcaaaacaaacccgataggtgggtgggaagacaggagtcagtcattgtcactgtcagcagatgaggacagtgaggggcaaggtatccggctaatgtggtcgtagaaggtgccagagccctcccctgcaggccctgggaccactgagttctctctgcaggaggctgcctgaaaaggactgggaaaagtggggcaggtgtgggctttgcactggggactcctaggaggaagcggcttaagctgggctgggtttagatggacagggagaggcagggcaggggggaactcctgacccaaggcacagtttattttaatagctttaaatagtgtttcttgctgcagaagagctaatatctaatatgcacgtacagtctgcttgctaccgggcactttgtaccatgcagagtgtgccgactcccatccagcgccctgggggcaagcccttggatagtttctcccacacagaagggagggtgtgcccctgccctcctgctgcgggtcagcactccgactgtgaactggagagcacagctgaaactgagccataagttcatgggcaccatcgtgatcctccctgtgttgtgtatgcttgagtcttcgtgataaaaggtttctaaaactccatctgtgagaggtgaaagggatctaacctttgttcattactgccagcccctgtcccaagccctttcaatgcatcgtctcattagagatcccctgaaatccatccctgttttacaggtgggaagactgaggctcacagaggttagttctcccatccatagctggtatcaggcaggctcaaggttcaatcctgggtctgctggcgtttgacactcagggagtttttgccttccctagctggctcctaaaagcaaagggttttgctggcaggaggcctgggcttttatgctcaattttgcgttttgctgaggatgacaagacagtagcttagcaggtgcctctgctcagaggagatccccaggggcaggctcagtggacaggaggggtgcagcagtaacagattgtcccttaatcttcagtccctggagaactcacacaccagagaaagagccaggcaatcagaaaccctccttatagaggtgaattttcatttctgggaggagaagccggtttccctccagatgtgaatcccagccctgccacagccctgggagggcagctttgtaaggcaccctgggccccggcacaccctgctggagtcattcaccgccttcctgtggcacccggatgcaggggcagcacagacccctctgcctctggccagcccccgccactgttccgcagcacaccctaccctgaggggtgctcagaggggccagtgagcctgcctcagagcagggtcccgagaagcctggtgcctggatgagcagcagccacagcccctgggaacttgtcagaaatgcaaacgctctgccagtcccagacctcctgaatcagaaactctgggtacggggccatggtgtgtttctcaggccctccaggtgggtgtttgtggggtccggttggagagccaccagggctcgtcaccactccctccttcgtgccctctggggtcggggagacttgctccagggcttgctttactctgactgtcttctctctccacccactccttttctccattgcatgcatcacaaggtgatcgcggaagtctgtttctttaccagttgagctctgtctccatgagattgcagcctccctgaggccagggccacttctgttagcagcaaatcaccattgcctagcagggtgcctggcacatggtggcacgagctcagcttatttgccaaatgaatgaatggggactagtggggaggctggctggggactcccaactgaaatccctagtaggggacggagaggctcggcctggtacctgtctggggagaagtggggactgggactgtgctcagctcagccttggctctcggtggggattgcttttccctggggccctgcatgggggacaagctccacaagcacaggtgacctggcttcaggtcctggctccaagggtattggccactgaccctgagtagccccccccgccctgccctgcacctccatgtttctattggtgaatcagctggcacggttaacttcaaaggcttcttgcagctctgatgttttctaattttaagcacattggacacttgccctaaatacgctttttatttttgttctattttgattctctgtcctataccgggaaaaggtgaggggaaaaaaaatctgctgggggctgtctttgtcctgtcttcatggtgcatatggttgcagtagtgatactgcctgcaccagaaactgtcacttcaggtgaccacactccccctgcttggcaagggggctgggggttggggtgggaattgaggggcgtttggagcagatagatcagagggaaggcacaaagcgggaggggagctagccccgggagaagcagccgagcgccaggaggcctttgccgcctgcagcccctgcggtttcctcttttcctccgcttcctggctcagccctgcctgctgaggaggaccatgctgcggtgcaggcctgtgtccacctgagacagcacagggggctctcatgaggatggacacaaacaaggtttcagagaactatctgtcaggtgcaggtgcccagccaggtgctcggacagactacagctgctctaaaacaccccagcctgccacaaacacctggctgctttccttctggaaagttctcctgttgaaaggcacgtcctctggaaaagaaaaacctcatcagactggtctcccctacgagggacggcctacaagcctgccagggagacaactgaaaagccccgggaggcgggtgacttaacagcgagttggtctcgtcatgattcgtctgcgttggaggtgacaacacatgtttatttctgagaccggcacgttctcattttctctttagtttcggcccagcttgaggtcttttttctgagctggcatgtgaggtagcaacagtgtgggttggaaacagctaatgaattttgaaggcaacttatccactctaattgcttttcttcctctccatcctcctccatggttagaaaaataatgaaatgggaaaagaatagttagcatctgtacatattttgcccaatctttcattgtcttattattagcactgtattcagcagttgcacccgagaaccatgttgagggccagagtgcaggctttgcaaggagggaatggtggagaagccacagtccctgccctcaaggtcaaggtccaggtcaagttgggcaggaaaggaaatgtgacatgagagtgtctgcctaaaaaatgggaactccagggaggagcctggggagccaggaagtgctgcatgtatgagaggatgagctggaagtttaagccaggcccaggactttctacacatagaaagccatggaggctttaagcagggctggctgtggccagatcactgctttggaaagcccatgctggtggcagggtgcatatgagagtgcagagaccaggggaaggaggactagccaggaggctgtatcagcttcaggcaggtgtagatggggcataaacaaagggagtggtgtgaactggggagaggtgggagatgagaagttctgggcagacacagataggcagagcagggtccctgggcacttggagaagaggcaaggggagaagccctggagaagggggcctcacagcaaaaggggatgaggctgtttttttctggaagctttgctaagagtttagggtgaactgtggagttagaggaaactgttcctaagactgctctcacttctgacaccagttgcaagttcaggagagatattctccaacccaccttcaggtttagtaattttccagaaggattctcagaacacactggaggctattacactattggttatgatttattacagggaaaggatgaagattaaaatcagccaagggagaggaagtgcagggggcagactccaggaggggcccaaatgcggagctctgagtcctcctctccctgtggagtcatggacggtgttagtgccactggccatggtatgtggcaatcctcgtggagtattgccaggccaagccttgggggtccaggccttttactagggttccgtcacatgcagatgctgtggctgacctttagtctccagtcctaccagagtcagaactgataccatgtggcccaaggccccatcatcaatctcagtgttagcctgcctatgaccaaagccctcaggccaaccaagacacttctgtcaggcaggacatccaggggcccagacatcacccccaggagccgagggaaaggcccgagttctctctgagtagagttaaatcttcaccacacggcttgcagtaaggcacgagagaaggaacagaagggtgaagacccgggaaatgggtactggaaagtagaaaggacttaaatagaaacatcctcctgtgtacttggttcagtaatgattagatgctgaattacacacaccctcacagtcaaggatgttcctctggcatcaggcatttggctcttcactcatgtaggttgtctttggggtgtctgtggttgatttttcacatcccgttgtgtgctgggcatagaggtcacactgggaacagagaaacagccaggatattgtgcgaggaacatgtacaccattggtggccacaaccttgacctcttccctgcacttcagtccttacctgtgaaatggaggcatggcgctacccacagggtgttgtgaggatgaaatgcaacccctaatataggaattctttgcacatgtagcacaaaaccccccataaagaagcaagaacaccttgtgttaaaatccagcttctgaaagtaactttgctaggataactcttttgtggtacagtgaaatgccataccactttggaaaagtgccctatggtgttggggcaactgctcctgaaataatgcccttcttctgtggtcctaggtgaggctccaggttgggctctatgctgtgtaccttctggactggctcagcgtttttgacaagcaacagtttctcattcttcgcctggaagatcatgcatccaacgtcaagtacaccatgcacaaggtcttccagtttctgaacctaggtatgagtgtggtgcttagactgacgggccaaagcatgagctccgtggacttgttctgggagtcctctggggcaaatgcagacctggtcagctgggtgggaatgggctgagctgggaggcctggggatgtccttcaggaggcctgttaagtaccatttattgagcactagctgtacataggtcattgtgcacagtatggtgagggattctctggagagaaggagatggtttcccttctgggagcttatggtctagtgaagggagaggaggaagccatagctcacctaactgaatgacaggtaggatgccgtggggaaggtcagcactgtcatgtaaggtatgtgctgatggtttgggatcccagctactgcacggatgaggaaggcttcatggaaggaaagggcctgagagctgagctttgtaggaccaacaggatgtcaccggggggctggagcagaggacttggggcttagaggagggaacagacagatcattgcatcatctccggtattcttggaaattccaggagtcagagccgtgtggctgagttttggctgctgatcatggatgctgggcccctggggcatgagcgcctgccctcagcctgtggataccagcccccccaggggcctgagagtcactttgtggtgacaggccacactgctgactatggtgatggctggcagaggcatgtgctggcggagcgagtgctgcccatgtggacggggcaccgagggatggcttgaaaggctgagcaggctcgaacaagccgccctccttcccagaacgcctcctgcagccctgactaatggtcttgcccgggaacttggttaattgagtatttctgaaaatatatctgcctgccactgggacttgggcctctttgatcatttgattttgtttctcctttttttggagtttgatgagttctttcccttccaaggcttagaatcatctttctttgatttgaccacatgttgactctgtcccattaatgagcttgtcttttgtccccaagatggatagtaaggccaattctgtgtttcatatggccctaggatgctgggacatgctttttctgtctatgggctaaggactttggccagatcccaagagcccccggtaaagaggcttgagcagtgatgggttacaccaagaagctgtggcccagagggcggggcgttggggtcgcagcccttgctgttctgtttcagggcctctcactccagagggcggggcgtgtgcgtgactgacagcccctcccggccttttccagggcctctcctcactccagagggcggggcgtggcggtgactgacaacctctgccagcctgttccagggcctcgcctcactccagagggcggggcgtgggggtgactgacagcccttgccggcaggcctcttctccctgatctccttgctgcagatggaggttcagccagtgggggctctgggcacaagtggcctcctcccagccctcctccctatggccacttcacagcaagacgcacagggtgaaactgtgcaggcccagggaccttggcatgagcagcctgaagtagaaacgatgatggcggaattccagagggctgctgagcaggaaaaccgaaacccgtgggctgtgctcggcaggccgcacgttcctccaaggacgggctgacacccatggagagcagcccaccaagggcaattggaagggaatccttgaggtcagccttagacgctgtatcatcattaaatgccagctgggctcccccgagggtgggcatcctgcacccgccgcagaatttcttcgcaatttcctgatggtgtttccaccttcctccctcagtgcttccaaaatggatccagccaaagaattttaatccctaaatatgttctcttaaaggaaactcctgtctgaatacgaagcatagctgggatttttgcaaagtcccttttacttcctgccatgcctcctgccttacgggactcgtcttcttttattctagggcccttaagtgagaagcaggaggctttgatgaccaagagccccgcatccaatgcacggcgtcccgaggaccggaacctggggcccatgtggcccatcacacagaagattctgcgggatttctacaggcccttcaacgctaggctggcgcaggtcctcgcggatgaggcgtttgcgtggaagacgacgtgagagctgaattgttgctgcacgtgctgggcccgccaatgccgtcatcatcaggattttacaaatctctttgcggggaactgtttcactcatggtatggaaaaccccaggactctgccactctaggcacacatgaattataaccattttggaatttccttcgtgatgttcgagagctcagcaatggacccctcacagagctcctctatccgaggccattggagaccccagtttctcaagaattcagctctgctctgagcgtcctggagcttggggatgcagccagctggcctgcactgggtgtggagagaacacctagggaaggcagcctggccctgcccgcctccgccttctggagagcctctgggttctgagtcagcaagccagaggtcatgccacaggcctggctggaacttacacttcacgttccctttttttccccctagagatggggtctcgccgtgttgcacagactgtctgtattcaatggctatcttcacaggtgtgatcataccacattcacttctgaaacactcttgttgcgatcgctaacctcactgggacagagaaccgcagtctttcgagaatggaggctcttcattttttttttctcctttactccaaactcagccctccagtttcttcagatgtaaaccctgttaacgtcactgtttccaaaaggaaaaaaataagtcagtttttggcagcaccttcatctttctgacctcctcctattctgtccttgtggacttatgtttaacatagaaaatgaatgcgtttaaaacaaaaccactttctgcatttaaccagtcctggctctctctctgctgcctcttcatacgttttctcaagaacttcagtttataattggaagagaaatttttgctgttaatgccagaatgagcaacctcaaggaattgaacacttcttggaaaatctaggtaattcaagccctcatcaggtttacaagatcatcagagaaacagaggattttaatttttagttctggccggctacaggctccatttctctgccttcccattggaaatagtttatttccacattctccactgcgtgtggtcaaagttcctcacccagcaagggactatagatactcgtgtcccaattccaaaacacaatgcacaagctgaacttgggctgaacgtggcgtgttgagatttggaatgaggtttctaagagccgtgttcttcatggaattttccaggccacttggcagcttggtttaccgatggatgggctagagatcttgtcgtttcttggaagtcacagggaagattgaagagaacgcttgagcatccttggcaacagcccaggtgggacctggatgaagctttgcactcaagtattgtcaagggaagcttcctgtgaaccaaagttctcaggccaaggtctcgcccaccaaagccagaaagtgcaagcacccgtctacccagctctaacttgtatgtgtgagacagaccaggcttcgggggtaggaggatctgcagttgttcagccgtctttctgctggtgttgtctttctgccatcagagaagggacacacagcccgttcgaaggtgtgcagagggctctgagcgccaggatggccagggctgtttttgctactgaaggagcgtgtgtcctgaactcccacttgcagggacagtccccaccttctctatagccggcactgggagcagccgccagcagggaaatctggcctgagcacaaggatgctttagggagagatcacttcagtgtgtgtgtatatttatttgcagtacagtgcgcgcgtgtgtgtgtgtgtacgcgcacgtgtgggtgagtgcgtcttctgagtgggttctgttcagttgctaatgaggctcctccgctctggacacaacccttttatagattaatttctctgccaattaacttgtcattttcagtacatattttactattccacaccaaccataattacaacaagggatttttcttatgcactcctatgcatgtgaataacatgtggtgtaattctgcttcttacagaagtattactgaaggtattatttccaatattatttggtttattatgcggatcttttttatatatgcagtcccatcccttctgtgccactcaatgccatccagacatggtttttccctccaggggcctttctctccagagggcacttcggctgcctctgcttcctctcattcgaggcccggctcttgctgacagaataggttccgttctgggcggtggttctcgagcctgccattcaaaaccaaagcaaattggagcatttctcacaacatggtattgaagttcctttttgttctcaaaagttgtgaccgtgttaaattgtactcccttagtcctgtaaggtatgttaagtgaatcgcagttacgctgtacttttattaatatttaacataattaaagatggacccataagagtgacgcctgtggagcgcgtgctcttcctctgcagccaagctcttcctggtgcatgagtgaatcgcagtggtttagtgtcgcacctgctcgagttgtgcaggctctgtgtaaagaggagttacagctgtgctggctgctgagagacgaggtgtgattgtgcgagcaacaggcagaagaaaactcaagaccagagagaaaaggattcagatgttagcagggactccctgtgcgagtcctgttggggtgtgagtcagggtgggaggtctggcccagccacagtcaggcctagcgttgtcttcagaccttcaaatttgaaggttaagtgaccacaggcctcattccggtggcctgcctggcccctggcagctgtgagtttgagacccctggtgtctctggcacatgtccttattgctgagggcaagcccgcagaaggaggtgtggtgtgcactcaggtggggcagccaggacaaaagaccacaaacaacggaaactgattttctcagtctggaggccagagacccgagatcaaggtgctgcagggctggtttctctgggggtctctgtccttggcttgctgatggctgattctctctgtgtgttcatgtggccacacacacacacccctgctgcctcttcctctccttataaggacaccagtcggagtggatgaaggcgtgctctgacagcctcatcttaacctcatcatctctttaaacaactttatctgcaaatgcagtgacattctgaggtactcgagattgggacttcaacatacgaatttggggcacacttttcagcccatacagaggggacatctcaggcttagggctctgaaagctgggccatcctgagcacagcgtggaccatggtgggtcccccagttctgggcagaccttcctgggggagccttctccccagcaccacctcccacagtggtgtgttgaggtagggggcaggtgtgtccaggctggaaatagggaagaccccatcttttcctgcgagggtcaggaatggctttacccagcagggaatggaggacgggtgggagtcaggagcaggacggctggggtgcatctttgagggctgagggtatgacctccctccatttcagatttcctctgaaagcctctcccgtgaggccacccactccccaccgagaaaccagccctcgggaaggatcctgatgaggagtatgcctcttccccacaaaatgaccctatttgggaactgaagcaaaggctgtgctccaggtggaggaactccaaggatccctgagtgtggagacagggattatgtgggtgactattttcctgttactccagaaatctcaccctccaggcagctgtgctgcctatggtgaggtggatcccatggggactgataggaaaacatcactctgatgaatcgggttttcccagtacttcaccgggcaaggttccctgcagagcagcagagacagaataggtcccgtggggcagaagctgcatcggccggaacagctgtcggcctgggagctttgtgaatttatgttgctataaaggagtacctgaggctggaaatgtataaaggaaaaaaggcttgtttggctcacgattctgctggctaaggattgagcattgggtgaaagcctcaggctgcttcacgcctggcggaaggtgaagagggcgggctgcgcagaggtcacaggggagggcagggccgggggagggaggtgccaggctctttttaacaacctgcttttgcgggaacaaatagagcaacaactcactacccccaggatggcaccaagctattcttgcgagctctgcccccatgaccccaacactggggatcagatttcaacatgaggtttggggtacacacatccaaactacagcagctactataaatcaccccaaacttagtggctcaaagcaacagaagtttatgatcttacagtgctggaggccagaagtctgaagttggtctcactgggctaaattcaagtgatgagcaggactggttccttccaggggctcaaagggagtgttttcctaccttttccagctttgagaggctgcctgctctcatggctcctggttctttcctctgttgtcaaaagcatggcatcttcaagtctaactctctccctctgcttcagagatcacatggccttctctgaccctcatgctcctggtgtcgtaaggaccctctcgatgacaccgggcccaccagataatccgggatcatctccccatatctggatcacatctgcaaagcctcttttgccatagaagggagcatatttgtaggctctagggattatgacatggacatcttcaaaggcccgtattcggccaagcacaggagggtggtgtggagagctggccagtcagccaagcgtgggatggaggaggtaccccgtggctggttccctgtgctctactgtacagctcaggcaggtctgagtggggagggggctgccctcagcagaaggccgagcttctggatgcgtctattttgggacagcgcaccttcccgtccaggcaaggccctgtgactggggtagtggagtaggtgggacagggtgacacgaggggtcaggccacagacccacctcctcctcaattcacatcacagtgtttttcccgtggaaggtcacctggtttccaagagtcagccttgtcccccacaatggagacaggacaatttctccagctcttggtagaagtaatttttgagtgcttactagttatttacctttttactttttaaaaaattcttgtgaagttactttgtgagttttccaggatgtgtgtaaactacacacatcagccacctaggtagttttgagttgctttgaagttcagctgttgttgacttcaaaggcagcagcttatgaaagttggagaaatagaacattttccagtccctattcaggggttggtgacctccgtggcccccagcctcgtggctttgggctttggaaggctggtgtctggtctcactgatggctacaggctggactcacccccaccatctctgtcctcaccaaccctgtccccagccccctggctcatccccagtatcctctacaaacctgctcctactcgggtccagggcaggaggctgagcactgtgggccatcctgggagcctcaggctgcacaggttgctgaccttggactgtaagggctgagtacgaaggcagaaggtggggattctcaggcaatgcagcaggcctgcgagagactctggggaggagcaacagggctctctaaattgccacctgcaagtggctgcgtcctcctaccatggggcacccaggacccagctcaggcttgcacctgggttcttccttgttgaacctgtggcaaagcaaggaggagacttggtctactccctcctgggcagcctctgctgactgccctataggtgctgggcactgtgtctgggacacagagactgtgaaaggcctcctctcccacagtggagagctgccagcagcatgaggaggccgggttcatgcagggtccttggcaggcctgagggccagtggggatcctgggggctttctggggtgtaccctcagctctgcatgctttgaaaggcccctttaaagtcaggtcctggtcagatctagaagcgggcaagtctcagctgaggctgaaacctcggcctccctgagccttgtgacttgcccagggtcggaggcccaacgccccctgaggaattctcttcctggtacggcagagaaaggtgggggccagggaatcagggtggggaaatcccagctgcctctccctgcaccctggcccatctcccccaggtcatgagccatcccccttcgactgttttcccaccataagggactatgatttacatctaccaaactctgccaccgacaaggacagtgtgggaagagggtgagccctgagtggagccaggtgagctggattcaaagcccagttccgcagcagagagcctgggagagccatctcttaaccttgggtacaccacaggccctttctgcacccacaggtctgtcttgctcatgagtgggtctcagagtttacaaatatagactgaggatcagagaggctgcatgcgtgcctgaggtcacacagctcagatccccagaaagagagcagaatgcagctcagacattccgagtcagtgcttttaaccatagtgctgcattatataccctcagcaccagccccaggcttccatcctcagtagcctgtctacatttcaagggttagttctccttcccctccatttcaaatgcccccctttcaagttccctcagggaaggccagtggtttttggggtcacctgggccagggttttctgcagctcaacccatcaggggtctaggtgatgactgggatttctagggggaaacaagggaaataaacatggctttttctgccaaaaggctctctcagccgagacttgctggcacggatattgcccctgccctgggctggctggcgtgagttgtctgcgcctccctgaaggcagacttcaggggctagctgtgatgggctagctgcggtgaggagtcccctgagccctgagtcacatcagaagcacattgctccaccccagggctcggccttgcccagggcctcaaaggcaccaaacgtatacacctgagctagaaagtgtaaaaaagccaaaatttaattttctcagcaaatattttctgaacatctactatgcacgagtcattgggccaggcattgtggtgagggtgggacattgttcatttgctcattcattgattccttcactggttcttccaacaaatattgagggatcgccagccatgtccttggtattagaggcacctgggagagcagagctggtccctgcctgcatgcagtgcagcagacagattttgatcagaaacagacaagacattgatcacagcattgcctgaagcatttcagaactgcaacaggcatgaggggcgatactggggacagtgacatatttctggtgagataccctcattcctccccagctactccactctatgacctccccatctgcctcagagaccaagccccaagaggaggctgggctggaactgaacccccagctttccccaggccacacgaagaccactcccagaatgtttcaggcctaccagcgcctctacctacgaggtcacccccaaggctgccatgccctgatcctcaggaagccactgtaccttgcattgggtcctatgtgtcccatggcccctcatccattctcaaaatgcctcctccactttcatgctctggctcaagatgactgaagtgtttccataaagggccagatggtaaataatattagactttgtgggcccaagaggaaaaacagggatattaggtactaatgtaacacagagaaaagaggttccacaaatatttagagatggaattcaaaatacaatagttgagtacaattttttggtaatacagctctgcttacgagaagcaaggggttcttttgggagtgggtaacatgctgcttcattgagggtcaagttgagtgcaccctgtcagaccctctgcagatgctcgtctggagatgccattcctaatccaatctcctggccctgttgactttgttggcagctcctcctgaaactctcacttggtctccagaacaacggactcctcgctggtcctcatcctgcctccatggctgcacctgctcttctttctggccatgaatgtcggggtgcccagcggctcagtccttagccctctcccataactgttcttatccagtccgtggcctcagacgccatctctatgccgatgactcctagacctcagccctgagcgcaggctggtgcacccactgcgtgacaggtggcgcccccagcattaatgactcagagctcttgggtctgtctctccacctaagccgcctccccagcagggttccatcttcagtcgcagtgaccagcccatgcaggccatgtcactgagctctacccgggcgctgctcgcccacacccaccctggaacccatcttgccggccgtcctgctcctgccatctcttctgcgggaaggctctgcccccagcttcctccttcaggctgacagccacttcccagtcaacctgaccaccctgaccaaacagccaccccgccccttcccaagccactctctcaccgtcctgtcttattattttgtgtaagtgatcagggaagggaccatagtgaggcaaaggcaccggcccggccagggtcagggaagggaccatagtgaggcaaaggtgctggtctggccagggccagtgaagggaccatagtgaggcaaaggtgctggtctggccagggccagggaagggaccatagtaaggtgatctcacttggtcatagtaaggagaccaatggtggatcctgcctcataggatccaccattctcccggctctgccccctcatcttgaccactcttgtattagtttggttgactattttctgtattttatgatcctttgacatcttgctggcctgggaaggactgccctctcgggactagctaacccctagatatagaggcacttggagcacaccttttgtgtgcaaaacggccaatcccagcccaccccgaccatctcccttcctgagcacttgcagtgggcaatgcagctccccagtcgccccgcgggccaggggccagaaacttggaagcccagacactctgagccccataaaattattcaaactcagctctagccctgcatagcccagttgctgtttgtccatttcttcctgtgaaaaccacagcaaaggctctggctcaccatttccccagggctctctctgcctcctcccctcggtgcttcccagtggccccacatagcccggtgtgtctcttcctcttgggaactgtgagtaacaaaccattgtgccaaaggcaatctttttttttttttttttttttgagacagggtttcactccgatgcccaggctggagtgcagtggtaccatctcggctcactgcagcctcaacctccagggctcaggtgatcctcccaccttagcctcctgagtagctgggactaaaggcacctgctatcatgcccagctaactttgtgtatttttttgtagagacagggtttcgctatgttgcctaggatggtcttgaactcctgggctcaagcaatccacccacctcagttcctcaaagtgctgggattataggcatgagccactgagcccggctaaagacaatcttctgagctgttggtctcactttacccgaataacagtgaaacctatgcttcaacaccccccacccccgcaccactcccgcatggtggtgagagccggggccaaggccctcctggcacctccactgtcacttttcccctgcagtccttcaaaccatgtcactctcttccttgaaaccctccccaaccccccaacacacctaggataaaaggccaagacctgctcatggccctcgaggccctccctgggttctaccctgccctgctgacctctgagacctcagctgcccgcactcacctcagccctggctatgctgacctcaccgccatgctcagcacaccaagcccttccctgtactggcctgtgaccctggggtgccctgcctggcacacccttccctgaccctggccaggctggcaccttcgcctcactacggtcccttcgctggccctggccagaccagcacctttgcctcactacggtcccttccctgaccctggccaggccggcaccttcgcctcactacggtcccttccctgaccctggccaggccagtgccttcgcctcactacggtcccttccctgaccctggccaggctggcaccttcgcctcactacggtcccttccctgaccctggccaggctggcaccttcgcctcactacggtcccttccctgaccctggccaggccggcaccttcgcctcactacggtcccttccctgaccctggccaggccagtgccttcgcctcactacggtcccttccctgaccacttacacaaaataatacctctcctgcatggccagcctccctgcttgatttgctcacagctgtcacctgagactggaccatctgtgtgtctgctgctgcttcagcagccctctgcccatcagggacctccgctccttgaggtgggaactctgttcatggctgcagcctcagagcctgaatcagtgactgcacataatactcactcaacaaacttagatggggcaaaggcatgtgtgatgatgctgtagagcaggcaatcccccacccctcgggcatgggccagtagcagtcctgggctacacagcgggaggtgagaagcaaagcttcatctctatttacagctgctccccatcgctcacattaccacctgagctccacctcctagtggtaacgttggattctcatagcagctccaaccctattgtgaactgtgcatgtgagggatctaggtggcacattccttacgagaatctaagatctgttgctgtctcccatcacccccagatgggaccacctagttgcaggaaaacaaattcagggctcccactgattctacatgatggtgagttgtagaattatttcattacgtatttcagtatagtaataatagaaatgaagtgcacaatacatgtaatgagcttgaatcatcccaaaccatcccccccaccaaactgtggaaaaactgtcttccatgtaactggtccctggtgccaaaaagttggggcctgccgctctggagtgtgaagcagggaaagaggacctcaccgtaagggccaggctcactttcctaaggaaggaacagggagagcctagaagaatgcaggccttgtgcaaatgtcagaacctccagcagaggagaggtctgcagggtgcatgggggctgtgacccagatggcatcaggaaagaggtggcgttaagctgagccctaaagactggcaggatctagaaaggtgggcaggcatgccgagaggaggggctggggtgagcaggggcagggagcagggaaggccaaaagagcagggaaggtctcagtgcctccggaaaggagtatacgaacattctgggctttggagtcagggagacctggactacaatcctggctctgccattgtcctctgtgtgaccttaggcagagggtttgatgctactgagcctctgttttcttatctgcagaatgggtatgcactcagactcaggcccttatggcgataagggttcacgcatgtaataccctccacatggcatctggaccctggaggtgggggcaggtcacctcagcaatggtcctcaggcacgattgttgtagcagtaggaggtgaagccacccaggtaagtgggcacaaggtcaaagagggtttgggtctcagggtaaatgcctttggttgaactagtggtgtattgagcttcccacactgacattttctgagcagaggaattattggttagcgcagggatttaggtcattaatttggagcaggtagaagtgcctggaaatggaaggactaaggctgaggcttctatggtccaagtgagtgatcacaggggctgggagtaggaagcacggctgaagggccatctcaaaggcactgtaccaatgggatggtgacatcactactgacggcacccacagagctggggtatatgtatgcttatgtgtaacttcccattttacagaaaaggaagctggggctcagggaggttaggtgactgctccaaggtcacacacttagtactggacccagtgttggaacccaccaaatctgacccatcttgtgcttgtcactaactgaaggatgtggcaggcaatggaggcaaggtcaaaggcaaagtcaagccccaaatggtcaaagacaaggattagacttggagctggtgtccagcctgagggtggaggggtgagggacatttaccgtagcaggggaaggctgggtcgagtcaacgttcttgcaacatccgtaattgcagcgttagctgggcaagttagatgggtggggaagtcctacttaaccacatagacatttcttaaacattttatttttacttcaaatatgtgaagtacagcacatctatttgtctgccttttggtatggagccaaaaccttttctctgagcatgagcccactgattggagctctgggtcatctctgtggcagaaaccacagagcagtgaatcagcactgatttctggtttcagtgtttctaaagggacatgagaactggaaggcgcttgcaaggcaatctcgaggcagagtccttcattatttgtgtgattattttccccaaatcattaccctcatctgtgctgggactttccaaagcttccagcctagcattcagggagcagctccctttctgcattaatatttcatcagcttccctcagtggctctccgagagtggcccagggaccacttgcgaccctttcagggaatccaaagtccaaattcttttcacggtcaaactgagatgttgtttgcccttgatgctctcattttctccagaaggtacaaataaagattttcagagcccccagcccccagccctggcctctgacagccgacggaatgcgtgcttgtgtgtctctgtgctttgaaagtctctcatctttaattttgaagatagtcaatatcaatcaatgcaagccactgaaacaaaagctgtttgggatcttcaatgatttttaagagtataaaggaatctttaaacagtttgaggctgggcatggtggctcacacctttaatcccagcattttaggaggccgaggcaggaggatcccttgaccccaggagtttgagaccagcctgggcaagatggtgagaccctgtctctacaaagtaggtaagtaagtaagtaagtaaataaataaataaataaataaaaattagcagaatgtggtggcacacacctgtggtcccagctacttgggaggccgaggtgggaggatcacttaagcaccaaaatttgaagcagcagtgagctgtgatcatgccactgcactccagcctgggggacagagcaagaccccacctctgaaaacaaacaaacaaacccaactagtttgaaaacttgctagcttatatgatatttaattaacctgtgccttcataatatcaagaacagctggcatgaaaaaggctcgggggcaaacacaattgacttgtggtaaatacaagatcagctggagggtgttttgccaaacggctgaaagccaggagagctgagcacgcccaggatgtctaggggacatggacacacctgtcacctgcaatggccagatgagaggccatccatggtaaaggggatgaaaacggtcataacagggccagctatgattgaacacagggtgagtgccacgccctgtgctggggcgtctcctcgtgtctcattagatcctcactgcaaccccaggaggaggttttatctttattctggttccgccattataaaggtgggagaattggggctcagtcccctcagctagtaaggagaagagctggtccttgatctcaggtctgctggtccccagagctcgagtcccagcttcagcttctcaactctgagtctctgaaaagggtttccaaggaggcggtggaaccgtgtggactcaatgacttcagacatggtctggggctgggaggccagaccgagctgctgcaggtagggagggctgaggtcagggttgggtgccatcttcaggttgtggaagcaacagcaatgccaggacagcagggcctcctcctcccctgcgacccactgtgtgcccagactcccagggacagaaactccgtcctgggctccaccgctgccttcactgcatcccctccctgtcccacatccccctgcaggccagagccgagctgagtgtgctgctggccatggggctcttcgcaggcgctgttgagcagatgggaccggctgtgccctgggcccttccacctcacaggctgacgcttgctcagagcccaggaacctcgagccgccccagacgcggccaattctgaggtcaatacggggccccggtggccaggggctccagcagctgaaggttcgagtcacggtggaggaatggggcgtggctgctctcttccccagggttgggctcccggccgcggaggggcagctggctcgtgccccagtggcgggggagactatttgcttactcccacctccacatgagataatcaggaggtctcctgccatactctgcgctttcagcataatggaattcaggaaaattcctgggccgagccaccccgcaattctaaaggcagagacctgggcagcctgcaaggacctcgggatatgggtacacttcctatccccgctatcttcctacttctcctaagaaaccacttgcctcccgggaccccaggcctctgcctcctgcctttgcccacgaggtgactccaccaggagtgcccacccccacattgttcaactgagtccgcctcttaccccaccccaaggccaagttcaagtgctgctgcttcctccatgatggctgcccggattcctccatccctatccccagatatgcagcagtggagcgatgttcctgatgcggaggcagtggatgtctggagagagaaccgaactggggggccagagaaagagctggacgatcttaagcaagcaatttaacctctctgagcctcagtttccccagcctctgaacggggtgagaatacggaggatttcaaggggcccttatagatctgcctctttattgccttttgaaaactcgccactttccccaagctgattgaattcctgaggcgttttgcagaggagctgcgggaagggtgtggaagggggcgggtccgggagtggcagccccgtccccacgcccctggggttctgcggaccagctcactggagaccaggaggcgctaaaaggcagccctgcgctgccccctggtggccgatgtggacactgcagccaggaagcctttccctcccggccttccggagacaggctgccggctggacactcccctggcttcgcggctcacctctcacctggctagggaactcctgacaccaagggggaccccgggatgagggcgttggagggtgaaagactgggtctcagctcagccaatcaagagcgtagttctgaagaagcccagttgcgggaaaggagtgaatgtggcggcccccagaggtgcgcccagctgctcctccgtctgtgggcttttcccacggccttctcaggagcgccgcccagcagctccgctggaagtggtaggtgcgcagacacctcctccccacccttctgccctcctagtccttccaccctgggacagttgccccttcccaaccctctcttctgaacccttacaaaaccttgtcctgagccagctgtactttgttctcaagccccctcctaggactgtggacggttgaggagggcctcggaaggagccaccactatccccagggaggccttggaagtgggcgtgatagtgatggggagttcctggagcaggatcaggggcctgtctgcaaacacaccagggtcctatcctttttcaccattgcctgcctctgccttctccacttctccccagcattctgtcttccctggcctctcccgtctcctctctgcctctcttctctccttaagccttgcgtctgtgtcctcgtagtcctatgcaggcaggctctgcttatccctgttccctgaaccattctattcctagatggaacaggatggaacaggtccaggggccgctgggctccgacacccctggccctattcccagggcctccctgtgttatctgagcaccttcccagccttagttcaacacgctgaggtctgggatttccatcttggacccaggtgctcatcctgcttggccctgaccttcccctcccctgtccactttgcctttgagtcctttctgccctctcgtctcctttacttgctttctctctcctcctctccatttgctctcgcccctccggcagtgaaggagatttactgggctgggctagggctggggttggggttccaagggacagagggtctggataataagccgctactgtgcaggcttaggagtgtccgcagcctcaatgaaaagccgagataacgcagataaatccacatgccctgctctgcctaaaagacacacttagaagatccaatctgtgacgcttggctgcactttttttttttttaaattttactttaagttctgggatacatgtgcagaacatgaaggtttgtcacataggtatacatgtgccatggtggtttgctgcacctatcaaactggtatctaggttttcagctctgcatgcattaggtatttgtactaatgctgtccctcccctagaccccaccctccaacaggtcccggtgtgtgatgttcccctccctgtgtccatgtgttctcattgttcaactcccacttatgagtgagaacatgctgtgtttggttttctgttcctgtgttagtttgctgagaatggtggcttccagcttcatccatgtccctgcaaaggacatgaactcatccttttttacggccgcatagaattctgtggtgtatatgtgccacattttctttatccagtctatcattgatgggcatttgggttggttccaagtctttgctattgtgaatagtgctgcagtaaacatatgtgtgcatacgtctttatagtagaatgatttataatcctttgggtatatacccagtaataggattgctgggtcaaatggtatttctggttctagatccttgaggaatcaccacactatcttccacaatggttgaactaatttacactatcaccaacagtgtaaaagcgttcctatttctccacagcctcgccagcatctgttatttccttactttttaatgatcgccattctaactggcatgagatggtatctcattgtggttttgatttgcatttctctaatgatcagtgataatgagctttttttcatatgtttgttggctgcataaatgtcttcattcttttttattatttattatttttaatttttttaaaaaataatttccttggctgggcttggtatcactgtccccaccttccatggtaggctgctggggtggcctggggcgtaaaggccttaggtacctgggccggaatctgggcggggggacccactcatctccctgctgttggtgcccctccaatggggctgtctgtttggttctaccccatcagtgccctctataggctgctgctggttggggggccgggggcctcgcacaaaccgccgtaggtagaagggtggggggcgccatcgtctgggccgctgcccagagtcttcggcccgctccccttcgccgccaggttctgtcccccgagaggggatctctgccaccatgggtggtggggcaactgagggaggccggggatgaatcagcggaacctacgtcggttgggggcataacggtgcccttcatgggcacccccgccgccctgggcccagttacattagtggcttctgcgcccttctctccttccacgacatcaaattccacagtctccccatctctaacgctgcgcagaaacttcctggggttgtttcttttaacagctgtccagtgaacgaagacatcttccttggcgtcattcctgttggtgaatccgtaaccactccggacgttgaaccgtttggcagtgcccaggcaggactcgggttgccagcaccggcttgtccgcctgactccgggcgggggttcccgaggccgccgtcgccgggttgccaggggtgcgggggcccggcgccgagggggtcccagcagcggggtccaaggcggctgcgtccccgccgcagccgcccgccccgccgcctgctttctgcggctcccctgcgggcaccggtaccaccaccgctaccacccctgccaccgtcgcgggcaccgtcgccgcggggaccgctgtcgccaccgctgccgcctccacctcgctcatcccgccgggtccagtaccggcccccgccgccaccgcctcctccgccgccgccgccaccgccccggcccctccccccggctggcgaacccgctgcgctgcgcgatcctcgcgccccgagcctcgcccggacgcccaatgtcttcattcttaattgctgcacttcttttttttttttttttttttttttttttgagatggagtctcgctctgtcgcccaggctggagtgaaatggctgatctcggcacactgcaacctccacctctcggagtcaagtgattctcctgcctcagcctcccaagtagctgggattacaggcgtgtgccacaacgcccggctaatttttgtatttttagtaggacgaggtttcaccatgttggtcaggctggtctcaaactcctgacctcaagtgatcctcccgtcttggcctcccgaagtgctgagattacaggcatgagccatcatgcccggcctgcacttcttaatcgctccctttccccagtccctcaagcccatgcttgttcacgtatcacagcccctcaccaaccagtggctatgcctcttggaacacggggccctctcagcccatgcaccagaagagggaactaccattgccttagctgagaagcgacccatttaagtccactcacatttcagttgccagaactcgatctgtgtccccatccagctgtgagacggccagtctgccttggcctggatggagagatgctgtcaggaacctgcgctgtcttgcatttcactgaggactcctatgagactctgcaaggagaaaaaccatatgatcgtctcaatcaacgtcaacaaaaggatttgactaaaggtaacatcccttcatgatgaaaatcaccaacaaattaggtgtgaaaaggaacatatctcaacacaataaaggacatatatgacaaacccacagctaatatcatattgaataaaaaaaagctgaaagcttttcctctaaaatctggaataagacaaggatgcccactttcaccacttgtattcaacatagtactggaagtccctgccacagcaattaggtaagagaaagaaatagagagcatccaaattggaaagaaagaagtcaaattttctctgtctgctgatgacgtgatcttctaaagtcttcaccaaaaaaaccgttagaattcataagttcattaaagttgcatggtacaaaatcaacatacagaaattagtactgtttccatacaccaatagcaaactatctgaaaaagaaatcgagaaagcaatccctgggctgggtgtggtggctcacgcttataatcccagcactttgggaggctgaggcaggaggattgcctgaggtcaggagtttaagatcagcctggccacatggtgaaacccgttttgtatctactaaaaatacaaaaactagctaggcatggtggtgcacacctgtaatcccagctacttggggggctgaggcaggagacttgcttgaatgcgggaggcagaggttgcagcgaggcgagatagtgcctctcccctccagcctgggcaatagagtgagactgtgtctcaaaaacaacaactacaacaacaaaccaagaatacattgaatcaaagtggtgaaagatttctacaatgaaaatataaaatatcaatgaaacgaactgaagaggacacaaataaatggaaaggtattttatgttcatgggttagaagaattaatattgttaaaatgttcatactgcacaaagtgatctagaatttcaatgcaatcccgatcaaaaaaattaacattcttcacaaaaatagaaaaaacaatcctaaaatatgtaccaaaccataaaaaaacccaaataaccaaagcaatcttaagcaaaaagaacagagctggaggcattaaactacctaacttcaagatacactacaaagctatagtaaccaaaacaacatgatattagcataaaaacaagacatatagactaatgtgagagaatggagaacccagaaataaatgcaagcagttatagccaactgattttttttgacaaaggtgtcaagaacacacactgggagacaggacagcctctttagtaaatggtgctgagaaaactagatattgacattcagaagaataaaactctaccactttctttcaccatattaaaaaaaatcaactcaaaatggattgaagagttaaatgtaagacctgaaactgtaaaactactagaagaaaacataggggaaatgttttaggacataggcctgggcaaggattttttgttgcctatgctcaaaagcataggcaacaaaagcaaaaatagacaaatggtattatagcaaactaaaaagcatttgtacaacaaaggaaacaatcaacagagtgaagagacaatctatagaataggagaaaatatttgcaaactatgcatctgacaagcggctgatatccagaatatataaagaactcaactcactagcaaaaaactaaataattgaattttaaaatgggcaaaagatctgaacagatatttatctaaagaatacataaacattgccaacaggagtgtaaaaaaatgctcaacatcactaatcatgagggaaatgcaaataaaaaccataatgagatattacctcaccccaagtagaatggttattaccaaaaagacaaaaaacaaaagaaatactggcaaagatgtgaagaaatgggaacccttatgtaatagtctgttctcacgtggctaataaagacatacctgagactgagtaatttatgaaggaaagaggtttaattgactcacagttccacatggctgcaggggccccacaatcacagtgaaaggtaaaagggaagcaagacatgtcttacatggcagcaggcatgaaggcttgtgcaggggaactgcccttttatacaatcatcagatctcacgagacttattcactgttatgagaatagcatgggaaaaacccactctcaagattcaattacctcccactgggcccctcccatgaaacatgggcattattacaattcaatatgagacttggttggggacacagagccaaaccatatcaccttatatactgctggtgaggaatgtaaactagcacagctgttatggaaaacagtatggaggttcctcaaaaaattaaaaatagagctaccgtatgatccagcaatctcactgctgggtatactgtatatatctaaaggaaatgaagccagtatgtcaaagagacacctgcacctccatgtttattgcaacaccattcataatagtgaagatatggaagcaaccgaagtgtccattagtgaatgaatggataaagaaaatgaggtacgcatacacaatggaattgtattcagccataaaaagaatcgagtcttgttattttctgcaagatggatgaacctgtaggacattatgttaagtgaaataagccaagctcagaggtataaataccacatgatctagctcacttgtggaatctgaaaaagctgatctcatagaactgcagagtagaatagaagttaccagagggtggagaagcttaggggaaggaggggatgagaagagattggtcaatgggtacaaaattacaggtagatagaagaaataagttatagtattctattgcacagtagggtgactatagttaacaatacaaggggacttcaaaaagttaggaaaaaatggaattaaaagataaaaatttaaagcataaatttcatttctcaacataagctccatcaacttcaagacatttttctaagagatgtgatatggtttggatctgtgtccccacccaaatttcatgttcaactgtaatccctagtgttggaggtgggtggggcctggtgggaggtgattgggttacgggggcacatttctcatgaatgttttagcactaccccttgatgctgtcctcatgatagtgagttcttgtgacacctggttgtttaaaagtgtgtagcacctcctgcccacccccaccatccctcctgctcttgccatgtaagacacctactctcactttgccttctgccatgagtaaaacttcccaaggccttcccagaagcagatgccgccatggttcctgtacagcctgccaattaaacctcttttctaataaatagcagtttgacaatggactaatacaggatgataccagccatttagtccgttcctgaagaactgagggtcctgggaatttaactatgtcaatgtagtcttttttacattattaactaaaggaaaatgggtgccatttaaagattttttaagattaaggccgggtgcagtggctcatgcctgtaatcccagcactttgggaggccaaggtgggcagatcaggagttggggactagcctggccaacatggcaaaagctcgtctctaccaaaaatacaaaaattagctgggtgtggtggtgcacacctgtaatcccagctacttgggaggttgaggcacgagaatcgcttgaacccaggaggcagaggttgcagtgagctgagatcacgccactgcactccaacctgagtgacagagcaagactcttgtctcaaaaaataaataaatgaaataaaaaatacatttttttttaagattaagaaacaaaaagaaggcagaagaagccacatcaggactgtaaggtgcatacctaatgatttctcattgaaactctcataaaagcccttgtttgacaagaggaatgagcaggaacattcttgtggtgaaggattctggtgaagattgcctgggagattttctcttaaagctttggctaactttttgaaaacactctcataataagcagatgttatcattctttagttctccagaaagtcaacaaaccaaatgccttgagcatccccaaacatgttgctatgacctttgcccttgactagtctgttttgctttgacaggactcctttgtagccattgctttgattgtgcctggtgttcaggatcatgctagtaaggccatgcttcgttttctgttataattctttaaagaactgcttcaggatatggattctactgtttgaaatttccattgaaagttctgctcttctctgaagttaacttgggtaaaactgcccttatctcgtttataaaattaatcagggctgggcacagtggcttatgcccataatcccagcactttgggagaatcgcttgagcccaggatttgagaccagcctgggcagcatggtgagaccctgtctctataaaaagtagaaacaattagccaggtatagtggtgcatgcctgtggtcccagctactcaggaggctgaggcaggagaattgcttgagctcaggaggtcgaggctgcagtgaactgttgataccgttgcactccagcttgggcaacagaatgagatgctgtctcccaaaataaaagaaaatgaaaattagggaagaagggagagggagaaataaaaataaaccaagcttgcagcacgttcagcattaatcatgaagtcagcctgttctccgacctgcttcctcacagttgtttgtttggtgcctattgtcctggaatgatgtagaccctgttagaagattatagttctccttaactgctctgtagataacaacttaacgagtataaaatgttaagttttccctttgagatatactttcaggtcctgcatactgatgaattattgacttggctggtctgaaggaccccactgatgccagctggtctgaaggaccccataagaagctaactcaccaaagcatgagtttccacatcttgatgatatcatcccccttagcccaaccaatcaacacccctaattctccagcccctcatcctccataatccccttaaaaacccaatcctagaactccttaggcagaggaatttgagggtctcctcccatttccttgctcagcactctgcaatcaatcaatcctttctctgctgcaacccctactgtcccagtgtaatgggtctgttactgcacagggggccatgggcacaatgggcttggcacctattgagtggaacatttgttcagttataattttacagtcagaattgtatatgctgaaccaactgagatatctatggtcttgcctattttttcttctgtgaattgtcagtcctcttcagttagggcacaaagaagcttaattttttcctcgaaaattgatgtggatgatctgctgctgttggccaaacttctgcatgttcccatccctttgagttatccttgtgtaaactgctgatctcactggggcattgttctaataagctttttgaaaagcatcaattatttcatcatttgtccatccaagcttcaccataaatttcgtgtttgttcttgcttcaattttagcagaattcatgttgctctgacggggctctgatacggtttcgatctgggtccccacccaaatctcatgttgaattgtaatgttcagtgttggaggtggggcctggtgggaggtgattggatcatggagatgtttctccagaatggtttagtaccatccccttggtgctgttctcataatagcgagtacatgagttctcacaagatctgattgtttaagtgtgtagcacttacccccttcctctctcttgctactgcttttgccatgtgacatgcaagtttccactttaccttctgccataattgtaagcttccagaggcctcccagaagcagactccagtactgtgcttcttgtacagcctgcagaaccgggagccaattaaatctctttacttaataaattacccagtctcaggtattttttttatagcaatgtgagaacagcctaatacaggctgtttttaagtccatgtcttacccttcttagttcctcaaactagatcctgctcaggcccctattataagttagtatgtgtttatttctgtgcaaaaatttttgcaatccatgcgtagtttttttcataatatgcactttccatgaacttcttgaagacccctcacactgtatcatgtatttcaaaataattagaagagaggattttgaaggttctcatcacaaggaaatgataaatgtttgaggtgacggatatgcttaataccatgattttatcattacagaatgcatacatgtattaaaacatgacactgtacttcataaataggtacaattattgtgtgtcaattaaaaataaaatataacaacaacaaaatgaactactagattctaggttggtcctcattcattattcctcataatcttaatcttttcagattttctcttaatcttaattccttttaatcgttttcagattttctttttctttttttttttttttttttttttttttgagatggagtctcgctgtgatgcccaggctgaagcgcagtggcgcaatctcagctcactgcaaacttccacctcccaggttcacaccattctcctgcctcagtctcccaagtagctgggactacaggtgcttgccaccaggcccagctaatttttttgtatttttttagtagagacagggtttcaccatgtaagccaggatggtctcaatctcctgaactcgtgatccgccctcctcagcctcccaaagtgctgggattacaggcatgagccactgcacccggcttcttttttttttttttcaacttttattttagtttcagaggtatatgtgcaggttgattctagggataaattgcatgttgtggggatttggcgtacatattacttcatcacccaggtaataggcatagtacctgataggtagtttttttggtcctcacccttctctcattcctcaccctccaatcggcccccagtgtctattgttcacttctttgtgtccatgtatactcaatgtttagcttccacttacaagtgagaatacatgatgtttggtgttttgttcctgcattaatgtgcctaggataattgcctccagctccatccatgttcctgcaaagaacagatcttgttctttttaatggctgtgtagtattccatggtgtatacgtaccacattttctttattcagtctacaattgatgggcatttaggttgatttcttgtctttgctattgtgaatagtgctgcaatgaacacatgtttgcatgtgtctttatagtagagtgatttatattcctttgagtataaacccaataatgggatggctgggtcaaatggtagttctgttttaagttctttgagaaatcaccgaactgcttttctactacagtggttgaactaatttgcattctcattagcagtgtataagttttctcttttctctacagccttgccagcatctgttattttttgattttttagtaatagccattctgactggtttgagatggtcatttcattgtggttttgattagcatgtctctaatgattagtgatgttgaatatttttttgtatgcttgttgattacatatatgtcttcttttgaaaagcgtctgttcatgtcctttgccaactttttaatcgggttgcttgttttttgcttgttagttcttttaagttccttatagtgtctggatattagacctttgtcagatgcatagtttgtaaatattttctcccattctgtgggttgtctatttactcggttttacagtttcttttgctgtgcagaagctctttagttgaattaggtcctatttgtccatttcaatttttgttgcaattgcttttggcatttttgtcataaaatctttgtcagggcctatctctacagtggtatttcctaggttttcttcaaggctttttatagttttaggttttacatttacatttttaattttgagttgatttttgtatatggtgtaaaaaaggggtccagtttcaatcttctgcatatggataaccacttatcccagcaccatttgtggaacaaagagtcctttccccattgcttttttgttgttgctgattttgtccaagatcagatggctgtagctctaaggctttatttctgggctctctattgtgttccatcagtctatgtgtctattttgtacatgctgtggtggttactgtagacttgtagtatagtttgaagtagggtaatgtgatgtttccagctttgttctttttgcttaggattgtgttgtctatttgggctctttctttcgttccatataagttttagaatagttttgactaagtctgtgaagaatgtcattggtagtttgataggaatagcattaaatctgtaaattattttgggcaatattgccattttaacaatattgattcttcctatccatggacatggaatgttttttcatttgtttgtgtcatctttgatttctttcagtaggttttgtaattctggttgtagagatctttcacctacctggttagctgtattcctaggtatttcattccttttgtggctattgtgaatgggattgtgttcttgatttggcactcaacttggatgatattgatgtacagaaatgctgccaatttttgtacattggttttgtatctggaaacttggctaaagttgtttatcaggtctaggagcttttgggcagaggctggggttttctaggtataaaatcatattgtctgccaacagaaagtttgacttcctccatggatgctttttatttctttctctttcctgactgctctggctaggacttcttgtactatgttgaaaaggagtggtaagagtgggcatctttgccttgttctggttctcaaagggaatgcttccagcttttgcccattcagtatgatgttggctgtgggtttgtcgaaaatggctcttattattttgaaacatgttccttcaatgcctactttgttgagggtgtttaacaggaagggatgctgaattttattaaaagccttttctgcatttattgagattaccgtgtggtttttgcctttagttcagtttatgtgatgaatacatctattgatttgtgtgtgttgacccaactttgtatgccagggaaagcctacttgattgttatggattggctttttgatgggctttggatttggtttgctagtattttgttgatgatttttgcatctatgttcaaggatattgtcctgaagtcttttttttgttgttgttgggtctttgccaggtttggtactggaatgatgctggcctcacagaatgagttaggaaggagtccctcttcctcaattttttggaatagtttcagtaggaatggtaccagctcttctttgtatgtctggtagaattaggctgtgaatccatctagtcctgggcttttctggttggcaggatatttattactcattcaatttcagaactcattgttggtctgttcgaagtttgaatttcttcctggttcagtcttgggaagttgcatgttttcaggaatttattcatttcttctaggttttctagtttgtgtgcatagggatgttcataatagtctctgatgttttttaatatctctgtgaggtcagtgataatgtccactttgtcatttctaattgtgttgatttggatcttctctctttttttcatgagtttagctagtagcctgtctatcttacgtattttttcaaagaacaaacttatggcttgttgatcttttgtatggtttttcatgtttcaatttcactcagttagctctttttcagattttatacctcttcatatctgcattgtattctgtgaaattctcttacatttatctcccagttcaccaaatcttcctacttgtctaaaccatcaattctgctatttaaactattaagtttttaaatgacttttggggttcattttcagtctgagaactacaatttggctcatgttcaggtcaggctgttattattttttaaatagaagcttattttttcaacatgatttttatcccttctttatgtgtttaatcatttaaaatgtatttggtatataatttgatttgggctattctgtcatcacaagtgtctgggggatctaattatgctgttgattgtatctgctgacttcccttattgtgaattgtttctttgtgtagtttgtgattttaaaaaaatcattggaagttttcttcagctggtgttgccattgttttcccctgtgggagtctcatgtggcctggcattgaagatgtctttagaaaaggagttctctttgctttagttttggagccaagggatcactcttctgaaattcattatatatatataaatatattgtatataatataattatattttataaatatatcatatatatgtaattatattttataaaaatatctatataattgattatattttatttataattatattttatatatatttggtttgggatttccttactttgtgggaagtataaattaaaactttacatctgattgggatggaatgagtttggagtttccatttccagtgggatatttttcccctttgctttttctgtgcagtcaagcttggttctggagattttgcttgagtttttctagttcctcttataagaagggggcagtcttccagggtctcaactctactcagagttcttagttcacctctgcctcatgcaggtcaaagtcatattccgtttctcctaatcagcatcaaaacccagctgtgagcccttaggacatgtgttcacatttgatgtttccctgggctcctggtgtgttggctcatggattacccgctggctgtagtttctattttatttctgttcaagaagtgtcttttttccttccttcaagttttcctatgaattaaaaggacattgacatatatttggaggcagagattgctagcatagcagaaaaggagatttcctaattaactttttgttattaatttctagattaatttcacagtggtcagagggttaatttcacagttgtcaagagtgattcaaatcccttgaaatctgttgagaattgttttatgacccagcatatgactgattttattaaatgttatgtgtgcacttaaaaagaatgcatattctgtcattgtaggatacagtgttaattaggtcaggctaattgtgctattactgattttctgtttgcatttctatcatatattgagaggagtgtgtttgtgcctctgaatattattgtgaatttgtctctttttcttttttagttctgtctgtttttgctttatgagtggattgatccttttatcattgcaaagcaactgctttatgtctagcaatgcttcttaccttccagtctacttttctgatattagaataatgataccagctttcttttgtttagtgtttatctggcatagcttttttcaactttgactttcatccttttttgcttttgaggtgggtctcctgtaaccagtatatacttgagttaataaaatcagatctgactattttggtcttacttgaagtatttagtcaatttatatttgacataattattaatatattagaatttatagttaccattttactttttgtgttgtacccattttatgttgcttttccatgtcttgggttttttttttactttcttttggatgaatagttttattattctattttccctatataaacttggtacttaagtattttagtaactactgtaaatgttgcaacatgtatccttgatttaatattgtctaatataatttaggacttttatttcttttacacaatgttgagaccttagaatactttattgctcccattcttttcctttactcttgtcaatatatattttaaatcccactagacatcatttttgatgtttcgtatggttaatatttatttatatttacatatatactctttctgtagctttcaatttcttcatgcatttcagtttttaaatctgggttcttttcctttgtctgaagaatttctattggcatttattttacactgggtttttctgttttggtgtctttaaataatattttcccttcatttttgaaagatgttttggaaattgcctttgcaaaaattagaacagtgagaaaattatgatagtgaaagatctaatcaactccatcttgcttttaacctccaaactgcccttggccattcctgagcatgggccagactaactttgggagactaaaacataatagctcttcccaaaactaagccacctttgcaaaactaatgaaaggcaaccaggttaggaagattagagggacctgaattctgctaagatgcaggcatagttaaatgattaccagccattattctggaagtcacaagatttgcaacttcttcaatgactcctgtaaagagcatcactattgtagaccctcagattgcccttttaagatgtcttttcagacttttgcatttctgatgactagatgactccaactggatcagcaactcctctctggctcccacccagaagtgaactcagcacatgaggaccacttaccacaccactatgattgcatcactaactcatcagcagcactcattccctatccccctgctcaccaaactatctttacaaaaccctagcctccaatttttggagaggctaatttgaatagtagtaaaactacagtccgtgtttagctggctctacatatattgaactctttctctattgcaattccccatcttgatacattggctgtatctgtgtgggcagtgggcaagattaacctattgagctgttacactttcattgaatatagaatttcaggttagttttactaccttccagctctttaaacatatcatttctgaaaagccaatcttcagtcttactgttgctccattgaaggtaatctgtcgttcctctcctgctgtgttcacaatttccttttttatctttgtttttcagctatactaaagtaaaatttattttatatatactttgcttagagtatgtaaagatttttaatttgtggactaatgtctttcctcagttttggaaaattgtcaggtattagttcttcaaatatttccttatcccattatctctttcctctctatctgaggctgcaattacactaatgttagacctttacactgctgtctatgtcctttatgttctcttttgtattttctatcttcttttcttctgtgtttcaatcttaattttttagattgctgtatttcctaattcactaatcttttttgctgtttctaatctattcataatagattattaataataacagattacattaataataaatccacctactgaattctttagtttttgcaatttttagttcttaaaattttcatttagttcctttcatagttttcaattgtctgatgaaattctattttcatccatctatctttttctatattgtctttaccatattaataacagttcacttaagcccttatcagctaagtccaatatctgaatcacctgtgggttgatttcccatatctaaatattccccctgatatttgaccatttagtcttgtctcttggtatgcctacattttttattgaatgctggacattgttcatcctttcctctgataggtagatatactgtattagcctgttcttgcgctgctaataaagacatacccaagactgggtaatttataaaggaaagaggtttaattgactcacaattccacatggctggggaggcctcacgatcgtggcagaaggcaaatgaggagaaaagtcacatcttacatggaggcagtcaaaaaaagagcttgtgcaggagtcccatttataaaaccatcagatctcatgagacttattcactatcacaagaacagcatgggaaagacccatccccatgattcagttacctcccatcaggtccctcccacgatatgtgggaattgtgggagctacaattcaagaggagatttgagtggagacacagccaaaccatatcatatactatgggttagtcagcttaattcaaccagggactgagttaactcagggctcagtagcagtattgaatctctacctactcctggatcatgtttattcttagagcatggttttagggttttccattgagtggctggggtgtttatcatggcccttgccccataagttctaaattctagtcctagtgtcctcagcacagtaagactattgaaaacttcacttagcttttcagaggctctgtatttgcctacctagtttccattttgtgtagctccagaaatttcccaatatcttctgttaaaaactgactgagagtttggctcagttatttgctccatcttgtgggattctggatcccccacccctaagaatttaattttccctttccagacctgtaagcttcccacatctttgctagttttcttgccctttctagtagcccaggcctggccttctgcccagcattcccaagttcatgagggaagagcagcttcagaatatggctcatctttccatgggttttccctttcaggaatcttggccccttaggcctggttgcctccacagctctccaatgccttcagacaaatgttttttggtatgccatcagcgttcttgttctctttaagaagattggtcctctgcaagctctctaagaaacagaagcccctttctattgtgtttgaatcattatatattttggggtctctttgttaccgcaagccaccctaccctaaataatacatattctatcagcattttaatatatttttaggagaaagtggcctgcaataactatgcttctaggatgttgaaccaaaggtcttacattgattaaaataaaaaatatgaatgaagtaactctaaagccagatattgtcattaaccacaagatttaggaacacagtcaaatactgtgtgaagaagatttttttaaaaatgttgagtctaattataaagataatataaaataatatctattataatagtcataattatctttatataaacataaagataaaaaataaagataattataaaaatttttgagttaatataaaaataaaaaaaattcaaagttcagtactcagaggcaactgctatttacatattgtcatatttttccagtcttatttctatatattttgctttagttgagatcatattatatggaaaatctacatgctgctcaaagaaaaacacacataaaacaaaacttaatgtaggatatgctgcgtgcccttggccccttcaattagtctcactgtacctcagctttctcatctgtaaaacagatatttattacagggctgtggtgaaagtctaatcagctatacatgaaattgttaacatgatttcagacacataattgcccaacgaattgtgcctattagaattattaaatgtcttagtccatttgtgttgctacaaaggaatacctgaagctggataattttttgttttttaaaaggagccttatttggtgcagttctgcaggctgtacaagaagcatggcaccagcacctgcttctggtgagggctttaggctgcttccactcatggcagaagaggaagggacactggcgtgtgcagagatcgcatagaaggagaggaagagagcaagaaagaggggagggaagtgtcaatttctttttaacagccagctcttgtgggaactgatagacggagatctcactcattaccataagaactgcaccaagcacttcatgagggattggcacccatgacccagacacctcttgctaggccacatcttcaacatcagggatcatatttcaacatgagagttggaggggtcaaatatccaaaccatagcattaggactactgatatcagtagtatctccattttagaatgagacaactgaatacgagaggagttaactaacttgcccagagtcaccctccttgtaagtggcagactgcaggtccacactctggtctgcctgacaccaggctccttccactgtcaccttctgctttgaactgcacatagaaccatgctaggtcctgagacatcatagaaactgagcgctccttctggcacctgtgtggagctagagtgaatccaccattaactgccacaataatgctgtgtatcaaccatacaacctcaataacaccctattattcatgtcacactataaatactgacacacaactctgtggatcagtgacttaggcagggctctgctaggcagttcttctggtcttggctgggctcacccacgtgtctgctggtcagctgcagcttggctgttctaggatgagcacaccagggacaactgggaaacttggctctgctccacatgactcaccacttggactgtcttggcaaaggagaaggagcaagagtgagggaaaagtgcaagtgtcccccacccaacccctcgctgagtcatgtttgctaacagcccattggccaaagcaagtcacgtggggtcaaggggcagaatgccacgcccacagtgggaggacactgaaagtctcatggtacagaaaaggtgaagaaaaaagcatcgatccgttaggcccattagagggaggagaagacacataaaccatctagttagctgcaagacaggcaggtcagagttcaccctgtgccatcccagcaggatggcatgtaaaaaaattaattgatgggctccttccagctccgcaaaaccctataaatgggtcgctagttaggtgaccacattccctggggctaagtcacaaataaaaacgtaaatgtaaataaaacaaaatgtaaaagtggggtgggggatgaggtggcagctcctggatcttaacttcaagaaccctggtctaggaataagaaaagattcagaaaaatatgccttgtttcttcttccttcatcaacagtaacttatcttcctgattaaggcagacccagatggcaaggggcagccctcctcccaggagtggagggaggatactcagtagcagagctccagcgggaaacgtgggctcgtgaactcagcaggtcagcttcacccagcgcccaaaccaaaaggaaaccaacaaaatctgtgaaagaggacagggcgcggtgcactcaaaagaggcactgttcagagcctaccacaaagccagaaagaagggaccaggacctcactgtcctgcactctctgcagcgaccttgcacctgaaggagctggatggggctggtacccacagctacattggagctgctcccaaatcaggaattcataagcaattctgggcttacaagaatcaaaagcggattgattgtactgtatgctgaatccagatacagccacacacacagtaaagaatacaaaatctctggagtctccaggaaagggaagaaactgaaggtgattattcccccaggagtctatgccctgtgggggttaatacagcaggggtgactgccttaaccacagaagctgggttggcctttgggtgaccaacttgccctggtctgcccagaacttttgcgatttcagctttgaaagttttgcattccagaaagcccactcagtcccactcaccctggccggcctggtgggtgaggacacaggctgagcaggaactaggggagcccatggcctcccgcctgcggagtctgcacgcgcgcaggcctccccgcagacacccatggctgggttcgcccgcaaagtctgctgcataagcccgagccctgcaaatctcagggagacagcgctcccgtcgggctgtccgccagctatttcccatccccacacctggaggaaaatctgcttggccctgagtgtattcaagggaacaagaacttcagggaaggcgtccaccaggtgcagagcagccacccgcggggcgcaacgaagagcggagagtccccatcacccgccccggcctggcggccgagggtccctatgatcattgctatggctttggtgcgtccagacgtgggatcggagcgaacgacaccccatccgctccccggagctactgccccttccaggactgggaatcagagggcgctcattatagcacttaaaagtagcgcacaaagacctgcccacccattccagcagagacagcgaggaacagcccgcaacgtgcccgcccgggagagaagcggcctcggctctggcagcggacgcccacccgcccgggagcctcctccaggggcgctcccagcacggcgagcagcacggccaggcggggcgttcagagcggcgggaaatcgttccgccctctccgtccctccgtccctccatccccgccctgccgctcaccttcatcccctcttcgctcctccacctctctcctctccctgctcctcccttctccccatcgctgccgcatccctccctcccacctcctcccctcccctgcatcctctcccctcccaccccgtccctccatcccctcccctctccacccctccatccctgcccctccctttcacctcctcccctcccctacatcctctcccctcccatcccacccctccatccccacccctctccacccctccatccccgcccctcccttccatctcctccccgcccctccccacctctccgtcccgtcccctcccccgctcgttctccgtcccgccccgcccctccatcccctcccttctccacccctccatccccgcctctcccatctcttcccctccctactcctcccctccctttccctcccctcccctcctctcccctcccctcctcgttctctgccccgccccgccgccacatttctgtgggtttccacagctccccttctgcatcaccgttgacaacttgagttaagtgggatcgactcaggagtcaggatacaagtacgttcgctcgtatcccttttgaatggctccactgctgaaaaaagaagtttcaaagtcatttctcattcataaatcaaatgcataatcaataattaatatactgtattcaattttaaaaaatatgtacttttgaggcgagctggtttttcaggcttttcctgtcttttcaaataaaactctcagaccaggaatggggaagggggaggaggggaagaaaagaagttaaaccttgtgagtgtgagaatgtatattgggtgtgttcgtgtgtgggtatttgtgattgtgtttgtatgtgggtgtgttgggggtgtttgtgtgtgtgattgtgtttgggtgtttgtggggtgtttgtatgtgtgggtgtgtgtggagtgttttttgtgtgtgtgtgtttatgtgttgtgtgcgtttatgtggttgtggggtgtatgtttttgattgtgtgtgggggagtgtttgtgtgtgtgtgcgtgtgtggtgtttgtgattgcatgtgagtgtgaagtgtgtatatgtttgcgattgtgtttgtgtgtcagtgtggaagtgtttgtgtgtgttcttgtaattgtgtgtttgtgtgtggggggtgtgcatgtgtatggggaatatttgtgtgtgtgggcatgtgttggtgtttgtgtgtgttgggggtgggtgtttatgtgtgattgtgtgaaattgtttttgtgtgtggagggtgtgtgtgtgtctgtgtgtggggggttgtgtgtgtgtagggtgtttgtgtgtgtgactgtgtgtgggggtcatgtttgtgagtgactgtgtgtgaggtatttgtgattgtgtttgtgtgtgagtgtgggatgtgtatgtttgcaattgtgtgtgtgactgtgggggtgtttgtgtgtgtgtgattgtgtgtgaaggtgtttgtgattgtgtgtttgtgtggcgtttgtatgtatgtcagtgtgtgggggggatgtttgtgtgtatgtgtttgtgtgtgggtgtggggtgtgtgtatgtgattgtgtgtgtgaatgtgtggatgtttatgtgtggggtgtgtgtgtgactgtgtgtgggtgtggggtgtttttgtgtgtgattgcgtgtgtgtgtttgtgtgtgggagtgtgtatgtttgtacgtgtttgtgtatgggcgtggtggtatcttataggctgagaacccagggctgggtccactggtgcgggagagatgctcctcttcatcagcgaccatctgggttcctgggcctcccagaaaagcagcaggtggctgcagggggcggggcaacgtagggcagggggcagggcaaggtagggcagggggcgggcaaggtggggcagggagcggagcaaggtgggggcagtgcagacgctgagtcttctggggctaggcctgtctagcgctgggaatacagcccaagcaaggagctggagtgtctgtcctccacaagtgtcctcacacaactgtcctcaagtatccttgggctcacagtttaagccgggtgagtagcgatcattcagggctgcggagtgcggtgggaagcagagggcggaaccgcgcagtggagctggccaggggactgctaggatagaggctagggcactgaaatgagctgagatgtcgtgggtgcaaagggaggtgcaagtggccagacggagagagtggagagaggaaaggagagagcagcgggccagcttcatagcacttagctcccgcctctaaagcaacctctctccagcactgtggactcagacccagcccttttgcctctctgcttgggcgtctagtgaactcctcccgctcccctttatcgctcctcttgggtgtccagtgaatgcctcctgctctccgtttgcccctctgttttagtgtccagtgaacgcctcccactcgtgtcttcaccagcattgcacacctgtccgtcccatctctcaggagccaaggaacccagagccatcctgggctgctacccccactcacatcccacccacctgggatcctctgaacatctctgaactcctcaccactgccacccaaatccacttcaccctcctcctccctgcaggtgactcggggctctctgcgcccccctcttaacacccatcgtatgccggcagctggaaggagccttttgaatatgagctgggaactgttgctcagctcaaaccctgccataactccccattggctcagatgaaagcccacgtccttcccatgaccccaaggacctaccctttccctcatttcctccttcccagccccttggatcccctgggtttctcaaatacccaggcctgcccacaccttggagcctccccgctggctgatcccccacctggaaggctcacctgtcaccttgtcaacgaggccatctggtcaccctcccctggcattccaggtgccttcaatctgctcttttttaaatatatatatatatagcaatttcatcttctagaaaaccatcatttacttaccgtttgtttatcgctccccccgcccccctacccctagacagctccatggaggcgaggagttttgactctttgctgtttggcatcttccatcacaattgcctggcacatagtttatgtccaatagatatttgctgatggttggctgaatgtgaagatgtggcgcctggctggccacggaaggaactggcgttttgttctgttaaccgggataggcaataagagagtttaagcacaggtgcgatgtcagctgagtcgtgctcaggaagaaggccctgcttgccctggggaagatgggctgggcctgggggaggagacacacatgcaggcaggggtcatcgtcccttttgtccctgagagatcctggagcagggctgtcctgcaatggaagtgtcctgcattggcactgcacctgcagcggccacgggcctacgtgtggcccttgagcacttggaatctggctaggtgtggctgagaagttcggctttaaaattcactttattttaattaaattagtgcaatttacatagcgacatgtggctagtggctccgtgtggaccatgaagttctggaatcatccggattaaagacggtggtgcatggacaaggctggcagcaacagcaaaggtgaaagaggtcacctttgggctttatttgggaggtagaccccacaggttgtactgaaggttggattaggtgtgagggaaagaggactcaaaaagatgccctggtttggacctgagtcatggagacagggaaggctcagagggaagcggtgtggatggaaatggcatttctcttttagctgggtgagtctggagcacaggagggatctggtctgtggggagaaacaggaggcaactgcaggtggatggcactttaatccttaggagtggatgataccaaggaaggggaaagtgtacctggagctgcaaagagactaaggcatcaccaagccattcccagaagtgattagatgacatttgttgttatttggtgaatgggggctggactctcatattaagtcctgttatagaaaaataatacctgttttgtcacctgctttgttctgcaaaatttgttcttactacagatgctagcacatggtgggtgtgagcccagggtcctggccaggtgaaagcaaaattaaactttctactgcaaatactcaaataacagcaacgaactggaagccagtctggctggaggctgggattttatgggtgattaagtttgggtcattaaaagatgcaaatcagctggatttatgatcctctatcactgtcctatgggatcagagagtctgttttatgataactgccaaaaggctttgaaaaatactagactgatttaatgaaattagcagaagggaaatagactgttttcttagcaggattgaaactccccgttccgattgttgagtgtttcattgaagccctgagtcaaccatttgagtatactggggtagaggtgacctggattccagcactttaacctccagcccctaaacactctcctctctgccccacttctgacaaaaatatgctgcacacaaattttacacaatttatgccatggtttccttgacaggcagaacatacatgcaatcttctcggtttaaatacgtggttagaatgaatgatgactgtatcagcagcactctataactgattttgtgacgtgtcattcccagtttattagcgtgggcttcacgggggtatctgagaactcagaagtccacctttgcacgatgaggctgacgcctgtgtttggttccccgacacagccagcagggggcaggctggacctgggaatgcaccggagcggctccccggagacctgcagtttgccgagatgatcccaaggacgcctgagtcctgagttccttcaaagccccgttccccactggcccctaccgggacccagttttcttcccatcagtgagaaaagtctctggaattctcggccgggtggtccagttctcccttccccgccaaaagggccctggcctgttccagtagcttgtcctggccaagttgtcccttgagggctggggctctggctggggggtctggcttcttccctcacgctgcccttcagggccagctcacttggtcaccgcagcgcctgtgtttcaaaccagctccaggcccgctgagcccacctggcagccctgggcccaccctccactctgggtcctggtcctacctagatagcctggcctcaactcttggctctgccatttagtagcaacgtgaccttggttctccacttggtagttttgtcatctgtaaaatgggactgaatgagttaataattaagaagtgcttagacgaaggcctagtacgtaatctgtgcgagatggatatagatatataaaattttctttaactgtggaatactcttattctacttgaaatttgcagtggccctcagaatactcttttattctgcttgaaatttgcagtggccctcaatcggcagaggtgaggaggagccgctggagctggggttgacccacttaccaatactgaaaccaggttgtcagcccagagacagagccggcaacgccggcccctcctagatccactggcttctcctcccagcatatttgggccgcgttttctttaaaggagattttcagctgtgaagctctcaccctaaatgtgctgtggaaggaaagaggattgagttttcctgttgtttctttcaaatgcttagaggatgagtttcagtctcagactggaaaagcaaggaaaccctgaaactgtatacagatccagaccattccagaagcccctggagatatgcaaggcggctgagagctccagggagccacagagcccccctcactgctattcctgatggccccgatgcaagcagtgggcgctcagtggggggatggggtggggggacatggggcgggtaggcagacacgcgatcctccacttggttctcagcacaagaaactggactctgagccctacaccacacaaggctcttttgtcagacttcatgtctgaggccagggtttgctcccccaggttctgtgcaggcccccacctccccaccccaccccactccccctccatcctaggcagtccattctttccaaccaagaccactggaagcagctcaaagcagcatgggttggcctatgctgcatctgaccgtattttaagaggcttttaattctggaatagttctagggtgagttcattgtgtaaattccaatgcaaacactttttgttttcatcatcctcattgtttggtttcctctaactcatgtaatcagttgaaatattaattacaaaaagatggcggggcatatagagctggaagcgatttgctttatccgacaacagaggaggagacgagcctggaggggagagacttgccctagattgccagcccctggtagggctccctgggccctacccttggttcctgggcttctgtcctatttgctgacttgcatttccagtgctgatttccctggaagtggcaaagcactggaatgacccgtgaacttaggaagtgtctgaatagtgtggaagccacggtgggagcttggaccctcttggaaaggaagctggagtggtgagaagccactgtttggctgtgggtgtggggcatggagagggggcagatttctctttcctgctaaggtcattcatcaaggggggactccagggcccctgacctgctggggtgatgggtgacgctgggactctctcaccgcagggctgccttcagattagaaagggaaagggtgctggtaacggcagctcctctgcttagctggagtgacaggcagccatgcaggagggctgcagctggggtcagcccatgcagtgattccctggtggtccttgggcaaatcaaacctccttccccatctacagacagaagggggataggctcagacttgttttacaggcttgttgtagtgataaaataaagtctgtgagagcaacatctgacatatgccagcggagggtgcccagggggcatgtggctcaccctgagcagtggccgtggcacaggctggggtgtctgccgctggggaggcgagagagcagagcggtgctgcagtggctgtcccagctgggggagtaggaacctctgctggaggtggagctgtgtgtccccgtgaactcactgggtgacttttggttcttcgcccagagctccagcatcaccaatgagtgggcctgccctttcttcccaaactctgagacttgggcgaacacttgatcttctgggactctgcttcatcctttgatggagttcgtgcccattgggttggttagagtgaggaataaaaggatcctgtcactaagtgctttgcacagtgagccatcatctgccagtccaatgtggggagaatatgccagggggagatgagggcaggagcctcacgtagggtgtgagccaggcagtggctcagagcaaactgagaaggtccttccagccctggattcatgtctccatggaaacctgctcttgccagagagtccgcccagcccaggcccccctcctccagggctggtgggttcttcagctggagctccagcatcaccgatgagtgggcctgccctttcttcccaaactcagagaactggaatgggtttccttacctgggacctgcagttgactggggaatggaatccaggattctgagtgcagaagtttccagattcagggtaagctgggtgcctggccgcttctatgtgcagggagaacagacccttccctgtccccccatggtgctgaggttgtgtttagtgagaatgtgacgaattgggcactaggtgtgagcagaagcttgtaaataaccagggcctttccagaaggtctatattgatctcagagatgcagtgtttggaggtcccggcatggactcctcaaatgcccccattccctgcatttttttcatactaagctgtgaaggtcagactaagccatgaaggtcagaatctgtgattagtgggtgaatggcctcccttaaatagccatggcccagctaggtatgattctgtctgggtggcagaaagagccttgagtcaggaggccagggatgagtctggcttcaaaacctctgaccccagcctcgtaccctcactctgcctgtctgtttctcggctgtaagctggtgatagcatggccaaggctctgaacccagcttctgccctacttctgtctgcctgattctcccttttccttttcctctccttgtccctctctccatcttccctgccagaagcagggctggctgccctctcagtcagggtgtgcaaggcccccagggaggcgactgtgggtgcatgcatgcatgcgtgtgggggttttatgtggcagtgtctctaagattgggtttggggttcatgagattattttccaaaattagaaagcaaatgtatgtggggaggaaggaggtgctgccagagggcatgtctagctgtctcttttggaaattaaggaagaggaggtctagtttggcccctaaagtcatacttccccttggggctgcagtttttaatctgatatcattaaccaaagtcactgcaaagctcctcccagggctttgatttgaggtgagtgggagccccctgtcttcttgggggttgggtgattgttggatgacatcagagaagcccagtgttccaggtcagagccttactctccctgcaggctccccacctctgtccaccagaggatttcctgtcgcgtctgtttgcttattgcttctcagataagttttcatttgaaacagtggtctgaggctctaaatcatttgaaagtcttctctcccagtgttcagacaattcccctggttctaacatttggtgattctgcaagaagccttcatgctagggcaaacaactctcccactttgcccagcgccgtggggtttctggacatgggacttctagtgctgaaagtcccaggaaaaccaggccaattgttcatcctctcacattctcacttgagtagcttatattttgagccatgcttgtttagagaagggaaagacaccatttagaaagccccttcaatgcctaagtgtcaagaaaaatgggatccatcacctagtcgaatagtaacactggatgagaagggagggaagctggtgcccatatgttttgaaaaagcagcatttactttaactttgaaatctcagagcagtccccaggcaggatgggaagccaatggggccagggctggtgcagctgatgggatctgaagggaaagaagagcttttaaaaaggagaatttcacactgaatctcttaatctgttttacagactcataaaatcttaatatagccccgagactgtcatgtttacagacagtgcagcaaaggcagtggcttggagtgtgaccagagagtttgcagaacaaacgcaccagggaggggcttggatggaaataaccaagcgctctccccgcagggtaaggcaggacagccgggcagcccccgtctggttcccccaactgtgagcagaacgctgggctacaatctaggctgaagcttcagtgtactggcttttagcaaaaagcccccatactgctcctggggcagaggatggtaagatgccaactcctgacacatccatgacagtgtgtgatgcaggtggagctccagtccagtggacacacctgtgatagatttgagaacgcctggaggttggaggttgctgagaacccagtgttgctaagagggtcacaggcactcagaagacagggaggttccggtgggcttcctggagaggggccctgggctgggctccacagcatctgggaaggcagagggcatttctgggggagagggcatgagcaagtacggggaggctggatgggcacagcacaggtgagggcagcagaggcagcacctggagagagggcttttgttgggggaacggtgagagataagctcaccctagtcctggctttggagatgagaagaagaaacaaaaatgaagcaaaatacttgtcactgtagaggagcttacagtccagacgacctgggagaaatgaatttgaaaacaaaggaagatttaggagctgcgcctgtcaatgtcaaggtccagcctgagccatggaaaaagaatagaattggagtaagccctgctggagggcagacgtcttcttctctctgtactccctgcccatcccaggaatctggacactggcgtacttccgtgttaacataacggctttaaaatttttcccgttatgagctttaaagaagtaatttccaaatattggtctttgtggaaaaaatgagaaaagaatcaaggtttccctggtctaagactaaatgtgaaaagtaaagaaaatatagtgagttttttttttttttataaagccaagcttatttaatttggagtatcctttacacagagatgatgctgttcctatatttttatgttcagctggctttctttaatggaatcatggcctgtgaattaaaattaaaagtattggtttctgaaaccctaaaggctgggaactactgttttaatggctgattgtctccatttctaaaatatatatcaatatattttgacatatggacactaggcgtcaggaagacagaagaagctggacagaaagagatcaagatttaactggttatgctgtagaccatggcagatcgtaacagaagacaaagcccttaaaaggtaaacctccttggctctgttccctggaagaggtgggttattatgttgatgggaggtgggtacaaattgggagggatttggatgatgctataagattggaagctacgaaatttttgtgaatgtttatttctttgagctaggcttgggatggggaagactcttctctcctttgttccagacatgagtgagatcagaaagtctcctagacaacaagagctggccccctctgacacttctgtgtcacactccgtctgagctttctctggtcttgcccttttcctagggttagagtccaaaagccaagttgacatgccaacttggagctcatgcctgtgtaggggaggaaaataatttctctctacttttcatagtttttagttgggacagacccctgtaacaaaagacagattaacaagagaaaaacagaagtttaataacaagtataccctcatgcatagatgggaggtactcagaaaaatgaatgaatctcaaagaggtggcttggaattcaggcttaaaaactattgtctatggaaactaagaaacaagggcatggggaaggctggttatgggaagaaaaagcacagtaaacaaagagtaatgtttgtatttgcagatctgagtcagcgccttctccattgataagagtctttagtgatttgagtcctggtacagagagggagacactcttacagatggagatttcaccttttatagatataaatttcccttacacaaaggtagctgccactttgttttcagagcatcttttgtgtctgtagcttctcaaaataataagctcaaaataagtcttaagccaaagaggcatactttggagtagcattttctggtctcctacacctctgccttctagacaatgctccaattcctggaacattggaaagccccatccaaatgaccctgtgttagtctgagttctccagagaaacagaaccaataggttacacacccacatatttaaatgtatatatattatataagaagcatttattataagcactttattataaggaagtggctcacgtagttatagaggttgagatatcctaagatcttcagttggcaaagtggagacccaggagatccaatggtatagttccagtttgagtctgaaggtctgaaaatgaggagatccagtggtgtacattccatccaagtccaagtctaaatccataggtgggagaagaccaacttcccagctagaaggcagtcagacagaggagagagaattc
